United States Patent 8,183,436 (NUCLEOTIDE SEQUENCES AND POLYPEPTIDES ENCODED THEREBY USEFUL FOR MODIFYING PLANT CHARACTERISTICS) - sequence listing, part 3

SEQ ID NO: 2877 - DNA, 1143 bp, Glycine max
  misc_feature (1)..(1143): Ceres cDNA ID no. 16625900
  misc_feature (1)..(1143): Ceres CLONE  ID no. 510803
  misc_feature (1)..(1143): Also known as  Ceres CDNA ID no. 23685644
aattcccccttttggaagatggttccacagtcagtgataacgcaagtctccgattcaagtggcgtgaatgcgatatcaaacgtttcttctggccacggattctacgattggttgttcgaatgtcacgggttctggcacaatgccactctcaacatcccctcgttcctcttcgtcttctacttggcacttcaagccaggcacagcttactcaaactctcccttgcgcgctcctatataatcatttcatataacctttgcctctggctcattactctgctcaatctcgcttggtgctttctccaggcatgggagtgcacgtctgggagaaagttgacatggaacctgttatccttgttcactacttccggaatgctgtttttggaagtgagcttgctggcttttttatttcaaggaaataatgcaggcggcttagatgcaatgaaacgaacttttggtatctcaacgctcgttgttggcttggatatactgttgaaggcaatatatctatttgtatttgggattccattattcgtcgacagcaatgaacatactcatgggaagtggaacttgtgggttgtccacaagctgttgctcactgctgtttatggcttcataatgtttatataccattccggatggaaagaaacgttgcctgcaaaaattgccttttacaagtatgttgcaattatgttcatttttaatgcgattgcgacacttgcttgtggccttgctggaactggtgctgcgtttgctttctggctgtatcgtgtcacggttgtcttctaccatgcattttatcttccttttttgtatacaacattcctagcagacttttttcaggaggaaaatttccatttggaaaatgtgtattattccgagatgaaagatgcaggtttctttgacacggactgggagtgatgatgtatcagctataaattgacattgcctcagtatagtcatcgcagggaaccccgatcaggacatatgtaaataaaataaccatgttagcagatcggaatattattaaaaagatgtttatttttaagcacctcaagtgttataggcatgacgtagtataattcttaattattcagctagatacgagactgaataaaattaacatacgaaaaaaaaaaaaaaaaa

SEQ ID NO: 2878 - protein, 299 aa, Glycine max
  misc_feature: GI Number: 21618098; NR Description: unknown [Arabidopsis thaliana]
  misc_feature: GI Number: 14532472; NR Description: AT5g27210/T21B4_120
MVPQSVITQVSDSSGVNAISNVSSGHGFYDWLFECHGFWHNATLNIPSFLFVFYLALQARHSLLKLSLARSYIIISYNLCLWLITLLNLAWCFLQAWECTSGRKLTWNLLSLFTTSGMLFLEVSLLAFLFQGNNAGGLDAMKRTFGISTLVVGLDILLKAIYLFVFGIPLFVDSNEHTHGKWNLWVVHKLLLTAVYGFIMFIYHSGWKETLPAKIAFYKYVAIMFIFNAIATLACGLAGTGAAFAFWLYRVTVVFYHAFYLPFLYTTFLADFFQEENFHLENVYYSEMKDAGFFDTDWE

SEQ ID NO: 2879 - DNA, 1153 bp, Glycine max
  misc_feature (1)..(1153): Ceres cDNA ID no. 16626058
  misc_feature (1)..(1153): Ceres CLONE  ID no. 1045431
  misc_feature (1)..(1153): Also known as  Ceres CDNA ID no. 23708660
acattcctcaccaaactccaaacacatacacccacacgtacgcacacataacaatgtctcctttcaaaatattcctcttctcagctctccttgcggcggcgtttttagcctccaccgctgatttcaacagcgacgtcaacgtggcttggggaaacggccgtgggaagatactcaacaacggccagcttctcactctcaccttagacaaatcatctggttctggttttcaatccaaaacagagtatttgttcggtaagattgatatgcagattaagcttgttcctggtaactcagcaggcacggtcacaactttctacctgaagtctgaaggatctacttgggatgagattgattttgagttcttgggtaatatgactggagatccttatactctacacactaatgtgtacactcaaggtaaaggtgacaaagagcaacagttccatctctggttcgacccaacagccaatttccacacttactcaatcctctggaaccctcaaagaatcatattaaccgtcgatgacacaccgattagagagtttaaaaactccgagtcgctcggtgttttatttccaaagagcaagccgatgaggatgtacgcaagtttatggaacgcagacgattgggcaactagaggcggtctggttaaaacagattggtccaaggctccattcactgcttcttacaggaacattaagattgatggttgtgctcattccaacggaagatcgtcttgtacctcaacgaaaccaacctctaattggtacactcaagaaatggattcgactagccaagctagactcagatgggttcagaagaattacatgatctataattactgtacggatactaagaggtttccgcagggaatccctagggaatgtgcaacaagatcatagaagctttaagagagatcatatacatttaatctatttatcctccgctgctttctttcgctttatatgtaaagtactctgcttcttctttagttactacttgtgtgttgattctttcgattgtgtgaatcttggtccaataaaagcaaattaaaggtgtgtctatatatacatgttaagagattgtctattgtaaacaaaaatgtgtatgcaaatgataatagttgcccattctttcaaaaaaaaaaaaaaaa

SEQ ID NO: 2880 - protein, 282 aa, Glycine max
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 9758317; NR Description: TCH4 protein [Arabidopsis thaliana] >gi|17386136|gb|AAL38614.1| AT5g57560/MUA2_13 [Arabidopsis thaliana] >gi|15777883|gb|AAL05902.1| AT5g57560/MUA2_13 [Arabidopsis thaliana]
  misc_feature: GI Number: 29500899; NR Description: putative xyloglucan endotransglycosylase [Cucumis sativus] >gi|29500891|emb|CAD87535.1|
  misc_feature: GI Number: 4539299; NR Description: xyloglucan endo-1, 4-beta-D-glucanase (XTR-6) [Arabidopsis thaliana] >gi|7269432|emb|CAB79436.1| xyloglucan endo-1, 4-beta-D-glucanase (XTR-6) [Arabidopsis thaliana] >gi|38605152|sp|Q38910|XT23_ARATH
MSPFKIFLFSALLAAAFLASTADFNSDVNVAWGNGRGKILNNGQLLTLTLDKSSGSGFQSKTEYLFGKIDMQIKLVPGNSAGTVTTFYLKSEGSTWDEIDFEFLGNMTGDPYTLHTNVYTQGKGDKEQQFHLWFDPTANFHTYSILWNPQRIILTVDDTPIREFKNSESLGVLFPKSKPMRMYASLWNADDWATRGGLVKTDWSKAPFTASYRNIKIDGCAHSNGRSSCTSTKPTSNWYTQEMDSTSQARLRWVQKNYMIYNYCTDTKRFPQGIPRECATRS

SEQ ID NO: 2881 - DNA, 1348 bp, Zea mays
  misc_feature (1)..(1348): Ceres cDNA ID no. 16627747
  misc_feature (1)..(1348): Ceres CLONE  ID no. 424925
  misc_feature (1)..(1348): Also known as  Ceres CDNA ID no. 24360939
acagtaaatgagcatgacgattgaccaagaactcctccctcccgtcttcttctctgcccttctataaaacaagagaacagaagagagcggcaagaagaccagctcccgccggccactcgtctagactcgagagcggcacgatgcctccttctctgcaccctccccacctccacatccacaagctcaagcgccgccaccaccccgccgccatggccaagaagggcctggccgccatcctctacaagttccgcgacgtgcaccgcccgccctccgcctcgctgccgccgtcgaccccgtccgcgcactacgcccagcgctgctacccgccgccgctgtccgcgtggccttggccgtcgtgccggcatccgcgcaccagctcgttccgcgggcccaaagacgacgccgccgcggtgttccggaccgtgaacaccgtctacgacacgtcctcgggctcggagcaggtcctccggcgctcctccatcgatgaggcggcgtgcatcgaccggcgcccactgtcgttgctcggagaggccattgcggagcaggtggacgaggaggaggagaaggagacggagctgcgagagacggccgtcgtgcgcggcatgcgttcggagcgactgttcttcgaaccggccggcgcagagttcttgcccaatcagggcgtggcgccggcgagaggcaaggacgaggcggccaccgtggcagtggcagacgtcaagagcgaggaacaagcgacgacagacgcgccgcacgacaaggacgagccgccggcggaggccgtcacggcgaagggcggcgcggtggtggtcacggtggagtccaaggacccgtacggcgacttcagggcgtccatggcggagatggtggcggcgcacgggctgcgcgactgggaggccctggaggagctcctggcgtggtacctcaagctcaacgctaagggtgtccacgctgccatagtcggtgcattcgtcgaccttctcgtgagcatgcagccgcaggcgtcatccccgccgtcgctgccgtcccagtcgccctcgtcgtcgtgcatcaccttcgaggagtgctcctcggcaacctttgacgaggatgactgcaagagctgagctgatctgaggcggagggtgctccgtgttcgccatttctaatccttttttttttgtctcattcagagatagcggtttttgtgaattattttgtgcgcctatggaagaatggaaggtgaggtgaggcctgaatggtgccatggatgtacagttgctaaactacttgatgctgaccatcagaatagattaattgcctagacaactaattgaccatttttatttgctctacaaaaaaaaaaaaaaaa

SEQ ID NO: 2882 - protein, 1348 aa, Zea mays
  misc_feature: GI Number: 34908538; NR Description: P0423B08.18 [Oryza sativa (japonica cultivar-group)] >gi|15290117|dbj|BAB63809.1|
  misc_feature: GI Number: 21618162; NR Description: unknown [Arabidopsis thaliana]
  misc_feature: GI Number: 53769716; NR Description: COG0454: Histone acetyltransferase HPA2 and related acetyltransferases [Kineococcus
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66958848; NR Description: Urease accessory protein UreF [Azotobacter vinelandii AvOP] >gi|66875516|gb|EAM02837.1|
ACAGTAAATGAGCATGACGATTGACCAAGAACTCCTCCCTCCCGTCTTCTTCTCTGCCCTTCTATAAAACAAGAGAACAGAAGAGAGCGGCAAGAAGACCAGCTCCCGCCGGCCACTCGTCTAGACTCGAGAGCGGCACGATGCCTCCTTCTCTGCACCCTCCCCACCTCCACATCCACAAGCTCAAGCGCCGCCACCACCCCGCCGCCATGGCCAAGAAGGGCCTGGCCGCCATCCTCTACAAGTTCCGCGACGTGCACCGCCCGCCCTCCGCCTCGCTGCCGCCGTCGACCCCGTCCGCGCACTACGCCCAGCGCTGCTACCCGCCGCCGCTGTCCGCGTGGCCTTGGCCGTCGTGCCGGCATCCGCGCACCAGCTCGTTCCGCGGGCCCAAAGACGACGCCGCCGCGGTGTTCCGGACCGTGAACACCGTCTACGACACGTCCTCGGGCTCGGAGCAGGTCCTCCGGCGCTCCTCCATCGATGAGGCGGCGTGCATCGACCGGCGCCCACTGTCGTTGCTCGGAGAGGCCATTGCGGAGCAGGTGGACGAGGAGGAGGAGAAGGAGACGGAGCTGCGAGAGACGGCCGTCGTGCGCGGCATGCGTTCGGAGCGACTGTTCTTCGAACCGGCCGGCGCAGAGTTCTTGCCCAATCAGGGCGTGGCGCCGGCGAGAGGCAAGGACGAGGCGGCCACCGTGGCAGTGGCAGACGTCAAGAGCGAGGAACAAGCGACGACAGACGCGCCGCACGACAAGGACGAGCCGCCGGCGGAGGCCGTCACGGCGAAGGGCGGCGCGGTGGTGGTCACGGTGGAGTCCAAGGACCCGTACGGCGACTTCAGGGCGTCCATGGCGGAGATGGTGGCGGCGCACGGGCTGCGCGACTGGGAGGCCCTGGAGGAGCTCCTGGCGTGGTACCTCAAGCTCAACGCTAAGGGTGTCCACGCTGCCATAGTCGGTGCATTCGTCGACCTTCTCGTGAGCATGCAGCCGCAGGCGTCATCCCCGCCGTCGCTGCCGTCCCAGTCGCCCTCGTCGTCGTGCATCACCTTCGAGGAGTGCTCCTCGGCAACCTTTGACGAGGATGACTGCAAGAGCTGAGCTGATCTGAGGCGGAGGGTGCTCCGTGTTCGCCATTTCTAATCCTTTTTTTTTTGTCTCATTCAGAGATAGCGGTTTTTGTGAATTATTTTGTGCGCCTATGGAAGAATGGAAGGTGAGGTGAGGCCTGAATGGTGCCATGGATGTACAGTTGCTAAACTACTTGATGCTGACCATCAGAATAGATTAATTGCCTAGACAACTAATTGACCATTTTTATTTGCTCTACAAAAAAAAAAAAAAAA

SEQ ID NO: 2883 - DNA, 1897 bp, Glycine max
  misc_feature (1)..(1897): Ceres cDNA ID no. 16627749
  misc_feature (1)..(1897): Ceres CLONE  ID no. 524694
  misc_feature (1)..(1897): Also known as  Ceres CDNA ID no. 24402501
aaaaagatagatatgatggaggagatagaccccagaagtggtttctgcagctccaattcaatcttctacagcaagcgtaagcccctcccactccctcccaacaacgccttagacgtcaccaccttcatctcctcccgcgcccaccgcgccaccacagccttcgtcgacgccgccaccgcccgccgcctcacctacacccagctatggcgttccgtggagggcgtggcagcctctctctccgtggacatggggatccgaaagggcaacgtggtcctcattctctcccccaactccatccacttccccgttgtgtgcctggccgtcatgtccctcggcgccatcatcaccaccaccaaccccctcaacaccacccgcgaaatcgccaagcagatcgccgattccaagcctctcctcgccttcacgatctctgatttactccccaaaatcaccgcagctgcaccctctctaccaatcgttctcatggacaacgacggcgccaataataacaataacaataataatatcgtggccactcttgatgagatggcgaagaaggaaccggtggctcagcgcgtgaaagagcgcgtggagcaggacgacacggccacgctgctctactcctccggcaccacggggcccagcaagggcgtggtatcgtcccaccgcaacctcatagcaatggtccagatcgtgctgggtcggttccacatggaggagaacgaaaccttcatatgcacggtccccatgtttcacatatacggcctggtcgccttcgccacggggcttctggcttccggctccaccatcgtcgtgctctccaggttcgagatgcacgacatgctctcctcgatcgagaggttccgcgccacttacctcccgctcgtgccgcccattctggtggccatgctcaacaacgccgccgctatcaagggcaagtacgatatcacgtcgctgcattcggtgctctccggtggggctccgttgagcaaggaggtcatagagggctttgtggccaagtatcccaacgtcaccatccttcagggttatggtttgacggaatccaccggcgttggggcctccaccgactccttggaggagagtcgaaggtacggcacggcggggctcttgtctccggccacccaggctatgatcgtcgatcctgaatccggccaatcgcttccggttaaccgcaccggggagctctggctcaggggtcccaccatcatgaaaggttatttcagtaacgaagaagcaaccacatcaacccttgattcaaaaggatggttaagaacaggggatatttgttacattgacaatgatggattcatatttattgtggatcggttaaaggagctcatcaaatacaagggatatcaggttcctccagcagaactagaggccttgctactgactcatcctgctattttagatgccgctgttatcccgtatccagataaggaagctgggcagcatccaatggcatacgtggtgaggaaggctggaagtagcttatcagaaactcaagttatggattttgttgcaggacaggtggctccgtacaagcggattcgaaaagtggcatttatttcctccatacccaaaaatccatctggcaaaattcttcggaaggatctcatcaaactcgcaacgtctaaactctgaatagatgagctttttcgtaatatattttttctatcggagttggacaagtgaggaaataatctttagctccttttttgctgtaattttctggcttgtttacttttgctgctttcatattatctgttctttgttcaacagtctattgtaatttgtagagaacaaagtgctgtgagtacaccttataggcaataaaattgtctctgtaatttcttttttcaaaaaaaaaaaaaaaaaa

SEQ ID NO: 2884 - protein, 1897 aa, Glycine max
  misc_feature: PFam Name: AMP-binding; PFam Description: AMP-binding enzyme
  misc_feature: GI Number: 36312902; NR Description: 4-coumarate CoA ligase isoform 11 [Arabidopsis thaliana] >gi|26451137|dbj|BAC42672.1| putative 4-coumarate--CoA ligase [Arabidopsis thaliana] >gi|28973569|gb|AAO64109.1| putative 4-coumarate-CoA ligase
  misc_feature: GI Number: 15217956; NR Description: 4-coumarate--CoA ligase family protein / 4-coumaroyl-CoA synthase family protein
  misc_feature: GI Number: 42571563; NR Description: 4-coumarate--CoA ligase family protein / 4-coumaroyl-CoA synthase family protein
  misc_feature: GI Number: 29888141; NR Description: 4-coumarate-CoA
  misc_feature: GI Number: 29888143; NR Description: 4-coumarate-CoA
AAAAAGATAGATATGATGGAGGAGATAGACCCCAGAAGTGGTTTCTGCAGCTCCAATTCAATCTTCTACAGCAAGCGTAAGCCCCTCCCACTCCCTCCCAACAACGCCTTAGACGTCACCACCTTCATCTCCTCCCGCGCCCACCGCGCCACCACAGCCTTCGTCGACGCCGCCACCGCCCGCCGCCTCACCTACACCCAGCTATGGCGTTCCGTGGAGGGCGTGGCAGCCTCTCTCTCCGTGGACATGGGGATCCGAAAGGGCAACGTGGTCCTCATTCTCTCCCCCAACTCCATCCACTTCCCCGTTGTGTGCCTGGCCGTCATGTCCCTCGGCGCCATCATCACCACCACCAACCCCCTCAACACCACCCGCGAAATCGCCAAGCAGATCGCCGATTCCAAGCCTCTCCTCGCCTTCACGATCTCTGATTTACTCCCCAAAATCACCGCAGCTGCACCCTCTCTACCAATCGTTCTCATGGACAACGACGGCGCCAATAATAACAATAACAATAATAATATCGTGGCCACTCTTGATGAGATGGCGAAGAAGGAACCGGTGGCTCAGCGCGTGAAAGAGCGCGTGGAGCAGGACGACACGGCCACGCTGCTCTACTCCTCCGGCACCACGGGGCCCAGCAAGGGCGTGGTATCGTCCCACCGCAACCTCATAGCAATGGTCCAGATCGTGCTGGGTCGGTTCCACATGGAGGAGAACGAAACCTTCATATGCACGGTCCCCATGTTTCACATATACGGCCTGGTCGCCTTCGCCACGGGGCTTCTGGCTTCCGGCTCCACCATCGTCGTGCTCTCCAGGTTCGAGATGCACGACATGCTCTCCTCGATCGAGAGGTTCCGCGCCACTTACCTCCCGCTCGTGCCGCCCATTCTGGTGGCCATGCTCAACAACGCCGCCGCTATCAAGGGCAAGTACGATATCACGTCGCTGCATTCGGTGCTCTCCGGTGGGGCTCCGTTGAGCAAGGAGGTCATAGAGGGCTTTGTGGCCAAGTATCCCAACGTCACCATCCTTCAGGGTTATGGTTTGACGGAATCCACCGGCGTTGGGGCCTCCACCGACTCCTTGGAGGAGAGTCGAAGGTACGGCACGGCGGGGCTCTTGTCTCCGGCCACCCAGGCTATGATCGTCGATCCTGAATCCGGCCAATCGCTTCCGGTTAACCGCACCGGGGAGCTCTGGCTCAGGGGTCCCACCATCATGAAAGGTTATTTCAGTAACGAAGAAGCAACCACATCAACCCTTGATTCAAAAGGATGGTTAAGAACAGGGGATATTTGTTACATTGACAATGATGGATTCATATTTATTGTGGATCGGTTAAAGGAGCTCATCAAATACAAGGGATATCAGGTTCCTCCAGCAGAACTAGAGGCCTTGCTACTGACTCATCCTGCTATTTTAGATGCCGCTGTTATCCCGTATCCAGATAAGGAAGCTGGGCAGCATCCAATGGCATACGTGGTGAGGAAGGCTGGAAGTAGCTTATCAGAAACTCAAGTTATGGATTTTGTTGCAGGACAGGTGGCTCCGTACAAGCGGATTCGAAAAGTGGCATTTATTTCCTCCATACCCAAAAATCCATCTGGCAAAATTCTTCGGAAGGATCTCATCAAACTCGCAACGTCTAAACTCTGAATAGATGAGCTTTTTCGTAATATATTTTTTCTATCGGAGTTGGACAAGTGAGGAAATAATCTTTAGCTCCTTTTTTGCTGTAATTTTCTGGCTTGTTTACTTTTGCTGCTTTCATATTATCTGTTCTTTGTTCAACAGTCTATTGTAATTTGTAGAGAACAAAGTGCTGTGAGTACACCTTATAGGCAATAAAATTGTCTCTGTAATTTCTTTTTTCAAAAAAAAAAAAAAAAAA

SEQ ID NO: 2885 - DNA, 1576 bp, Glycine max
  misc_feature (1)..(1576): Ceres cDNA ID no. 16627750
  misc_feature (1)..(1576): Ceres CLONE  ID no. 542150
  misc_feature (1)..(1576): Also known as  Ceres CDNA ID no. 23691598
atattctctgttccgaacacgacacagtagcataccatcaatcttcccccaaattattcattcctctttttttccccattaacaatattaatcaatccaattaatttccatgaccatgtccataacactcttactccaagccaacccctcccacttgaaatggaaccagttaccttcccttccacgtcgcacaaggcccgaccgtttcactccaatacccgactcgaaacgccgcgtttcaagcgtcaaatgtatctcctcgtcgcggaagccggataacacgtttagtttgcagtccccgtgggaggttctggcgagcacggtgtcgaacacgctgaaggcgctgaagaaaccggccatagctgcggtgttggtggggctgttattaatgtacgatccaacttgcgccttcgcggcatctggagggagaatgggaggaaggtcgttttcttcgtcttcttcttcgtctaggagttattcagtgccgaggacgtcaagctcagggttctctttttcggcgccgtattacgggccttctccgttcggtggggtttatgtgggtcccgccgtgggggtcggagtcggtgctggctcgagtttctttctcatcttagtgggattcctggcttttgttttggtttctggctttctttcggatcgctcagagggtagtgtgctcactgctgccgacaaaaccaccgtgctcaagcttcaggttggattgttggggatgggtcgcacacttcaaagggatctgaataggattgcagaagttgctgatacatcaacttcagaaggtctgcattatgtattgacagagacaaccctagctttgcttcggcatcctgattactgtatctcagcatattcatctgtggacataaagcggggtattgaagatggggagaaacgtttcaatcaactttcaattgaagagcggggcaagtttgatgaagagacactagtcaatgttaataacataaagagacaaagcacaagaagccagagagcgaatgggttcagcaatgaatacatagtgataacaatattggcagctgccgaaggagaacataaacttcctagcatcaatggaagtggagacctgaaggaagctttacagaaacttggatccattccatcgagcagattattggcagttgaggtgttatggacaccacagaatgagaacgatactctctcagaacgtgagttacttgaagattacccacttttacggcctttgtaagttgtgaaggtatgcttgtcattctgcttctagccttctagagctatgaactgaaattgggttgtgattgcacaattaaggatcatctccagtagtactgaaataatatcgttaaaactgatgagattgtcctgctactcaatctgcaaggcaattttcagctgcggctaatgacgttgtatcacttataaaggttcaatattaaatattgatggcattagttgtaaaaattaccagtaggatcaactctaaagaatatgtacaatattatagagaatcattttatcattgaaataggtgttctttctgttcaaaaaaaaaaaaaaaaaa

SEQ ID NO: 2886 - protein, 1576 aa, Glycine max
  misc_feature: GI Number: 46129652; NR Description: COG4371: Predicted
  misc_feature: GI Number: 53765373; NR Description: COG4371: Predicted
  misc_feature: GI Number: 23130343; NR Description: COG4371: Predicted
ATATTCTCTGTTCCGAACACGACACAGTAGCATACCATCAATCTTCCCCCAAATTATTCATTCCTCTTTTTTTCCCCATTAACAATATTAATCAATCCAATTAATTTCCATGACCATGTCCATAACACTCTTACTCCAAGCCAACCCCTCCCACTTGAAATGGAACCAGTTACCTTCCCTTCCACGTCGCACAAGGCCCGACCGTTTCACTCCAATACCCGACTCGAAACGCCGCGTTTCAAGCGTCAAATGTATCTCCTCGTCGCGGAAGCCGGATAACACGTTTAGTTTGCAGTCCCCGTGGGAGGTTCTGGCGAGCACGGTGTCGAACACGCTGAAGGCGCTGAAGAAACCGGCCATAGCTGCGGTGTTGGTGGGGCTGTTATTAATGTACGATCCAACTTGCGCCTTCGCGGCATCTGGAGGGAGAATGGGAGGAAGGTCGTTTTCTTCGTCTTCTTCTTCGTCTAGGAGTTATTCAGTGCCGAGGACGTCAAGCTCAGGGTTCTCTTTTTCGGCGCCGTATTACGGGCCTTCTCCGTTCGGTGGGGTTTATGTGGGTCCCGCCGTGGGGGTCGGAGTCGGTGCTGGCTCGAGTTTCTTTCTCATCTTAGTGGGATTCCTGGCTTTTGTTTTGGTTTCTGGCTTTCTTTCGGATCGCTCAGAGGGTAGTGTGCTCACTGCTGCCGACAAAACCACCGTGCTCAAGCTTCAGGTTGGATTGTTGGGGATGGGTCGCACACTTCAAAGGGATCTGAATAGGATTGCAGAAGTTGCTGATACATCAACTTCAGAAGGTCTGCATTATGTATTGACAGAGACAACCCTAGCTTTGCTTCGGCATCCTGATTACTGTATCTCAGCATATTCATCTGTGGACATAAAGCGGGGTATTGAAGATGGGGAGAAACGTTTCAATCAACTTTCAATTGAAGAGCGGGGCAAGTTTGATGAAGAGACACTAGTCAATGTTAATAACATAAAGAGACAAAGCACAAGAAGCCAGAGAGCGAATGGGTTCAGCAATGAATACATAGTGATAACAATATTGGCAGCTGCCGAAGGAGAACATAAACTTCCTAGCATCAATGGAAGTGGAGACCTGAAGGAAGCTTTACAGAAACTTGGATCCATTCCATCGAGCAGATTATTGGCAGTTGAGGTGTTATGGACACCACAGAATGAGAACGATACTCTCTCAGAACGTGAGTTACTTGAAGATTACCCACTTTTACGGCCTTTGTAAGTTGTGAAGGTATGCTTGTCATTCTGCTTCTAGCCTTCTAGAGCTATGAACTGAAATTGGGTTGTGATTGCACAATTAAGGATCATCTCCAGTAGTACTGAAATAATATCGTTAAAACTGATGAGATTGTCCTGCTACTCAATCTGCAAGGCAATTTTCAGCTGCGGCTAATGACGTTGTATCACTTATAAAGGTTCAATATTAAATATTGATGGCATTAGTTGTAAAAATTACCAGTAGGATCAACTCTAAAGAATATGTACAATATTATAGAGAATCATTTTATCATTGAAATAGGTGTTCTTTCTGTTCAAAAAAAAAAAAAAAAAA

SEQ ID NO: 2887 - DNA, 1042 bp, Zea mays
  misc_feature (1)..(1042): Ceres cDNA ID no. 21572588
  misc_feature (1)..(1042): Ceres CLONE  ID no. 274260
  misc_feature (1)..(1042): Also known as  Ceres CDNA ID no. 24358252
cttggccacctcgtacgcatcggcatcgcgtcgcgcccgccgctctcctctcctgccggcctgtccaacttcaaaagagcacgcgcttccgccccccgccctcctgtaccgctctccttccccgacgatggatcccgcagccatgtcgagatccccgtgctctatcgtctcgccgggctccttattaaccgccccacttctcccagtacgcctcgccgtcaagccacgccgccgagtgcctgcttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggtttccgtttcttctggttgacagagttattgattacaaaccaggagaatatgctgttgcaatcaagaatgtgacaattaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgatcaagctgcagaagagattcggaattgcaaagatggaagggaaagcttacgttggcgccgacctagtatgcgaaggggagttcttgatggctactggatcagaatgaaggcaggagacacatggattgatggatacataatatttcaagtttttactgtgaaatcagctttccagtctaataagttttgaactgtgtctgtaatagcggtgtaatgtcgttgccttgtagtcttagtgagtgttgctgtgttggtgtgtatgagtaacagggctctaaggttaacaaccactgccatggaatggaacaaatggaaactgacagcgcgtttggttgtttttagagcgtttaaaaaaaaaaaaa

SEQ ID NO: 2888 - protein, 219 aa, Zea mays
  misc_feature: PFam Name: FabA; PFam Description: FabA-like domain
  misc_feature: PFam Name: 4HBT; PFam Description: Thioesterase superfamily
  misc_feature: GI Number: 50931539; NR Description: putative beta-hydroxyacyl-ACP dehydratase [Oryza sativa (japonica cultivar-group)] >gi|49328184|gb|AAT58880.1| putative beta-hydroxyacyl-ACP dehydratase [Oryza sativa (japonica
  misc_feature: GI Number: 21928166; NR Description: At2g22230/T26C19.11 [Arabidopsis thaliana] >gi|20198153|gb|AAD23619.2| putative beta-hydroxyacyl-ACP dehydratase [Arabidopsis thaliana] >gi|25090441|gb|AAN72302.1| At2g22230/T26C19.11 [Arabidopsis
  misc_feature: GI Number: 21592599; NR Description: putative
  misc_feature: GI Number: 14334124; NR Description: putative 3-keto-acyl-ACP
  misc_feature: GI Number: 25319393; NR Description: probable
MDPAAMSRSPCSIVSPGSLLTAPLLPVRLAVKPRRRVPAFIAPSGRPSVARRAAAGDKFEAETPIEKSFPPFPTVMDINQIRDILPHRFPFLLVDRVIDYKPGEYAVAIKNVTINDNFFPGHFPERPIMPGVLMVEAMAQVGGIVMLQPEVGGSRENFFFAGIDKVRFRKPVIAGDTLIMRMTLIKLQKRFGIAKMEGKAYVGADLVCEGEFLMATGSE

SEQ ID NO: 2889 - DNA, 1828 bp, Zea mays
  misc_feature (1)..(1828): Ceres cDNA ID no. 21572590
  misc_feature (1)..(1828): Ceres CLONE  ID no. 289334
  misc_feature (1)..(1828): Also known as  Ceres CDNA ID no. 24358258
agccgatgtctctcctctcctcgtgtgttggtggtccgactccaatcccacaacgagacaaacgaggagaatggaaggaagagccgtccgcgaaagcaggcagcgggcagccaccgcacggtgagcacggcgaccccgacaaagcctgaccgccgcccgttccgttccagcacgcgcgcgtttcccggtgcaggggataactagcgccaccacccagaccgcaccgcgcgtcacccatcgcatccaccggtcgttcgtcgtcgccggacacctcgccgccggccgtcgcgcgcgcgtctatgggcggcttcgctatccaccccgcccatggacgccccagcgacagcctgccgtccgccggcaccgggaggtcgacgacgtcctcgtctgcctcctccctcgacgacaacggcgtccgcggccagcaggcccgcacaccgggccacacgctggaggagccgccatcgcggcggcggcaccaggcgggctcgtcgtcccggccggcccggctgttccagaggctgcggcacgcgctgcccctcctgacgctggcgccgcgctgcgggcggatgccgcaggtcggcacgcccgccgagatcgcggcggcggccgcgtcgtcgtccttctccgtctcctcgtcctcctcgtcgtccgcgccgcccgtgcccaggggcgtgaccttctcgggcgcgtcgcggccgtgccgccgcgtgacgggcacgctctacggccaccgcaggggccgcgtcgtgctggcgctgcaggagacgccgcggtgcctgccgagcctcgtcgtcgagctggcgctgcagacgcacgcgctgctgcgcgagctcggcaaccccgcgggcgcgcgcatcgtcctcgaaaccgagcgccgcgcggcactggaggccgccccctcagccgccgccgcccgagacggaggaggcggggcgtcgcgggctaataataagcgcggagtccgcgcgccgccgccgccgctgctggacgagccgtcgtggaccatgttctgcaacggcaagaagaccgggtacgcggtgcgaaggcaggccacggacgacgacctcgctgtgatggagacgctgcgggcggtctccatgggcgccggcgtgctccccgggagggccgccccttcgtcggcgcccgacgcggctgcggcggcggcagcggacgacgaggtgccctacatgcgcggctgcttcgaccacttcgtcgggtcccgggactcggagtcgctgtacatgatcgcgccgcagggcggcggcacgggcccggagctggccgtcttcttcgtcaggctctgacctccgatccgatccgccccgcgccttgcctctagctatctcctcgcccccatgcatgcgaagacggcccaagggcatccattaaccgccacgtacatatacatcgtcagcattcattggatggtgcaacctaaagattgactaacaagaaagagttaagaatcaaagagagagtcgcccaatctttgatcgtgcaacgacctcaagattgactaataaggtcttctggttaaattttttttggctgattcgttattaggttgttgtatacgaggtgttcttggatttgtgccctatgcagcattgcaccatctatcattagtcagacattcatcagagtacataagagagtagtcactggacggtggaactgtggtccaaaagttgtttacttcagaatgtttttttcccattgtgagatattctttcagtcttataatagtagtcgttttagctattgtttttagggtcccttgtttttaatatctatatttaaacagatgataaaaaaaaaaaaaaaa

SEQ ID NO: 2890 - protein, 335 aa, Zea mays
  misc_feature: GI Number: 21618123; NR Description: unknown [Arabidopsis thaliana]
  misc_feature: GI Number: 21593037; NR Description: unknown [Arabidopsis thaliana]
  misc_feature: GI Number: 34911646; NR Description: P0039G05.26 [Oryza sativa (japonica cultivar-group)] >gi|20161546|dbj|BAB90468.1| P0510C12.13 [Oryza sativa (japonica cultivar-group)] >gi|20805135|dbj|BAB92806.1| P0039G05.26 [Oryza sativa (japonica
  misc_feature: GI Number: 21592736; NR Description: unknown [Arabidopsis thaliana]
  misc_feature: GI Number: 5821151; NR Description: RNA binding protein [Homo
MGGFAIHPAHGRPSDSLPSAGTGRSTTSSSASSLDDNGVRGQQARTPGHTLEEPPSRRRHQAGSSSRPARLFQRLRHALPLLTLAPRCGRMPQVGTPAEIAAAAASSSFSVSSSSSSSAPPVPRGVTFSGASRPCRRVTGTLYGHRRGRVVLALQETPRCLPSLVVELALQTHALLRELGNPAGARIVLETERRAALEAAPSAAAARDGGGGASRANNKRGVRAPPPPLLDEPSWTMFCNGKKTGYAVRRQATDDDLAVMETLRAVSMGAGVLPGRAAPSSAPDAAAAAAADDEVPYMRGCFDHFVGSRDSESLYMIAPQGGGTGPELAVFFVRL

SEQ ID NO: 2891 - DNA, 1252 bp, Zea mays
  misc_feature (1)..(1252): Ceres cDNA ID no. 21572591
  misc_feature (1)..(1252): Ceres CLONE  ID no. 313608
  misc_feature (1)..(1252): Also known as  Ceres CDNA ID no. 0
atcacgaaacggaacggcaaaccaaatccatgactgaacaactgaaccgggagtacgacatcggcgacgagatcggccgcgggcgtttcggcgtggtccggcgctgtgtctcccgcgccacgggtgacgccttcgccgtgaagtccgtggaccggtccctcctcggcgacgacctggaccgcgcgctggcggagctggagccgaagctggcgcggctcgcggggggcgagggcgacgggaacccgggcgtcttgcaggtgcgcgccgtctacgaggacgacgcctggacgcacacggtcatggacctctgcacggggcccgacctgctggactggatccgcctccggcgcggcgcgcccgtgcccgagcccgacgccgcgcgcgtcgtcgcgcagctggccgaggcgctcgcgggctgccaccgccgcggcgtcgtccaccgcgacgtcaagcccgacaacgtgctcctggacgtggaccccgccggcgaggcgcccccgcgggtccggctcgcggacttcggctccgccgcgtggctcggcgagggcgcgcggggccgcgccgaggggctcgtgggcaccccgcactacgtcgcgcccgaggtggtggccggcggcgagtacggcgagaaggtggacgtctggagcgccggggtggtgatgtacgcgctgctctccggcggcgcgctgcccttcggcggcgagacggccgcggacgtgttcgcggccgtgctgcgcggcagcctcaggttcccgcccgctctgttcgccggggtctcgccggcggcgaaggatctgatgcggcggatgatgtgccgcgacgtctcgcgaaggttctccgccgagcaagtcctcaggcacccgtggatccagagcggaggcggaggccgagagctggtgcggccaacctgagcagccatatatcgaacgagacctgaaccgatcgagtatcatcgtagcagtccggtgggtgtgtactcccccgatgagtgttgtgcagacgtctctgtatatccagtaagcaggcggcggcggcggcggcgagtgtgagactggagatcgtcgtttcgccgcacttcgcccgtgtgtttgtgtgacagtgacctgggccgttttcctcttttgccttgtgggccttttttcgggccgccctctttgcttgggagttaaacgtcgtgcgacgatgatctgttatgtccaaccgtccatgtacaaatgaagtttgagctttctcgtaaaaaaaaaaaaaaaaa

SEQ ID NO: 2892 - protein, 293 aa, Zea mays
MTEQLNREYDIGDEIGRGRFGVVRRCVSRATGDAFAVKSVDRSLLGDDLDRALAELEPKLARLAGGEGDGNPGVLQVRAVYEDDAWTHTVMDLCTGPDLLDWIRLRRGAPVPEPDAARVVAQLAEALAGCHRRGVVHRDVKPDNVLLDVDPAGEAPPRVRLADFGSAAWLGEGARGRAEGLVGTPHYVAPEVVAGGEYGEKVDVWSAGVVMYALLSGGALPFGGETAADVFAAVLRGSLRFPPALFAGVSPAAKDLMRRMMCRDVSRRFSAEQVLRHPWIQSGGGGRELVRPT

SEQ ID NO: 2893 - DNA, 1399 bp, Zea mays
  misc_feature (1)..(1399): Ceres cDNA ID no. 21572592
  misc_feature (1)..(1399): Ceres CLONE  ID no. 325247
  misc_feature (1)..(1399): Also known as  Ceres CDNA ID no. 24358274
atcacactcacagtcgcagctcagccagagcacaaacagttgcagtattagtgcatcaccaccagcggggcgagctagaaacagagagagcctgccctgctcgaatggcgttcaagaaagcggccatcggactctcttcccttctcctcatccttgtcctcctccttgtcgcgcccagcgctacggcggcgagaccgacgcgccagttgacttccgacgacgacgacgacggcactggtgctgcggcgcccgctgccgcaccggccatagcgcaccctgctgctgacgcaccggtcactgccgatgccagtccacctgtggtaggaggcgccggtgtggtggcggcgcccggaggcgccgtggcagctgacgcaccggtcgctgccaatgccatccccgctgctgctgcggcagctccggtcgcagccagcaccatccctgtgggggccggggccggggccgcgggagcgggtgcagcgggcggcggcgctgacggccacgggatggtcttcttcatgcacgacatcctcgggggcacgaacccgtcggcgcgcatcgtggccggcatcgtggacaacgccgcggtcaccgggcagctgcccttcgcgcggcccaacggcgccgtgctgccgctcaacagcggcgtgaacgtcaactccggcgcggcgggcgccatcgacaacaacaacatccccttcctcacgggcctgggcggcgccaccaacgccgccaagtccgtcggcagcaacggcaacgggaacgggaacggcgtgccggtcttcgccggaggcagcctcccgcagggcaccacgctgcagaagctcctcttcgggaccatgaccgtggtggacgacgagctgacggaggcgccggagctggggtccgccgcggtgggccgcgcgcagggcttctacatcgccagctcggaggagggcgtcagccagacggtggcggtgaccgccatgttcaaggaaggcgggttcgacgacaccgtcagcttcttcggcgtgcaccgcaccgcggactcggagtcgcacctcgccgtcgtcggcggcacggggaagtacgtcggtgcgaagggcttcgccaaggtggccgtggtgaggcccggaggggtggcggcgtccggcgcgctgctcgagaccgacggcgtcgagtccgtactccagttcaccgtgttcctcgtgtaatgtatgagcctgtgtgtgtgcgcgcatgtacgacgacgacgactgcgggtgatgctgttcaaggagcggcaagtgcgtgcaacttaggttgatgtgttgtgtgatgcagcaatgagttgcatgcaaaagttgatgtattactagctgctgttgctactactacttgttacataatacggatacatgttttcacaaaaaaaaaaaaaaaa

SEQ ID NO: 2894 - protein, 361 aa, Zea mays
  misc_feature: PFam Name: Dirigent; PFam Description: Dirigent-like protein
  misc_feature: PFam Name: Peptidase_S8; PFam Description: Subtilase family
  misc_feature: GI Number: 34895944; NR Description: P0011G08.13 [Oryza sativa (japonica cultivar-group)] >gi|15528621|dbj|BAB64642.1|
  misc_feature: GI Number: 53749146; NR Description: At2g28670 [Arabidopsis thaliana] >gi|4580390|gb|AAD24368.1| putative disease resistance response protein [Arabidopsis thaliana] >gi|27754517|gb|AAO22706.1| putative fibroin protein [Arabidopsis
  misc_feature: GI Number: 38454170; NR Description: At2g39430 [Arabidopsis thaliana] >gi|3355472|gb|AAC27834.1| putative disease resistance response protein [Arabidopsis thaliana] >gi|44022160|gb|AAS46642.1| At2g39430 [Arabidopsis thaliana]
  misc_feature: GI Number: 7019656; NR Description: disease resistance response/ dirigent-like protein [Arabidopsis thaliana] >gi|11282368|pir||T47662 disease resistance response/ dirigent-like protein - Arabidopsis thaliana
  misc_feature: GI Number: 27497202; NR Description: Putative disease resistance response protein [Oryza sativa (japonica
MAFKKAAIGLSSLLLILVLLLVAPSATAARPTRQLTSDDDDDGTGAAAPAAAPAIAHPAADAPVTADASPPVVGGAGVVAAPGGAVAADAPVAANAIPAAAAAAPVAASTIPVGAGAGAAGAGAAGGGADGHGMVFFMHDILGGTNPSARIVAGIVDNAAVTGQLPFARPNGAVLPLNSGVNVNSGAAGAIDNNNIPFLTGLGGATNAAKSVGSNGNGNGNGVPVFAGGSLPQGTTLQKLLFGTMTVVDDELTEAPELGSAAVGRAQGFYIASSEEGVSQTVAVTAMFKEGGFDDTVSFFGVHRTADSESHLAVVGGTGKYVGAKGFAKVAVVRPGGVAASGALLETDGVESVLQFTVFLV

SEQ ID NO: 2895 - DNA, 751 bp, Zea mays
  misc_feature (1)..(751): Ceres cDNA ID no. 21572593
  misc_feature (1)..(751): Ceres CLONE  ID no. 373727
  misc_feature (1)..(751): Also known as  Ceres CDNA ID no. 23795046
gattacacagaattccctcccaatcggcggcgccacgatgcgcctccgcagccgggcaatctttcccctcgtccgcaccaccgccaccaccacatcggccgcgtcttcgtcgccggcggtgctgagcatcggccacgcgctgcgcgagcgccggctgttcacgggggacgacgtggcggcgtacgcggcgatcagcggtgaccgcaacccggtgcacctcgacgacgccgtcgcccgggagctgagcgggttccagcgaggccgcgtggtgcacggcatgctcgtggcgtccctcttcccttccatcatcgctgccacctggcgctgtgtacgcgagccagacgctcaagtttgcggcgccggtgtacgtcggggatgaggtggttgctcgagtccaggcactcaacatcaggacggcggcggcgacgaacagctgcacggcaagacgatatgtcgtcaagttcgcaaccaaatgcttcatggacgaagaggaaggctctgttgcgattgaaggcgaagcaatggctgtcctgcctacactggagctcagctctcagtcgactagaaactaggagtggcctcaaaccgggtgactagtcacaagttgctgttgcttaatcatacccgacctggtaatccctctcttctggaacactgtgtagaatgcgtgtaaactaaacttagtgtagcctttacattataagcgaggagtgaaataaagctgttgtttatgacaaaaaaaaaaaaaaaa

SEQ ID NO: 2896 - protein, 751 aa, Zea mays
  misc_feature: PFam Name: MaoC_dehydratas; PFam Description: MaoC like domain
  misc_feature: GI Number: 15239296; NR Description: maoC-like dehydratase
  misc_feature: GI Number: 62359342; NR Description: maoC-like dehydratase,
  misc_feature: GI Number: 50442693; NR Description: enoyl-CoA hydratase [Aeromonas hydrophila] >gi|50442676|gb|AAT77259.1| enoyl-CoA hydratase [Aeromonas hydrophila] >gi|20372710|gb|AAM19086.1| enoyl-CoA hydrotase [Aeromonas hydrophila]
  misc_feature: GI Number: 16124957; NR Description: MaoC family protein [Caulobacter crescentus CB15] >gi|25327487|pir||E87336 MaoC family protein [imported] - Caulobacter crescentus >gi|13421927|gb|AAK22689.1| MaoC family protein [Caulobacter
  misc_feature: GI Number: 28948377; NR Description: Chain B, (R)-Hydratase From A. Caviae Involved In Pha Biosynthesis >gi|28948376|pdb|1IQ6|A Chain A, (R)-Hydratase From A. Caviae Involved In Pha Biosynthesis
GATTACACAGAATTCCCTCCCAATCGGCGGCGCCACGATGCGCCTCCGCAGCCGGGCAATCTTTCCCCTCGTCCGCACCACCGCCACCACCACATCGGCCGCGTCTTCGTCGCCGGCGGTGCTGAGCATCGGCCACGCGCTGCGCGAGCGCCGGCTGTTCACGGGGGACGACGTGGCGGCGTACGCGGCGATCAGCGGTGACCGCAACCCGGTGCACCTCGACGACGCCGTCGCCCGGGAGCTGAGCGGGTTCCAGCGAGGCCGCGTGGTGCACGGCATGCTCGTGGCGTCCCTCTTCCCTTCCATCATCGCTGCCACCTGGCGCTGTGTACGCGAGCCAGACGCTCAAGTTTGCGGCGCCGGTGTACGTCGGGGATGAGGTGGTTGCTCGAGTCCAGGCACTCAACATCAGGACGGCGGCGGCGACGAACAGCTGCACGGCAAGACGATATGTCGTCAAGTTCGCAACCAAATGCTTCATGGACGAAGAGGAAGGCTCTGTTGCGATTGAAGGCGAAGCAATGGCTGTCCTGCCTACACTGGAGCTCAGCTCTCAGTCGACTAGAAACTAGGAGTGGCCTCAAACCGGGTGACTAGTCACAAGTTGCTGTTGCTTAATCATACCCGACCTGGTAATCCCTCTCTTCTGGAACACTGTGTAGAATGCGTGTAAACTAAACTTAGTGTAGCCTTTACATTATAAGCGAGGAGTGAAATAAAGCTGTTGTTTATGACAAAAAAAAAAAAAAAA

SEQ ID NO: 2897 - DNA, 1557 bp, Zea mays
  misc_feature (1)..(1557): Ceres cDNA ID no. 21572594
  misc_feature (1)..(1557): Ceres CLONE  ID no. 386465
  misc_feature (1)..(1557): Also known as  Ceres CDNA ID no. 24372007
gagagtagtcatgtgcgagtgtgccccggcgcagtcctaacggtacgtaggtctctccacggtggtttagtgaagttaagaacaccgccatggtgacaggccgggtcaaggcggccatgggcttccagcgcagccccaagtcgcaggtgccggaggcggcgtctccttctcgggcgcctacgtcggggcccgtgtccaccgccgggtcggcgccgtccaaggcgtcggcgctcgcgcggtccttcggcgcgtacttcccgcgctcttcggcgcaggtgcgccccgccgcccgcgcgccgccgcaggtcgccgagctgctgcgcgccatcgagcagctccaggagcgggagtcgcgcctccgcgtggagctgctggagcagaagatactcaaggagaccgtcgccatcgtcccgttcctggaggccgagctcgcggccaagaaggccgagctgcagaggtgcagggacaccgcggagcggctggaggccgagaacgggcggctgtgcgccgagctcgacgccgccgcgctggaggtcacgagcaggaagcagaggatcgtcgagctggagaaggagatggcggagctgaggacgcggcaggacgcggcagcggacgccgacgactgctcctcgtccgcttcggcgccgagcgagcgtctcgagagctccagcgctgcgccaaagccaaaccgcgcgagtttagctcagcttgatcctccagcgccgccagcgcctttgaagtccaagtcctacttctccgcgagctcgtcgcacccttcgcccgcaagctcgtcgccgccgccctcgccgtcttcctccacgtcgacctcgtcttcgccagcgcactcccgctcgtcgtcggacacggcagcagctccaagggcccgcgtggtagagctctcaaagctcccgcccatacctcctccgccgccgccttgccctcctccgccacctcccagcaggagcaagagatcctctcccccgagctcagccagcgtggacggaagcgcagccgcggctccgcctcccccgccgccgccgccgccgccgcctccccctccggcaaggaggcagttcggcgccgcgccagcaccgcctgcaggggcatcgtcggggcagggcgacgtgaggcgcgtgcccgaggtggtggagttctaccactcgttaatgcggcgggagtccaagagggacggcagcgccacagcaagtgaggccgcgaacggaggcggcggcggcgcggcggcgacgcgcgacatgatcggagagatcgataaccggtcggcgcatctcctcgcggtgcgtacagctgaagcatccatccatccgtaatcacctcgttctcgttttccgaaccgtgaccaccgccgccggtacgcagctactacgcgcgttaggtcgggtagataggcgtcctcttcagctgctagcctgctaaccactgtccgaatggaacgacccgaagaacgcttcgtgtaggttggttggttggtttggtgacgcacagtcgtggaacagtggaggcgtcgttctccgtcgtcaaaaaaaaaaaaaaaaaaaa

SEQ ID NO: 2898 - protein, 412 aa, Zea mays
  misc_feature: PFam Name: FH2; PFam Description: Formin Homology 2 Domain
  misc_feature: PFam Name: Drf_FH1; PFam Description: Formin Homology Region 1
  misc_feature: PFam Name: Extensin_2; PFam Description: Extensin-like region
  misc_feature: PFam Name: Transformer; PFam Description: Fruit fly
  misc_feature: PFam Name: TT_ORF2; PFam Description: TT viral ORF2
  misc_feature: GI Number: 34911862; NR Description: pherophorin - like protein [Oryza sativa (japonica cultivar-group)] >gi|19571144|dbj|BAB86567.1| pherophorin - like protein [Oryza
  misc_feature: GI Number: 55297080; NR Description: pherophorin-like protein
  misc_feature: GI Number: 22135814; NR Description: AT4g18560/F28J12_220 [Arabidopsis thaliana] >gi|28416477|gb|AAO42769.1| At4g18560/F28J12_220 [Arabidopsis thaliana] >gi|30684447|ref|NP_193591.2| proline-rich family protein
  misc_feature: GI Number: 34872074; NR Description: similar to Ser/Arg-related nuclear matrix protein; plenty-of-prolines-101;
  misc_feature: GI Number: 28972153; NR Description: mKIAA0324 protein [Mus
MVTGRVKAAMGFQRSPKSQVPEAASPSRAPTSGPVSTAGSAPSKASALARSFGAYFPRSSAQVRPAARAPPQVAELLRAIEQLQERESRLRVELLEQKILKETVAIVPFLEAELAAKKAELQRCRDTAERLEAENGRLCAELDAAALEVTSRKQRIVELEKEMAELRTRQDAAADADDCSSSASAPSERLESSSAAPKPNRASLAQLDPPAPPAPLKSKSYFSASSSHPSPASSSPPPSPSSSTSTSSSPAHSRSSSDTAAAPRARVVELSKLPPIPPPPPPCPPPPPPSRSKRSSPPSSASVDGSAAAAPPPPPPPPPPPPPPARRQFGAAPAPPAGASSGQGDVRRVPEVVEFYHSLMRRESKRDGSATASEAANGGGGGAAATRDMIGEIDNRSAHLLAVRTAEASIHP

SEQ ID NO: 2899 - DNA, 715 bp, Zea mays
  misc_feature (1)..(715): Ceres cDNA ID no. 21572595
  misc_feature (1)..(715): Ceres CLONE  ID no. 394675
  misc_feature (1)..(715): Also known as  Ceres CDNA ID no. 24358302
gcgattaaggaaataagggggaaaaggaggaaggtccaagcggcggcagcagcaaaaacccgctccgaaaggcagaaccacaataaacaaggcacgcaacgaatccgatcccgatttaattcgcccaaatccgtcgattaatccccacgccggccgcgtcatgctccggccattcctctcccctcccctcaccgctctgccgcccccccctgcctccaccgcagcagccgcgggcgccgcggcgatgcgacccgcatcctcctcctcctcctcccgctcctcggccggcggaggcggggcccaccaccaccaacacaaccacggcggccacagcatctccgtctctccgccggccgaggagcgggaggaggaggaggaggacggcattggcaaggggagggccggcgatggtcaggacgacgaggtggaaagccatggccacgaggatgagtagctagctgcattgcattgcatgcatggcgccatggatgcgacgaccacaggacatacgatgcgagctgggcgccatctgtttaatttgttcgttcgttctttctttcttcttgctactaaatcagagtactactagcttttatcactaccttttgttattagctaccacctgcatgcatctgctgctgcttctagctagctgttattatgtatactactatatatgatatgatgatactactgcaaaaaaaaaaaaaaaaaa

SEQ ID NO: 2900 - protein, 97 aa, Zea mays
MLRPFLSPPLTALPPPPASTAAAAGAAAMRPASSSSSSRSSAGGGGAHHHQHNHGGHSISVSPPAEEREEEEEDGIGKGRAGDGQDDEVESHGHEDE

SEQ ID NO: 2901 - DNA, 1785 bp, Zea mays
  misc_feature (1)..(1785): Ceres cDNA ID no. 21572596
  misc_feature (1)..(1785): Ceres CLONE  ID no. 399080
  misc_feature (1)..(1785): Also known as  Ceres CDNA ID no. 0
agttctgcacttctgcttgctccccacgcggccacgccgaacgggaatccggctcatcagcccctgcaccagcatcagcatcagcgccgccgccgccgccgccctcctcgcgctcttcacagtcctcccgcccttcccgcgcctggtctcccctcgcgttcccgatgtcatcttccaccgcactcgcgtggcgacgcaccctccgcaacgccctacttcgcggcttcccgcggcgcggcgcggcgcccgagcggtacgccagcacggcctccgcgtccggcgcggccgccgatgctgcagctgcagccgcgccgaagaaggtgcccccgtcaccccgcaagggaaggcttttaactggggccatgatagcgttggccattggtggaggtgcttatgtgagtactacagatgaaggaaagttttgcggatggttattcaagtcaacagaacttgtgaacccactctttgcactgttggatgcagagtttgctcatagtttagctgttaaagcggctgcccatggatttgttccaagagaaaagagacctgatccatcagttcttggggttgaggtttggggaaggaagttttcaaacccaatcggtcttgctgctggctttgataaaaatgctgaggcagttgaaggtctcttaggcctgggatttggctttgtggaagttggctctgtgacacctcttcctcaagagggaaatcccaagcctcgaattttcagattaaaggagcatggtgctgtaatcaaccgatgcggattcaacagtgaaggaattgtagttgttgctaagcgtcttggggcacaacatggcaagaggaagatggaagaaacttcaagctccacgcttccctcaaccagcgacataaagcaaggaggaaaagcaggacctggaatcttgggagtcaatcttggcaagaacaagactagtgaagatgctgctgctgattatgtgcaaggggttcatacattgtcacaatatgctgattacttggtcataaatatttcttccccaaatactcctggtcttcgcaaattacaaggtagaaaacaactgaaagatcttgtgaagaaggtgcaagctgcacgggatgagatgcagtgggctgaagatggacctccaccattgctcgtgaagattgcaccagacttgtctaagcaggatcttgaggatattgctgcggttgctcttgctcttaggttggatggcctgattatatcaaacaccacagtttccagaccatcacctgcagataaacatccattggctcaggaaactggtggattaagtgggaagcctttgttggacttatctactaacattctcagggacatgtatatgcttacacggggcaagattcccctcataggctgtggtggcgtgagtagcggtgaggatgcatacaagaagatccgttccggagctacacttgttcaactttatactgctcttgcatatggtggtccagctcttatacccagaataaaggctgagctagcagaatgtttggaaagagacggtttcaaatctgtgcaggaagcagtcggcgctgatttccgatgatccctggcggatcgctgagaaggtctgaataaccgttccgttaaagttcatgtgattttgatgagaagcaagcaactttttttttgtgtgtgggcacgatgcttgccaattccatttgaccggtacttgaaaagaaataccgggttgaaactttgctgggggtgagttgagtaatgagcggctgtatcacgcgcgcgaaaaaaaaaaaaaa

SEQ ID NO: 2902 - protein, 469 aa, Zea mays
MSSSTALAWRRTLRNALLRGFPRRGAAPERYASTASASGAAADAAAAAAPKKVPPSPRKGRLLTGAMIALAIGGGAYVSTTDEGKFCGWLFKSTELVNPLFALLDAEFAHSLAVKAAAHGFVPREKRPDPSVLGVEVWGRKFSNPIGLAAGFDKNAEAVEGLLGLGFGFVEVGSVTPLPQEGNPKPRIFRLKEHGAVINRCGFNSEGIVVVAKRLGAQHGKRKMEETSSSTLPSTSDIKQGGKAGPGILGVNLGKNKTSEDAAADYVQGVHTLSQYADYLVINISSPNTPGLRKLQGRKQLKDLVKKVQAARDEMQWAEDGPPPLLVKIAPDLSKQDLEDIAAVALALRLDGLIISNTTVSRPSPADKHPLAQETGGLSGKPLLDLSTNILRDMYMLTRGKIPLIGCGGVSSGEDAYKKIRSGATLVQLYTALAYGGPALIPRIKAELAECLERDGFKSVQEAVGADFR

SEQ ID NO: 2903 - DNA, 1138 bp, Zea mays
  misc_feature (1)..(1138): Ceres cDNA ID no. 21572597
  misc_feature (1)..(1138): Ceres CLONE  ID no. 406768
  misc_feature (1)..(1138): Also known as  Ceres CDNA ID no. 24358281
atttaggtagagtagtggacaaccaagcccaaggccaaagctattgcttgctcagcctctctgcactgcactgcagggcgagggtcacacacacacacacacacacagggtgtggtggatgatgaggcaacggcaaactggcagcagcaagtactactagcgcttgctaaaggccaggagcccaggacccggaggtgctcgctgtcgctgatcaaccgcgcgccgtcgcaggcagcacagcaaccagcaacagctaggcaggtagtagtagtatacatgagcaggttcgcggggcagacgtccaccaggccgtgggtggggatggcgggctctggcgccaccgcgtccgagcctgccgccgccgacgtcgcgagggacgacgccacggcggccatgaggggcgccggcgccggcgccggcaccaacgccagcgccatctccttcggcttcgcggccacggcggtcctcgtctccatgttcctcctcatggccatcttcgagcacctcatcaagcccggcctggcttcctcctcctcccgcggcgcatcgggctcccatgaagacgccgccgacgacgatggcgaaggccgcggccaccgccaccgcatggggggatcacccccggctcgactgcgcgagcgcgacgacgcggcgccggacaagctctgtcacctgccaaaggtggaggccgtggtggacttgacggtgctgatgccggggcagcggtacccgacgttcctggcgcagccggcgccgctcgcgccgtgccccagggaaggcgtgctatggccttcgcaccaccgtcgccgctcgtttgtgccaccgtgatctttttttttcccaccacatcgttctgtacagaggttattgtaaaaggcagcgccctggcttattcgaggcttctctatatactaggtggtgccagtgcgttgcgacggaaccatataataacttatgtacatatatgtgagtgcccatgcgttgcaacgaggatatataatatcacggtaacttatatattatatgtctccgttgcaacgcacggacactcatctagtaaggtactatactatatttagaacccaaaataatgaacactataatcgttagatgattttttagaaaaaaaaaaaaaaaa

SEQ ID NO: 2904 - protein, 183 aa, Zea mays
  misc_feature: PFam Name: Cation_efflux; PFam Description: Cation efflux family
  misc_feature: PFam Name: Lipoprotein_5; PFam Description: Transferrin
  misc_feature: PFam Name: Extensin_2; PFam Description: Extensin-like region
  misc_feature: GI Number: 34907352; NR Description: P0471B04.10 [Oryza sativa (japonica cultivar-group)] >gi|21952785|dbj|BAC06201.1| P0018C10.2 [Oryza sativa (japonica cultivar-group)] >gi|22202668|dbj|BAC07326.1| P0471B04.10 [Oryza sativa (japonica
MSRFAGQTSTRPWVGMAGSGATASEPAAADVARDDATAAMRGAGAGAGTNASAISFGFAATAVLVSMFLLMAIFEHLIKPGLASSSSRGASGSHEDAADDDGEGRGHRHRMGGSPPARLRERDDAAPDKLCHLPKVEAVVDLTVLMPGQRYPTFLAQPAPLAPCPREGVLWPSHHRRRSFVPP

SEQ ID NO: 2905 - DNA, 1443 bp, Zea mays
  misc_feature (1)..(1443): Ceres cDNA ID no. 21572598
  misc_feature (1)..(1443): Ceres CLONE  ID no. 425337
  misc_feature (1)..(1443): Also known as  Ceres CDNA ID no. 24358293
attcttcctcgccgctgccagatgctccgccgcagcctccccgaggccgggtccttcttccgccggctccttggccgcgtctcgaacgagggcgggcttgctgccggctcctccgcgtctgtccgacatttcgtcgaacagcttgtaggcggcacggccccgatctcccgcgtcccctccgccctcgccgtcgcctccgcggagcgtgggaccggaggaagcaacggcgcttccttgacggtccacttccttcgccactcctgcggcctcgaagaagccgacgccgcgaaggcggccgagcgcgtgcacctccgctccaccaagaacgcgcacgccgtggtcgcgctcctccgcgacacgctcggcatgccccccgcctccgtcgcgcgtctcgtctccgcgtaccccgcggtcctttcctcggtcacactcggcgctaagttgaacttctacctccgcgagctcggcctctcctccgccgagttgcgccgcttcctcctcgcgagcccccaccgcttcctcctcgcggggatcgagactcgcctgcgccccaacctcagcctcctcaaggaccttctcggcaccgaagagaacgtgctcgccgccgtcaagcagtccatggagctcatctacgacaacctcgagatcgtcctgcttcccaagctccaggtgctccgcgaacacggcgtcactgaggaggttctcgtcaagctcctcaccacccaccccagggctcttgtgcacaggtctacccgctttgatgagggcttgaccgccatgaaggacctcggggtgagtccaaagtctggcgccttcccctacgcctttggggtgttcgccagaatgtaccagtccaaatgggatcgcagggtggagaattatgtcagtctggggtggaccgaggagcaggtcaggcgggcatttgtcaggcacccctacttcatgacggtgtccgaggacaaggtcaagaaacgcatgcagttcattgctgaaaagcttggctggaaccctgatgttctgtcgtcgtacccgactattctttccttcagccacgagaagcgggtactgccgaggtacagggtgcttcatatactggcgtcccgtggtgtcatcaaaaaaggcatcaggatgagccatctgacaatgccggaaaagaagttcaaggaaaggtacgttgataagcaccaggaagagattcctcaagtactggaagcttatggagcaagaacagaggcatgatgattctgcctcaactgatcaactctacattggaacaaaggcactgtatcccttgtcctcagcggtttgattctgttgggtgcttttctttctgttttttttaggatgcaaagaactcggattcacaaactttgttggcttcactgctgattttttttaataattaggcatttcagtggtaactatacaaaaaaaaaaaaaaaa

SEQ ID NO: 2906 - protein, 1443 aa, Zea mays
  misc_feature: PFam Name: mTERF; PFam Description: mTERF
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: GI Number: 50912803; NR Description: mitochondrial transcription termination factor-like [Oryza sativa (japonica cultivar-group)] >gi|46390202|dbj|BAD15633.1| mitochondrial transcription termination factor-like [Oryza sativa (japonica
  misc_feature: GI Number: 62732922; NR Description: mTERF, putative [Oryza
  misc_feature: GI Number: 51536066; NR Description: mitochondrial transcription termination factor-like [Oryza sativa (japonica
  misc_feature: GI Number: 51536072; NR Description: mitochondrial transcription termination factor-like [Oryza sativa (japonica cultivar-group)] >gi|51535002|dbj|BAD37286.1| mitochondrial transcription termination factor-like [Oryza sativa (japonica
  misc_feature: GI Number: 3367528; NR Description: Strong similarity to gi|2160138 F19K23.6 gene product from A. thaliana BAC gb|AC000375. [Arabidopsis thaliana] >gi|15220664|ref|NP_176389.1| mitochondrial transcription termination factor-related /
ATTCTTCCTCGCCGCTGCCAGATGCTCCGCCGCAGCCTCCCCGAGGCCGGGTCCTTCTTCCGCCGGCTCCTTGGCCGCGTCTCGAACGAGGGCGGGCTTGCTGCCGGCTCCTCCGCGTCTGTCCGACATTTCGTCGAACAGCTTGTAGGCGGCACGGCCCCGATCTCCCGCGTCCCCTCCGCCCTCGCCGTCGCCTCCGCGGAGCGTGGGACCGGAGGAAGCAACGGCGCTTCCTTGACGGTCCACTTCCTTCGCCACTCCTGCGGCCTCGAAGAAGCCGACGCCGCGAAGGCGGCCGAGCGCGTGCACCTCCGCTCCACCAAGAACGCGCACGCCGTGGTCGCGCTCCTCCGCGACACGCTCGGCATGCCCCCCGCCTCCGTCGCGCGTCTCGTCTCCGCGTACCCCGCGGTCCTTTCCTCGGTCACACTCGGCGCTAAGTTGAACTTCTACCTCCGCGAGCTCGGCCTCTCCTCCGCCGAGTTGCGCCGCTTCCTCCTCGCGAGCCCCCACCGCTTCCTCCTCGCGGGGATCGAGACTCGCCTGCGCCCCAACCTCAGCCTCCTCAAGGACCTTCTCGGCACCGAAGAGAACGTGCTCGCCGCCGTCAAGCAGTCCATGGAGCTCATCTACGACAACCTCGAGATCGTCCTGCTTCCCAAGCTCCAGGTGCTCCGCGAACACGGCGTCACTGAGGAGGTTCTCGTCAAGCTCCTCACCACCCACCCCAGGGCTCTTGTGCACAGGTCTACCCGCTTTGATGAGGGCTTGACCGCCATGAAGGACCTCGGGGTGAGTCCAAAGTCTGGCGCCTTCCCCTACGCCTTTGGGGTGTTCGCCAGAATGTACCAGTCCAAATGGGATCGCAGGGTGGAGAATTATGTCAGTCTGGGGTGGACCGAGGAGCAGGTCAGGCGGGCATTTGTCAGGCACCCCTACTTCATGACGGTGTCCGAGGACAAGGTCAAGAAACGCATGCAGTTCATTGCTGAAAAGCTTGGCTGGAACCCTGATGTTCTGTCGTCGTACCCGACTATTCTTTCCTTCAGCCACGAGAAGCGGGTACTGCCGAGGTACAGGGTGCTTCATATACTGGCGTCCCGTGGTGTCATCAAAAAAGGCATCAGGATGAGCCATCTGACAATGCCGGAAAAGAAGTTCAAGGAAAGGTACGTTGATAAGCACCAGGAAGAGATTCCTCAAGTACTGGAAGCTTATGGAGCAAGAACAGAGGCATGATGATTCTGCCTCAACTGATCAACTCTACATTGGAACAAAGGCACTGTATCCCTTGTCCTCAGCGGTTTGATTCTGTTGGGTGCTTTTCTTTCTGTTTTTTTTAGGATGCAAAGAACTCGGATTCACAAACTTTGTTGGCTTCACTGCTGATTTTTTTTAATAATTAGGCATTTCAGTGGTAACTATACAAAAAAAAAAAAAAAA

SEQ ID NO: 2907 - DNA, 1660 bp, Zea mays
  misc_feature (1)..(1660): Ceres cDNA ID no. 21572599
  misc_feature (1)..(1660): Ceres CLONE  ID no. 444935
  misc_feature (1)..(1660): Also known as  Ceres CDNA ID no. 0
aattcacgggcgcagcgacctctcgtctcctctccatctagacaccactttcttctctccgcctcaggcggcgcgcgcgcggctagcttcccggcctcccagcaacatcccgccaccacttcctcctcctcctccgctctctccggccgcgcgcgccgacgttttttttccaacggaggccgccgcgcgctgcctttagtttcggacccatccatccatacatagccaacatcacctatagcaggcggagggacggaggaccgtccgtctcgttcactccgcgccgcgcgtggcccgatccagcccggccctcggatggtcgccgctggcacgtacagcgacgacaccagcggcggcgggtgcgggtccatggagttctggccggagttcctggcctccagcggcgggcgcgagttcgtggccggcggggtgggcggcatggcgggcgtgctggcgggccacccgctcgacacgctccgcatccgcctccagcagccgcccgccgcgggcgcaccacgccgccgcgacgcgcacccctcagccccgcgcctcctacgcggcatcctccgcgccgagggcccctgcgcgctctaccgcggcatggccgcgccgctcgcctccgtcgccttccagaacgcgatggtgttccaggtgtatgcggtcctgtcgcggtcgctgggccccgccacctccgagccgccgtcctacgcgagcgtggcgctggccggcgtcagcacgggggcgctgcagacgctgatcctgtccccggtggagctggtcaagatccggctgcagctggaggcggcgtcggggcacggccccgtggagatggtccgtgaaatcctccggcgcgagggcctgcgcggcgtgtaccgcgggctggcggtgaccgcgctccgcgacgcgccggcgcacggcgtctacttctggacgtacgagcgcgcccgggagcggctgcacccggggtgccgccgcagcagcagcagccaggaccaagacggggacgagggcctgggcaccatgctcgtggccggcggcctggccggggtcgccagctgggtgtgctgctacccgctggacgtggtcaagtcgcggctccaggcgcagggcgcggcgtcggcgcccaggtaccgcggcgtcgtcgactgcttccagaggagcgtccgggaggaaggcctccccgtgctgtggcgcggcctcggcaccgccgtcgcccgcgcgttcgtcgtcaacggcgccatcttctccgcctacgagctggccctgcgcttcattgccagcggcggcggccccaggctggtcatggaggacaagtgagtcagactggaccatgttgtacataggctagtataagtatccattccagtggttggtggagagtatccatgccactgccagcgcagtgagctgagattcgtggactggagtagcgtaccgtagctgcaagcttcatacaaatcgaagcatgcgtcttgatgatggcgatcgattcaccctggtaatttggggaaatacactgtgtagcgcattgtgcattacattggtgtgctgctattccatatagtatagtactctgcatgaacatcagtgatcagtcaactgaccaattgacattacagtatgtatggataaaccattcatggtaaaaaaaaaaaaaaaa

SEQ ID NO: 2908 - protein, 1660 aa, Zea mays
AATTCACGGGCGCAGCGACCTCTCGTCTCCTCTCCATCTAGACACCACTTTCTTCTCTCCGCCTCAGGCGGCGCGCGCGCGGCTAGCTTCCCGGCCTCCCAGCAACATCCCGCCACCACTTCCTCCTCCTCCTCCGCTCTCTCCGGCCGCGCGCGCCGACGTTTTTTTTCCAACGGAGGCCGCCGCGCGCTGCCTTTAGTTTCGGACCCATCCATCCATACATAGCCAACATCACCTATAGCAGGCGGAGGGACGGAGGACCGTCCGTCTCGTTCACTCCGCGCCGCGCGTGGCCCGATCCAGCCCGGCCCTCGGATGGTCGCCGCTGGCACGTACAGCGACGACACCAGCGGCGGCGGGTGCGGGTCCATGGAGTTCTGGCCGGAGTTCCTGGCCTCCAGCGGCGGGCGCGAGTTCGTGGCCGGCGGGGTGGGCGGCATGGCGGGCGTGCTGGCGGGCCACCCGCTCGACACGCTCCGCATCCGCCTCCAGCAGCCGCCCGCCGCGGGCGCACCACGCCGCCGCGACGCGCACCCCTCAGCCCCGCGCCTCCTACGCGGCATCCTCCGCGCCGAGGGCCCCTGCGCGCTCTACCGCGGCATGGCCGCGCCGCTCGCCTCCGTCGCCTTCCAGAACGCGATGGTGTTCCAGGTGTATGCGGTCCTGTCGCGGTCGCTGGGCCCCGCCACCTCCGAGCCGCCGTCCTACGCGAGCGTGGCGCTGGCCGGCGTCAGCACGGGGGCGCTGCAGACGCTGATCCTGTCCCCGGTGGAGCTGGTCAAGATCCGGCTGCAGCTGGAGGCGGCGTCGGGGCACGGCCCCGTGGAGATGGTCCGTGAAATCCTCCGGCGCGAGGGCCTGCGCGGCGTGTACCGCGGGCTGGCGGTGACCGCGCTCCGCGACGCGCCGGCGCACGGCGTCTACTTCTGGACGTACGAGCGCGCCCGGGAGCGGCTGCACCCGGGGTGCCGCCGCAGCAGCAGCAGCCAGGACCAAGACGGGGACGAGGGCCTGGGCACCATGCTCGTGGCCGGCGGCCTGGCCGGGGTCGCCAGCTGGGTGTGCTGCTACCCGCTGGACGTGGTCAAGTCGCGGCTCCAGGCGCAGGGCGCGGCGTCGGCGCCCAGGTACCGCGGCGTCGTCGACTGCTTCCAGAGGAGCGTCCGGGAGGAAGGCCTCCCCGTGCTGTGGCGCGGCCTCGGCACCGCCGTCGCCCGCGCGTTCGTCGTCAACGGCGCCATCTTCTCCGCCTACGAGCTGGCCCTGCGCTTCATTGCCAGCGGCGGCGGCCCCAGGCTGGTCATGGAGGACAAGTGAGTCAGACTGGACCATGTTGTACATAGGCTAGTATAAGTATCCATTCCAGTGGTTGGTGGAGAGTATCCATGCCACTGCCAGCGCAGTGAGCTGAGATTCGTGGACTGGAGTAGCGTACCGTAGCTGCAAGCTTCATACAAATCGAAGCATGCGTCTTGATGATGGCGATCGATTCACCCTGGTAATTTGGGGAAATACACTGTGTAGCGCATTGTGCATTACATTGGTGTGCTGCTATTCCATATAGTATAGTACTCTGCATGAACATCAGTGATCAGTCAACTGACCAATTGACATTACAGTATGTATGGATAAACCATTCATGGTAAAAAAAAAAAAAAAA

SEQ ID NO: 2909 - DNA, 1685 bp, Zea mays
  misc_feature (1)..(1685): Ceres cDNA ID no. 21572600
  misc_feature (1)..(1685): Ceres CLONE  ID no. 453520
  misc_feature (1)..(1685): Also known as  Ceres CDNA ID no. 23830651
aacatttttaataataataataataataaaatctcccgtggcctccttcttctccggttctcgctcgtgcccttctctcctggcggcgacggctgggcgagcggcgcggcccgttatcacttcccaggtcttcgacggcgacgagtttccaccaggctgaccggaacgcagtgggtggagaaccggtgagcagctgcagccatgtccgtggcggccggcgtgagcgacgcggccatcgcggtgcgcgacaagctccgtggaaagattggccagaccaaggtcaaacggtactggccggggaaggcgcctgagtgggccgatgacgtcgatgaggacatcgacctcaggacggcacgggtctccctcgacaaggcgttccccagggacgaggacggcgatgttcccgccaaggatgaccgccggctccgccggctcgcggagacccgcgcggagaataaggaggagctgagggcggatcaccgccgcatacggcaggcggagatcgtgtcaaccgcggaggaggagaacgagaggcaggaggctgacgccgacgaggaggatgaggaggcccaagaggagaggaggaggagaataagggcaaggcagctgctgagggagcaggaagagctgcttcctcaggaagaggaggaaccggtggaggccgaggagtctgaggaggaatctgagtacgagacagactctgaggatgagcagatgggaatggccatggtgaagcccgttttcataccaaagtcacagagagacaccatcgcggagcgcgaacggctggaggaggaggaacggcagcttgaggagctggtcaagaagaggctggaggctaggaagatcgagactagacagattgtggtcgaagagattagaaaggaggagcacatcgagaaggcactgaacgaagaggccaacatcgaggatgtcgatacagacgacgagttgaacgaagcagaggagtacgagtcgtggaaaaacagagaaatagcaaggattaagagggacagggaggaaagagatgcgaggttgaaggagaaggaggagatcgagaaagtcaggaatatgaccgaggaggagcgtcgcgaatgggagcggaagaatccgaagccgcttcgtcagacgaaacagaagtggaagtttatgcagaagtattaccacaaaggtgccttcttccaggaaggtgctgatgatgttatccagtcagcgggtaaagaggatatctacacccgtgatttctctgagcccactggagaagataagatggataagagcatcctgcccaaggtcatgcaagttaaacatttcgggcgcagcggcaggacaaaatggacacatcttgttaatgaagacactacagattggaatgcaccatggtcaacaaatgggcctctgcgagcaaagtataatgcaaaaatggcaggcatgaatgcacctattgctaaaccaaagggaagtaagaagctgaaggattgggatgcaaaatgagatgccaggttagctggtattatctaagcgttataagaactatgtagccaaaaagtgcaaacaatgcttatgcagatgctttctttccattttgactgcataaacaatgtgacctttatgtgctattatctgttgaagtgtcccaatagtatgatgtgatgatccatgaatgatcaaaaaaaaaaaaaaaa

SEQ ID NO: 2910 - protein, 430 aa, Zea mays
  misc_feature: PFam Name: MFAP1_C; PFam Description:
  misc_feature: PFam Name: E-MAP-115; PFam Description: E-MAP-115 family
  misc_feature: PFam Name: Plasmodium_HRP; PFam Description: Plasmodium
  misc_feature: PFam Name: Caldesmon; PFam Description: Caldesmon
  misc_feature: PFam Name: TolA; PFam Description: TolA protein
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
  misc_feature: GI Number: 48104934; NR Description: similar to
  misc_feature: GI Number: 66551430; NR Description: PREDICTED: similar to
  misc_feature: GI Number: 52138891; NR Description: Unknown (protein for
MSVAAGVSDAAIAVRDKLRGKIGQTKVKRYWPGKAPEWADDVDEDIDLRTARVSLDKAFPRDEDGDVPAKDDRRLRRLAETRAENKEELRADHRRIRQAEIVSTAEEENERQEADADEEDEEAQEERRRRIRARQLLREQEELLPQEEEEPVEAEESEEESEYETDSEDEQMGMAMVKPVFIPKSQRDTIAERERLEEEERQLEELVKKRLEARKIETRQIVVEEIRKEEHIEKALNEEANIEDVDTDDELNEAEEYESWKNREIARIKRDREERDARLKEKEEIEKVRNMTEEERREWERKNPKPLRQTKQKWKFMQKYYHKGAFFQEGADDVIQSAGKEDIYTRDFSEPTGEDKMDKSILPKVMQVKHFGRSGRTKWTHLVNEDTTDWNAPWSTNGPLRAKYNAKMAGMNAPIAKPKGSKKLKDWDAK

SEQ ID NO: 2911 - DNA, 2338 bp, Glycine max
  misc_feature (1)..(2338): Ceres cDNA ID no. 21572601
  misc_feature (1)..(2338): Ceres CLONE  ID no. 463229
  misc_feature (1)..(2338): Also known as  Ceres CDNA ID no. 24355984
atgagtgtaatcaaacccacccaatggaacactcgttttggtcactcccatgagacatgatcgcctccacctccacttccaccaatgttgtacctcaccctctgcgctttctgtccaaaccaacctcacattccactacgaggtttctgtctctcacactccactctcggggcatcgctgttgcactttcctcgtccagtagaaccacccccttgaagcccacgtgccacttcaacagcaaagatggaagctttgagctgcatgaggatgaggatgagcgtgatgtgcattgtgaggtccaagtgatttcgtggagggagcgcaaagttaacgcccaaatcacggttgatgctgacactgagtccgtttggaatgctctcactgattatgagcatcttgctgacttcatcccaaatcttgtgtggagtgggagaattccttgtccgtacccaggaaggatatggttagagcaaaggggattccaaagggcaatgtattggcatatagaagctcgtgttgtgttggatcttcgagaagtcatcaattcagcatgggatcgagaacttcacttttccatggttgatggggactttaagaagttcgatggtaaatggtccgtaaaatctggaacaaggtcatcaactgctattttatcttatgaagttgatgtgataccaaggttcaatttcccagctatttttttggaaaggattatcagatccgatcttcctgtgaaccttcgagctttggcatacagagctgaaaggaactttgtgggatatcagaaacttccagtgtcagaaaaccacttgcgcaaaacttatgcggccattaacgggtcatctgttaaaaagataaatggtgcttcgtctgaaagttttaaaaagataaatggtgctttgtgtggaagtgataagttgcctcctgcagagaacaaaaaagaaattgccacctcagtttctggttccatgctcacatcttccagtgaggtgagaagcaactggggtgtatttggaaaagtttgcaggcttgacagacctcggatggtggatgaagttcatctccgcagatttgatggacttctggaaaatggaggtgttcatcgctgtgttgttgcaagcataacagttaaagctcctgttcgtgaagtatggaatattctaactgcctacgagactcttcctgagatagttccaaatttagcaatcagtaaggtggtatcacgagataatagtaaagttcgcattcttcaggaagggtgtaagggtcttctttatatggtgcttcatgctcgtgtagtgctggacttgtgtgaatatttagaacaggagatcagttttgaacaagttgaaggggactttgattcattccggggaaaatggatttttgagcaactaggaaatcatcacacactgctaaagtactctgtggagtcaaaaatgcgcaaagatactttcctttccgaagccataatggaggaggtcatttatgaagatctcccatcaaacttgtctgcaataagagactatattgagaacatgaatgcatcaaaatcttctgaagtttgtgagcagaatacgaattcagggcaacaaattgtttcatcaggctctcaaaaagatgacaactctggttcaactgaggaagttcctcattgcgacgttcgatgttcatctcagcaaagatctaaagtgccaggcttacagaggaatattaaagtactagaatctgaactactgaaattcattgcagaacatggacaggaaggatttatgccaatgaggaagcaactccgtttgcatggaagagtggatattgagaaggctataactcgcatgggtggattcagaaagattgcaaccatattgaacctttctttggcttacaaacaccggaaacctaagggttactgggacaatcttgaaaatttgcaggaagagataagtcggtttcaaaggagctggggcatagacccttcatttatgcccagtagaaagtcatttgaacgtgcagggcgatatgatattgcacgtgcactggaaaagtggggtggactacacgaggtttctcgccttctgtcgctcaaggtaagacaacggagcagacaggacaaccttgctaaggataagaggagtgatcatacagatagtgaaatgaagacaccatgtattcctcaagacacacaaaagtggcttacaaaactaaaacagtttgacatgaattggtttgagtaaaagaggattgattttatattgtgtatacccgtgttagtgtggttatagttcagttcaatgattctccaccaggccattcagtattcaaaaaaaaaaaaaaaaaa

SEQ ID NO: 2912 - protein, 725 aa, Glycine max
  misc_feature: PFam Name: Polyketide_cyc; PFam Description: Streptomyces
  misc_feature: GI Number: 23127291; NR Description: COG2867: Oligoketide
  misc_feature: GI Number: 45510141; NR Description: COG2867: Oligoketide
  misc_feature: GI Number: 46129613; NR Description: COG2867: Oligoketide
  misc_feature: GI Number: 34906002; NR Description: P0518C01.12 [Oryza sativa (japonica cultivar-group)] >gi|15289980|dbj|BAB63675.1|
MIASTSTSTNVVPHPLRFLSKPTSHSTTRFLSLTLHSRGIAVALSSSSRTTPLKPTCHFNSKDGSFELHEDEDERDVHCEVQVISWRERKVNAQITVDADTESVWNALTDYEHLADFIPNLVWSGRIPCPYPGRIWLEQRGFQRAMYWHIEARVVLDLREVINSAWDRELHFSMVDGDFKKFDGKWSVKSGTRSSTAILSYEVDVIPRFNFPAIFLERIIRSDLPVNLRALAYRAERNFVGYQKLPVSENHLRKTYAAINGSSVKKINGASSESFKKINGALCGSDKLPPAENKKEIATSVSGSMLTSSSEVRSNWGVFGKVCRLDRPRMVDEVHLRRFDGLLENGGVHRCVVASITVKAPVREVWNILTAYETLPEIVPNLAISKVVSRDNSKVRILQEGCKGLLYMVLHARVVLDLCEYLEQEISFEQVEGDFDSFRGKWIFEQLGNHHTLLKYSVESKMRKDTFLSEAIMEEVIYEDLPSNLSAIRDYIENMNASKSSEVCEQNTNSGQQIVSSGSQKDDNSGSTEEVPHCDVRCSSQQRSKVPGLQRNIKVLESELLKFIAEHGQEGFMPMRKQLRLHGRVDIEKAITRMGGFRKIATILNLSLAYKHRKPKGYWDNLENLQEEISRFQRSWGIDPSFMPSRKSFERAGRYDIARALEKWGGLHEVSRLLSLKVRQRSRQDNLAKDKRSDHTDSEMKTPCIPQDTQKWLTKLKQFDMNWFE

SEQ ID NO: 2913 - DNA, 1492 bp, Glycine max
  misc_feature (1)..(1492): Ceres cDNA ID no. 21572603
  misc_feature (1)..(1492): Ceres CLONE  ID no. 463950
  misc_feature (1)..(1492): Also known as  Ceres CDNA ID no. 24767006
tcagatacgtagcccccccccccttaaataattaattacaacctcgcaatccaagaatcatgaacgaccaaaacaacaacacaagtctttccattccacaaaaccaagacagaatggacatcgaaaacacttctgagatttcacatgcagattcggtgtaccatatgaaaagtgtaaagttctattgccaacactgccgcagggacttctcaattcttaaccctgaaaacaatcgcggaacatgccctcgttgcgataatgtatccacaacgctctcttctaagaaccaatcgcaaccacaacaacagcagcaacaacaacagaaccagagcacacaacaacagagacaacaaaacgcacaatcaactcagcaagcaaatagctcaagtgcttctgctcaaccagacactcaccaacacagaaatcccttcgcttttgttcaaaacttaatctttggctctgagtctgcaaaccaacaacatggcgagagcgcacagcgtcaacaacagcaaccacagccccaatctcaatctcagggcgcacaacaaagccaaggaggtggattcttaaataaccttcttggattcggacagaatgtactaacaaacattctggacggtattgcagacctcgctgttccaccaccgcaaactcaaagaagacaacctcaaatagtgtttatgccttggggttccaacacttctcagagctcgtttactagcaatccatttgatctctttggagatatttatgagcagcaagagcagcagccacaattcttcccacaacaattcttcccacagcaaactatcttcttccaaagaccacctcaacaggctcctcaacatcatatcgtttttggaatcaatcccttcgagatggtctttcttccagttggtggccagcacgtcttctttaatgttgctcctggtgccaattacgatagaatcatcgaagagttcctaagaaacgaccctaacaactatggtgctgctcctgcttcgcaagaaaacatcagcagacttagagatttcgactatgctcctggagtttgcaaaaatgttgactgtaccgtttgtcaagaggattacaaagtcggagacaaatgtgtcagtcttccctgcggacacaactatcacaaagattgcgttgttgagtggcttgttagacacgactcatgtcccgtctgcagaaagcccattggagagacgctccctaatatgcaccaagcacaacgggagaactcacaaaccatggccagcgaagaacctcaaactggcttctaattaatctaagctctactatctacaaatctttaagcttttaggctttttagtcaatttttgtaaatctaaccttagtcatcgtcgctagagacgatcccttttcttgataaattagcaagaactgtacatataattcgttgatagattatcaaagctatcatgtttatgttttttaactctaatactccaaaaaaaaaaaaaaaaaa

SEQ ID NO: 2914 - protein, 1492 aa, Glycine max
  misc_feature: PFam Name: zf-C3HC4; PFam Description: Zinc finger, C3HC4
  misc_feature: PFam Name: Tryp_alpha_amyl; PFam Description: Protease
  misc_feature: PFam Name: SSDP; PFam Description: Single-stranded DNA
  misc_feature: PFam Name: GAL11; PFam Description: Transcription regulatory
  misc_feature: GI Number: 33417148; NR Description: MGC69096 protein
  misc_feature: GI Number: 49522450; NR Description: Rnf126-prov protein
  misc_feature: GI Number: 61883503; NR Description: PREDICTED: similar to
  misc_feature: GI Number: 50760987; NR Description: PREDICTED: similar to
  misc_feature: GI Number: 55296745; NR Description: putative ring finger protein 126 isoform 1 [Oryza sativa (japonica cultivar-group)] gi|55296657|dbj|BAD69377.1| putative ring finger protein 126
TCAGATACGTAGCCCCCCCCCCCTTAAATAATTAATTACAACCTCGCAATCCAAGAATCATGAACGACCAAAACAACAACACAAGTCTTTCCATTCCACAAAACCAAGACAGAATGGACATCGAAAACACTTCTGAGATTTCACATGCAGATTCGGTGTACCATATGAAAAGTGTAAAGTTCTATTGCCAACACTGCCGCAGGGACTTCTCAATTCTTAACCCTGAAAACAATCGCGGAACATGCCCTCGTTGCGATAATGTATCCACAACGCTCTCTTCTAAGAACCAATCGCAACCACAACAACAGCAGCAACAACAACAGAACCAGAGCACACAACAACAGAGACAACAAAACGCACAATCAACTCAGCAAGCAAATAGCTCAAGTGCTTCTGCTCAACCAGACACTCACCAACACAGAAATCCCTTCGCTTTTGTTCAAAACTTAATCTTTGGCTCTGAGTCTGCAAACCAACAACATGGCGAGAGCGCACAGCGTCAACAACAGCAACCACAGCCCCAATCTCAATCTCAGGGCGCACAACAAAGCCAAGGAGGTGGATTCTTAAATAACCTTCTTGGATTCGGACAGAATGTACTAACAAACATTCTGGACGGTATTGCAGACCTCGCTGTTCCACCACCGCAAACTCAAAGAAGACAACCTCAAATAGTGTTTATGCCTTGGGGTTCCAACACTTCTCAGAGCTCGTTTACTAGCAATCCATTTGATCTCTTTGGAGATATTTATGAGCAGCAAGAGCAGCAGCCACAATTCTTCCCACAACAATTCTTCCCACAGCAAACTATCTTCTTCCAAAGACCACCTCAACAGGCTCCTCAACATCATATCGTTTTTGGAATCAATCCCTTCGAGATGGTCTTTCTTCCAGTTGGTGGCCAGCACGTCTTCTTTAATGTTGCTCCTGGTGCCAATTACGATAGAATCATCGAAGAGTTCCTAAGAAACGACCCTAACAACTATGGTGCTGCTCCTGCTTCGCAAGAAAACATCAGCAGACTTAGAGATTTCGACTATGCTCCTGGAGTTTGCAAAAATGTTGACTGTACCGTTTGTCAAGAGGATTACAAAGTCGGAGACAAATGTGTCAGTCTTCCCTGCGGACACAACTATCACAAAGATTGCGTTGTTGAGTGGCTTGTTAGACACGACTCATGTCCCGTCTGCAGAAAGCCCATTGGAGAGACGCTCCCTAATATGCACCAAGCACAACGGGAGAACTCACAAACCATGGCCAGCGAAGAACCTCAAACTGGCTTCTAATTAATCTAAGCTCTACTATCTACAAATCTTTAAGCTTTTAGGCTTTTTAGTCAATTTTTGTAAATCTAACCTTAGTCATCGTCGCTAGAGACGATCCCTTTTCTTGATAAATTAGCAAGAACTGTACATATAATTCGTTGATAGATTATCAAAGCTATCATGTTTATGTTTTTTAACTCTAATACTCCAAAAAAAAAAAAAAAAAA

SEQ ID NO: 2915 - DNA, 1399 bp, Glycine max
  misc_feature (1)..(1399): Ceres cDNA ID no. 21572604
  misc_feature (1)..(1399): Ceres CLONE  ID no. 464316
  misc_feature (1)..(1399): Also known as  Ceres CDNA ID no. 24359998
aaaaccctagtcacacccattccataaaaacaaagctttttcttcctttgccactttcccggaaaatcctcctcattttttctggaaaatttatcttccgttttctcgctgacaccaccgcacactcttcacgccttctctcactctaatctattatggcggatgaaggtgttgccaacggcggcgtcgatgatcagtacggcgaagaatcggcgactaagatcgcggcgttgcaacgcgagcgcgacgaattggtgagcgaaaacgcggcgaggaaggaggagatcaagaagctgacggcggagctcgacggattgaggagcgacggtgcagataggagcgagaagattgaagagctgcagagagaagtagcgcagtcgcgtgatgctgccaaagcgacggaggttatcgccgcgagggcggcggacctggagacggaggtggcgaggcttcaccacgatatggtagcggagatgactgcggcagaggaggcgagggcggatgccgctgaattgaggaaggttttgggagagacagagtctagggttgagtctctggaaagggaattggcagggttgaagaaggtgaaggctgagagtgaggttagggttagggatttggagaggaagattggagttctggagactaaggaaattgaggaaagaaacaagagaattaggtttgaggaggagactagggataagattgatgaaaaggagagggaaattaagggttacagacagaaggttgagggattggagaaggttgctgctgagaaaaaaacagaattagatgagttggttaaacagaaattgaggttggaggaatcacttagagaatctgaggagaaagtgactggtttggagtccagtattcttcaattgcgtgaggaagcaaaggaagccgagagggtgatcatatcgctgaatgaaaaggcggtggagacggttgagacaatcgacagaggtttgaatggtgtacatggtgaagggaagaagggattgaagttgcagtggccagtggtggcagcagggtctacaggagctgttgttgcagctgctgctgtaatctacgtgtgctatgggaaacggaggtgattttctgtgtcggagactgatcaagaacaaaggaacaaggggaattccaatggaaggaggaaggtgtagaggttagacataccaggtctttagtagtcatagatttgctgctgcagttttgtttgtcacaaaacaatgctgcttctctggcttttgtttttgaagcctgtgaattttttgctcatcgaagttggcatactacttgtttggttgttagttgcttgttatgaggatcaaaccactgtgtgttggatttaataaataggttgcataattgagattacaaaaaaaaaaaaaaaaaa

SEQ ID NO: 2916 - protein, 313 aa, Glycine max
  misc_feature: PFam Name: Myosin_tail_1; PFam Description: Myosin tail
  misc_feature: PFam Name: Tropomyosin; PFam Description: Tropomyosin
  misc_feature: PFam Name: Caldesmon; PFam Description: Caldesmon
  misc_feature: PFam Name: E-MAP-115; PFam Description: E-MAP-115 family
  misc_feature: PFam Name: HOOK; PFam Description: HOOK protein
  misc_feature: GI Number: 6692690; NR Description: F12K11.14 [Arabidopsis thaliana] >gi|15221511|ref|NP_172140.1| myosin heavy chain-related
  misc_feature: GI Number: 21595387; NR Description: unknown [Arabidopsis thaliana]
  misc_feature: GI Number: 50261849; NR Description: AT1G06530 [Arabidopsis
  misc_feature: GI Number: 6689249; NR Description: M-like protein
  misc_feature: GI Number: 6689246; NR Description: M-like protein
MADEGVANGGVDDQYGEESATKIAALQRERDELVSENAARKEEIKKLTAELDGLRSDGADRSEKIEELQREVAQSRDAAKATEVIAARAADLETEVARLHHDMVAEMTAAEEARADAAELRKVLGETESRVESLERELAGLKKVKAESEVRVRDLERKIGVLETKEIEERNKRIRFEEETRDKIDEKEREIKGYRQKVEGLEKVAAEKKTELDELVKQKLRLEESLRESEEKVTGLESSILQLREEAKEAERVIISLNEKAVETVETIDRGLNGVHGEGKKGLKLQWPVVAAGSTGAVVAAAAVIYVCYGKRR

SEQ ID NO: 2917 - DNA, 1061 bp, Zea mays
  misc_feature (1)..(1061): Ceres cDNA ID no. 21572605
  misc_feature (1)..(1061): Ceres CLONE  ID no. 468781
  misc_feature (1)..(1061): Also known as  Ceres CDNA ID no. 24358334
agaaacccaccaccgcaacacctgcgctccgcggcctgctctctctttcaaacagcttcgtgtgtcgttgcgccgcgcatagttccagcgccagctcggcactgaagaatctggtgaccggcctggatcgagatccaagctcgagcaggaacggagagcgcgcggatatatatagctaggatgatgatgatgatggacaggcaactcgtcaggcaatgcgacatggaggtcatgaggatggccatgctcaagcacgaagagaccttccggcagcaggtccacgagctgcaccgcctgtaccgcatacagagggagccgatgagcgacctaataacgacccgatacgacgacgagccgctgctgctgacgaccgccggccggcgcagcaagcagccgcgccgggcgctggacctgcagctcccagccgacgagtacatcgtcagcgccgacgaggacgacgacggcgacgcggacgccgccggcgcggagctggagctgacgctggccgtcggcgggcgctgcgcagccggcggcggccggcgcaagagcaacaggcgccggaggcaatcagcagagcggcagcagcgcgacaacaacgccgccggcggctcctcgccgttcgggtccgactgctccggcgcgagcgccctgtcgtcgccgccgccttcgtcggccgagtactactccgacgacgggccggcggcggcggcgtgccagagggccgttgcgttcgaccttggaggagaagccgacggcgtgatgaggcagcagcacgcgccgtggctggcgcagtgccagcagtacctcagcctgaggatgacatgagtgaagctgcaggcctgcagcgcgctgctcgccgccgtccatgtcgatgtccatgtcgctagctgtaccaggttgcgtttgtgttgtagcttgtaggagcagcagtacgtactagccagtagccactagtgtttttttttttttttttttgccctttgtgtttgctatatgtcctagccgtggccaatggagtccgggaagaaggcctgcagtttaaaaaaaaaaaaaaaaaaaaa

SEQ ID NO: 2918 - protein, 214 aa, Zea mays
MMMMMDRQLVRQCDMEVMRMAMLKHEETFRQQVHELHRLYRIQREPMSDLITTRYDDEPLLLTTAGRRSKQPRRALDLQLPADEYIVSADEDDDGDADAAGAELELTLAVGGRCAAGGGRRKSNRRRRQSAERQQRDNNAAGGSSPFGSDCSGASALSSPPPSSAEYYSDDGPAAAACQRAVAFDLGGEADGVMRQQHAPWLAQCQQYLSLRMT

SEQ ID NO: 2919 - DNA, 1331 bp, Glycine max
  misc_feature (1)..(1331): Ceres cDNA ID no. 21572606
  misc_feature (1)..(1331): Ceres CLONE  ID no. 471402
  misc_feature (1)..(1331): Also known as  Ceres CDNA ID no. 24355948
acttagcttagttattatattatctatattctatcatggtgaaactcaaactctcttgcctcacctcatatgtagaataattgaatagatctttaactccattgcttcattacttcaacctccactcaatttttcaaaaccctagctaaaaaacactaccagttttcgagtaataataattaaaagaggagaatattttttggtttttttttttctattgttttagggagggaaagtggagagcgatatggaattcgacgagcaagaggagcatgaggaggaggaaatggtgatgccggagccggcggcggtatcggcgccgccgagttacgactcgctcgggaactccggggcgatgtcgaaacttggcggcggcgaggggcggaagaccgcgctcggcgccgcggcggcggcggtgcggtaccgagaatgccagaagaaccacgccgtgagcttcggcggccacgccgtcgacggctgctgcgagttcatggcggccggagaggacggcacgctggaggccgtcatctgcgctgcctgcaactgccaccggaatttccaccgcaaggagatcgacggcgagattacctccttccactaccgtgcacagcctcccccgccgccgatgcaccaccaccaccaattctccccgtactaccaccaccgcgtcccgcagcaccccgccgccgctggctacctccaccaccacctcacacctccgatgtcgcagcaccgcccgctcgccctcccggccgcagcctccggcggcggcctaagccgcgaagaagaagacatgtcaaaccctagcagcagcggcggcggtggcggtggatccaaaaaacggttccgaacgaagttcacgcaggaacaaaaggataagatgctcgcattcgcggaacaactagggtggagaatccagaagcacgatgaatctgctgtggaacagttctgtgctgagaccaatgtgaagcgaaacgttctcaaagtttggatgcacaataacaagagcactcttggtaagaaaccctaatttcgccaattgttgttataatagtataattctttctctcgttctttccgttcggtgagggaaaaaaatgtaatttgaaatttcattaatggagatcaagctagggttctccctttccttaattttaatttctagtgttggcaagggatgatgattaaagtgcatgatttggttaacatgtactattattgtacattaattgcgaatgaattctcggtgattagtttgtctgtaaagagatcgagaccaaataaagacaaggtaacgaagttgattaaaaaaaaaaaaaaaaaaaaaaaaa

SEQ ID NO: 2920 - protein, 260 aa, Glycine max
  misc_feature: PFam Name: ZF-HD_dimer; PFam Description: ZF-HD protein
  misc_feature: PFam Name: Homeobox; PFam Description: Homeobox domain
  misc_feature: PFam Name: Mucin; PFam Description: Mucin-like glycoprotein
  misc_feature: GI Number: 13374061; NR Description: ZF-HD homeobox protein
  misc_feature: GI Number: 5091602; NR Description: 10A19I.6 [Oryza sativa
  misc_feature: GI Number: 21554149; NR Description: unknown [Arabidopsis thaliana]
  misc_feature: GI Number: 53689757; NR Description: ZF-HD homeobox
  misc_feature: GI Number: 21592512; NR Description: unknown [Arabidopsis thaliana]
MEFDEQEEHEEEEMVMPEPAAVSAPPSYDSLGNSGAMSKLGGGEGRKTALGAAAAAVRYRECQKNHAVSFGGHAVDGCCEFMAAGEDGTLEAVICAACNCHRNFHRKEIDGEITSFHYRAQPPPPPMHHHHQFSPYYHHRVPQHPAAAGYLHHHLTPPMSQHRPLALPAAASGGGLSREEEDMSNPSSSGGGGGGSKKRFRTKFTQEQKDKMLAFAEQLGWRIQKHDESAVEQFCAETNVKRNVLKVWMHNNKSTLGKKP

SEQ ID NO: 2921 - DNA, 1289 bp, Glycine max
  misc_feature (1)..(1289): Ceres cDNA ID no. 21572607
  misc_feature (1)..(1289): Ceres CLONE  ID no. 473247
  misc_feature (1)..(1289): Also known as  Ceres CDNA ID no. 24355968
accagcgaatgcgatgtcgcagcaaggtcaaattccgataaaccccatgctccctccgcagaacccgatggccaccatgcccatgcccatgcacatgccccttcccatgccgctccagattcccttctccgcccaggacaccgccccctcctccgggaagcgccgccgtgacgacgaggctcccggcaccgccgccgcgccggatcaatcggcggcgaagcgcgccaagggacaggatgtgatattcaggatcgtcgtgccctcccgccacatcggcaaggtcatcgggaaggaaggtcatcgcatacagaagattcgagaagacaccaaagccaccatcaaaatcgctgacgctattgccagacatgaagagcgtgttatcattattagttctaaggacaatgatgaaaaagttactgatgcagagaaagctcttgagcaaatagcccatttaattttaaaggaagatgatagcagtcttgatgcgtcaaaagttactgcaggacatgtggctgccaatacgataagacttttgattgcagggtcccaggcaggtggattaattgggacgtctggtcaaaacattgagaagttgagggactcttctggtgcctctattactgttcttgcaccaaatcagttgcctttatgtgcttctgctcatgaatctgacagagttgtgcagttatcaggagatgttcctgcagtcatgaaagctttggaggagataggttgtcaactaagggaaaacccaccaagacaagtgatttcaattagcccaacatacaactatgctgcaattcgaccatcccagccatatcttgacccaacttcaggacaaccaatcttgcagttgattatgttacattcgagatgctgatttcggaaacgatggttggtgggttgattggccggtgtggctcaaacatctcgaggatcagaaatgagtctggagcaatgattaaggtttatggtggtaagggtgaacagaagcatagacaaattcaatttggtggtagtgctcaacaggtagctttggcaaaacagagagttgatgaatatatatactctcagttgatacaacagactggcacccaacagtcagcgtaagcaattagttttttgtgtttggatatctatcctttatattttcatctgttagaattttggtcacgtgaactagtaccttaatagtaaatcaaaattgtgagactagttctttgtaaaaaaatgggaaccaatcttttaatgattgaaaaaaaaaaaaaaaaaaaaaaaaaaaaaaaaaa

SEQ ID NO: 2922 - protein, 1289 aa, Glycine max
  misc_feature: PFam Name: KH_1; PFam Description: KH domain
ACCAGCGAATGCGATGTCGCAGCAAGGTCAAATTCCGATAAACCCCATGCTCCCTCCGCAGAACCCGATGGCCACCATGCCCATGCCCATGCACATGCCCCTTCCCATGCCGCTCCAGATTCCCTTCTCCGCCCAGGACACCGCCCCCTCCTCCGGGAAGCGCCGCCGTGACGACGAGGCTCCCGGCACCGCCGCCGCGCCGGATCAATCGGCGGCGAAGCGCGCCAAGGGACAGGATGTGATATTCAGGATCGTCGTGCCCTCCCGCCACATCGGCAAGGTCATCGGGAAGGAAGGTCATCGCATACAGAAGATTCGAGAAGACACCAAAGCCACCATCAAAATCGCTGACGCTATTGCCAGACATGAAGAGCGTGTTATCATTATTAGTTCTAAGGACAATGATGAAAAAGTTACTGATGCAGAGAAAGCTCTTGAGCAAATAGCCCATTTAATTTTAAAGGAAGATGATAGCAGTCTTGATGCGTCAAAAGTTACTGCAGGACATGTGGCTGCCAATACGATAAGACTTTTGATTGCAGGGTCCCAGGCAGGTGGATTAATTGGGACGTCTGGTCAAAACATTGAGAAGTTGAGGGACTCTTCTGGTGCCTCTATTACTGTTCTTGCACCAAATCAGTTGCCTTTATGTGCTTCTGCTCATGAATCTGACAGAGTTGTGCAGTTATCAGGAGATGTTCCTGCAGTCATGAAAGCTTTGGAGGAGATAGGTTGTCAACTAAGGGAAAACCCACCAAGACAAGTGATTTCAATTAGCCCAACATACAACTATGCTGCAATTCGACCATCCCAGCCATATCTTGACCCAACTTCAGGACAACCAATCTTGCAGTTGATTATGTTACATTCGAGATGCTGATTTCGGAAACGATGGTTGGTGGGTTGATTGGCCGGTGTGGCTCAAACATCTCGAGGATCAGAAATGAGTCTGGAGCAATGATTAAGGTTTATGGTGGTAAGGGTGAACAGAAGCATAGACAAATTCAATTTGGTGGTAGTGCTCAACAGGTAGCTTTGGCAAAACAGAGAGTTGATGAATATATATACTCTCAGTTGATACAACAGACTGGCACCCAACAGTCAGCGTAAGCAATTAGTTTTTTGTGTTTGGATATCTATCCTTTATATTTTCATCTGTTAGAATTTTGGTCACGTGAACTAGTACCTTAATAGTAAATCAAAATTGTGAGACTAGTTCTTTGTAAAAAAATGGGAACCAATCTTTTAATGATTGAAAAAAAAAAAAAAAAAAAAAAAAAAAAAAAAAA

SEQ ID NO: 2923 - DNA, 1629 bp, Glycine max
  misc_feature (1)..(1629): Ceres cDNA ID no. 21572608
  misc_feature (1)..(1629): Ceres CLONE  ID no. 474552
  misc_feature (1)..(1629): Also known as  Ceres CDNA ID no. 0
agattgcgttgtgcgttgtgcgttgtttgaggccaaaatatctgttcactgattaaagataaacacagagacagggattccagaaccagcgatgaaacctcaaacaaaacaaaactaaactaaactaaattaaaagtaaaaacaaaacatgttggtttttcaaaatcaatggctgtgtcttcctctcactcattcccttttctccaagttacttcccagaacaaacatgcagcaacagtgttatccccaagactatgccccgtttggtgtcattcagtagctcgtgccaccactctgcccacttctccaggtggggcggagcaggttgtggacagttcgtttgatgcacctaaagtgaaattattgaagcagaaaatggaacttcttggtatcaacttggaaaagtcttgtttgcctgggaagtaccataacctgttttgtccaaaatgcaaaggtgggcagttaaaggagaggagtttgtcttttcacattatctctgattgtgaatttgcaatgtggaggtgttttcgagctcaatgtggttgggctggtcaggtttctgcagatgacaaggaattgtacagtggggtttgtactaatgccaatttatataggcaattagcagaggagagcttaggattggaaccacttggtcctgaggttgttgcttattttggagagagattgatatcagagaaaaccctgagcagaaatgctgtaagacaattgtctaacaataagactgtcattgcttttacttataaacaaaatgggttgcttgttggttgcaagtacagaacaatggagaaaagattttggcagggaaaaggcgcggacaagatactgtatggaatagatgacattagtcaagcctctgagatcatcattgttgaaggggaaattgataaactttcactcgaggaggctggctttcagaattgtgttagtgttccagtgggtgcaccagaaaaggtttcttcaaaagatttgccaccaattgaaaaggacactgcatttcgatacctgtggaactgcaaagagtacttggataaggcagttcgcattatcctggcaactgataatgatccaccaggtcaagctttagcggaagagctggcacggcgccttgggcgagaaagatgttggagagtactctggccaaagaaagatgaattcagctctttcaaagatgcaaatgaggttctcaaatacatgggagctgatgctttgaagaaattagttgaaaatgcagagccatatgcaaatgccaattaggtaatttcatctatgaaagtggatagatttcagtgctcatgatgaaaaccatgcatatgcctgaactactacaaaagtttagtcatacaaaaaatgtaaagtagtgtgaccatattcgtattatttttaattaaattgggtatcgagatatctcatttatttggtggctaaattttagttgtttagtgtcagtatttcaagtgtatgtgggcagtgtgttatgagattttaattgggctctttaagggtcagaaatgaaatacttttgactatatatgaccttcagaatagcatcttaatcaaatgattatttgcaagtcatacgtggttatttccaaaaaaaaaaaaaaaaaa

SEQ ID NO: 2924 - protein, 368 aa, Glycine max
MAVSSSHSFPFLQVTSQNKHAATVLSPRLCPVWCHSVARATTLPTSPGGAEQVVDSSFDAPKVKLLKQKMELLGINLEKSCLPGKYHNLFCPKCKGGQLKERSLSFHIISDCEFAMWRCFRAQCGWAGQVSADDKELYSGVCTNANLYRQLAEESLGLEPLGPEVVAYFGERLISEKTLSRNAVRQLSNNKTVIAFTYKQNGLLVGCKYRTMEKRFWQGKGADKILYGIDDISQASEIIIVEGEIDKLSLEEAGFQNCVSVPVGAPEKVSSKDLPPIEKDTAFRYLWNCKEYLDKAVRIILATDNDPPGQALAEELARRLGRERCWRVLWPKKDEFSSFKDANEVLKYMGADALKKLVENAEPYANAN

SEQ ID NO: 2925 - DNA, 1660 bp, Glycine max
  misc_feature (1)..(1660): Ceres cDNA ID no. 21572609
  misc_feature (1)..(1660): Ceres CLONE  ID no. 474943
  misc_feature (1)..(1660): Also known as  Ceres CDNA ID no. 24767007
tctccaaaactggtatgatcccgatggttctacatctaggaccggagttaggaccatgataggatcctcgtgggccaacaaatggtggatgtacagtaataataactgtcaattagtagatggttcgtatgcttgtaaaatggctcctagggatagtattgcctctttacaaattatgcatgattccgtagccaacagtaaaattggatctactttttgtacaaatacagttccatgtcctgatgttggaatggtctctcattttggaactacagaaagtgatggtcttattcttgctacttttgctaaagttacaggtcctttgattgctgagaagggtggatggtttattcgtttcacgagtggaacacctaaatcactttatttaaccaatattcaactcgctcaagctgatactcttctcattgctttaccctatcctgctggaactactttcaatatttaccacaaaccatgtgccagttgtggaaattttgttcattcttatagatccgtgggatctcttgcagcagttgccagtgcctatggtgatgcttatttctggagtagctcaactagaactctttatttacgtgtcgttcaaactggtgtctcttttgctaatactcaggaaccatggacagcaagccaagcctatgccaacatggatgcctttacacgtggtggtcattctctcattattccaagtcaacaatctggaatcatgattgaagcttcatgtcccaatttctactgtgctcctcaaagtgatgtgaaggttccttctgcattcccattaactagcacacccatcccaactacaaaacctactcctgcaccaactccaaaaccaactccagctcctactcctaaggctactcctaaaccaactctagctcctactcctaaaccaaccccaactccaactacaaaaccaactccagcccctactcctaaaccaacccctgctcctactcctaaggctactcctaaaccaaccactaaaccaactcctgctcctactcctaaggctactcctaagcctactactaaacctacttctgctcctactcctaaggctactcctaagcctacttctgctccttccactccagctcccaagttctttgctggaatcaatattggaggccttaatgttgcagccactgtcgaggataatcgatttgtaggccaaaacactgcaactactagaggtttctctgttgtgactgcagatgcccaatatgctgaaaccagcatcactgcaagtggaacaactgattggcacattaccacattgctcaacactggaatttattcttataaccaaaagacctctcttaatttcacccaaactgtcccagcgagaggatcatatgcttttagcttctggttgatggagaatgagcgtggatatagcagagctttcaaccttgctctcgaacaaaaggtggtggcatcaaatattggaacattggctaaagtaggagattggaagaaatatgggccttataccactactgtgaatgatggtgaactcaatttcgacctcattgccactttcggcagagctcaaattatggctgctgctattgaacaactttaaataaaatatgtgtgatttttttcatacctattactcaaaaaaaaaaaaaaaaaa

SEQ ID NO: 2926 - protein, 1660 aa, Glycine max
  misc_feature: PFam Name: LMBR1; PFam Description: LMBR1-like membrane protein
  misc_feature: PFam Name: GATase_2; PFam Description: Glutamine
  misc_feature: PFam Name: Pyr_redox_2; PFam Description: Pyridine
  misc_feature: PFam Name: Lipoprotein_5; PFam Description: Transferrin
  misc_feature: PFam Name: Extensin_2; PFam Description: Extensin-like region
  misc_feature: GI Number: 48894823; NR Description: COG2340: Uncharacterized
  misc_feature: GI Number: 46309399; NR Description: ORF55 [Agrotis segetum granulovirus] >gi|46200616|gb|AAS82683.1| ORF55 [Agrotis segetum
  misc_feature: GI Number: 45506069; NR Description: COG3420: Nitrous oxidase
  misc_feature: GI Number: 9631973; NR Description: Pro-, Lys-rich, PAPK (30x); similar to wheat Pro-, Lys-rich protein, corresponds to GenBank Accession Number X52472 [Paramecium bursaria Chlorella virus 1] >gi|1620077|gb|AAC96773.1| Pro-, protein A405R - Chlorella
  misc_feature: GI Number: 15213204; NR Description: unknown [Epiphyas postvittana nucleopolyhedrovirus] >gi|15320736|ref|NP_203248.1|
TCTCCAAAACTGGTATGATCCCGATGGTTCTACATCTAGGACCGGAGTTAGGACCATGATAGGATCCTCGTGGGCCAACAAATGGTGGATGTACAGTAATAATAACTGTCAATTAGTAGATGGTTCGTATGCTTGTAAAATGGCTCCTAGGGATAGTATTGCCTCTTTACAAATTATGCATGATTCCGTAGCCAACAGTAAAATTGGATCTACTTTTTGTACAAATACAGTTCCATGTCCTGATGTTGGAATGGTCTCTCATTTTGGAACTACAGAAAGTGATGGTCTTATTCTTGCTACTTTTGCTAAAGTTACAGGTCCTTTGATTGCTGAGAAGGGTGGATGGTTTATTCGTTTCACGAGTGGAACACCTAAATCACTTTATTTAACCAATATTCAACTCGCTCAAGCTGATACTCTTCTCATTGCTTTACCCTATCCTGCTGGAACTACTTTCAATATTTACCACAAACCATGTGCCAGTTGTGGAAATTTTGTTCATTCTTATAGATCCGTGGGATCTCTTGCAGCAGTTGCCAGTGCCTATGGTGATGCTTATTTCTGGAGTAGCTCAACTAGAACTCTTTATTTACGTGTCGTTCAAACTGGTGTCTCTTTTGCTAATACTCAGGAACCATGGACAGCAAGCCAAGCCTATGCCAACATGGATGCCTTTACACGTGGTGGTCATTCTCTCATTATTCCAAGTCAACAATCTGGAATCATGATTGAAGCTTCATGTCCCAATTTCTACTGTGCTCCTCAAAGTGATGTGAAGGTTCCTTCTGCATTCCCATTAACTAGCACACCCATCCCAACTACAAAACCTACTCCTGCACCAACTCCAAAACCAACTCCAGCTCCTACTCCTAAGGCTACTCCTAAACCAACTCTAGCTCCTACTCCTAAACCAACCCCAACTCCAACTACAAAACCAACTCCAGCCCCTACTCCTAAACCAACCCCTGCTCCTACTCCTAAGGCTACTCCTAAACCAACCACTAAACCAACTCCTGCTCCTACTCCTAAGGCTACTCCTAAGCCTACTACTAAACCTACTTCTGCTCCTACTCCTAAGGCTACTCCTAAGCCTACTTCTGCTCCTTCCACTCCAGCTCCCAAGTTCTTTGCTGGAATCAATATTGGAGGCCTTAATGTTGCAGCCACTGTCGAGGATAATCGATTTGTAGGCCAAAACACTGCAACTACTAGAGGTTTCTCTGTTGTGACTGCAGATGCCCAATATGCTGAAACCAGCATCACTGCAAGTGGAACAACTGATTGGCACATTACCACATTGCTCAACACTGGAATTTATTCTTATAACCAAAAGACCTCTCTTAATTTCACCCAAACTGTCCCAGCGAGAGGATCATATGCTTTTAGCTTCTGGTTGATGGAGAATGAGCGTGGATATAGCAGAGCTTTCAACCTTGCTCTCGAACAAAAGGTGGTGGCATCAAATATTGGAACATTGGCTAAAGTAGGAGATTGGAAGAAATATGGGCCTTATACCACTACTGTGAATGATGGTGAACTCAATTTCGACCTCATTGCCACTTTCGGCAGAGCTCAAATTATGGCTGCTGCTATTGAACAACTTTAAATAAAATATGTGTGATTTTTTTCATACCTATTACTCAAAAAAAAAAAAAAAAAA

SEQ ID NO: 2927 - DNA, 2184 bp, Glycine max
  misc_feature (1)..(2184): Ceres cDNA ID no. 21572611
  misc_feature (1)..(2184): Ceres CLONE  ID no. 482479
  misc_feature (1)..(2184): Also known as  Ceres CDNA ID no. 24355976
gatttttctaagtcttggtctcattcggcttcttcttgggaaatggccaatagcagcctaagccagaagttgatatcaattcagacacctccatgtataaatgcatctggtgctttgagtaggagttctcagtcacatcaaattaatgggatattggaagaatgctggcctctaaatatcaattccaagcctaaccaaggttttcgaagtgatgcacctatacagaatggattttaccctgggtcttcatctgggtccaaggaaccatcaatgaacatctcttcaattagctatgactatctcaatcataaaaatgattgtaagataattcctgatcacttcatcaacaatgtttcatcaaaatcatgtaagggttcagattcaaattgcaatgacatgacatctggaaaagattttgacttgaatgtgctgcttccaaatggttcatccaacagcttagttccccagtcaggtgttaggataattgatggagaaaagaacaatgaggagcgtcatgcggtgttgccttggcttagagggaagacaacttgtaagaatggagaacataacactgcaggagagtcgagattattccatgatgcctcattgtccaacaaagatgaaactggaaagggacctagcagaaaatttatgcacaatataacttcaattttgtgttctaatgacattgaggcaaggaggaaggagttaaacgaaagctctagtaataagaaaattcttggtgttcccatttttgatatggctcatatttctcctaagaaggagttgtcttcaatcacttctctgtctgtgtcgaatcctaatccatctgatgtggaagcagcgggaaataagaaaaaacggatatttgatatgaacttgccttgtgatgctgctgtcgttgagttggacaaagaagcattcactgaaactgctgttggtaagacaaggtctcctacaacagaagcagactctagaaatcaaattgatctgaacttgagtatgagtgaggacgaaggatctttcacaactataccaagtgacaatgtaaaaatgaaggcacaaatagatttggaagcccctgctcttcccgagacagaagaggatgctgttcttgaagaaaagctgcttgaaacttctctagcatcactgcaagtcccacaagacacagttgaactagcaaaggatgaacttatgacaaatgcagcagaggcaattgttgtcctgtcatctcttacctgtgatcaaggggatgattgtgtgatcagcaaaagtccatcagaaagtccaaaggtggacctgctaaattggtttgcagatgttgtttcctcatgcaaagataatgtagagggaaactgtgatgtttcaagggaaaaagatggcgaggacaacgaggggcattcctctgaaggaatggattactttgaggcaatgacattgaacatgccggagaccaaggaagaagactacatgcccaagcctcttctccctgaaaacttcaaattggaagaaacaactactttgttaccaactcggacacgaaaagggccagcaaggagagcgaggcagcggagggacttccaaagggacatccttccaggccttgcatcattgtcgaggcatgaagtgacagaagatcttcagacatttggagggcttatgagagcaacaggttatcaatggaattcaggattaactaggagaagctcatctaggaatggtggtggcagggggaggcgacgggtgcaagttgccccgtctcccctgacactggtggcaaccaatgaaactagcacccccctgatccagcagcttaacaatattgaagttggattggaggatagaagcctaacaagttggggcaagacaaccagaaggccccgccgacagaggtgcccggctggtaaccctccgttgatccagttaacctaatcaccataagaggcttaaaatttttagatgagaatttatagaggtaagcagggccggtttttgaattaatggaacaatgatgttctcaggcatgtggatttctcttgtaaatttcttcaacccgtatttgggtatatgcttgatttgtcagtctttggggtggtggtaccagcttgtattattcttaaataatgttgcatgatttcttctcattatctctttatagaactgttgagatataaaaaaaaaaaa

SEQ ID NO: 2928 - protein, 629 aa, Glycine max
MANSSLSQKLISIQTPPCINASGALSRSSQSHQINGILEECWPLNINSKPNQGFRSDAPIQNGFYPGSSSGSKEPSMNISSISYDYLNHKNDCKIIPDHFINNVSSKSCKGSDSNCNDMTSGKDFDLNVLLPNGSSNSLVPQSGVRIIDGEKNNEERHAVLPWLRGKTTCKNGEHNTAGESRLFHDASLSNKDETGKGPSRKFMHNITSILCSNDIEARRKELNESSSNKKILGVPIFDMAHISPKKELSSITSLSVSNPNPSDVEAAGNKKKRIFDMNLPCDAAVVELDKEAFTETAVGKTRSPTTEADSRNQIDLNLSMSEDEGSFTTIPSDNVKMKAQIDLEAPALPETEEDAVLEEKLLETSLASLQVPQDTVELAKDELMTNAAEAIVVLSSLTCDQGDDCVISKSPSESPKVDLLNWFADVVSSCKDNVEGNCDVSREKDGEDNEGHSSEGMDYFEAMTLNMPETKEEDYMPKPLLPENFKLEETTTLLPTRTRKGPARRARQRRDFQRDILPGLASLSRHEVTEDLQTFGGLMRATGYQWNSGLTRRSSSRNGGGRGRRRVQVAPSPLTLVATNETSTPLIQQLNNIEVGLEDRSLTSWGKTTRRPRRQRCPAGNPPLIQLT

SEQ ID NO: 2929 - DNA, 1797 bp, Zea mays
  misc_feature (1)..(1797): Ceres cDNA ID no. 21572612
  misc_feature (1)..(1797): Ceres CLONE  ID no. 487539
  misc_feature (1)..(1797): Also known as  Ceres CDNA ID no. 25088211
aacaaagaagggaaacagaaccattctcccccgcatacctctgcctgcgccctgcgagtcttccctcgcttccattcctcattctgttctccgagagatctcgttctccgatgatcgccggttcttcgccgccggtcatcacatcccacctcggcagttcccagttcccaccaccagatcgccacgatgcaaccggagccacctacgccatccggaggcacgacgcccctccgcccgcgcgccgacatcacgaagggcctccctcgccacgacgccgtgctgtactgcccgtcgtgctgggcctaccgccaacccccggcgtcctgggtccgccgcgagccgcggtcctggatgagcactacgccgggtacggctaacgacgtagtaagaatccacctcgaccgcgtgcgccgccacatcgccggcctcggtctcacgatcaccgccgcgaggtccttctccaccacggcctgccccaggcgcttctacctacacctccgccttcgccgcgggcacgaggcgggaacggagccgcaggcgcacgtcgtcgagctcacctcgcacgaccgcctctgtgacgcctgcagccggtcccaggccgacccggaccgatggcccgccgtcgtgcaggtgcgccagcgcgcgtcaacgtcgtcgtcgtgccgccgcacgctcaaccacgtcatgtcgctgctcgtctgctaccgcggcaacgactcgctcctccgcgtggactgggacgcgggcgccggggtcctcgacgtgcacgtcgtgtcgcgcgcccacgccgcccgcttcgtccgcttcgtctcgaccgtcgcgcccgcccgcgtcgtcggcacggcgcggaggctcgtctcgcgcgacggcgagggcagcccctacagattgcacttcatctccgtggacatctgcccggtctgcgaggatgacctcgtcctcctgcacgcggaggcgtcccgcgccctcggccgcctggggcccctcgtcctgtgcatcaaggtcaccagctcgctcgcgctgctcgacaccggcaacatgcgcgtcgtggtggtaggcgtcgaggcgtgcgagcggttcaggatccagcccttgctcgaccgcggccgcctcgtcgagtacgtcgtgcttggcgtgcaacacgacccgtccggccacgtcgcggcgctcggtgcgagcttcatgatgtcgtgggcgcaggtcgtccgctcgtcggacgtgggcaagaaggacgccgccgtcatcaccgtgaagacgcacctcggctacgacctggagcctgggtgccacgcgctcggctacgacctctccggagacgacgtcttcggccatggcttggagaagtatgggaagagacacacgttgccagctgcggtgcttactcggaggtactacgacgatgacgaggactgggaggagagcgcaggcgggatgcaggacggcagggagggacgtcgcggcggcggcgggattgaagaggttaccacgggtattggatgcatggacctgaacccggccgacgacaagaacaccacagtaccatgacaccattccatcggctatgagtagcgagtaagcgacaagtgtttcatgtagtaccaccaacattaatccacggctgttgttgactcttattctaatgaatcataagccatgcattagatgactctagtcataccttagtctaaaaatctatcactggagttatacatgtagcagtgctcatgagtagatagcgagttgcaattttgttgcttctgataattcatcaattcttggctaaaaaaaaaaaaaaaa

SEQ ID NO: 2930 - protein, 452 aa, Zea mays
  misc_feature: PFam Name: NMD3; PFam Description: NMD3 family
  misc_feature: PFam Name: Mucin; PFam Description: Mucin-like glycoprotein
  misc_feature: GI Number: 34905738; NR Description: OJ1294_F06.10 [Oryza sativa (japonica cultivar-group)] >gi|20805202|dbj|BAB92870.1|
  misc_feature: GI Number: 15810403; NR Description: putative
  misc_feature: GI Number: 22136400; NR Description: putative nonsense-mediated mRNA decay protein [Arabidopsis thaliana] >gi|20466624|gb|AAM20629.1| putative nonsense-mediated mRNA decay protein [Arabidopsis thaliana] >gi|4582430|gb|AAD24816.1|
  misc_feature: GI Number: 66853650; NR Description: nonsense-mediated mRNA
  misc_feature: GI Number: 28574039; NR Description: CG3047-PA [Drosophila melanogaster] >gi|28380257|gb|AAF50957.3| CG3047-PA [Drosophila
MQPEPPTPSGGTTPLRPRADITKGLPRHDAVLYCPSCWAYRQPPASWVRREPRSWMSTTPGTANDVVRIHLDRVRRHIAGLGLTITAARSFSTTACPRRFYLHLRLRRGHEAGTEPQAHVVELTSHDRLCDACSRSQADPDRWPAVVQVRQRASTSSSCRRTLNHVMSLLVCYRGNDSLLRVDWDAGAGVLDVHVVSRAHAARFVRFVSTVAPARVVGTARRLVSRDGEGSPYRLHFISVDICPVCEDDLVLLHAEASRALGRLGPLVLCIKVTSSLALLDTGNMRVVVVGVEACERFRIQPLLDRGRLVEYVVLGVQHDPSGHVAALGASFMMSWAQVVRSSDVGKKDAAVITVKTHLGYDLEPGCHALGYDLSGDDVFGHGLEKYGKRHTLPAAVLTRRYYDDDEDWEESAGGMQDGREGRRGGGGIEEVTTGIGCMDLNPADDKNTTVP

SEQ ID NO: 2931 - DNA, 1116 bp, Zea mays
  misc_feature (1)..(1116): Ceres cDNA ID no. 21572613
  misc_feature (1)..(1116): Ceres CLONE  ID no. 498221
  misc_feature (1)..(1116): Also known as  Ceres CDNA ID no. 24358325
atggcttgaaccaaataaatccctcagtttgaaaactactaccaccccgcccccagcagacctctctacctcttatcccccgggccggcttgctcctactcacgccagcgccacagctgcacacgtcgctgttgacatcagagctgacgccaatggtgagggggctacccttcagctccctcttgtacaccaccactaactcagcccaggacaccccgcaactgtcaccgccgccagccgctcctccaccggcatggatgtggccctcctgcaagcacccaaggacgagccagtacttgcggaccccatccgccaccgccaagaccatcgcatccctcttcctggactccggggagtcgtccttcgccaactcctcggcgcggacgacgcgccacgtggactgcgcgtccgacagccagtccaccgagtccgaggccccggcggccgacgacttcgcggacgccatcgtccgggggctccgctccgacgaccgcctcctcttcgagccccacgggccctccagctccatcctcgagaggaagcctccggcggcgcctgccctgcggccgcgagcggcggcgtccttcgttgacggcgtcgcggtggcgttcgactccgccgacccgtaccacgacttccgggcttccatgcaggagatggtggccgcgcacggcatgggcgactgggactggctcgagaggatgctggcgtggtacctcggcgccaacggcagggacacccaccccgccatcgtcaccgcgttcgtcgacctcgtcgtcaccatggccgcggcgtccgcctccgcctgcgcctgcagctcctccagccgcgtctcttctttcacgttcgccagcagtagcgagccggccgagagcagcagcgccggcggccatttctccttcggcctgaggtaaacggtaaaccaaagcaaaccagccggccggacgctattatctggctcgtctcagtagctccggcgtgtatcaccatgcctgttgtcgtaactcgtgtgccagcaaccgtacgtgtgtgtgcgtgtgttgtgagatttatagttgtacctgatccaggttgattatatattttgcttgttgcggtacaaaaaaaaaaaaaaaa

SEQ ID NO: 2932 - protein, 253 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: Pkinase; PFam Description: Protein kinase domain
  misc_feature: PFam Name: Extensin_2; PFam Description: Extensin-like region
  misc_feature: PFam Name: Podocalyxin; PFam Description: Podocalyxin
  misc_feature: GI Number: 34908538; NR Description: P0423B08.18 [Oryza sativa (japonica cultivar-group)] >gi|15290117|dbj|BAB63809.1|
  misc_feature: GI Number: 21618162; NR Description: unknown [Arabidopsis thaliana]
  misc_feature: GI Number: 27375632; NR Description: blr0521 [Bradyrhizobium japonicum USDA 110] >gi|27348769|dbj|BAC45786.1| blr0521
  misc_feature: GI Number: 188864; NR Description: mucin
  misc_feature: GI Number: 41400384; NR Description: plus agglutinin
MVRGLPFSSLLYTTTNSAQDTPQLSPPPAAPPPAWMWPSCKHPRTSQYLRTPSATAKTIASLFLDSGESSFANSSARTTRHVDCASDSQSTESEAPAADDFADAIVRGLRSDDRLLFEPHGPSSSILERKPPAAPALRPRAAASFVDGVAVAFDSADPYHDFRASMQEMVAAHGMGDWDWLERMLAWYLGANGRDTHPAIVTAFVDLVVTMAAASASACACSSSSRVSSFTFASSSEPAESSSAGGHFSFGLR

SEQ ID NO: 2933 - DNA, 1176 bp, Zea mays
  misc_feature (1)..(1176): Ceres cDNA ID no. 21572614
  misc_feature (1)..(1176): Ceres CLONE  ID no. 498239
  misc_feature (1)..(1176): Also known as  Ceres CDNA ID no. 24358322
acaaacgcccattgccatcaaccccaccaccagcagcagacagcagaggcattgttagttccgaaagcacacgtctcacattagctacttccagccttcgtccaggacacgagaggaaaccgcagccatggccaacaaccgcacctacgaggagcatacccccgccgtcgagtggagccgctccgccgccgaggccgacgccgtcaagatctcgctcccagggttcaagagggaggacctccgcgtgctggtggacaaccacggccacctgcggacgcgcggcgagcggcacctcaccggcaacaggcgcatccgcttccagaacgacttcgagcttcccgccaactgcaacgccgacggcatccgcgccaagttcgagaacgagacactcaccatcacgctccccaagaagaccccctcgacgcccatgcagccgccgccaaggatgcccacggcggcgccgcctccgttgcagggccaggggcaggggcttccgccggcggccaggcctgccgcgccgaccccggcgccgctggctccagctgctccttccgtgaagccgcccgccgagtccagagcgtcgatgccgaggaagacgtacgatcctgtgccggcgccggcgccggaagtggaaccgcctgcaaccacaaagccccagccgtcgctgggggctgttcagaggctgaaggaggaggaggaggagaggaagagggaggaagaggggaagatggccgaggacaggaaggagatggtgcatgagaaggacacgcagcaggagcagcagccaatgctagcagagacgatggcgttggcgaacctgaagcccaggcaggcctccgcgaggcaaggcatgctggtgagcgtggcggtcgcggtggttgtgctgcttgggttcaccgtctacgtgtggcacagcctgaggaacgccacgggaggcgccggcggcgagcacggccacggacaccagctgtggaccggtagctacggcgacgagatgtgagcaagctagctcgaggtgtggcgtgagtacacagtacatctaagtggaaaggaagcaatgcaagtgtgcgtgtgtatatatagttatacacgcacacgtacatacacatatactacatacatgggaggctcagtccaaaaaaaaaaaaaaaaaaaaaaataaaaaaaaaaaaaaaa

SEQ ID NO: 2934 - protein, 290 aa, Zea mays
  misc_feature: PFam Name: HSP20; PFam Description: Hsp20/alpha crystallin family
  misc_feature: PFam Name: Mucin; PFam Description: Mucin-like glycoprotein
  misc_feature: PFam Name: Lamp; PFam Description: Lysosome-associated
  misc_feature: PFam Name: Syndecan; PFam Description: Syndecan domain
  misc_feature: GI Number: 18483234; NR Description: small heat shock-like
  misc_feature: GI Number: 50919779; NR Description: Putative small heat shock protein [Oryza sativa (japonica cultivar-group)] >gi|21397266|gb|AAM51830.1| Putative small heat shock protein [Oryza sativa (japonica cultivar-group)]
  misc_feature: GI Number: 21592618; NR Description: unknown [Arabidopsis thaliana]
  misc_feature: GI Number: 15242107; NR Description: heat shock family
  misc_feature: GI Number: 24417442; NR Description: unknown [Arabidopsis thaliana]
MANNRTYEEHTPAVEWSRSAAEADAVKISLPGFKREDLRVLVDNHGHLRTRGERHLTGNRRIRFQNDFELPANCNADGIRAKFENETLTITLPKKTPSTPMQPPPRMPTAAPPPLQGQGQGLPPAARPAAPTPAPLAPAAPSVKPPAESRASMPRKTYDPVPAPAPEVEPPATTKPQPSLGAVQRLKEEEEERKREEEGKMAEDRKEMVHEKDTQQEQQPMLAETMALANLKPRQASARQGMLVSVAVAVVVLLGFTVYVWHSLRNATGGAGGEHGHGHQLWTGSYGDEM

SEQ ID NO: 2935 - DNA, 1216 bp, Glycine max
  misc_feature (1)..(1216): Ceres cDNA ID no. 21572615
  misc_feature (1)..(1216): Ceres CLONE  ID no. 511078
  misc_feature (1)..(1216): Also known as  Ceres CDNA ID no. 24356059
acacaatacattcatccttgtgtttccgttcccgccattgcaaagggaaaaaaatggcttctgcgccatcgagaaccctaacggactttttccaacccgcttcgaagcgcttgaagcccactctccccgcatcatgcaaatccgacgacgccaatgcttccacgctctccgtcgatcagaagttgcgcatggaatacaacaagctcctcgccaagtccaagaggaatctcaaactctgcgtcgagagggtctccaaaagcaaaggtttaggtggcgtgaagctggaagagctgctggtggaagaaacgtggttggaagctctacctggtgaactccaaaaaccctatgccctcactctctccaaattcgttgaaagtgagatttcgggcggagacggcgtcattttccctccgacgcacttgattttcaacgctcttaactccacgccttttcatacagtgaaagctgttatccttggccaggacccttatcatggtcctggtcaagcaatggggctttcattctcggttcccgagggaatcaaagtcccttccagtttggtaaatatatttaaggaacttcaccaagaccttggctgctccattccaactcatggaaatcttcaaaaatgggctgtgcagggtgttctcttgctgaatgctgttctcacagtcaggaagcatcaagcaaattctcatgccaaaaaaggctgggaacaatttactgatgttgttatcaagaccatctcacagaagaaggaaggagttgtgtttctgttgtggggaaactctgctcgggaaaaatctaggttaattgatgcaagaaagcatcatgttcttactgctgcacatccttctggtttgtctgcaaatagaggcttctttggctgcaggcacttctctcgcactaaccaacttctggagcaaatggggattgatccaatagattggcaactataattattacctatagtttcaagcttcctttttccctttgattaggattatctttgaagcctactgctgtaagtttgcggagcttctgaagtcaatttccttaatgtgtagatgattctgtcgatttcaaatctacctagaaaagatgctttttgtcgatagtttgctcctgcagtgttgctaccttggagattctgctgtaatgcgtaatgaccattactatataggattttggcttaaccaaaaaaaaaaaaaaaaaa

SEQ ID NO: 2936 - protein, 301 aa, Glycine max
  misc_feature: PFam Name: UDG; PFam Description: Uracil DNA glycosylase
  misc_feature: GI Number: 21537176; NR Description: uracil-DNA glycosylase, putative [Arabidopsis thaliana] >gi|9294324|dbj|BAB02221.1| uracil-DNA glycosylase-like protein [Arabidopsis thaliana] >gi|15230152|ref|NP_188493.1| uracil DNA glycosylase family
  misc_feature: GI Number: 53611343; NR Description: COG0692: Uracil DNA
  misc_feature: GI Number: 26988146; NR Description: uracil-DNA glycosylase [Pseudomonas putida KT2440] >gi|24982878|gb|AAN67035.1| uracil-DNA glycosylase [Pseudomonas putida KT2440]
  misc_feature: GI Number: 48729760; NR Description: COG0692: Uracil DNA
  misc_feature: GI Number: 46907446; NR Description: uracil-DNA glycosylase [Listeria monocytogenes str. 4b F2365] >gi|47092026|ref|ZP_00229820.1| uracil-DNA glycosylase [Listeria monocytogenes str. 4b H7858] >gi|47019742|gb|EAL10481.1|
MASAPSRTLTDFFQPASKRLKPTLPASCKSDDANASTLSVDQKLRMEYNKLLAKSKRNLKLCVERVSKSKGLGGVKLEELLVEETWLEALPGELQKPYALTLSKFVESEISGGDGVIFPPTHLIFNALNSTPFHTVKAVILGQDPYHGPGQAMGLSFSVPEGIKVPSSLVNIFKELHQDLGCSIPTHGNLQKWAVQGVLLLNAVLTVRKHQANSHAKKGWEQFTDVVIKTISQKKEGVVFLLWGNSAREKSRLIDARKHHVLTAAHPSGLSANRGFFGCRHFSRTNQLLEQMGIDPIDWQL

SEQ ID NO: 2937 - DNA, 1239 bp, Glycine max
  misc_feature (1)..(1239): Ceres cDNA ID no. 21572616
  misc_feature (1)..(1239): Ceres CLONE  ID no. 511218
  misc_feature (1)..(1239): Also known as  Ceres CDNA ID no. 24356027
atcagcacacgatgagaaaaaagtttcccagtcatttatttcctcttttccatattttgttagaatcatgaaaagcttcaatgtcagtggttcatatactctgaatatcccttatcagttttcgatggcacatcttcccaattgcaagataaagattattcttcataatttgaaaggagaacattggactgttaattccgtgccaacaactagagtgcatactagtcacactctttgtggaggatggatggcctttgttcgtggtaataacataaaggttggagatatctgcatttttgagcttgtgcatgagtgtgaattacgtgttcgcattgctgaggttgcaaaagatgggtctgactgccaggttggaaacctagccattactaggcctagtgcaggacatgctgtaacttccagatgtatgccaatgaatcctaaagtcaactcaaaatgcataagaaaagttgatctatcggataagaagtggtcaaagattggtcaagaaactattttatccattgacttaaagaaatctagtagagcttcaaatacttctaagaagatggggctttgccctcagtcgaaagctgcccataaaaagttggctgctccaaggagacatcgtgttgacgatgaactaagctcacaggctaaagctggtttgagaatgttgtttgcactcgatgaacaaagagtagctcaagcttttacttccccttttcctagttttgtgaaaataatgaaaaagttcaatgtcagtggatcatacactttgaaaatcccataccagttctcagctgcacatctcccaacttacaaaactgaagttacacttcgtaattcaagaggtgaatgctggactgtgaactcggttccagatgcaaaaggtagaacagttcacaccttttgtggagggtggatggcctttgttcgtgataatgacatcaattttggagacacatgcatttttgaactcgttgctcaatgtgagatgcacgtttacatatctggggttggaaaggaagggcttgatcatcaaaatgggcatttaaaacttactaatagattagctaacgttccatctacctgctaacgttcttgtttgtgagaatcaatcttccatgaagatgtttgttttgagagtggcaaaagatcttttgcattttatgtacatattgcagtaatttcataccctcttgatatgtaaaaaaaaaaaaaaaaaaaaaaaaaaaaaaa

SEQ ID NO: 2938 - protein, 342 aa, Glycine max
  misc_feature: PFam Name: B3; PFam Description: B3 DNA binding domain
  misc_feature: GI Number: 34910734; NR Description: P0022F10.13 [Oryza sativa (japonica cultivar-group)] >gi|20160548|dbj|BAB89497.1|
  misc_feature: GI Number: 30694114; NR Description: transcriptional factor
  misc_feature: GI Number: 50428689; NR Description: putative transcirption factor(auxin response factor) [Oryza sativa (japonica
MKSFNVSGSYTLNIPYQFSMAHLPNCKIKIILHNLKGEHWTVNSVPTTRVHTSHTLCGGWMAFVRGNNIKVGDICIFELVHECELRVRIAEVAKDGSDCQVGNLAITRPSAGHAVTSRCMPMNPKVNSKCIRKVDLSDKKWSKIGQETILSIDLKKSSRASNTSKKMGLCPQSKAAHKKLAAPRRHRVDDELSSQAKAGLRMLFALDEQRVAQAFTSPFPSFVKIMKKFNVSGSYTLKIPYQFSAAHLPTYKTEVTLRNSRGECWTVNSVPDAKGRTVHTFCGGWMAFVRDNDINFGDTCIFELVAQCEMHVYISGVGKEGLDHQNGHLKLTNRLANVPSTC

SEQ ID NO: 2939 - DNA, 1511 bp, Glycine max
  misc_feature (1)..(1511): Ceres cDNA ID no. 21572617
  misc_feature (1)..(1511): Ceres CLONE  ID no. 511379
  misc_feature (1)..(1511): Also known as  Ceres CDNA ID no. 0
attaataataaaaataaacaaatatttactttcaaaattgtcttcaatgttttcagctacacttagaaagaatgctttgaatctttatagatgctcagctcgcaatttcactcaatcccaattcaacaacaagttctcctctaatttcttaaaacaaacctcaaataatgggttaactcaacctatgtttgctcctcttagcaccaggttctttggtaccgacaaaagtacaactgaaaagcttgtggaaggcgcagaacaattaaaagaaggcattcaacataagtatgatgaatggtctgatgctgcaaagattgcaactggtgagtccaaaagttggactgatagcgttaaagaaaaagtcaaagaaaaagttaaagaagaggtaaaagaaacagctaaagactgggttaagggaacaaattcaagtacaaaagaaacctatgaaaccgctaaaggctatgctcaagctgctaaagaaaaagtagaagaagtcgcaaagagtgatactgctcaaaatgtcgctgataaggctaaagattgggcagaaaccgctaaagaaaaagttcaagaggcaactagcagcagtactgctaaaaatgtcgctgataaggctaaagattgggcagaaactgctaaagaaaaggtacaagaaactgctaatcaaaccgaaaaaggtacctttgaaaccgctaaggattgggcgcagtcagctaaagaaaaagttgatgaggtcactcatagcaagtctgccgaaaacataactagcactattaaaaactgggcaaaggcagcctctgataaagttcaagaagctgtttcaggggaagatactacctctaagctcaagtctggtgttgaaaaagccgaggaaactgttaaagaaacagctcaaaatgtgacagaaaaagcaaaagattggtcacaatcaactactcaaacctcaactgagacagcaaaggaatggctcaaagctgctggagaaaaggcttctgaagctaaagaaactgctcagggtgctactgaaacagccaaagaatggcttggaacagctaaagataaagttggagatcttaaagaaggagctcaagttgctgctgaaaaagcaaaagagtggactcaaaccgcaaaagaaggtgttcaaaccgcaacagagaaagcaaaagattgggctgaagttgctaaagaaaaagttcatgacgcaaaggaagtcactgaaggcttaaaaagcaaaggtgaagaactttatgaaactgccaaagaaaaggctcaagaagtagctaacaaatttaacaagaaataaggtagtagtaataaatttagtattgttagttggcttattctaactacaaaaagttaaatatcattattttcttgcattttcagattatatataaacaacttattatctaattttcgtatcccaaggcgagttactatttgtatatattcagtatcataattgtgttaataaaataaagatttctaaacctttaaaaaaaaaaaaaaaa

SEQ ID NO: 2940 - protein, 418 aa, Glycine max
MFSATLRKNALNLYRCSARNFTQSQFNNKFSSNFLKQTSNNGLTQPMFAPLSTRFFGTDKSTTEKLVEGAEQLKEGIQHKYDEWSDAAKIATGESKSWTDSVKEKVKEKVKEEVKETAKDWVKGTNSSTKETYETAKGYAQAAKEKVEEVAKSDTAQNVADKAKDWAETAKEKVQEATSSSTAKNVADKAKDWAETAKEKVQETANQTEKGTFETAKDWAQSAKEKVDEVTHSKSAENITSTIKNWAKAASDKVQEAVSGEDTTSKLKSGVEKAEETVKETAQNVTEKAKDWSQSTTQTSTETAKEWLKAAGEKASEAKETAQGATETAKEWLGTAKDKVGDLKEGAQVAAEKAKEWTQTAKEGVQTATEKAKDWAEVAKEKVHDAKEVTEGLKSKGEELYETAKEKAQEVANKFNKK

SEQ ID NO: 2941 - DNA, 1384 bp, Glycine max
  misc_feature (1)..(1384): Ceres cDNA ID no. 21572619
  misc_feature (1)..(1384): Ceres CLONE  ID no. 512056
  misc_feature (1)..(1384): Also known as  Ceres CDNA ID no. 0
gaaatcaccggaattgccgtaaatgccgcctatgacaacacgctgcgaatcgacaaatcaaatgcctccgtggaccactcaggtcctctttcccatttccactcttcaattcaattaatatctcacacacacacactctctctctcatacacacacaaagttccctctccaaacatggcggcaattttctcttcttcgctcttcgtttcttcgcctcttcccaaaccactttcttcctcctattcccgaatccataaagctccacaacttttcagggctcgctcctcgctccttcaggataaagaggaaaaagtgatcgtgcaggattcattcccctccaaaacctctcctcttcactccgctgataaatcaactagtggaaactcgattaacacctctgcgttcgagaaacggattatcaaggtcgaacaatcggtgaatatctttctcacggattccgtcataaagatacttgatactctgtaccatgatagacactatgcaaggttttttgtgcttgaaactattgccagggttccttactttgcctttatgtcagttctccatatgtatgagagttttggctggtggagacgggcagactatctgaaagtgcattttgctgagagctggaatgaaatgcatcatttgctcatcatggaagaactaggggggaatgcttggtggtttgaccgctttctcgctcaacatattgcaatattttattatattatgacagttttaatgtatgcagtaagcccaagaatggcatatcacttttcggaatgtgtagagagtcatgcatttgaaacttatgacaaatttatcaaggtccaaggagatgaattgaaaaaaatgccagctccagaggttgctgtgaattattatacaggagatgacttgtatttatttgatgaatttcaaacttccagagttcctaattcaagaagacctaagatagagaatctgtacgatgtatttgtaaacatcagagatgatgaagctgaacattgtaagacaatgaaggcttgtcaaacccatgggaacctccggtcacctcattcatatgcagaggatgatgacagctcagtctgtgctcttgaagcagattgtgaaggaatagtagactgtataaagaaatctgttacttctaatgcagctaaggtgaagtaagataagtggcacaatacatagtacattcatttaataagataggaggcagagaataataattggaggtagtaaatagttgaaatttggataaggttgctctccggttaattgtctttatagaaagtaaaggttaaatattcataccacacactctgaggattatcaaagaaaataatattatggagattgtctaaaaaaaaaaaaaaaaaaa

SEQ ID NO: 2942 - protein, 332 aa, Glycine max
MAAIFSSSLFVSSPLPKPLSSSYSRIHKAPQLFRARSSLLQDKEEKVIVQDSFPSKTSPLHSADKSTSGNSINTSAFEKRIIKVEQSVNIFLTDSVIKILDTLYHDRHYARFFVLETIARVPYFAFMSVLHMYESFGWWRRADYLKVHFAESWNEMHHLLIMEELGGNAWWFDRFLAQHIAIFYYIMTVLMYAVSPRMAYHFSECVESHAFETYDKFIKVQGDELKKMPAPEVAVNYYTGDDLYLFDEFQTSRVPNSRRPKIENLYDVFVNIRDDEAEHCKTMKACQTHGNLRSPHSYAEDDDSSVCALEADCEGIVDCIKKSVTSNAAKVK

SEQ ID NO: 2943 - DNA, 1712 bp, Glycine max
  misc_feature (1)..(1712): Ceres cDNA ID no. 21572620
  misc_feature (1)..(1712): Ceres CLONE  ID no. 512967
  misc_feature (1)..(1712): Also known as  Ceres CDNA ID no. 24355992
taattcaattaaacacttcaaacaataaattttcctaactacaaacaccttctcatatgcaacaacaacaagcctatccccctttctacaacggccaactcgatggtatcccttccagcaatccgctcaacaagcctgtccaatcattctcacctgaaaaatcagcaagaactgataaatctcaaactggtcaaccagaacctgttcctctcagagacagccacggatcaatctcccctcaaaaacaagcatattcctccacagaaccacaacaaactactactggtatcatccgacctattgatatcaatactctgagaactactcaacctttaccccaaactcatacgccctctcctttaagaccattggaagagttattgagtggattgagtccagaaatgattaatgaaatcaaatcaaaggttgtccgtactacagatccaaaattcgattcacaattgcgaactgatattcaaacaaatattcgttcaacaaagccagaggataaaattagcagtgtttatagcactcttagtcgtcatgaactcatctcaccagacagatataccaaaacttatggtaattattcaactgcagatactcaaaatggtcgtaattctggccttcatgaaagagctcataaccctcatatcgatatcacatcatgtgtgaatgatgatactaaagcaagtgtaaaggcaggaattcaagatggatataccacaccagtaacaggaaatactatgcatgaaaaagaacttctcaaaactcccaaaaagcatgagaggatacctgaaaatgaaattgaagaatctcctgagaaaactggatctggctctgttaaaagaagcagacaagtccgaagatcttatggtgatctcgatagcattctatcccctcaatcaagactccgtacaagctcagtaactgctgatggacttcctgatagaacacatctcgtgtccagtattaatagtgcccttcaaaaatctgcgggaagagaaagattgttatcgacaccatcaaagatatcaataacaagacattctgctttaagtcctgcaaagtttgaagtggaaaagttatttaaagagaaatatgaagatggatcaatctatgaaggagacgccaaggatggcattagacatggaaaaggaaagatttactatgcagatggaatggttttcgaaggaagatttagtgaaggagtgatgaatggaccaggagttctttggtataagaatggaaagctgtgctttgaaggagattataaaggagataagtttgatggacatggaatattgtataatggattgattggagatatgagaagcggatttgattatagagattttggaaagattagcaatctatggatgaagtatgaaggagattttgtgaaggataagaagaatggatcaggaactttgtattttataaatggagaaagatattttggagagtttagagatgataaggtgaatggaaaaggaactttttattttgttgatggaaagagtatgactggtgtttgggaaaataatcttctcaaacaaactctttagagagatttttatataatgaaatatgttagtagctgtcttatataagtttttgaattaatttttgctttttatattgagagaatatacattgtcaatacattattaaaagaaaattttcattcttttgaaaaaaaaaaaaaaaaa

SEQ ID NO: 2944 - protein, 503 aa, Glycine max
  misc_feature: GI Number: 50405025; NR Description: Phosphatidylinositol-4-phosphate-5-kinase, putative [Paramecium tetraurelia] >gi|50057402|emb|CAH03386.1| Phosphatidylinositol-4-phosphate-5-kinase, putative [Paramecium
  misc_feature: GI Number: 40063384; NR Description: MORN repeat family
  misc_feature: GI Number: 23481997; NR Description: MORN repeat, putative
  misc_feature: GI Number: 50355990; NR Description: morn [Homo sapiens]
  misc_feature: GI Number: 40062709; NR Description: MORN repeat protein
MQQQQAYPPFYNGQLDGIPSSNPLNKPVQSFSPEKSARTDKSQTGQPEPVPLRDSHGSISPQKQAYSSTEPQQTTTGIIRPIDINTLRTTQPLPQTHTPSPLRPLEELLSGLSPEMINEIKSKVVRTTDPKFDSQLRTDIQTNIRSTKPEDKISSVYSTLSRHELISPDRYTKTYGNYSTADTQNGRNSGLHERAHNPHIDITSCVNDDTKASVKAGIQDGYTTPVTGNTMHEKELLKTPKKHERIPENEIEESPEKTGSGSVKRSRQVRRSYGDLDSILSPQSRLRTSSVTADGLPDRTHLVSSINSALQKSAGRERLLSTPSKISITRHSALSPAKFEVEKLFKEKYEDGSIYEGDAKDGIRHGKGKIYYADGMVFEGRFSEGVMNGPGVLWYKNGKLCFEGDYKGDKFDGHGILYNGLIGDMRSGFDYRDFGKISNLWMKYEGDFVKDKKNGSGTLYFINGERYFGEFRDDKVNGKGTFYFVDGKSMTGVWENNLLKQTL

SEQ ID NO: 2945 - DNA, 1555 bp, Glycine max
  misc_feature (1)..(1555): Ceres cDNA ID no. 21572621
  misc_feature (1)..(1555): Ceres CLONE  ID no. 514347
  misc_feature (1)..(1555): Also known as  Ceres CDNA ID no. 25088213
ggaggagaagagagagaaagagaaaaactcaaagtcatcatcatctaccatggcaaattctgtggcattttccgacgagattcctaacatgagcatgagcttccctttctcccctgctttctctagtagcatctttgacatgatgccaccaccaccaccttcctcatctcacgatcctaaagctcccaactttgctaatagcttcatggacttgctcgctgtccctgctgattattataccccttctttattcgactggtcccaaaacaccgcccccacgtcagcaccaccaccttccaccacccaaatcaaccaccctcttccgtcgccagccagctccaatgtccccgacggctccgaggttctcaacactccggcgtctcccaattcttcgtctatttcatcatcgtccaacgaagcagcagccgccaccaccgccaacaaaacaacgggaaatgataatgaagaggaggaagatgaaacagcaatagatgcaacagcaggcagagaagaagaagatcatcaagaccaagacaagactaagaaacagctcaagccaaaaaagaagaaccaaaaaaagcaaagagagccgagatttgcgttcatgacaaagagtgaagtggatcacctcgacgatggctatagatggcgcaagtacggtcaaaaagccgtcaaaaacagccctcatccaaggagctattatcgttgcaccaccgcgacatgcggcgtgaagaagcgcgtggagcgttcctcggaggatcctacggtggtggtgacaacctacgaggggcaacacactcacccgtgtcctgccacgtcacgggctagcttcgggttcatgcactccgaagcaagtgggttcggacccaccagtggactaggttcggcacactttatgctgcaacaacaacaacagtttcgggaccaagcacaagcacaagcagcaatgttgtataactccacctcatcgtcattgtcattgccactgaatgttgttaactcagcttcttgtgttaataatagctatgccaatacgtcatcgttgagtggctttcttcagggccaagagaatcatcagcgaggttttgtgccgtctagggtggtggctcctcatattttcttgagggacaatgggcttcttcaggacattgttccaacgcagatggggaatgaggagaatgaagatcgtgtgtaggtgatgatcatcataatatatagtcatattttgggttaattaattaatcatagaacttaattatgacaaattagtttattttaattattttgttgtatattaattatatgtatctttgtatggtatattattatgtaccgttggttctttagctaactgaactaatggtgaaaagtgaaaacctctatgggcgggcttcttggggtgttttgtgttttactttagaggttaccatagagaaacctcgcttcaactgatggcttgtgttcatatgaaacattttggaggttcccactttttatggttagataatagatatatatggagggactttgtattctgaaaaaaaaaaaaaaaaaa

SEQ ID NO: 2946 - protein, 381 aa, Glycine max
  misc_feature: PFam Name: WRKY; PFam Description: WRKY DNA -binding domain
  misc_feature: GI Number: 30017307; NR Description: At2g47260 [Arabidopsis thaliana] >gi|26450898|dbj|BAC42556.1| putative WRKY-type DNA binding protein [Arabidopsis thaliana] >gi|2275204|gb|AAB63826.1| putative WRKY-type DNA binding protein transcription factor 23
  misc_feature: GI Number: 21536889; NR Description: putative WRKY-type DNA
  misc_feature: GI Number: 33519200; NR Description: WRKY16 [Oryza sativa (japonica cultivar-group)] >gi|34912866|ref|NP_917780.1| putative DNA-binding protein homolog [Oryza sativa (japonica cultivar-group)] >gi|11761085|dbj|BAB19075.1| DNA-binding protein
  misc_feature: GI Number: 46394352; NR Description: TPA: WRKY transcription
  misc_feature: GI Number: 51854273; NR Description: WRKY transcription
MANSVAFSDEIPNMSMSFPFSPAFSSSIFDMMPPPPPSSSHDPKAPNFANSFMDLLAVPADYYTPSLFDWSQNTAPTSAPPPSTTQINHPLPSPASSNVPDGSEVLNTPASPNSSSISSSSNEAAAATTANKTTGNDNEEEEDETAIDATAGREEEDHQDQDKTKKQLKPKKKNQKKQREPRFAFMTKSEVDHLDDGYRWRKYGQKAVKNSPHPRSYYRCTTATCGVKKRVERSSEDPTVVVTTYEGQHTHPCPATSRASFGFMHSEASGFGPTSGLGSAHFMLQQQQQFRDQAQAQAAMLYNSTSSSLSLPLNVVNSASCVNNSYANTSSLSGFLQGQENHQRGFVPSRVVAPHIFLRDNGLLQDIVPTQMGNEENEDRV

SEQ ID NO: 2947 - DNA, 1387 bp, Glycine max
  misc_feature (1)..(1387): Ceres cDNA ID no. 21572622
  misc_feature (1)..(1387): Ceres CLONE  ID no. 514382
  misc_feature (1)..(1387): Also known as  Ceres CDNA ID no. 0
aatattgagcttgataataaaatctactctcaaccatctgagggtgctttaaatcctagctattatatcaaagccaaaatgagagatgatacctggcatctcgcgaaaattatcgattgtcgtccagtgagagatcttgatttgaaaaaaaagaagaacgattattcctacgagtattatgtccattaccaagactttaatagaagaaatgatgaatggaccacacgttccagaatcatgcctcttgaaatgttgattgaagaagaacacaccaagaaaaagagaaagggtgaagataaaaagcatcagcaacatcatcccgacaataacgtcgatgacgaacatcagggtatggatgccgcagacttattagcccacgaacaggctaccaagctaaaaactatcgattatattcagatgggaaaacacaagtgcgaaacttggtatttctcgccttacccaaaaagatgtcagaatattccatgcttattcatttgcgaattttgcctctcattctatatctcaaaagaagagctactcagacatagccaaatctgtactttgactcatccacctggagatgaaatttatcgacacgggaataactcaatgtacgaaattgatggacagagaaactctacatattgcgaaaatcttggctatttagctaaactgttccttgatcacaaaacattatattttgatgtgaaaccctttttgtattttgtcttgactgaaaacgatgaacatggaagtcatatggtgggctatttttcaaaagaaaaggattctccagaatataatttggcctgtattcttaccttgcctttccaccaaagaaagggatacgggaaacttttaatcacattttcatatgagctctcttacattgaaaagaaggttggaactccagagagaccattatcagatttgggaagagagagttatatttcatggtggactcaacgaatcattgagtatattaaaaaaactcaaggcaaaacctactcaatccaagacattacagatgaaaccatggttcatggtgatgatattgtctatatctttgaaaaatataatttgatcaaatacactccaggaggatattatttatgcactgacactgccgttttagataaattattcaaaaatgcaggaagaccaggtcgggaatgcgcaagagataaaattatctgggtcccatatcacgtcaaaaatgaatcaacttgattgtttctctttaacgtattattaattcttgtatttttgaattgactttctaaactagttatctaactccataaaggtttgtctgtttgttgtcaataatttttagatattctcataatatggttattataaaatcatcaaaaaaaaaaaaaaaaaa

SEQ ID NO: 2948 - protein, 383 aa, Glycine max
MRDDTWHLAKIIDCRPVRDLDLKKKKNDYSYEYYVHYQDFNRRNDEWTTRSRIMPLEMLIEEEHTKKKRKGEDKKHQQHHPDNNVDDEHQGMDAADLLAHEQATKLKTIDYIQMGKHKCETWYFSPYPKRCQNIPCLFICEFCLSFYISKEELLRHSQICTLTHPPGDEIYRHGNNSMYEIDGQRNSTYCENLGYLAKLFLDHKTLYFDVKPFLYFVLTENDEHGSHMVGYFSKEKDSPEYNLACILTLPFHQRKGYGKLLITFSYELSYIEKKVGTPERPLSDLGRESYISWWTQRIIEYIKKTQGKTYSIQDITDETMVHGDDIVYIFEKYNLIKYTPGGYYLCTDTAVLDKLFKNAGRPGRECARDKIIWVPYHVKNEST

SEQ ID NO: 2949 - DNA, 1257 bp, Glycine max
  misc_feature (1)..(1257): Ceres cDNA ID no. 21572625
  misc_feature (1)..(1257): Ceres CLONE  ID no. 517142
  misc_feature (1)..(1257): Also known as  Ceres CDNA ID no. 0
tgaaatacattattctatgtgctaacatgttgaaatggtttatataactggtttcaaatttcagttttagttgaaaatgttttctggtatgacagttttagttgaaacatacatctggcaggtgatttagctattgtgggtatgcttggtttttatgattgatggcttcattttttttccattttaacttttaataaattctctatttttatcttgaagtagattctttgtgtgtttaggtcatgccgccactatggtgcaggattgataggctatggtatccccatcctggtattttggaagggtccatgactagacaaccttttctctgtcctttggaccacgtatttgaggtgaatgtcatgttgaaaaagctccctgaagaagagtttggtcctcaaatagattttagagagtactcaatacttgataatccttctcttccatcagaggtaaaaaagtcttggcttgatgttcagctctgtaaagatggaacccaagattgtgatgcatcagcatcaaatgataccactgttgggggagtacttaaatttcccaagcacagcaatgaagaaatgtttatgaaagtattctcgtcactcaaggatgtaaaagtgatcaagttctctacagtgcaagatgcattcacaggttttactgacaaggaaagggaagaaaaattcagaaatcgtgttaagcggtatgtgggcatatggtgctgtgtgccagatcacagtcctggtcatatatattatgatatgtactgggatgagaaaccaggatggaaagcagttcctcctcaaacttctgaggatgatcatccaccgtattgaaatcaacttagatttgtgtttgttaaaacattgatggataggggaataagagacataaatccaaaggagatttaatttccaactaattgtcaacacaaagattgtaaactttcacaagtgaagaatctgtatccatattgaggatgtaagatattcatagagattagacaattggttcttttgtaacaatttagaatttttttttggctttgtatcatgttatcaatatattgcagtcaagagaaatggaggccgggaatttcttaagaggatgcactttttggtctttgatgtcttagtagatcttttatttgactgtaattaaatactggagacattcaattgtatcactcttttcttccatattttattttgaacagaaaataaatggtgtttgattttctgctgtccaaaaaaaaaaaaa

SEQ ID NO: 2950 - protein, 196 aa, Glycine max
MPPLWCRIDRLWYPHPGILEGSMTRQPFLCPLDHVFEVNVMLKKLPEEEFGPQIDFREYSILDNPSLPSEVKKSWLDVQLCKDGTQDCDASASNDTTVGGVLKFPKHSNEEMFMKVFSSLKDVKVIKFSTVQDAFTGFTDKEREEKFRNRVKRYVGIWCCVPDHSPGHIYYDMYWDEKPGWKAVPPQTSEDDHPPY

SEQ ID NO: 2951 - DNA, 1563 bp, Glycine max
  misc_feature (1)..(1563): Ceres cDNA ID no. 21572626
  misc_feature (1)..(1563): Ceres CLONE  ID no. 519446
  misc_feature (1)..(1563): Also known as  Ceres CDNA ID no. 24356066
gggcaaagcgcaatttcctgatggaaactgagccgaaataagagaacatggcatttgcagttagggctttatgggcagtgagaaagagttgcagaggaagtcctcgccgttattgtttcagcaaacatgcgcattcaaattcaaattcacattcaaattcaaatccccttctcttgaaattgcttcaggttccgaactcgcacattaaaacgacgctggatcaggaaatggcttcccttcaaagctcgcaacgttcttgggacttccttattacctctctctccccttcttcctccgacaaagctcgattgattttggaatggattttggagaagatgctgaaagaaaatgagaaagatcgagatctcttctctgaactcatctttctatgtggaaaagtgaaggacgtgatgctaggaatgcgtgtgtttagttctatggaggctactggagttaaacccaattcactagttttcaattcccttataagtgtttgtttgtcttcccatgatattgttacagcagttagtttatttgagatcatggagagttcagagagctataaacctgattttcacacttataatatctttatttcagcattttccaagtcagggaatgttgatgccatgttagcttggtactcagcgaagaaggctgccagacttggtcctgatcttcaaatgtttgaatccctcatatcaggctgtgttaattctagaaagtttaagattgctgatagaatttttgaagaaatgatgatttctggaattgttcctagtgcttccataattgaaagtatgcttaatgggatttgcaagcaaaagagattgggtcgggcagaggagtttttcacgtttgcgatggattctggatgggaaataaatgagaacatggttgataagttagtagctatgtatcttcaactagggaaagcggaagaaatggaaggtctacttaaaactatgatgaagccctgtgttactactactggtgttctcacacgaattcattgtgggattgtgaagatgtatgcaatggtagatagattggatgatatagagtttgctgtgggtagaatgcttaaacaagggttgtcattcacaagtgcagatgatgttgaaaaggtcatctgctcatactttagaagggaagcttatgataggctagacatattcttggaatgtttaaagagatgctatgtccttaataaatcaacatatgatttgttgatatctggctataaaagagcacgcttgcttgaaaaagtagaaagggtgatggaagacatgaaatcagcaggattagtttaatgtttggtgtgacgattacggataagctccatgacatttgcaccaagcagcaatattgaatataccatcaaatgaattctgaaagttcagtgtcattttaccatttctccctctctatcaagctaacaacgggattgaggaagggttgttatgtcaaatttaggcttctgtataattgacacaggccatgcaattttgactgttaatgtgacttcaacaacctcgtgtaaagaaaaaaaaaaaaaaaaaa

SEQ ID NO: 2952 - protein, 421 aa, Glycine max
  misc_feature: GI Number: 34896698; NR Description: putative pentatricopeptide repeat protein [Oryza sativa (japonica cultivar-group)] >gi|28875991|gb|AAO60000.1| putative pentatricopeptide repeat protein [Oryza sativa (japonica
  misc_feature: GI Number: 50938865; NR Description: putative pentatricopeptide (PPR) repeat-containing protein [Oryza sativa (japonica cultivar-group)] >gi|34393454|dbj|BAC82993.1| putative pentatricopeptide (PPR) repeat-containing protein [Oryza sativa
  misc_feature: GI Number: 20465657; NR Description: putative salt-inducible protein [Arabidopsis thaliana] >gi|18175643|gb|AAL59902.1| putative salt-inducible protein [Arabidopsis thaliana] >gi|3757517|gb|AAC64219.1| putative salt-inducible protein
  misc_feature: GI Number: 50935497; NR Description: putative pentatricopeptide (PPR) repeat-containing protein [Oryza sativa (japonica cultivar-group)] >gi|33146978|dbj|BAC80051.1| putative pentatricopeptide (PPR) repeat-containing protein [Oryza sativa
  misc_feature: GI Number: 3107905; NR Description: leaf protein [Ipomoea nil]
MAFAVRALWAVRKSCRGSPRRYCFSKHAHSNSNSHSNSNPLLLKLLQVPNSHIKTTLDQEMASLQSSQRSWDFLITSLSPSSSDKARLILEWILEKMLKENEKDRDLFSELIFLCGKVKDVMLGMRVFSSMEATGVKPNSLVFNSLISVCLSSHDIVTAVSLFEIMESSESYKPDFHTYNIFISAFSKSGNVDAMLAWYSAKKAARLGPDLQMFESLISGCVNSRKFKIADRIFEEMMISGIVPSASIIESMLNGICKQKRLGRAEEFFTFAMDSGWEINENMVDKLVAMYLQLGKAEEMEGLLKTMMKPCVTTTGVLTRIHCGIVKMYAMVDRLDDIEFAVGRMLKQGLSFTSADDVEKVICSYFRREAYDRLDIFLECLKRCYVLNKSTYDLLISGYKRARLLEKVERVMEDMKSAGLV

SEQ ID NO: 2953 - DNA, 1148 bp, Glycine max
  misc_feature (1)..(1148): Ceres cDNA ID no. 21572627
  misc_feature (1)..(1148): Ceres CLONE  ID no. 524154
  misc_feature (1)..(1148): Also known as  Ceres CDNA ID no. 24356055
aactcaataatcccttccctggttcccatcatggacgaattagaagaaaccctactcacccaaatcgactgggaatcgttcctcgacgacatacctgaacttaacgtcgatgattttttgcaggacgacaacgccgttcctgttgttaccgacaatcattcctccccgaacgacgaccccgttttgtccgagatcgagaacatgctcatgacgcaggccgaaaacgacgctgtcgttttgcccgagacgccgtcttcggaggccgggtattacaagctcttcgaggagattctggtggaggagcccaaggaaggacccgtgagcccgccttcaaaaatagagtccgaggaaggctccgacaaagacaagaccgatgatgctgcttccgatgaacccatgtcgaagaaattaaagaggcagttgaggaacagggatgctgctgtgaggtcaagggagaggaagaagttgtatgtgaaaaaccttgagatgaagagtaggtacctagaaggggaatgcagaagactggggcatttgctccagtgctgctatgctgagaacaacgctttgcggctttgcttgcaattgcgtggtacatatggtgcttcaatgaccatgcaggagtctgctgtgctcttgttggaacctctgctgttgggttccctgctgtggtgcatgggcatcatatgccatctcagtctgcctctaatgctgtgggttgcagcagtacttccaagagaaaacatcgagcagaagggcctaagaagggtaactcaaaaaggatcagaaagtaagatctctgagtgtttccagatgcaatcatttttaaagagtagaaaaagccgagcttcaagaacaaagatgaaattcaattttatagtgttctaatgttctataacttctgaagtgggggctctaaggttttctattcatctcttctttctttcgttcgttttctcttttgttttattggatttataaatacggtcgaacttgttagaggttctgtgatatgcttttttaggtgctgttcttgtaacttatattgggaccataacatgttgcgttcttatctttaacatagacgtcgttttgagtttttggcagttcaatgaaacttattgtttgcaccacttgaaaaaaaaaaaaaa

SEQ ID NO: 2954 - protein, 284 aa, Glycine max
  misc_feature: PFam Name: bZIP_1; PFam Description: bZIP transcription factor
  misc_feature: PFam Name: bZIP_2; PFam Description: Basic region leucine zipper
  misc_feature: GI Number: 22136790; NR Description: putative bZIP transcription factor [Arabidopsis thaliana] >gi|15028323|gb|AAK76638.1| putative bZIP transcription factor [Arabidopsis thaliana] >gi|25405103|pir||E96497 probable bZIP
  misc_feature: GI Number: 51090849; NR Description: bZIP transcription
MDELEETLLTQIDWESFLDDIPELNVDDFLQDDNAVPVVTDNHSSPNDDPVLSEIENMLMTQAENDAVVLPETPSSEAGYYKLFEEILVEEPKEGPVSPPSKIESEEGSDKDKTDDAASDEPMSKKLKRQLRNRDAAVRSRERKKLYVKNLEMKSRYLEGECRRLGHLLQCCYAENNALRLCLQLRGTYGASMTMQESAVLLLEPLLLGSLLWCMGIICHLSLPLMLWVAAVLPRENIEQKGLRRVTQKGSESKISECFQMQSFLKSRKSRASRTKMKFNFIVF

SEQ ID NO: 2955 - DNA, 1455 bp, Glycine max
  misc_feature (1)..(1455): Ceres cDNA ID no. 21572628
  misc_feature (1)..(1455): Ceres CLONE  ID no. 524433
  misc_feature (1)..(1455): Also known as  Ceres CDNA ID no. 24356043
gtctctcacacacacaaaaaaaaagctgttcaaacttcaaaatagaaccctcgctctccctttgttgtatgagagagagagagagagaacgatttgttttgctttacaaaactctctctcatggctctcctaacttccttgcctgaacagttctccattacccccaaacgccacaaacgtaagccacaacaacaacaacagaaacaaaagcaaaagcaaaagcaaaaacagaaacagaaaccagcctcttcatgggaccaaatcaagaacctcttaacctgcaaacagatggaagagtcgagagtgcacgacccttcgaaaataactgggtactcgaagctagggtcttcttgcagctccatatgcagcttcagagatgtggttcatgggaacacacgtgttgtgcataggtctgataactcctcaccagagagtagttctctgggtcaggaaactaatgggttactcactaggaaacctgttactactactactactcgttccgcaaaatcaaacggcggagcaacctgcacgtcatcatcatcatcttccagaggcatgcaattcaggaagctttctgggtgttatgaatgtcacatgatcattgaccctagcaggttaccaattgcgaggagcactgtgtgtgcttgctctcactgtggtgaggtcttccctaaaatggaaagtttggagcttcatcaagctgttcgtcatgccgtttcggagctaggtccggaggattcgggtcggaacatagtggaaataatcttcaaatcgagctggttgaagaaggacaacccgatttgcaagatcgaacggatactaaaagtgcacaacacccaacgcaccatccaacggtttgaggagtgcagggacaccgtaaagaaccgtgcgctgggcagcaccaagaaaaaccccaggtgcgcagccgactgcaacgaactcttgcggttccactgcaccaccttaacgtgcgcactgggtgcacgtggctcttcctccctctgcgcctccgtacccggctgcagcgtctgcaccatcatcaggcacggtttccaaggcgggtgcggcggcggtggagaccacgcgagggcgaagggcgtgagaaccaccgccagcagcggtcgggcccacgactctgtggtgtgcggtgacgccacgcgcagggccatgctggtgtgtcgcgtgatcgcgggcagagtgaagcgcgtggtggaggacgcgccgtcggaggaggaacacgtgtcgtatgattccgttgcggggtacgctggaatctactcgaatctcgaggagcttgttgttttcaatccaaaggctatccttccttgtttcgtggtcatttacaaagttcctttgtgttagtttagttaatgcacgtttagacatccgttaaaaagtcattcaacggaaagaaaaacacatttttagacacctaaaaaaataaaaaaaaaa

SEQ ID NO: 2956 - protein, 414 aa, Glycine max
  misc_feature: PFam Name: zf-C2H2; PFam Description: Zinc finger, C2H2 type
  misc_feature: GI Number: 9802582; NR Description: T2E6.3 [Arabidopsis thaliana]
  misc_feature: GI Number: 15222333; NR Description: zinc finger (C2H2 type) family protein [Arabidopsis thaliana] >gi|9369383|gb|AAF87132.1|
  misc_feature: GI Number: 5777616; NR Description: CAA30374.1 protein [Oryza
  misc_feature: GI Number: 62701936; NR Description: Zinc finger, C2H2 type,
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
MALLTSLPEQFSITPKRHKRKPQQQQQKQKQKQKQKQKQKPASSWDQIKNLLTCKQMEESRVHDPSKITGYSKLGSSCSSICSFRDVVHGNTRVVHRSDNSSPESSSLGQETNGLLTRKPVTTTTTRSAKSNGGATCTSSSSSSRGMQFRKLSGCYECHMIIDPSRLPIARSTVCACSHCGEVFPKMESLELHQAVRHAVSELGPEDSGRNIVEIIFKSSWLKKDNPICKIERILKVHNTQRTIQRFEECRDTVKNRALGSTKKNPRCAADCNELLRFHCTTLTCALGARGSSSLCASVPGCSVCTIIRHGFQGGCGGGGDHARAKGVRTTASSGRAHDSVVCGDATRRAMLVCRVIAGRVKRVVEDAPSEEEHVSYDSVAGYAGIYSNLEELVVFNPKAILPCFVVIYKVPLC

SEQ ID NO: 2957 - DNA, 1899 bp, Glycine max
  misc_feature (1)..(1899): Ceres cDNA ID no. 21572629
  misc_feature (1)..(1899): Ceres CLONE  ID no. 525317
  misc_feature (1)..(1899): Also known as  Ceres CDNA ID no. 0
ggactaccaaaagatttgtaaattgtaaagagatatgaaatagctctagttcttgaattgcatggtgaagcaaagattgaaatgcttgcatagcatgtttgtttctttggacttcttccctatcatctatttgaaaatgttattctggtgctttaaagctccgagaggagatggagaaagcagagaaggaccggagggagaagaaggagaagaaaagggaaaagaaagagaggaaaagagagaagaaggagaagaaagagagaaggaaagcggagaaagaaaggaaacttaaagacggagcaagtgcctgccctggcactgatgatggcaaaaagtttaagctcatcaacgaactaaaggaaaccaaagcagatggaaaattgcaaaagggtgaagacagtgagaatgaacaacatgagaggagtggaattacagaggaacttgacctacctgtcacttctgtggagccttgctgcctttctgactgtactcaaagcagtaagagaaaaaggagctccccagaatcaactcatgatcatggatctgctattaaaattcgacttccgttgaggaagcatagagaacctgaagaattgaaatccaaatcaaaatttcaagcggggtgttcttctggaagtgtgggggaaactgcaaattccttcactaaaactacacttggaagtgatcgtcagtcacaatgtctcaggattacagagctgaatcgggtacttggaaactctgattcaagacatggcaaagcaatgcagaattcagttcatggagatgttgtggtcactaagaataccattggaagtaatcgtcagtcacaatgtcacaggactacagagcccaaacatgttattggaaactccggcaaagtgatgcagaattcagttcatggagatgctgcggtcattaagaataccattggaagtgatcgtcagtcacaatgtctcaggaccacagagcccaaacgggttcttggaaactctggcaaagtgatgcagaattcagttcatggagatgctgcggtcattaagaattccattggaagtgattgtcagtcacaatgtctcgggaccacagtgcccaaacgggttcttgggaactctgtcaaagcgatgcaggcagttcatggagatgctgtggtcactaaaaagaaccttggaagtgatcaatacctcagggttacagaaccgaaacgggttcttggaaattctgattctagaaatggcaaagcaaagcagaatccagttcatggagatgccgttgtcactaaaaatacctttggaagtgatcatcagttgaaaagtctcgagattacagagcccaaacggattcttggaaactctgattctaaacattgcaaagcgttgcagaatttggttcctggaagtcaaaaagttgaatctttgtacgaatctttgttacagattccaccactaacgtatgatggattggactcggtatatgatgattggttatttagttctgaaccgaaagagtcaaggcccgtctcgaagaaacagaagtgtgattctgatgtctttcagctttcaaattctatgtggcctcgtgcacaatacttgcctgaggtcgaagtatatgcgttgccatacgcagttccgttttgattcttttggattattttttgacaataggtggtagtttgatgaaagtagggagctgttctgtgttctaattgagaaccggtggatgattgtttttttgaaagagaaaaacaattacatggcatatgggcaaagattgcgttaatatgttcaaacatgatcgatgtaattttgtcatccatacttggcggtagtagtatttgtagaatgcacagacataaatattatagtagtaaaacagttttttagcaaaaaaaaaaaaaaaaaa

SEQ ID NO: 2958 - protein, 487 aa, Glycine max
MEKAEKDRREKKEKKREKKERKREKKEKKERRKAEKERKLKDGASACPGTDDGKKFKLINELKETKADGKLQKGEDSENEQHERSGITEELDLPVTSVEPCCLSDCTQSSKRKRSSPESTHDHGSAIKIRLPLRKHREPEELKSKSKFQAGCSSGSVGETANSFTKTTLGSDRQSQCLRITELNRVLGNSDSRHGKAMQNSVHGDVVVTKNTIGSNRQSQCHRTTEPKHVIGNSGKVMQNSVHGDAAVIKNTIGSDRQSQCLRTTEPKRVLGNSGKVMQNSVHGDAAVIKNSIGSDCQSQCLGTTVPKRVLGNSVKAMQAVHGDAVVTKKNLGSDQYLRVTEPKRVLGNSDSRNGKAKQNPVHGDAVVTKNTFGSDHQLKSLEITEPKRILGNSDSKHCKALQNLVPGSQKVESLYESLLQIPPLTYDGLDSVYDDWLFSSEPKESRPVSKKQKCDSDVFQLSNSMWPRAQYLPEVEVYALPYAVPF

SEQ ID NO: 2959 - DNA, 866 bp, Glycine max
  misc_feature (1)..(866): Ceres cDNA ID no. 21572630
  misc_feature (1)..(866): Ceres CLONE  ID no. 526078
  misc_feature (1)..(866): Also known as  Ceres CDNA ID no. 24355988
tgtccttggtggaccaaaaaaaaaagatatacgcgatatcacggtaaattcacagtccggtgcgccaagaaccatctcgcaaagaccagtgtacagcaagtgttcccgaattcattaacactatctcgttgatagctcgcctgagcttaaccttttgcacgtcagaagaagccttattccttcaaaatgccacgaaggggctctgcttctccgatgaggagcaggtccccaccaagggctgcatcacccccaccaagggcagcacctcctccacctcctcctccagctgcaggtgctggaacaggggcaggagctgcagcctcagggggaccttccctcatgggacaaatggctgcaacagctggaggtgttgctgttggctctgccataggccatgtcgccggccatgccctgacagggatgttcagtggtggaaacgactcccagtctggtcaacctcaggctgctgcacccgctcagtatgcccagcagtaccctcaggcaggtggagcagagcctagtggtccatgtgcctgggaaataaagcaattcttgcagtgtgcacaggggcaaactgacttatcattatgtgaaggcttcaatgaagcacttcgtcagtgcaagcaaaataacagggttgctatgtaggtggaatgtagaattatgttctgtgactagtctcatctcctgcttacatctggtaaaatttccagggactttggggcatcccatacctctattgtgagtactgtttacagcatgtagagcaacctaaatttcaatagtgttccacaagttgtgcaatatcctgtggagtatctacattaaagtgataattttcataaaagaaaaaaaaaaaaaaaaaa

SEQ ID NO: 2960 - protein, 153 aa, Glycine max
  misc_feature: PFam Name: CHCH; PFam Description: CHCH domain
  misc_feature: PFam Name: Vitellogenin_N; PFam Description: Lipoprotein
  misc_feature: GI Number: 31220107; NR Description: ENSANGP00000013101 [Anopheles gambiae] >gi|30175586|gb|EAA12081.2| ENSANGP00000013101
  misc_feature: GI Number: 48097243; NR Description: similar to
  misc_feature: GI Number: 37674436; NR Description: unknown [Homo sapiens] >gi|48735013|gb|AAH71985.1| Coiled-coil-helix-coiled-coil-helix domain containing 2 [Homo sapiens] >gi|15990501|gb|AAH15639.1|
  misc_feature: GI Number: 42542702; NR Description: CHCHD2 protein [Homo sapiens]
  misc_feature: GI Number: 50758164; NR Description: PREDICTED: similar to coiled-coil-helix-coiled-coil-helix domain containing 2; 16.7kD
MPRRGSASPMRSRSPPRAASPPPRAAPPPPPPPAAGAGTGAGAAASGGPSLMGQMAATAGGVAVGSAIGHVAGHALTGMFSGGNDSQSGQPQAAAPAQYAQQYPQAGGAEPSGPCAWEIKQFLQCAQGQTDLSLCEGFNEALRQCKQNNRVAM

SEQ ID NO: 2961 - DNA, 1540 bp, Glycine max
  misc_feature (1)..(1540): Ceres cDNA ID no. 21572631
  misc_feature (1)..(1540): Ceres CLONE  ID no. 526823
  misc_feature (1)..(1540): Also known as  Ceres CDNA ID no. 24367192
gaggtcagggactgaaagggggtgttctgttctgatcggatctgaaatcatcgggaaaatgtcgtcgtttctgcaccagagaagcagtctccagaacccattctcgaatccattcccggcatcaactccatcatcatcgaattcgaagaaatccctgtccatcatgggccccaccaccctcctagccctaatctccctcatagtcatactcggcgtcttctgcccctgggtgggctttccccagggcttccccttcactcccactcccacttccaaatgggctcactacactttagaacaagcgctctccttcgtcgccaaaaacggttcctccgtcatcgtctgcattgtgagccaaccctacttgcccttcctcaacaactggctcatcagcatttccatgcagaagcgccaagacatggtccttgtcatcgccgaggactacgcttctctcgacagggtcaatctgctttggcctggccacgccgtcctcatccctcccgtcctcgacgccgaagctgcccacaagtttggttctcagggtttcttcaactttacagcaaggcggccaagccatctgctgaagattttggagcttggatatagtgtgatgtacaatgatgttgatatggtttggttggcagatccatttccttatctgcaagggaaccatgatgtgtactttacagatgatatgactgcaattaaaccattgaaccattctcatgatttaccaccaccaggaaaaaagggccgtccttacatttgtagttgcatgattttcctccgccctaccaatggagcaaagctaattttgagaaagtggattgaggaacttcagattcaaccctggtctaaaactgtgaaatctaatgatcagcctgcttttaactgggctttaatgaagaatgctaaagaggtggatttgtacctgcttccacaggcagcattccctacaggcggattatatttcaagaacaaggcatgggttaaggaaactaaaggaatgcatgttatcattcataataactatatcgttggctttgagaagaaaataaagcggttccgtgactatggtctctggttggtggatgatcatgcacatgagtcccctctaggaggattatgatccttggtagatgaaagacactagtttatcgttagctttggttcaagcatttggattaagaacatgctttctctgccaatttgttcatcctaattgcttggtggctgatttctgaagagattacaaccgttgctgtcaacatgcaacatcgactaaatgatgggttggaaaaaaaatggtcttttgctttcaattttgtgaaggaaaaaggtgcttacaaaatgtagattttatttcaaggccctaggaagaggaggatatatttttagttggttgttggagttgtacgtgacaagtgataatgtatgattgtttagaaaaagaatatgcttccactgtaagaattatttaatttaattggcatatatatgaaatatattctactttttatccaaaaaaaaaaaaaaaaaa

SEQ ID NO: 2962 - protein, 356 aa, Glycine max
  misc_feature: GI Number: 28466905; NR Description: At1g56550 [Arabidopsis
MSSFLHQRSSLQNPFSNPFPASTPSSSNSKKSLSIMGPTTLLALISLIVILGVFCPWVGFPQGFPFTPTPTSKWAHYTLEQALSFVAKNGSSVIVCIVSQPYLPFLNNWLISISMQKRQDMVLVIAEDYASLDRVNLLWPGHAVLIPPVLDAEAAHKFGSQGFFNFTARRPSHLLKILELGYSVMYNDVDMVWLADPFPYLQGNHDVYFTDDMTAIKPLNHSHDLPPPGKKGRPYICSCMIFLRPTNGAKLILRKWIEELQIQPWSKTVKSNDQPAFNWALMKNAKEVDLYLLPQAAFPTGGLYFKNKAWVKETKGMHVIIHNNYIVGFEKKIKRFRDYGLWLVDDHAHESPLGGL

SEQ ID NO: 2963 - DNA, 1118 bp, Glycine max
  misc_feature (1)..(1118): Ceres cDNA ID no. 21572632
  misc_feature (1)..(1118): Ceres CLONE  ID no. 528785
  misc_feature (1)..(1118): Also known as  Ceres CDNA ID no. 24356082
atccaaaatttgagcttctattggagagaaacaaacaccaaataaaaatagcaatcatggcaaataagtaccatgttcgttctattagtttgccttctagatctcatcctagcaccattagagttgaggaggagcttagcaagatcaaaacttgggaaggaacattcacatccacatcagggtccattcacacaggcatatccttgattgaagatttgtacatttgcttggatgatcttctcaacatggcatctacccaaaaggtgatttctcaccatagaggtgaaaaatgtgtgcaagaggtgttggatggttcagtgagaattttggatatatgtggcatcacaagggacaccatgttgcaaattaaggaaaatgtccaagcccttcactcttctctaagaagaagaaagggagactcatgtgttgaagcaagtgtggctgagtacaagttgttcacaaaaaagatgaagaaggatgccattaagttgatcacatctttgaagcagatggatggcaaatttggggtgtccacacttttggatcttgatcaccacttcgctgctgtgattagagtgcttagggaagtcattctgatgaacttgtcactattccaattttttttgtcattcttcaccgtgtcttcatcgaactcaaagacatccaaatggttgctggtgacaaaattgatgcacagggggataaaaccttgtgaagacaaatcagagaatatcaatgaatttcagtgtgtggaagcatctttgagcacccttctaaatgaaggcactattaatgatgagaagatgcaggtagttcatgaaagattggaggctttggagaatgccattgaaagtgttgagaatggcttggagagtgtgtttaggcgcttgattaaaactagagcttcccttttgaacataatctcccaatagagtactttcaatagatatttttctccaaattctgcaatgcagccaaattttaggggtatgctgaggaatgaaatttttacctacaattatttgtagatatgtataattcaaaagaaatatattgaaatgtaaaaacaaaaaagaaatctttgttccctacattacggcaaaaaaaaaaaaaaaaaa

SEQ ID NO: 2964 - protein, 291 aa, Glycine max
  misc_feature: GI Number: 62733338; NR Description: Arabidopsis protein of
  misc_feature: GI Number: 6573720; NR Description: T23E18.17 [Arabidopsis
  misc_feature: GI Number: 21553499; NR Description: unknown [Arabidopsis thaliana]
MANKYHVRSISLPSRSHPSTIRVEEELSKIKTWEGTFTSTSGSIHTGISLIEDLYICLDDLLNMASTQKVISHHRGEKCVQEVLDGSVRILDICGITRDTMLQIKENVQALHSSLRRRKGDSCVEASVAEYKLFTKKMKKDAIKLITSLKQMDGKFGVSTLLDLDHHFAAVIRVLREVILMNLSLFQFFLSFFTVSSSNSKTSKWLLVTKLMHRGIKPCEDKSENINEFQCVEASLSTLLNEGTINDEKMQVVHERLEALENAIESVENGLESVFRRLIKTRASLLNIISQ

SEQ ID NO: 2965 - DNA, 1375 bp, Glycine max
  misc_feature (1)..(1375): Ceres cDNA ID no. 21572633
  misc_feature (1)..(1375): Ceres CLONE  ID no. 530221
  misc_feature (1)..(1375): Also known as  Ceres CDNA ID no. 24356078
ataagcttccatatatgcgtgactgcagataacatggaaagagaaacacgacggattgtcatcttaaacgtatgggcatggcttgccttggtttcacttttcactattcataccaattcagcactagaaaataacaaccccggtttcataagcattgattgtggatcagaagcagcttattcccacaccgaaactggaatttggtttgagacagacaatgattatgttggaacaggaagcaatcatatggtttcatcgaatgtgaacttaaactatcgcgattatgggagacagttgaacacactgagatgcttcccaaaaggagagaggaactgctacaccctgaaaccacagcatggtaaaaataacagtagcaagtatctcataagggctttcttttcatatggaaactatgatggcaaaaatgaagctccttcttttgacatgtacattggagtcaatcttgtggacaaagttaatctcactgattacgccgacacttactggttcacggagattattcagactgtgtcaagtgaaagcatagatgtgtgccttgttaaaagtggccccacaatcccttgcattgcttcattggaattgagacctttgaacacttccatttatcacactcccaccgctgctccacaaccactattatatcttcagctaaggattgacgttggctcctctgcattgcctccaccttatggagactattactttaggtacaaagatgacgtgtatgatcggatatggcggtgtgacctcgatgatacgaatggttggtatcccttggttatggaatctcttaacttggacagtggaagaagaagcagtgatatttataagttgccctcccaagtactaagaactgcagtccaatctccaaacgtctcgcaccctttacaatttgactatgacaatctttatgcgcccctggacaaaccttatgagtactacgtctactttcactttcttgaaattcagcaacttcccattggtaaaaaaagaatcattaatatcacccttaactaccaaaccattctcacacaacctttggttcttgaatacctcaagcctgtcaccattgcgcctcaaaaaacaagttctggttctgtcttgttcaatgttagtgccacgtcagaatcggatgctccacctatcctcaacgccttcgaggtctataagttgataacacaacttgatttgcccacacaggctagagatggtatctatcaatacaacaatatgttacatacgtacttataagtttgaaatctttgtaggatgtgcttataattacaatagtagagaagatattatataagaggaatatgtgaaacattataatcagaaaaaaaaaaaaaaaaaa

SEQ ID NO: 2966 - protein, 412 aa, Glycine max
  misc_feature: GI Number: 15218052; NR Description: leucine rich repeat
  misc_feature: GI Number: 3135251; NR Description: putative receptor-like protein kinase [Arabidopsis thaliana] >gi|20196929|gb|AAM14837.1| putative receptor-like protein kinase [Arabidopsis thaliana] >gi|7446408|pir||T01269 serine/threonine-specific protein kinase
  misc_feature: GI Number: 42565656; NR Description: leucine-rich repeat
  misc_feature: GI Number: 3135253; NR Description: putative receptor-like protein kinase [Arabidopsis thaliana] >gi|7446409|pir||T01271 serine/threonine-specific protein kinase (EC 2.7.1.-) F27F23.3 - Arabidopsis thaliana >gi|15224743|ref|NP_179513.1| leucine-rich
  misc_feature: GI Number: 6522612; NR Description: receptor-like protein kinase homolog [Arabidopsis thaliana] >gi|11346388|pir||T45690
MERETRRIVILNVWAWLALVSLFTIHTNSALENNNPGFISIDCGSEAAYSHTETGIWFETDNDYVGTGSNHMVSSNVNLNYRDYGRQLNTLRCFPKGERNCYTLKPQHGKNNSSKYLIRAFFSYGNYDGKNEAPSFDMYIGVNLVDKVNLTDYADTYWFTEIIQTVSSESIDVCLVKSGPTIPCIASLELRPLNTSIYHTPTAAPQPLLYLQLRIDVGSSALPPPYGDYYFRYKDDVYDRIWRCDLDDTNGWYPLVMESLNLDSGRRSSDIYKLPSQVLRTAVQSPNVSHPLQFDYDNLYAPLDKPYEYYVYFHFLEIQQLPIGKKRIINITLNYQTILTQPLVLEYLKPVTIAPQKTSSGSVLFNVSATSESDAPPILNAFEVYKLITQLDLPTQARDGIYQYNNMLHTYL

SEQ ID NO: 2967 - DNA, 1613 bp, Glycine max
  misc_feature (1)..(1613): Ceres cDNA ID no. 21572634
  misc_feature (1)..(1613): Ceres CLONE  ID no. 533867
  misc_feature (1)..(1613): Also known as  Ceres CDNA ID no. 24356217
ttttttgaaaaaaacgatacggtatgtacgtggtgcctccaccccagcgttcggatccgggttcgggatccggtgatttgcgggtctaccaagcgtggaaggggagcaataaattttttcttcagggaaggttcatatttggaccagatgcaagatcattggccctgacgatttttcttattgctgctcccgttgcagttttctgtgtctatgttgccagaaaactaatagatgatttttctgatcacttgggggtaaccataatggccattgctgttatattcacaatttatgtgttagttcttctcttgttaacatctggacgagaccctggcataattccacgcaatgcacatcctccagaaccagaaggttttgaaggtagtctagatgttggggctggtcaaactcctcaattgcggttgcctcgaattaaggaggttgaggtcaatggaattactgttaaggtcaagtattgtgatacttgcatgctctacaggcctcctcgatgttctcactgctcaatttgtaataactgtgtggaacggtttgatcaccattgtccctgggttgggcagtgcattgggctgcgtaattatcgcttcttcttcatgtttgtcttctcaactacactactttgtatatatgttttcgcattttgttgggtctatattagaagaattatggaggcagaggagacaacaatttggaaggcaatgatcaaaaccccagcctccatagtgttaataatttacaccttcatatcaatgtggtttgttggtggcctgactgcctttcatttatatcttataagtacaaatcagactacatatgagaacttcagataccgatatgatcgacgggccaacccgtataacatgggagtgttcaataatttcttagagatattctgcaccagcattccccaatcaaagaacaatttcagggcaaaggtaccaatggaaccagtattacctgctcgatcggtgggtgcaggctttatgagcccgagcatgggaaaagctgttgacgacatagagatgggcaggaaaaccgtgtgggccgacatgggtactgctcttgatccttctgaaggtcaattaaatgatcgcgtggctgtaaaggatggggaatttggtgagttgtctccagaaattaggacaacagtagacgaaactagtcaccgtgccggaatgcatcccaggagatccagctggggaagaaaaagtggaagctgggaaatgtcccctgaagttcttgctttggcagccaaggttggggaatcaaatcgaatgggtggaggtagcagcagtttgaccactgagaacaggcatacatagccactgaaattatattagtctggcaaagggttttatttgttgtaattaaacggtgttacatttctgatgcagtaaatcatcagcaaaattaattgtatttgcaatgtgggggatgagggctttggagggtgtttgttagtgttgttttcgccatattgtgcttctagggagttgttgtgttgttgtgagtgagcttttttcctttgccttgtgttgtatcacgcttcccaattaactatttgtcttaccaattactaaaaaaaaaaaaaaaaa

SEQ ID NO: 2968 - protein, 438 aa, Glycine max
  misc_feature: PFam Name: zf-DHHC; PFam Description: DHHC zinc finger domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
MYVVPPPQRSDPGSGSGDLRVYQAWKGSNKFFLQGRFIFGPDARSLALTIFLIAAPVAVFCVYVARKLIDDFSDHLGVTIMAIAVIFTIYVLVLLLLTSGRDPGIIPRNAHPPEPEGFEGSLDVGAGQTPQLRLPRIKEVEVNGITVKVKYCDTCMLYRPPRCSHCSICNNCVERFDHHCPWVGQCIGLRNYRFFFMFVFSTTLLCIYVFAFCWVYIRRIMEAEETTIWKAMIKTPASIVLIIYTFISMWFVGGLTAFHLYLISTNQTTYENFRYRYDRRANPYNMGVFNNFLEIFCTSIPQSKNNFRAKVPMEPVLPARSVGAGFMSPSMGKAVDDIEMGRKTVWADMGTALDPSEGQLNDRVAVKDGEFGELSPEIRTTVDETSHRAGMHPRRSSWGRKSGSWEMSPEVLALAAKVGESNRMGGGSSSLTTENRHT

SEQ ID NO: 2969 - DNA, 1709 bp, Glycine max
  misc_feature (1)..(1709): Ceres cDNA ID no. 21572635
  misc_feature (1)..(1709): Ceres CLONE  ID no. 538407
  misc_feature (1)..(1709): Also known as  Ceres CDNA ID no. 23699755
tcattttctgtagtgatgattgagaagatagaagacctggtgtctggccttttcctgccactgttttttgtgtctagtggcttgaagactaatgtggcaactattagtggaggactttcttgggcaatgttggtgcttgttatattcaatgcttgctttggcaagattgttggcacaatagttgtgtcgttaacgtgcaaggtgccttctcaagaagccgtggcacttggatttctcatgaacacaaagggcttggtagaactcatagttctcaacattgggaaggaccgtaaggtgttgaatgaccaagcatttgccatttgtgttctcatggcattgtttaccaccttcatcaccaccccaatagtgatggctgtatataaaccagctcgcagaggagcaccctacaagcacagaacaattcagcgcagagatcctgacactgagctccgaatgctagcttgcttccacaccacccgcaacattcccacgttaatcaatctcatagagtcttcccgcggaattcgaaagagaggaaagctttgcatctatgccatgcacttgatggaactctcagagcgatcttcagcaatcacaatggttcacaaggcacgcaagaatggcatgcccttctggaacaagaaaccggatgacaaagatcaaatgatcattgcttttcaggcttatgagaaactaagaagtgtcaatgtgcgccccatgacagccatctctgctctcaatagcatccatgaggatatttgtactagtgctcaccaaaaacgtgcagccatgattatcctcccattccacaaacaccaacgtgtggatggatcaatggagtcactaggacattcactccatgtgatgaatcagcttgtgctaagccatgctccttgctcagtgggaattttggttgatcgaggtcttggagggacaagccaagtccaagctagtgatgtgtcttataaggttgttgtacccttctttggaggacgtgatgatcgtgaagcactttgttatggtatgagaatggctgagcacccggggattttgctcaatgtggttaagtttgtgcccccacctggggcatcattggcctttggtgctaaattggttgggatgtcatcgaacaaggacaagaaagcaatggaagtggttggtggcagttattatgatgataaacaacaagatgatcaattgtggagtgagtttttaagtgcatgcaacaacaaccaagagtcaatgaagtatgagcaaaaactggtggcaagcaaaggtgatattgaggcagcattgaaggaaatgaataggagcaatctaatattggttggtagaatgccatcagtaggacctttggttagcagaagtgattgtccagaacttggacctgttggaagctacatggcttcttcagatttctccactgttacatcagttatggtaattcagcaatataatccttcaactgacattcatccactagtgatggaggaatttgattacccagataagctagagccaaacgcaccaaggagttaatgtggcattaaagctggagttgtcttttggttataacttataacttacgaaacaaggcggatgctcataatgttggaaataaatttgtatgtccaggatctaagttatcatgtaatcaattctaattttaataataaagtattattttatttttaaaaaaaaaaaaaaaa

SEQ ID NO: 2970 - protein, 1709 aa, Glycine max
  misc_feature: PFam Name: Na_H_Exchanger; PFam Description: Sodium/hydrogen
  misc_feature: GI Number: 10178015; NR Description: Na+/H+ antiporter-like protein [Arabidopsis thaliana] >gi|42568248|ref|NP_198976.3|
  misc_feature: GI Number: 9294151; NR Description: Na+/H+ exchangeing
  misc_feature: GI Number: 61658325; NR Description: cation/H+ exchanger
  misc_feature: GI Number: 42573539; NR Description: cation/hydrogen
  misc_feature: GI Number: 15229087; NR Description: cation/hydrogen
TCATTTTCTGTAGTGATGATTGAGAAGATAGAAGACCTGGTGTCTGGCCTTTTCCTGCCACTGTTTTTTGTGTCTAGTGGCTTGAAGACTAATGTGGCAACTATTAGTGGAGGACTTTCTTGGGCAATGTTGGTGCTTGTTATATTCAATGCTTGCTTTGGCAAGATTGTTGGCACAATAGTTGTGTCGTTAACGTGCAAGGTGCCTTCTCAAGAAGCCGTGGCACTTGGATTTCTCATGAACACAAAGGGCTTGGTAGAACTCATAGTTCTCAACATTGGGAAGGACCGTAAGGTGTTGAATGACCAAGCATTTGCCATTTGTGTTCTCATGGCATTGTTTACCACCTTCATCACCACCCCAATAGTGATGGCTGTATATAAACCAGCTCGCAGAGGAGCACCCTACAAGCACAGAACAATTCAGCGCAGAGATCCTGACACTGAGCTCCGAATGCTAGCTTGCTTCCACACCACCCGCAACATTCCCACGTTAATCAATCTCATAGAGTCTTCCCGCGGAATTCGAAAGAGAGGAAAGCTTTGCATCTATGCCATGCACTTGATGGAACTCTCAGAGCGATCTTCAGCAATCACAATGGTTCACAAGGCACGCAAGAATGGCATGCCCTTCTGGAACAAGAAACCGGATGACAAAGATCAAATGATCATTGCTTTTCAGGCTTATGAGAAACTAAGAAGTGTCAATGTGCGCCCCATGACAGCCATCTCTGCTCTCAATAGCATCCATGAGGATATTTGTACTAGTGCTCACCAAAAACGTGCAGCCATGATTATCCTCCCATTCCACAAACACCAACGTGTGGATGGATCAATGGAGTCACTAGGACATTCACTCCATGTGATGAATCAGCTTGTGCTAAGCCATGCTCCTTGCTCAGTGGGAATTTTGGTTGATCGAGGTCTTGGAGGGACAAGCCAAGTCCAAGCTAGTGATGTGTCTTATAAGGTTGTTGTACCCTTCTTTGGAGGACGTGATGATCGTGAAGCACTTTGTTATGGTATGAGAATGGCTGAGCACCCGGGGATTTTGCTCAATGTGGTTAAGTTTGTGCCCCCACCTGGGGCATCATTGGCCTTTGGTGCTAAATTGGTTGGGATGTCATCGAACAAGGACAAGAAAGCAATGGAAGTGGTTGGTGGCAGTTATTATGATGATAAACAACAAGATGATCAATTGTGGAGTGAGTTTTTAAGTGCATGCAACAACAACCAAGAGTCAATGAAGTATGAGCAAAAACTGGTGGCAAGCAAAGGTGATATTGAGGCAGCATTGAAGGAAATGAATAGGAGCAATCTAATATTGGTTGGTAGAATGCCATCAGTAGGACCTTTGGTTAGCAGAAGTGATTGTCCAGAACTTGGACCTGTTGGAAGCTACATGGCTTCTTCAGATTTCTCCACTGTTACATCAGTTATGGTAATTCAGCAATATAATCCTTCAACTGACATTCATCCACTAGTGATGGAGGAATTTGATTACCCAGATAAGCTAGAGCCAAACGCACCAAGGAGTTAATGTGGCATTAAAGCTGGAGTTGTCTTTTGGTTATAACTTATAACTTACGAAACAAGGCGGATGCTCATAATGTTGGAAATAAATTTGTATGTCCAGGATCTAAGTTATCATGTAATCAATTCTAATTTTAATAATAAAGTATTATTTTATTTTTAAAAAAAAAAAAAAAA

SEQ ID NO: 2971 - DNA, 1487 bp, Glycine max
  misc_feature (1)..(1487): Ceres cDNA ID no. 21572636
  misc_feature (1)..(1487): Ceres CLONE  ID no. 538813
  misc_feature (1)..(1487): Also known as  Ceres CDNA ID no. 23688176
gactctcttcttacttcccctttctctctgtctctaaaaaccctttttttctctctctttcacacacaccaaccagactcgatcagtggtggcagatagagagagacatgatgtcaacttccggcgccggcaggtacatggcttttccgccgtctccgtccgcgcctccgtcgccgcacctctccggtcttcgctccactcccctctccgacccggacaaatatctagctgagttgttgggagaacgtaacaagcttagtcccttcatggctgtgcttcctcactgctttcgattgtttaaccaagaaattttgcgtgtaaccacgctgatggggaatgcatcagttttaggtcaaagtgggcttgaacacgctagccccctggctactggaggaatattttcaaatggaggtgccgatgtgaacggatgggcatcacgatttcaatcagaaagacccagcttgttacagtcctcatcaacacaaaactggctgagtccacaaggtagctcatctggtattattgttaaaaagacggtcagagtagatattcctgtggacgcatatcctaattttaactttgttggtcgcctcctaggccctagaggaaactctctaaagcgtgtagaagcaagtactgagtgtcgtgtcttgatcaggggccgaggtagcattaaggatccagctagggaggaaatgatgagaggaaaacctgggtatgagcatctgaatgaacctctccacattctagttgaggcagaattaccagttgaaatagtagatgctcgcctgatgcaggcacgtgaaatacttgaagatttgctcaaaccggtggatgaatctcaggatttctacaagaagcagcaacttcgggagctagcaatgctgaatggcactcttcgtgaggagggttctcccatgtctggttctgtttcacccttccacaacagccttggtatgaagagggccaagaccagggggtaaattatcctaaagggtgagagggattttggagcttgtgttaattttctacatcatcacttaccgtgccacaggtaatgctgtcaacgaatgccctgatctgcgatcggggcactggcatcatagtgccagttctaacttgttctatgtgcagtgtgtttatattgagtttgggggaggtttaaagatggtagcacgtagtaaaggtccaattgagtttggtgaatttgcttttatagtgttggttaaggtttggttagatattcaccaaatctgtctatactactattatatggggttatatttgctgataaaaaaaaatatggggttatatttaagcttgcaataacagttttgatatgtttttggtattttctgcgaggaaggtaatgttaatggtttgtacccagattgtgaggcagataaatatctacttcaatgcgtctatgggtgacattttgtagtatctaatttagattataaattcgcaaaaaaaaaaaaaaaaaa

SEQ ID NO: 2972 - protein, 1487 aa, Glycine max
  misc_feature: PFam Name: KH_1; PFam Description: KH domain
  misc_feature: GI Number: 24030184; NR Description: putative RNA-binding protein [Arabidopsis thaliana] >gi|9758634|dbj|BAB09296.1| RNA-binding protein-like [Arabidopsis thaliana] >gi|15241136|ref|NP_200425.1| KH domain-containing protein
  misc_feature: GI Number: 19424087; NR Description: putative RNA-binding
  misc_feature: GI Number: 50912257; NR Description: putative KH domain protein [Oryza sativa (japonica cultivar-group)] >gi|45735990|dbj|BAD13019.1| putative KH domain protein [Oryza sativa (japonica cultivar-group)] >gi|45735994|dbj|BAD13022.1|
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 34900448; NR Description: KH domain-like protein [Oryza sativa (japonica cultivar-group)] >gi|24060154|dbj|BAC21599.1| KH domain-like protein [Oryza sativa
GACTCTCTTCTTACTTCCCCTTTCTCTCTGTCTCTAAAAACCCTTTTTTTCTCTCTCTTTCACACACACCAACCAGACTCGATCAGTGGTGGCAGATAGAGAGAGACATGATGTCAACTTCCGGCGCCGGCAGGTACATGGCTTTTCCGCCGTCTCCGTCCGCGCCTCCGTCGCCGCACCTCTCCGGTCTTCGCTCCACTCCCCTCTCCGACCCGGACAAATATCTAGCTGAGTTGTTGGGAGAACGTAACAAGCTTAGTCCCTTCATGGCTGTGCTTCCTCACTGCTTTCGATTGTTTAACCAAGAAATTTTGCGTGTAACCACGCTGATGGGGAATGCATCAGTTTTAGGTCAAAGTGGGCTTGAACACGCTAGCCCCCTGGCTACTGGAGGAATATTTTCAAATGGAGGTGCCGATGTGAACGGATGGGCATCACGATTTCAATCAGAAAGACCCAGCTTGTTACAGTCCTCATCAACACAAAACTGGCTGAGTCCACAAGGTAGCTCATCTGGTATTATTGTTAAAAAGACGGTCAGAGTAGATATTCCTGTGGACGCATATCCTAATTTTAACTTTGTTGGTCGCCTCCTAGGCCCTAGAGGAAACTCTCTAAAGCGTGTAGAAGCAAGTACTGAGTGTCGTGTCTTGATCAGGGGCCGAGGTAGCATTAAGGATCCAGCTAGGGAGGAAATGATGAGAGGAAAACCTGGGTATGAGCATCTGAATGAACCTCTCCACATTCTAGTTGAGGCAGAATTACCAGTTGAAATAGTAGATGCTCGCCTGATGCAGGCACGTGAAATACTTGAAGATTTGCTCAAACCGGTGGATGAATCTCAGGATTTCTACAAGAAGCAGCAACTTCGGGAGCTAGCAATGCTGAATGGCACTCTTCGTGAGGAGGGTTCTCCCATGTCTGGTTCTGTTTCACCCTTCCACAACAGCCTTGGTATGAAGAGGGCCAAGACCAGGGGGTAAATTATCCTAAAGGGTGAGAGGGATTTTGGAGCTTGTGTTAATTTTCTACATCATCACTTACCGTGCCACAGGTAATGCTGTCAACGAATGCCCTGATCTGCGATCGGGGCACTGGCATCATAGTGCCAGTTCTAACTTGTTCTATGTGCAGTGTGTTTATATTGAGTTTGGGGGAGGTTTAAAGATGGTAGCACGTAGTAAAGGTCCAATTGAGTTTGGTGAATTTGCTTTTATAGTGTTGGTTAAGGTTTGGTTAGATATTCACCAAATCTGTCTATACTACTATTATATGGGGTTATATTTGCTGATAAAAAAAAATATGGGGTTATATTTAAGCTTGCAATAACAGTTTTGATATGTTTTTGGTATTTTCTGCGAGGAAGGTAATGTTAATGGTTTGTACCCAGATTGTGAGGCAGATAAATATCTACTTCAATGCGTCTATGGGTGACATTTTGTAGTATCTAATTTAGATTATAAATTCGCAAAAAAAAAAAAAAAAAA

SEQ ID NO: 2973 - DNA, 1542 bp, Glycine max
  misc_feature (1)..(1542): Ceres cDNA ID no. 21572637
  misc_feature (1)..(1542): Ceres CLONE  ID no. 539183
  misc_feature (1)..(1542): Also known as  Ceres CDNA ID no. 24356190
gggttgttgttggtcatgtttggcattgccgcttgagagctgtctcacatcacctaccgcggagtcgccaagaaaaccaaacctcatttcttttcatctcacctcactattaagtattaaactttcacgacacaacacaaaaagcatagtactatacaacaccactttctgtttctcttcactctaatggccatggcagcgtctgcaaagctcaacaccttgtcttcttcccagtggatcgcccacaattccttctctcctcgccgtggatcctcttctcgccgagtctctcttccgatccgcgcttcttcttaccaacacgaactcgtccaaaccgccaaatccattgcatcacccggccgtggaattcttgcaattgatgaatcaaatgccacatgtgggaaacgattagcatccattggattggacaataccgaggtgaatcgccaggcctataggcagctgctgctcaccacacctggccttggtgaatacatctctggtgcaattctttttgaagaaaccctttaccagtcaacaacagatggaaagcaatttgttgattgcctctgcgatcagaacattgtgcctggcatcaaagttgacaagggtctggtccctctgccagggtcaaacaatgaatcttggtgccaagggttagatggattggcttctaggtctgccgaatactacaagcaaggtgctcgatttgccaagtggaggaccgttgttagcattccatgtggtccttctgcattagctgtcaaggaagcagcatggggacttgcacgttatgctgctatctctcaggacaatggtcttgtgccaatcgttgagcctgaaattcttcttgatggagaccacccaattgagaggacgctggaagtggctgagaaggtctggtcagaagtctttttctatttggctgaaaacaatgtcctttttgagggaattttgctcaaacctagcatggttacacctggggctgaacacaaggaaaaggcttctccagaaaccattgccaaatatactctaaccatgcttagaagaagagttcctcctgctgtccctggaatcatgtttttgtctggtggacaatctgaagtggaagcaacactaaatcttaatgcaatgaaccaaagtcccaacccatggcatgtttctttctcatatgcacgggctcttcagaacaccgtgctaaagacatggcaaggacaccctgagaatgtggaagctgctcaaaagtcccttttggtgcgtgctaaagcaaactccttggctcaacttggaagatactctgctgagggtgagagtgaagaggccaagaagggaatgtttgtcaagggctatacctactaaaactttaggagtcttttggtttcagttttgttttagctatttatcatcattccttcttagcagtgaattcgaaggggacttagatgttgtatttttattttttttcaacttctagcaaatgagagtttgaataaattgaaaagctaaaaaaaaaaaaaaaaaaagaaaaaaaaaaaaaaaaaa

SEQ ID NO: 2974 - protein, 390 aa, Glycine max
  misc_feature: PFam Name: Glycolytic; PFam Description:
  misc_feature: GI Number: 53828647; NR Description: At4g38970 [Arabidopsis thaliana] >gi|18420348|ref|NP_568049.1| fructose-bisphosphate
  misc_feature: GI Number: 399024; NR Description: FRUCTOSE-BISPHOSPHATE ALDOLASE 1, CHLOROPLAST PRECURSOR >gi|322710|pir||S29047 fructose-bisphosphate aldolase (EC 4.1.2.13) precursor, chloroplast
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
  misc_feature: GI Number: 4827251; NR Description: plastidic aldolase
MAMAASAKLNTLSSSQWIAHNSFSPRRGSSSRRVSLPIRASSYQHELVQTAKSIASPGRGILAIDESNATCGKRLASIGLDNTEVNRQAYRQLLLTTPGLGEYISGAILFEETLYQSTTDGKQFVDCLCDQNIVPGIKVDKGLVPLPGSNNESWCQGLDGLASRSAEYYKQGARFAKWRTVVSIPCGPSALAVKEAAWGLARYAAISQDNGLVPIVEPEILLDGDHPIERTLEVAEKVWSEVFFYLAENNVLFEGILLKPSMVTPGAEHKEKASPETIAKYTLTMLRRRVPPAVPGIMFLSGGQSEVEATLNLNAMNQSPNPWHVSFSYARALQNTVLKTWQGHPENVEAAQKSLLVRAKANSLAQLGRYSAEGESEEAKKGMFVKGYTY

SEQ ID NO: 2975 - DNA, 1785 bp, Glycine max
  misc_feature (1)..(1785): Ceres cDNA ID no. 21572638
  misc_feature (1)..(1785): Ceres CLONE  ID no. 540435
  misc_feature (1)..(1785): Also known as  Ceres CDNA ID no. 24356221
atttttttttcttctcttttgatatcctttactgtttccctttaaacaccctcctcctaggtactgaaaaggctacattatattgatctctggggtagtaaaatatcaaacaaaggtgcttctgttctcaatacattcccaaagttgacctatctcaatcttgcttggaccagtgtcacaaaattgcctaaattatcatttcttgaatacctgaacatgagtaactgtactattgattctatacttgaagatgataaagctcctttggcaaagcttattctctctggggccatgttcatgaatgaagctgaagctttgttatatgcaaatacaaatttcctatcctttttggacgtggccaattccagctttcacagattcttcttcttaagtaaaatgaaagtgatagaacatctcaatctcagctcatgcatgatgggggatgattcagttgagatggttgcgtgcgctggtggaaacttgaaaagtctgaatttgagtggtaccagggttagttctgctggattagggattttagctggacatgttccccatcttgaaattctgtcattatctcagacaccagtggatgacactgccatctcatttatcagtatgatgccttcattaaaggatgttgacctgagcaatacaaatattaaaggttttctgcaccaaggaaggactgatgtgaactccctgctctctctaatggctctgcaaaatcttaaattagaaaggttgaatttggagcatacgcaagttagggatgaagcgttataccctttgtcaagcttccaagagctgagatatttatctcttaaaagtgcttcacttgcagacatctcactttactatttatcatcaattcctaaattgacaaatcttagtatttgtgatgcggtattgacaaattatgggcttgatatgtttaaggctcctgaaactctgaaactgctggacctcaaaggttgttggctcttaactgaagacactatcttgtcattctgtagaaatcatccacaagttgaagtcaggcatgaacttggtaccttatttcctgtcaatcaaaacggacttaatcattcctctccatctcgatcaacttccaagactatgcaaatgactaagaagaaagatcaaattcccttatctccatattttgttgatcaaagattgaagtatagcagggacgagttacttgcattgcagtttacatctttgccccttgcatctagtagtgagagtggcaattcaatatttgagaaacaattgggttgagtggagaaatctccttccatataattgtttgcactcatggcgttgggaagggaatgcgatttgaacagagattgcctcaggattaacagcccaagtatgatgttattcaatgtttcataagtatggcttctcaccaaaaggaaaggtgcaactcgaatgcacaagctcaaagctgaatcacgtttctgatagagaaatcgaatgatatgccttgactccaacttagtaaacatgtagatatgcaatgtggttaaagaaaggctttttagtaattttattgcatgatttggctgacacgttattctttttccagtgcaatggtgaacacatcacacatggaatgtgaaagattgctggttcttagtttctgcgggtttctgtgtgtgtttagccagttatttgtgggttttcttctccttctaaggaaaagctaggcaaaatattttgtgtagaagctcttaaaaataaaaggagctcttttttatcaaaaaaaaaaaaaaaaaa

SEQ ID NO: 2976 - protein, 354 aa, Glycine max
MSNCTIDSILEDDKAPLAKLILSGAMFMNEAEALLYANTNFLSFLDVANSSFHRFFFLSKMKVIEHLNLSSCMMGDDSVEMVACAGGNLKSLNLSGTRVSSAGLGILAGHVPHLEILSLSQTPVDDTAISFISMMPSLKDVDLSNTNIKGFLHQGRTDVNSLLSLMALQNLKLERLNLEHTQVRDEALYPLSSFQELRYLSLKSASLADISLYYLSSIPKLTNLSICDAVLTNYGLDMFKAPETLKLLDLKGCWLLTEDTILSFCRNHPQVEVRHELGTLFPVNQNGLNHSSPSRSTSKTMQMTKKKDQIPLSPYFVDQRLKYSRDELLALQFTSLPLASSSESGNSIFEKQLG

SEQ ID NO: 2977 - DNA, 1203 bp, Glycine max
  misc_feature (1)..(1203): Ceres cDNA ID no. 21572639
  misc_feature (1)..(1203): Ceres CLONE  ID no. 541481
  misc_feature (1)..(1203): Also known as  Ceres CDNA ID no. 24356225
gagaaggaagaagaagaaggtgtgttggagaatgaaaactgaaacagagccaaatgaaaccgagtcagattggagcgagttgactcgcgagtgcctcatcaacatcctctctcgactcagcgtcgaggatcgatggcgcggcaccatgctcgtttgcaagtcatggttcagcgtcttcaaggaaccctctcttcacttcgtcttcaacctcgaccctcaattcgactcgcccaccgaatcaactcgctggtggacccccgagttcgaggccaagatcgataacatgcttcgatctgtcgtcgaatgggcccaatcctctctcacccatatacgcattcgccactgttctgatcgttctctcgccctcgtcgcccaaagttgcccaaaccttgaggtgttgtttatcagaagctgtcctcgtgttaccgatgattctatctctaggatagctttgagttgtccgaagcttagggaattggatatcagctattgttatgagataacccatgaatcgttggtgctgattggaagaaattgtcccaaccttaaggttctcaaaagaaatctcatgaattggcttgatccttcccaacaccgagggattgttcctgacgattatctaaatgcttgtccgcaagatggagacgatgaggctgctgcaattgctaattccatgcctggtctagagcagcttgagattaggttctccaagttaacagctaagggcctcaattccatatgtcagggatgtcccaaccttgagttcttggatttgtctgggtgtgctaacttgactagtcgagacattgcaaatgcatcttctagtttggtgcacttgaaagaaattaaaaagcctaatttctatatccccaggtctgtcttccacactgaaaggtatggttattggagtttgtatgatgagagatttcaaacggatattttccaaatctgagcagtgatgggaagatcgatctaagatgtaaacactgagttcatcacttaatcttctttccgctgctttttggatatcttagcagggtctctatggttattttcacagtcaaatatgtatagtagaaattataatctctgtctatgtagttatatgttgttttccttccatcattttgatgtatttgcaatgtatttgtgttgtctcaagttctcataatagatttatctcgtaaaaaaaaaaaaaaaaaa

SEQ ID NO: 2978 - protein, 306 aa, Glycine max
  misc_feature: PFam Name: Lipase_GDSL; PFam Description: GDSL-like
  misc_feature: GI Number: 37789825; NR Description: putative GDSL-motif
  misc_feature: GI Number: 6721157; NR Description: putative GDSL-motif lipase/acylhydrolase [Arabidopsis thaliana] >gi|21537340|gb|AAM61681.1| putative GDSL-motif lipase/acylhydrolase [Arabidopsis thaliana]
  misc_feature: GI Number: 22758315; NR Description: putative early nodulin gene (Enod) related protein [Oryza sativa (japonica
MKTETEPNETESDWSELTRECLINILSRLSVEDRWRGTMLVCKSWFSVFKEPSLHFVFNLDPQFDSPTESTRWWTPEFEAKIDNMLRSVVEWAQSSLTHIRIRHCSDRSLALVAQSCPNLEVLFIRSCPRVTDDSISRIALSCPKLRELDISYCYEITHESLVLIGRNCPNLKVLKRNLMNWLDPSQHRGIVPDDYLNACPQDGDDEAAAIANSMPGLEQLEIRFSKLTAKGLNSICQGCPNLEFLDLSGCANLTSRDIANASSSLVHLKEIKKPNFYIPRSVFHTERYGYWSLYDERFQTDIFQI

SEQ ID NO: 2979 - DNA, 1836 bp, Glycine max
  misc_feature (1)..(1836): Ceres cDNA ID no. 21572640
  misc_feature (1)..(1836): Ceres CLONE  ID no. 547472
  misc_feature (1)..(1836): Also known as  Ceres CDNA ID no. 24356180
aagaaggataacaacaaggattattttatcatcattttcaggaaggttgaaccatcatgaaaacaggtagatcactagacaggaaagccgtgaaggcttctggaaagtgcaatctaaagacaggatccattggagtgagaaattctcccaaaagaacaaataagttggatagcaaagccagaggatgcggtcaagagttgactgataaagagaatcagtattttccatttaaggaacatatgagaaagtgcccagaactttccaacaagtgtacttttcttacagaaaagagaaaggctattgaacttcatcctggacaaatgctcacttctgcaaaaatcaagttacaactttttccaattaatgaagaaactcggataggacttgaaaaggatgggcataatccttatttggaactcacacttagaggtcgaaagaaaatatcttcaatattaaaacaccttggaaagaagtggggaagttcaagtatagccaatggggatcttatactttttccatataatgtaatggaaaatctatctgactgcagaaggtggacaattaatgatagtgacacaacagcctctgctgtttatgctgctgttggaactcttgcacttttccggttgaagtatggctggttctacatgcatgagcccgggccttttggtataccttctacaccaactccctataagcttgttgtacccggaggagacaatgctaatttagaggagactttacgtggtgaacgggacgaggttgagataagcaaagaatacaaagaaaccgaagtgggcaatgcagcaagtgaaactgtggctcagaaagtagaaaacgctgctgttgatcctacggataatgagccaagaacaagaataagtagcagccttcaacagtcatcatctccatgggttgatagtctaagcaatataagcatagggggcctgctgtccgaagcatcattatttggtgggcttgatccaaaatcatttgcttgcatacagccgtgtgatataacttctgattcattggatgcttttattgccgctgctcaaattaataattgcccagttccaagactacctgctgatgacttgcacacatctattttggatgctgaagagacatgtcatgcatttcctcttcaaaagttatcttccccaacggatgtgcaggcagcttgtagaaaggattattctgctgtctgcagtcagggtgttttttcaaacttgttaaagttgtcaaatatagataaggtcaatgatcaagatggagcttcacaaaatcctccatcggggaagactcagacagacttgctttcttcacgcccatatgatgatgatagaagtcttgggttaacaggcatcaattggaatgattctatgggaccttttgatcttggcatgcccgcacagaagcttattggtggagacggtcttactggcaaatttgttaaatagcagcacagatgcataatttgttgaccaaatgactccatttcgaagatacgttctcaggaaaaagaagaaaaaggaaattgtacataatagaaaatacttgctgaagatacgagccagtcagaatactgattacggagctgtgtcaggcttaaactttaaaccatagccactgagaggactaatatttagctcttttgcattgtcttcgctttggtcccgatttggttcggctttatgtcaactatctctagagtgatgtgctgaaatgtaattataatgatcatgctatacttttgaacctttcatcttactctggaatagactaatcttatttggtgcgaaaaaaaaaaaaaaaaaaaaaaaaaaaaaaaaa

SEQ ID NO: 2980 - protein, 468 aa, Glycine max
  misc_feature: GI Number: 30686982; NR Description: myb family transcription
  misc_feature: GI Number: 22218300; NR Description: myb/SANT domain protein
  misc_feature: GI Number: 34913318; NR Description: putative myb/SANT domain protein [Oryza sativa (japonica cultivar-group)] >gi|22093830|dbj|BAC07117.1| putative myb/SANT domain protein
  misc_feature: GI Number: 34906224; NR Description: P0666G04.18 [Oryza sativa (japonica cultivar-group)] >gi|13122435|dbj|BAB32916.1|
MKTGRSLDRKAVKASGKCNLKTGSIGVRNSPKRTNKLDSKARGCGQELTDKENQYFPFKEHMRKCPELSNKCTFLTEKRKAIELHPGQMLTSAKIKLQLFPINEETRIGLEKDGHNPYLELTLRGRKKISSILKHLGKKWGSSSIANGDLILFPYNVMENLSDCRRWTINDSDTTASAVYAAVGTLALFRLKYGWFYMHEPGPFGIPSTPTPYKLVVPGGDNANLEETLRGERDEVEISKEYKETEVGNAASETVAQKVENAAVDPTDNEPRTRISSSLQQSSSPWVDSLSNISIGGLLSEASLFGGLDPKSFACIQPCDITSDSLDAFIAAAQINNCPVPRLPADDLHTSILDAEETCHAFPLQKLSSPTDVQAACRKDYSAVCSQGVFSNLLKLSNIDKVNDQDGASQNPPSGKTQTDLLSSRPYDDDRSLGLTGINWNDSMGPFDLGMPAQKLIGGDGLTGKFVK

SEQ ID NO: 2981 - DNA, 2387 bp, Triticum aestivum
  misc_feature (1)..(2387): Ceres cDNA ID no. 21572641
  misc_feature (1)..(2387): Ceres CLONE  ID no. 555060
  misc_feature (1)..(2387): Also known as  Ceres CDNA ID no. 0
agtctgctacctctcggccgcggccatggcgggcggcaagaagctgcaggagagggtcgccctggggagaactgcgtggatgctggccgacttcgtgatcctcctcctcctcctcgccctcgtggcccgccgcgccgcgtcgctcggggagcgcggcgggacgtggctggcggcgctcgtctgcgaggcgtggttcgccttcgtctggatcctcaacatgaacggcaagtggagccccgtccggttcgacacctaccccgacaacctctcccacaggatggaggagctcccggcggtggacatgttcgtcacgacggcagacccggcgctggagccgccgttgatcacggtgaacacggtgctctcgctgctcgccctggactacccggacgtcggcaggctggcgtgctacgtctccgacgacggctgctcccccgtgacgtgctacgcgctgcgcgaggccgccaagttcgccggcctctgggttcccttttgcaagaggcacgacgttggtgtgagggcccctttcatgtacttctcttccgcgccggaggttggcaacggaacagtcgaccacgagttcctggaaagctgggcactcatgaagagccaatatgagaagctggcccgccggatcgagaacgccgacgagggcacaattatgcgtgacggcggcgacgagttcgccgagttcatcgacgccgagcgcgggaaccatcctaccatcgttaaggttctctgggacaacagcaagagcaaagcaggggaagaattcccacatctggtgtacctctctcgagagaaaagccccagacatcgtcacaacttcaaggccggtgccatgaatgttctgacaagggtgtcggccgtgatgaccaacgctccgatcatgctgaatgtggactgcgacatgttcgccaacaacccgcaggtcgccctacacgcgatgtgcctcctgttggggttcgacgacgagatccacagcgggttcgtccaggcgccacagaagttctacggcggcctcaaggatgacccctttggcaaccagatgcaggttataaccaagaaaatcggaggtgggctcgccgggatccaaggcatgttctacggcgggacaggctgttttcacaggaggaaagtcatttacggcgtgccgccaccagacaccgtcaaacacgagatgaaaggttcaccatcttacaaggagctgcaggccaagtttgggagctcaaaggagttgatcgaatcatctaggaacatcatctcaggagacctgctcgctagaccaaccgtagatttatcgagtcgcgtcgaaatggcaaaacaagtaggcgactgcaactatgaggctggcacatgttggggccaggagattggctgggtctatggatcaatgacagaggacatcttgaccgggctgcggatccatgcggcgggttgggaatcggccttattggacaccgagccaccggcattcctgggatgtgctccgaccggtggaccggccagcttgacccagttcaagagatgggcaacagggcttctggagatactcatcagccagaacagcccgatcctcggcaccatcttccgacgcctccaactccggcaatgccttgcctatctcatcgtagaagcgtggcccgtgcgggcgcctttcgagctgtgctatgcgctactgggacctttctgccttctcacaaaccagtccttcttgccaacggcatcggatgaaggtttccgcatcccagcggctctattcttgacctgccacatataccacctgatggagtacaaggagtgcgggctctcggtccgcgcctggtggaacaaccacaggatgcaacgcatcacctcggcctccgcctggctcctcgccttcctcaccgtcattctcaagacgctagggctctccgagaccgtgttcgaggtcacccgcaaggaaagcagcacgtcctccgatggcggcgcgggcaccgacgaggccgatcctgggctcttcaccttcgactcggcgcccgttttcatcccggtgacggtgctctcaatgctgaacattgtcgccctcgccgtcgcggcatggcgtgctgttgtcggggcggcggcgggcgttcatggtggcccgggcatcggggagttcgtgtgctgtggctggatcgtgctgtgcttctggccgttcgtgagagggcttgtcagcaggggaaagtatggaatcccgtggagtgtcagggtgaaggctggtttgattgtggctgcgttcgtgcacatctgcacaaggaactaaccggcggggctggccatagaaatattcgaagcgtaattttggttctgcacagaactactcctaccacatttgtaattaaaagcttgttgtaaaaaaaaaaaaa

SEQ ID NO: 2982 - protein, 752 aa, Triticum aestivum
MAGGKKLQERVALGRTAWMLADFVILLLLLALVARRAASLGERGGTWLAALVCEAWFAFVWILNMNGKWSPVRFDTYPDNLSHRMEELPAVDMFVTTADPALEPPLITVNTVLSLLALDYPDVGRLACYVSDDGCSPVTCYALREAAKFAGLWVPFCKRHDVGVRAPFMYFSSAPEVGNGTVDHEFLESWALMKSQYEKLARRIENADEGTIMRDGGDEFAEFIDAERGNHPTIVKVLWDNSKSKAGEEFPHLVYLSREKSPRHRHNFKAGAMNVLTRVSAVMTNAPIMLNVDCDMFANNPQVALHAMCLLLGFDDEIHSGFVQAPQKFYGGLKDDPFGNQMQVITKKIGGGLAGIQGMFYGGTGCFHRRKVIYGVPPPDTVKHEMKGSPSYKELQAKFGSSKELIESSRNIISGDLLARPTVDLSSRVEMAKQVGDCNYEAGTCWGQEIGWVYGSMTEDILTGLRIHAAGWESALLDTEPPAFLGCAPTGGPASLTQFKRWATGLLEILISQNSPILGTIFRRLQLRQCLAYLIVEAWPVRAPFELCYALLGPFCLLTNQSFLPTASDEGFRIPAALFLTCHIYHLMEYKECGLSVRAWWNNHRMQRITSASAWLLAFLTVILKTLGLSETVFEVTRKESSTSSDGGAGTDEADPGLFTFDSAPVFIPVTVLSMLNIVALAVAAWRAVVGAAAGVHGGPGIGEFVCCGWIVLCFWPFVRGLVSRGKYGIPWSVRVKAGLIVAAFVHICTRN

SEQ ID NO: 2983 - DNA, 1246 bp, Triticum aestivum
  misc_feature (1)..(1246): Ceres cDNA ID no. 21572642
  misc_feature (1)..(1246): Ceres CLONE  ID no. 555190
  misc_feature (1)..(1246): Also known as  Ceres CDNA ID no. 24368594
ctcaattcacaggtgcataaccaactcacaggtcgcgcaggacgaaaggaattgcaccggtgcgatcttcgtgtctgtccaccatggcggcgagtagtcaaactgaggagagcatgatgaactacgattctccggcgtgcggcggcgacgcggcagacacggtcatcgaggacctccccacggacgtgctgtccctcatgctccgccggctcgacggcgcgtcgctggcggcgctcggctgcgcgagctccagcttccacgacctcgccaccgaccccgacacatggcgcggactctgcctcgccctgtggccatcggtcgccggcctcctcgacaattcttgctgccgcggaaccggcgacggctttcaccgggcgctcttcgccgacgcgttcccgttcccagcgacgacggcggcggccccgggcacggtcgcgcccgccctgcctagccggctcgtgtccgcggtggacctgcaccacaagggggtctgcatcatgtcgcgcgtggtggagacggacgcctcgtcggcgtggttcctgggctcgccgttccgcgtcgacgcgcttctgcaggagggcttctcggcggcgtcctcgatcacgccggcggagctcacgctgagctggcttctgctcgacccgacgtcaggccgggtggtcaacgcctccagccggcggccggtgtccgttgaccggagctggctcacgggggagaccgtggcgcggttcaccgtggtgctcggcggcgtcgccctggacgcggccgtcacgtgcgacgaccggtttgggcacgtccgggaggtcagcctgtgcgtggaggacggcgacggaggcggcgtcagcgggcgggacgggctggccgcgatcgccgcggccatggccgccccgaggcagggccggggcgcggaggcggaggcacaggcggcacggcagtacggggagttcgtgaaggggaagagcgcgcggaaggagtggaaagcgaggcgggaggggctcgtcgacctctgctgctccggcgtcggagcggcggcgttcgtcgggttcctggtgatgctcacgtgccggtgagcgcgggcgcatcgactagtaaaggtttgctcacacgtgcgaggaatgtgaatacgtgttcgtccagtaggttgcacaggggcagagggtagctgccacaatgtacatgtactatagctcaaggccaagagttatcttttttgcatattttcagaaaggcaaaaaaaaaaaaaaaa

SEQ ID NO: 2984 - protein, 328 aa, Triticum aestivum
  misc_feature: PFam Name: F-box; PFam Description: F-box domain
  misc_feature: GI Number: 62701652; NR Description: F-box domain, putative
  misc_feature: GI Number: 50253058; NR Description: F-box protein-like [Oryza sativa (japonica cultivar-group)] >gi|50251878|dbj|BAD27806.1| F-box protein-like [Oryza sativa
MAASSQTEESMMNYDSPACGGDAADTVIEDLPTDVLSLMLRRLDGASLAALGCASSSFHDLATDPDTWRGLCLALWPSVAGLLDNSCCRGTGDGFHRALFADAFPFPATTAAAPGTVAPALPSRLVSAVDLHHKGVCIMSRVVETDASSAWFLGSPFRVDALLQEGFSAASSITPAELTLSWLLLDPTSGRVVNASSRRPVSVDRSWLTGETVARFTVVLGGVALDAAVTCDDRFGHVREVSLCVEDGDGGGVSGRDGLAAIAAAMAAPRQGRGAEAEAQAARQYGEFVKGKSARKEWKARREGLVDLCCSGVGAAAFVGFLVMLTCR

SEQ ID NO: 2985 - DNA, 1860 bp, Triticum aestivum
  misc_feature (1)..(1860): Ceres cDNA ID no. 21572643
  misc_feature (1)..(1860): Ceres CLONE  ID no. 555237
  misc_feature (1)..(1860): Also known as  Ceres CDNA ID no. 24356712
aaaaaccctagtgtaccactccacgaatggttgccgcccacctccgcgcaccaccatgctgctccgccgcctcctccacccctcccaccacctccggcgcggcctccagaccctaaccacgaccaccaacgccgccgctgcccccccgacaccgcatcctctctccgcccctctcccatttcgccgcctccccgcccgcctcctctcgccgcggctgctctccacctccggcggcgacgacgacacccgaagaccctgggccttcacgcaggactccggagatccggaccccttcgccgatgtggaccccgccgccgccgtccccggcgaagcgccgctaggatcgagcgccgtcgtcgagggcccgtggtcgaaggacttccgcgcggaggacagcgacaaggccgacgtgttcgaggagatctacaaggatgcggccgcggcagcgcctgccgtgaggaaggcggccccggccgagccgtggacgtgggatttggagggtgagaaagacgacccgttcgccgcgagaaaggatgcggccgcggcagcgcctaccgcgagaaaggcggccccggccgagccgtggacgtgggatttggaggacgagaaagacgatcccttcgccgcggctgtgcttgatgtggggctagaggggatcgcggatgagggtgctcagatcgaggagcttgttgatgggaaagaagaagatgcggagcgccagcggcaggaggacaaggcgagggagcagcagctgatggagactctcaaaggtcctgatcgtgcatttggggatctaatttctgcctctgggattacggaggagatgattgacagtttgatcctcttgaaggatgccaggggaataccaggattgcctcctctgagtgaaatacaagatagagctatccagaaaatgaatgcaacatcaagcagggcagaagtagaacgccaaatgcaagaggaaattgccaaggcacgtgtgagacaagttgatgagaaaggaagggcttatggtacaggtaaaaggaagtgcagcattgcccgtgtttggattcagcctggtgatggcaagtttgttgtcaatgacaagcagtttgatgcttacttcccaattctggatcatcgagctgatcttctccggccatttactgtgaccaagacgttggggctttgggatgtagcttgtactgtgaaaggtggtggtgtttcaggtcaagttggagctgtgcgcctagggatcagcagagccttacagaattgggaaccaggactacgcccatatctcaaagcagctggatatttaaccagagattcgcgtgtggtcgaaaggaagaagcctggaaaggcaaaggcaaggaagagcttccaatgggtcaagcgttaacaggtctacgtgcaaaattagcgtgcctctggtggcaggtcctctgctctttgttgtggattttgtagcgagcacagatctgtatttgcactggatgtgctgtcacttcggcggaaggcccttccaagctttgtactcggatattccagtttgcatcggtcatggagttcctgagacaccaaaaattatgttttttttaatgctgttgatcaggaaaaatgtcattttgacccaagatgcagaagatacttagtcatgagctgttgcctccgaataaaaccgggctgccaacaatgttcagcttacaatgttccttttctcctttcagtttcttatagtgggatgacatggctgtatgtcaaattaacgcagccgttttattgatagctagttccatgatgtatttctccttcatgtttgtccgtgcgtgctgcacatggaagattattttttatgtttcaaaaaaaaaaaaaaaa

SEQ ID NO: 2986 - protein, 442 aa, Triticum aestivum
  misc_feature: PFam Name: Ribosomal_S9; PFam Description: Ribosomal protein
  misc_feature: GI Number: 50939755; NR Description: putative 30S ribosomal protein S9 [Oryza sativa (japonica cultivar-group)] >gi|33354201|dbj|BAC81159.1| putative 30S ribosomal protein S9 [Oryza sativa (japonica cultivar-group)]
  misc_feature: GI Number: 50939753; NR Description: putative 30S ribosomal protein S9 [Oryza sativa (japonica cultivar-group)] >gi|33354200|dbj|BAC81158.1| putative 30S ribosomal protein S9 [Oryza sativa (japonica cultivar-group)]
  misc_feature: GI Number: 62289740; NR Description: RpsI, ribosomal protein, S9 [Brucella abortus biovar 1 str. 9-941] >>gi|62195872|gb|AAX74172.1| RpsI, ribosomal protein, S9 [Brucella
  misc_feature: GI Number: 23501677; NR Description: ribosomal protein S9 [Brucella suis 1330] >gi|38258389|sp|Q8G1C9|RS9_BRUSU 30S ribosomal protein S9 >gi|23347598|gb|AAN29719.1| ribosomal protein S9
MLLRRLLHPSHHLRRGLQTLTTTTNAAAAPPTPHPLSAPLPFRRLPARLLSPRLLSTSGGDDDTRRPWAFTQDSGDPDPFADVDPAAAVPGEAPLGSSAVVEGPWSKDFRAEDSDKADVFEEIYKDAAAAAPAVRKAAPAEPWTWDLEGEKDDPFAARKDAAAAAPTARKAAPAEPWTWDLEDEKDDPFAAAVLDVGLEGIADEGAQIEELVDGKEEDAERQRQEDKAREQQLMETLKGPDRAFGDLISASGITEEMIDSLILLKDARGIPGLPPLSEIQDRAIQKMNATSSRAEVERQMQEEIAKARVRQVDEKGRAYGTGKRKCSIARVWIQPGDGKFVVNDKQFDAYFPILDHRADLLRPFTVTKTLGLWDVACTVKGGGVSGQVGAVRLGISRALQNWEPGLRPYLKAAGYLTRDSRVVERKKPGKAKARKSFQWVKR

SEQ ID NO: 2987 - DNA, 1176 bp, Triticum aestivum
  misc_feature (1)..(1176): Ceres cDNA ID no. 21572644
  misc_feature (1)..(1176): Ceres CLONE  ID no. 555313
  misc_feature (1)..(1176): Also known as  Ceres CDNA ID no. 25088241
acgagcaagggttttaattccatcgttcccaaatctgtcgaactcttccgttcccggcgggcggcggctggtttaggcagcgagctgacggcggatctcctcaattccttggtgttcttcagtcccctcccctccttctcctatagtaaaccacgcggagacgatccaagatgggtgggtgctgctgctgtttcccctccaaacccccaagggagaacccaatgcacccaatcgcagagccgctcatcaagcggaagcccaatcacacccctccctaccatcaaaggcccccggtgaccacccatgctcacaagggtatgaacgctgtcgtgcgcctgaagaccggcttcgagcgtttcagaacgaatgtgtacaacaagaacccgaagctttttgaatcacttaggaaggaccagtcccccaagtacatggtgtttgcatgtgctgactcgcgtgtgtctccaacaataaccctcggactgaatccaggagaggccttcactgttcgaaatattgctggaatggttcctgcctatcaaaagacaaggcactgcagcgtcgggtcagccatcgagtttgccgtggttgtcctcaaggttgagtgcattgttgtgattggtcacagccgctgtggtggaattagggaactactctcactgaaggacgaagggcctaacgcctaccacttcattgaggactgggtgaagatcggtatggaggccaagaagaaggtccagagagaaaacaggttgttgccttttgacgaccaatgcaccgtgctggaaaaggaggccgtcaaattttcccttagaaatttgaagtcgtacccgttcgtcaaggacagactgaacaagggcacactgaatttgattggtgcccgctatgactttgtccacggaagcttcgaaacgtggaatgcctgaagtcaagtagtgcagaaatggttagctagctagccagtcgcaaatatttcgtcgaaaaaggctagttgcatgcatcgctgttgctgggtttgcattccatgcaagtcctttgggtaccgccaagatagatttttttttgacagcaatatgttttattcctcaaacaatagccatgtcatgtacaagtaattgagaaataaaagtataaaaccagggatagaatcatcccaaaagctgaaaaaaaaaaaaaaaa

SEQ ID NO: 2988 - protein, 250 aa, Triticum aestivum
  misc_feature: PFam Name: Pro_CA; PFam Description: Carbonic anhydrase
  misc_feature: GI Number: 729003; NR Description: CARBONIC ANHYDRASE, CHLOROPLAST PRECURSOR (CARBONATE DEHYDRATASE) >gi|7436817|pir||T04478 probable carbonate dehydratase (EC 4.2.1.1)
  misc_feature: GI Number: 34911604; NR Description: carbonic anhydrase [Oryza sativa (japonica cultivar-group)] >gi|3345477|dbj|BAA31953.1| carbonic anhydrase [Oryza sativa] >gi|15290096|dbj|BAB63789.1| carbonic anhydrase [Oryza sativa
  misc_feature: GI Number: 5917783; NR Description: carbonic anhydrase 3 [Oryza sativa] >gi|7436816|pir||T03254 probable carbonate dehydratase (EC 4.2.1.1), chloroplast - rice
  misc_feature: GI Number: 606815; NR Description: carbonic anhydrase >gi|7489810|pir||T02080 probable carbonate dehydratase (EC 4.2.1.1)
  misc_feature: GI Number: 606811; NR Description: carbonic anhydrase >gi|7489809|pir||T02079 probable carbonate dehydratase (EC 4.2.1.1)
MGGCCCCFPSKPPRENPMHPIAEPLIKRKPNHTPPYHQRPPVTTHAHKGMNAVVRLKTGFERFRTNVYNKNPKLFESLRKDQSPKYMVFACADSRVSPTITLGLNPGEAFTVRNIAGMVPAYQKTRHCSVGSAIEFAVVVLKVECIVVIGHSRCGGIRELLSLKDEGPNAYHFIEDWVKIGMEAKKKVQRENRLLPFDDQCTVLEKEAVKFSLRNLKSYPFVKDRLNKGTLNLIGARYDFVHGSFETWNA

SEQ ID NO: 2989 - DNA, 1225 bp, Triticum aestivum
  misc_feature (1)..(1225): Ceres cDNA ID no. 21572645
  misc_feature (1)..(1225): Ceres CLONE  ID no. 555458
  misc_feature (1)..(1225): Also known as  Ceres CDNA ID no. 23733212
atcaaaccattaaacagtacgggcttcctcatctactagctcgtcgttagctatggccgccaccgcggtgaggtgcctgctcatggccgccgctgtcctggccccgcttttcgccggctccgagggcgcgtatctgacgcccaagttctacgaccggaggtgccccggcttgccgggcatcgtgcgggcggcgatgacgcaggccgtcgcggccgagccgcggatgggcgcctccatcctccgtttgttcttccacgactgcttcgtcaatggctgcgacgcgtcgatcttgctcgacgacaccgccaacttcaccggcgagaagaatgcggggccgaacgccaactcggtgcgcggctacgacgtcatcgacaccatcaaggcccaggtcgaggcggcctgcaaggccaccgtctcctgcgccgacatcgtcgccctcgccgcacgggacagcgtcaacctgctcggcgggccgacgtggacggtgcagctgggccgccgcgacgcgcggaacgcgagccagagcgcggccaactccaacctcccgagcccggcgtccagcctcgccggcctgatcaccacgttcggcaacaaggggctgacgccgcgggacatgacggcgctgtccggcgcgcactcgctcgggcaggcccggtgcgccaccttccgcgaccgcatctacaacgacaccaacatcgaccccaagttcgcggcgctccggaagctgacgtgcccgcagaccggcggcgacgccgcgctcgcgcccatcgacgtgtcgacgccgacctggttcgacaccacctactacgacaacctcgttaacaagcaggggcttttccattcggaccaggagctgtacaacggcggctcgcaggacatcatggtgaaggtgtacatgcgcaacccggacacattcgccatggacttcggcaaggcgatggtgaagatgggcagcctcatgccgtcggcggacacgcccacggagatcaggctggactgcaagaagatcaactaatataaggtcaaccggatcggaggatgaacctgtggtgtccagtccggacgaattcgcgaggctatgcatgctcacagcttcactcagagtacattgagcagccaaaagggctgttagccgatatgggactgctcccatttccattttgttgctggcaattgtaatgatcaattaattaatcaagattcttttccaaaaaaaaaaaaaaaa

SEQ ID NO: 2990 - protein, 320 aa, Triticum aestivum
  misc_feature: PFam Name: peroxidase; PFam Description: Peroxidase
  misc_feature: PFam Name: Pkinase; PFam Description: Protein kinase domain
  misc_feature: PFam Name: Cation_efflux; PFam Description: Cation efflux family
  misc_feature: GI Number: 55701043; NR Description: TPA: class III peroxidase 88 precursor [Oryza sativa (japonica cultivar-group)] gi|53792939|dbj|BAD54114.1| putative bacterial-induced peroxidase
  misc_feature: GI Number: 55701039; NR Description: TPA: class III peroxidase 86 precursor [Oryza sativa (japonica cultivar-group)] gi|53792947|dbj|BAD54122.1| putative bacterial-induced peroxidase
  misc_feature: GI Number: 55701041; NR Description: TPA: class III peroxidase 87 precursor [Oryza sativa (japonica cultivar-group)] gi|53792942|dbj|BAD54117.1| putative bacterial-induced peroxidase
  misc_feature: GI Number: 61697137; NR Description: peroxidase [Populus alba
  misc_feature: GI Number: 5453379; NR Description: bacterial-induced
MAATAVRCLLMAAAVLAPLFAGSEGAYLTPKFYDRRCPGLPGIVRAAMTQAVAAEPRMGASILRLFFHDCFVNGCDASILLDDTANFTGEKNAGPNANSVRGYDVIDTIKAQVEAACKATVSCADIVALAARDSVNLLGGPTWTVQLGRRDARNASQSAANSNLPSPASSLAGLITTFGNKGLTPRDMTALSGAHSLGQARCATFRDRIYNDTNIDPKFAALRKLTCPQTGGDAALAPIDVSTPTWFDTTYYDNLVNKQGLFHSDQELYNGGSQDIMVKVYMRNPDTFAMDFGKAMVKMGSLMPSADTPTEIRLDCKKIN

SEQ ID NO: 2991 - DNA, 1120 bp, Glycine max
  misc_feature (1)..(1120): Ceres cDNA ID no. 21572646
  misc_feature (1)..(1120): Ceres CLONE  ID no. 556077
  misc_feature (1)..(1120): Also known as  Ceres CDNA ID no. 25088242
aaaactcaaacaaagccaattctttttctcctttgttcaatgaaacacccttccttgtcatatcaatggctacttttgatttctctgacacactcaacccttctcaccgcaaaacactcattgacaattccaaggatgagtccaattcctgaatgggaaacatcactacacgaccacccagttgcaactgatgccgaagaagtgaaaacattttacttcaaacaggttctggatcacttcaactacaggccagaaagctacacaacgtttcaacaaagatatctcgtcaatttcaagtactggggtggtgccaattctagtgcccccatatttgcatactttggtgctgaatcaccaattgataactcacctaacggcattggatttttaactgataacgctgcttctttcaatgcccttttggtatacatagagcaccggtattatgggaaatcagtgccatttggatccagggaagaagcattgaagaatgcaagcactattgggtatttcaactcagctcaagccttggcagattatgcagcaatactcgaacatataaagaagacattacatgcccaaaattccccggtgattgtaattggaggatcatatggtggaatgcttgcttcatggtttaggctcaaatatccccacctgaccgttggtgccttggcctcagcagctccaatcctatactttgataaaattacaccacaaaatggttactactctgttgtcacaagggattatcgagatgccagtgagacatgctatgaaactatacttaagtcttggtctgaaatccacagagtagcttcacaaccaaatggtctagtcactctcagccacagattcaacacttgccagtacaaacactaattttatctcttccttttgtttgtaaagaaatgctctagcaagtcaatcttcacattctgtattataggatgaaatctatttaaaacttattaatgatgtgggttgcacttgcaccactcttctgcttcactaaatgatgtagattgtgggttgcagtcacattcttacaactctcaccccatgtgaatttcaccttataataagactaatatttcactaagaaaaaaaaaaaaaaaaa

SEQ ID NO: 2992 - protein, 280 aa, Glycine max
  misc_feature: PFam Name: Peptidase_S28; PFam Description: Serine
  misc_feature: GI Number: 21537161; NR Description:
  misc_feature: GI Number: 10177233; NR Description: prolylcarboxypeptidase-like protein [Arabidopsis thaliana] >gi|30688688|ref|NP_851059.1| serine carboxypeptidase S28 family
  misc_feature: GI Number: 30688698; NR Description: serine carboxypeptidase
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 20197495; NR Description: putative prolylcarboxypeptidase [Arabidopsis thaliana] >gi|25350513|pir||G84634 probable prolylcarboxypeptidase [imported]
MKHPSLSYQWLLLISLTHSTLLTAKHSLTIPRMSPIPEWETSLHDHPVATDAEEVKTFYFKQVLDHFNYRPESYTTFQQRYLVNFKYWGGANSSAPIFAYFGAESPIDNSPNGIGFLTDNAASFNALLVYIEHRYYGKSVPFGSREEALKNASTIGYFNSAQALADYAAILEHIKKTLHAQNSPVIVIGGSYGGMLASWFRLKYPHLTVGALASAAPILYFDKITPQNGYYSVVTRDYRDASETCYETILKSWSEIHRVASQPNGLVTLSHRFNTCQYKH

SEQ ID NO: 2993 - DNA, 1516 bp, Glycine max
  misc_feature (1)..(1516): Ceres cDNA ID no. 21572647
  misc_feature (1)..(1516): Ceres CLONE  ID no. 556519
  misc_feature (1)..(1516): Also known as  Ceres CDNA ID no. 23406387
aatcaatcaatatacctagtagtgattagatttagtgatcgatcctctcctttcgttctcaaaccgtagatttagattttagggtttctctcttaatataatcttttgacacttccgtaacaaacaaaaaaattacataaattttcccttataattattattatttggcttttatctttggattaactaggcttgagctatcacaaataattgtttcggagaatggaaaagaaaaaggtggcagttcccctcgtgtgccacggtcattctcgccctgtggttgatctcttctacagtcccgttacgcctgatgggtttttcctcatcagtgccagcaaggattcgagtcctatgctcagaaatggagagactggagattggattggaacatttgaagggcacaaaggtgctgtgtggagttgctgcttggataccagtgccttacgtgccgcaactgcttctgctgatttctcaacgaaagtttgggatgctttaacaggagatgaattgcactcttttgagcataagcacattgttcgagcatgtgctttttctgaggatactcaccttttgctcactgggggagttgagaaaattctccggatctatgatatgaataggcctgatgcgccacccagagaagtggataagtcccctggttctgtcagaactgttgcctggcttcatagtgaccagacaatattgagttcatgtactgatatgggaggtgtcaggttatgggatgtaagaagtggtaaaatagtccagacacttgaaactaagtcatctgtgacaagtgctgaagtgagtcaggatggccgttatataaccactgctgatggttctactgtaaagttttgggatgcgaactactatggattggtgaagagctatgatatgccctgcactgtggaatcagtttcactggagcctaagtatgggaacaagttcgttgccggcggagaagatatgtgggttcgtgtgtttgatttccatacagggaatgagattgcatgcaacaaggggcaccacggtcctgtccactgtgttcgtttttctcctggtggagaatcctatgcctcaggatctgaggatggaaccatcagaatatggcagactggccccttgaccctcgatgactcagagactgtgtctgcaaatggttcagttgataaggtgaaggaaactgcagatgaggtttcacgcaagattgagggttttcaaattgcagatgaggggaaatctaaagaaaaggatgaggctgtggaggaatcaagctaatatagtctcgcattttgtctggcagagtgttagaattaactagatcaagtgcctactactcatgtacgtgattagtaaagtaaattttgtaaattttagtttgtttgagattttactgaattgaacgagcttgttgcatctggcttaaataagttctatgtttgcttttatttcaattctgacattggagtttatggaatataggaagtgacttggtaaaaaaaaaaaaaaaaaa

SEQ ID NO: 2994 - protein, 352 aa, Glycine max
  misc_feature: PFam Name: WD40; PFam Description: WD domain, G-beta repeat
  misc_feature: GI Number: 30725304; NR Description: At1g52730 [Arabidopsis thaliana] >gi|5903032|gb|AAD55591.1| Similar to gb|AJ010025 unr-interacting protein from Homo sapiens and contains 3 PF|00400
  misc_feature: GI Number: 50725469; NR Description: putative WD-40 repeat
  misc_feature: GI Number: 50906147; NR Description: putative serine-threonine kinase receptor-associated protein [Oryza sativa (japonica cultivar-group)] >gi|51536270|dbj|BAD38438.1| putative serine-threonine kinase receptor-associated protein [Oryza sativa
  misc_feature: GI Number: 41053501; NR Description: serine/threonine kinase receptor associated protein [Danio rerio] >gi|41107550|gb|AAH65428.1| Serine/threonine kinase receptor
  misc_feature: GI Number: 12667270; NR Description: serine-threonine kinase
MEKKKVAVPLVCHGHSRPVVDLFYSPVTPDGFFLISASKDSSPMLRNGETGDWIGTFEGHKGAVWSCCLDTSALRAATASADFSTKVWDALTGDELHSFEHKHIVRACAFSEDTHLLLTGGVEKILRIYDMNRPDAPPREVDKSPGSVRTVAWLHSDQTILSSCTDMGGVRLWDVRSGKIVQTLETKSSVTSAEVSQDGRYITTADGSTVKFWDANYYGLVKSYDMPCTVESVSLEPKYGNKFVAGGEDMWVRVFDFHTGNEIACNKGHHGPVHCVRFSPGGESYASGSEDGTIRIWQTGPLTLDDSETVSANGSVDKVKETADEVSRKIEGFQIADEGKSKEKDEAVEESS

SEQ ID NO: 2995 - DNA, 1584 bp, Glycine max
  misc_feature (1)..(1584): Ceres cDNA ID no. 21572648
  misc_feature (1)..(1584): Ceres CLONE  ID no. 557372
  misc_feature (1)..(1584): Also known as  Ceres CDNA ID no. 0
aaataaaaacaaaaagaaaaaaaattctacaacaaccgcaatcacaataacaaggacgaagagagagtgaaaaatcacagagacgaaaagatcgtcttctgaatcggaacaaggtgttcaggtttaaattttaaagcaatatactagcaatcatgaaattcaagaaagggaataaggtggaagtgttaagcaaagttgaggtgccttgtggctcctggctatgtgcagagatcatttgcagtaatggccaccactatactgtgaaatatgatggatatgaaagtgacgctggtgaggcaattgttgagcgggtgtccaggaaagacttaaggccatgtccacctgcacttgaactcacagataattggagtccaggtgatgtggtagagatcttccagaacttctcatggaagatggctacagttttgaagatattggggaaaaaccacattttggtcaggctacttggatcttctttggaatttcaagtgagcaaatttgacattcgggtgagacagtcttggcaagatgacaagtggattatagttggaaagggttcttccagctgtgagaacagaaaacgttctagcacccaacttcagaagacatctacaaagacaaaactatcaggttctgcttactatcgtcctgaaaagaaaaaactgagtattctggaatcagaactcatttattttaaaacattgaaacgaggaagcaattcacaagttgaggcatatgctgagcctcccccaaagtttagagcacttgaaaatgaaggcagatgtcacagagcaagagttagaaatccacccacaccactcaaacaggtacagggtgtcagttttccaagagatgtgattgctgaagaatgtatacctgcttctgtaaacaacagaaaaactgggatttctaatatgattgacatggagaggaggaaagagactggcactgtgggttgttcatttggagaaaacagagaatcaaatcatgctgatagtattacatgctcagttggtagttgtagtatcactagcaggaattcctgtaaactgcaatttcctgtatctgcaggtccttttgatgatgtagacagttcatttagtgatgctgagtctgtctgccagaggagtgatgaggaaggggattgttcccctcctacacaagaggaattggcagcagaaattcataggttagagttgcatgcctatcgttgtacaattgaggcattgcatgcatcaggccccttaagttgggaacaggaagcattaatgacaaacctccgtctttcgctccacatatcaaacgatgaacacttaatggagctaagaaatttgatttcttctgaaaacagcattcctttaagatgacaggattttttttcctcttcaatttagtactttttccctaggatagagtttcataatagtttgatctcagcctcattcaactgtaagaagaaagatgaaatatttgggtccttcatttatgttttgacttagtgatatagtttgatgtgaatgtatatgctgaactgcatgaataagtgatcatttctgaactcttgttaaaaaaaaaaaaaaaaaa

SEQ ID NO: 2996 - protein, 404 aa, Glycine max
MKFKKGNKVEVLSKVEVPCGSWLCAEIICSNGHHYTVKYDGYESDAGEAIVERVSRKDLRPCPPALELTDNWSPGDVVEIFQNFSWKMATVLKILGKNHILVRLLGSSLEFQVSKFDIRVRQSWQDDKWIIVGKGSSSCENRKRSSTQLQKTSTKTKLSGSAYYRPEKKKLSILESELIYFKTLKRGSNSQVEAYAEPPPKFRALENEGRCHRARVRNPPTPLKQVQGVSFPRDVIAEECIPASVNNRKTGISNMIDMERRKETGTVGCSFGENRESNHADSITCSVGSCSITSRNSCKLQFPVSAGPFDDVDSSFSDAESVCQRSDEEGDCSPPTQEELAAEIHRLELHAYRCTIEALHASGPLSWEQEALMTNLRLSLHISNDEHLMELRNLISSENSIPLR

SEQ ID NO: 2997 - DNA, 1370 bp, Glycine max
  misc_feature (1)..(1370): Ceres cDNA ID no. 21572649
  misc_feature (1)..(1370): Ceres CLONE  ID no. 561353
  misc_feature (1)..(1370): Also known as  Ceres CDNA ID no. 24366750
gaaaaccaggcaaaggttatcgttcctgcttcgaagttgcataacgcattccgcagctttgcaatgccacgcccaaagcttcgtccaaggtttgctccccaacgccgttctcgaaactgacctcttgttagtctactctaaactcggccttctccgcaaagctcgcaaagtgttcgataaaatgctcgacagaagaaacatgtactcgtggaacatcatgattgcctcctatgcccagcattgcatgtattatgatgtcttaatggttttccacgagttcaagcactgctgccttaggcctgatcattacaccctgcccccgttgttcaaggcatctgtgggagtggacgatgcttgcattggaagcatgtgccacggtttggttataaggattgggtatgaaggatatgctattgtggcaaattctctgcttgagttttatgttaagtttggggcgatgcctcaggctttttgtgtgttttcgaacatgtcatgtaaggattccgtgacatggaatttgatgatctcgggatttggaagggccggtttgtattcggatgcaatgcattgtttcagggagatgctaagtttgaatgagatgatgagggtggatttcatgactcttcctagcgttattaatgcttgtggaaaggaaggagacttgttgaaagtgagagaagttcatggctatgtagtgagaagctttggttttgatgcagatgctgccattgggaatgcattgattgatgtgtattgcaagtgtggatgcttgaatgattcagaaaagattttcaggaccatacgccacgtgaacttagtcacgtggaccaccatgatatcttgttatggggcacatggaaaaggggaggaatctcttttgctgtttaagaagatggtagatgaagggtttaggccaaaccctgttacactcacagcaatcttggccagttgtagccgctcaggtatgatagatcaaggcaagcacattttcagctcaatatgttcagactatggatttgagcctactgttgagcattatgcttgtatggtggatcttctgagccgctgtgggtatcttgtggaagcacttcagttgttggaaagcaagaaatcatcagtgacaggaagcatgtggggtgcccttcttgctggttgtgtaatgcacaaaaatgttgaaattggagaaattgcagctcatcggctattccaattagaaccagataatgctagcaactacatagctttgtgtggtatctatcaatctcttgattttagttggaaatttggatcctgatgtcacaaatgatcgcatgaagcaagtttttggcccgtatggagaattagttggtgtggcaaaaaaaaaaaaaaaa

SEQ ID NO: 2998 - protein, 370 aa, Glycine max
  misc_feature: PFam Name: PPR; PFam Description: PPR repeat
  misc_feature: GI Number: 42565133; NR Description: pentatricopeptide (PPR)
  misc_feature: GI Number: 62734753; NR Description: Similar to
  misc_feature: GI Number: 30694644; NR Description: pentatricopeptide (PPR)
  misc_feature: GI Number: 51090953; NR Description: selenium-binding protein-like [Oryza sativa (japonica cultivar-group)] >gi|51090919|dbj|BAD35524.1| selenium-binding protein-like [Oryza
  misc_feature: GI Number: 18418348; NR Description: pentatricopeptide (PPR)
MLDRRNMYSWNIMIASYAQHCMYYDVLMVFHEFKHCCLRPDHYTLPPLFKASVGVDDACIGSMCHGLVIRIGYEGYAIVANSLLEFYVKFGAMPQAFCVFSNMSCKDSVTWNLMISGFGRAGLYSDAMHCFREMLSLNEMMRVDFMTLPSVINACGKEGDLLKVREVHGYVVRSFGFDADAAIGNALIDVYCKCGCLNDSEKIFRTIRHVNLVTWTTMISCYGAHGKGEESLLLFKKMVDEGFRPNPVTLTAILASCSRSGMIDQGKHIFSSICSDYGFEPTVEHYACMVDLLSRCGYLVEALQLLESKKSSVTGSMWGALLAGCVMHKNVEIGEIAAHRLFQLEPDNASNYIALCGIYQSLDFSWKFGS

SEQ ID NO: 2999 - DNA, 1264 bp, Glycine max
  misc_feature (1)..(1264): Ceres cDNA ID no. 21572650
  misc_feature (1)..(1264): Ceres CLONE  ID no. 561537
  misc_feature (1)..(1264): Also known as  Ceres CDNA ID no. 24360001
agcataccatatccaatcattctaacggataggatagaaaagagcaaaactgtttgagtctgagagaacttgaaacaacaatggcttcactttccctctctctctccacaccaacaacaccaacctcactctccttcacatcatcctccatcttcttctcttcacaccaattccacacacacaataattctttcaaatccaacagctttcccgttttaccctccaaaaaacccctctccatttcctgcaaggcctcccctcctcttcccgtcctcaacttctccggcgagagggtcggcgagtccttcctcgacctccgctccgcccctcccgacaccgcccgagccgtcgtccaccgcgccgtcgtcaccgacctccagaacaagcgccgcggcaccgcctccaccctcacccgcggagaggtccgaggcggcggacggaagcccttcccgcagaaaaaaaccggtcgcgcccgccgcggctccaaccgcacgcccctccgccccggcggaggcgtcatcttcggcccgaagccccgcgactggtccatcaagatcaaccgcaaggagaagcgcctcgccatctccaccgctgttgccagcgctgccgccagtgccgtcgtggtggaggacttcgcagcggagttcgccgagaagccgaagacgaaggagttcatcgcggcgatgaagcggtgggggctcgacccgaaggagaaggcgatgttcttgatgacggaggtgccggagaacgtgaggctatcgagcaggaacattgggaccttgaagatgcacacgccgaggacactgaatttgtatgatattcttgatgcggataagcttgtgctcacgcagggtgctgtggattacttgaatcagaggtatgggggtgattatcaagggagtgatgatgaagatgaagaagaagaagaagagggatatgaagagggtgaggaggaaggtgtagtggatggtgaagaaggacctgacgcaggggatagtgatgtggtaaattgagggtttaaagtcttctttgtgccattttatagaggaagttgctgatacagggatggaaggtctaaagtcttatttatttctaccaatttatgtttctttcctttccatcacataggatcctaatcttggtaacctgtaaggatatttgcctttgcccaatttcaatcatattagcttgcaggctcctttgtgtaatttattgaatcaattttgttgcttgtagtttgttttgtgcaaaaaaaaaaaaaaaa

SEQ ID NO: 3000 - protein, 310 aa, Glycine max
  misc_feature: PFam Name: Ribosomal_L4; PFam Description: Ribosomal protein
  misc_feature: PFam Name: Pyr_redox_2; PFam Description: Pyridine
  misc_feature: PFam Name: FH2; PFam Description: Formin Homology 2 Domain
  misc_feature: PFam Name: Pkinase; PFam Description: Protein kinase domain
  misc_feature: PFam Name: Extensin_2; PFam Description: Extensin-like region
  misc_feature: GI Number: 2792007; NR Description: chloroplast ribosomal protein L4 [Spinacia oleracea] >gi|3914665|sp|O49937|RK4_SPIOL 50S ribosomal protein L4, chloroplast precursor (R-protein L4)
  misc_feature: GI Number: 30680078; NR Description: 50S ribosomal protein
  misc_feature: GI Number: 8778555; NR Description: F22G5.34 [Arabidopsis thaliana] >gi|25294989|pir||D86208 protein F22G5.34 [imported] -
  misc_feature: GI Number: 21537296; NR Description: ribosomal protein L4
  misc_feature: GI Number: 2791998; NR Description: ribosomal protein L4 [Arabidopsis thaliana] >gi|2792000|emb|CAA74894.1| ribosomal
MASLSLSLSTPTTPTSLSFTSSSIFFSSHQFHTHNNSFKSNSFPVLPSKKPLSISCKASPPLPVLNFSGERVGESFLDLRSAPPDTARAVVHRAVVTDLQNKRRGTASTLTRGEVRGGGRKPFPQKKTGRARRGSNRTPLRPGGGVIFGPKPRDWSIKINRKEKRLAISTAVASAAASAVVVEDFAAEFAEKPKTKEFIAAMKRWGLDPKEKAMFLMTEVPENVRLSSRNIGTLKMHTPRTLNLYDILDADKLVLTQGAVDYLNQRYGGDYQGSDDEDEEEEEEGYEEGEEEGVVDGEEGPDAGDSDVVN

SEQ ID NO: 3001 - DNA, 785 bp, Glycine max
  misc_feature (1)..(785): Ceres cDNA ID no. 21572651
  misc_feature (1)..(785): Ceres CLONE  ID no. 564489
  misc_feature (1)..(785): Also known as  Ceres CDNA ID no. 23693969
ttgaaatgttggaagtcaataaaaatttgactgaatttgctatccatggaaacagaatttccttaagttgtttaagcagaataagaaagattttggcaaggaaccaaaaagaagcaaatgaaagagagccaaataagctcaagacggaattatacagacttcaatatgaacaaaagaagattgtcgatgctaaagaaaagctcaaagttcaagaaaaggaaattaacaaagccattgaaactaaggatactttaattaaagatattgaaaaattcaaaaacaatgaaacctataaaaggaaggctttacaagataagattgaagaacaaaagagtgaattatctcgaaagaaaggttttatcagtgataaaaaagatgaattagaaaagatgaaaatcaagcaccaagctgaaatggcagtgttaaaaggggaatatgaaggagccgtgaaaaagaagactgacttagatggtgatttaaagcaaatgcaggaatcaaaggagaagatggaagaggattatatggcaactatcaatcacttgaagggtcaaatcacaaatctcaagaaaaagggagaagaccttaagaagaaagaacaatctcttaatgaagagtttagaatgctcaagatgcattaatattcatattaatcaaaatgaaaacttaagttggtcatttatagatctgttgttattttttttacttttattgtatatggtgaattagttacctttcatactctctaaattcatgaatcaaactatgataaaaaaaaaaaaaaaaaa

SEQ ID NO: 3002 - protein, 785 aa, Glycine max
  misc_feature: PFam Name: Myosin_tail_1; PFam Description: Myosin tail
  misc_feature: PFam Name: TolA; PFam Description: TolA protein
  misc_feature: PFam Name: ERM; PFam Description: Ezrin/radixin/moesin family
  misc_feature: PFam Name: Filament; PFam Description: Intermediate filament
  misc_feature: PFam Name: Tropomyosin; PFam Description: Tropomyosin
  misc_feature: GI Number: 37595288; NR Description: M protein [Streptococcus
  misc_feature: GI Number: 34485692; NR Description: M protein [Streptococcus
  misc_feature: GI Number: 34485690; NR Description: M protein [Streptococcus
  misc_feature: GI Number: 37595224; NR Description: M protein [Streptococcus
  misc_feature: GI Number: 12718845; NR Description: enterophilin-2L [Cavia
TTGAAATGTTGGAAGTCAATAAAAATTTGACTGAATTTGCTATCCATGGAAACAGAATTTCCTTAAGTTGTTTAAGCAGAATAAGAAAGATTTTGGCAAGGAACCAAAAAGAAGCAAATGAAAGAGAGCCAAATAAGCTCAAGACGGAATTATACAGACTTCAATATGAACAAAAGAAGATTGTCGATGCTAAAGAAAAGCTCAAAGTTCAAGAAAAGGAAATTAACAAAGCCATTGAAACTAAGGATACTTTAATTAAAGATATTGAAAAATTCAAAAACAATGAAACCTATAAAAGGAAGGCTTTACAAGATAAGATTGAAGAACAAAAGAGTGAATTATCTCGAAAGAAAGGTTTTATCAGTGATAAAAAAGATGAATTAGAAAAGATGAAAATCAAGCACCAAGCTGAAATGGCAGTGTTAAAAGGGGAATATGAAGGAGCCGTGAAAAAGAAGACTGACTTAGATGGTGATTTAAAGCAAATGCAGGAATCAAAGGAGAAGATGGAAGAGGATTATATGGCAACTATCAATCACTTGAAGGGTCAAATCACAAATCTCAAGAAAAAGGGAGAAGACCTTAAGAAGAAAGAACAATCTCTTAATGAAGAGTTTAGAATGCTCAAGATGCATTAATATTCATATTAATCAAAATGAAAACTTAAGTTGGTCATTTATAGATCTGTTGTTATTTTTTTTACTTTTATTGTATATGGTGAATTAGTTACCTTTCATACTCTCTAAATTCATGAATCAAACTATGATAAAAAAAAAAAAAAAAAA

SEQ ID NO: 3003 - DNA, 1656 bp, Glycine max
  misc_feature (1)..(1656): Ceres cDNA ID no. 21572652
  misc_feature (1)..(1656): Ceres CLONE  ID no. 565330
  misc_feature (1)..(1656): Also known as  Ceres CDNA ID no. 24356330
acaacctcaagttcacacccttgtctctatggatgatccaattgaagttccaccaaccaccgccagccacgtggtggcgatgccatacccagggcgaggccacgttaaccccatgatgagcctctgcaagctgctcctatccaaaaactccgacatcctcgtaaccttcgtggtcaccgaggaatggcttggcctcatcggctccgaccccaaacccgacaacatccgattcgccacaatcccaaacgttattccctccgaacacggtcgagccaacgacttcgtcaccttcgtcgaagccgttatgaccaaaatggaagctccctttgaagacttactcaaccggcttttgccgccaacagtgatcatatacgacacttacctcttctgggtggttcgcgttgcaaataagagaagcattcccgtggcgtcgttttggccgatgtcggcgtcgtttttcgctgtgctcaaacactaccatcttctcgagcaaaatggtcactatcctgtaaacgtatcagaagacggtgagaaacgtgtggattatattccggggaactcgtcaattcgtctggcagattttccacttaatgatggaagttggcgcaaccgaagattgttggaattgtccttgaatgctataccatggatgcagaaatcgcaatatctgttatttccttccatatacgagcttgagcctcgagctattgatgctttgaaatccgagttctctatacccatttacactgttggccctgccataccttcttttggtaatagcctcattgatgacattggctacttccaatggcttgacaaccaaccctctggctctgtattgtacatctctcaagggagttttctttcgttttccaatgaacaaattgatgaaattgcggccggtgttcgcgaaagtggcgttcgattcttgtgggtgcagcccggagagagtgataagttgaaagagatgtgtggggataggggacttgttttggcatggtgtgatcaattgagagtgttgcagcatcattctattggggggttttggtctcattgtggctggaattccaccagagaaggagtttttagtggtgttccttttttggcctttccaatattaatggaccaaccactaaacggtaagttgatagtagaggaatggaaggtggggtggagggtgaagaaggaggtgaaaaaggacactttgataacaaaagatgaaattgctaatcttattaagaggtttatgcatttgggtggggatgaagtgagagatatgaggaaaagaagcagagagctgaagcagatatgtcaccgtgcaattgcaagtggtggatcatcagaatccaatatcaatgcttttctcttgcatatattacaggatgccaagcctcattaagaacatagttatttggtacttggtccttgtacgctgttactcatattttacattattacaaacatgtatttttgacggaaaaccgtcaaaaacccagcattaatgaacaaaaaaaaaaactctttaagtgagtaacaatgctggttttgttttgatcctccaatttcttttatattaattctcccggctagagtgttggatcctttatcaaataaggcctagtatttcatatttaaaaaataaaaaaaaaaaaaaaa

SEQ ID NO: 3004 - protein, 1656 aa, Glycine max
  misc_feature: PFam Name: UDPGT; PFam Description: UDP-glucoronosyl and
  misc_feature: GI Number: 3150405; NR Description: putative glucosyltransferase [Arabidopsis thaliana] >gi|15227717|ref|NP_180576.1| UDP-glucoronosyl/UDP-glucosyl transferase family protein [Arabidopsis thaliana]
  misc_feature: GI Number: 30387551; NR Description: At2g30140 [Arabidopsis thaliana] >gi|20260554|gb|AAM13175.1| putative glucosyltransferase [Arabidopsis thaliana] >gi|3150406|gb|AAC16958.1| putative glucosyltransferase
  misc_feature: GI Number: 55296827; NR Description: putative UDP-glucose:salicylic acid glucosyltransferase [Oryza sativa
  misc_feature: GI Number: 34909048; NR Description: putative glucosyltransferase [Oryza sativa (japonica cultivar-group)] >gi|20804579|dbj|BAB92271.1| putative glucosyltransferase [Oryza
  misc_feature: GI Number: 34909046; NR Description: putative glucosyltransferase [Oryza sativa (japonica cultivar-group)] >gi|20804578|dbj|BAB92270.1| putative glucosyltransferase [Oryza
ACAACCTCAAGTTCACACCCTTGTCTCTATGGATGATCCAATTGAAGTTCCACCAACCACCGCCAGCCACGTGGTGGCGATGCCATACCCAGGGCGAGGCCACGTTAACCCCATGATGAGCCTCTGCAAGCTGCTCCTATCCAAAAACTCCGACATCCTCGTAACCTTCGTGGTCACCGAGGAATGGCTTGGCCTCATCGGCTCCGACCCCAAACCCGACAACATCCGATTCGCCACAATCCCAAACGTTATTCCCTCCGAACACGGTCGAGCCAACGACTTCGTCACCTTCGTCGAAGCCGTTATGACCAAAATGGAAGCTCCCTTTGAAGACTTACTCAACCGGCTTTTGCCGCCAACAGTGATCATATACGACACTTACCTCTTCTGGGTGGTTCGCGTTGCAAATAAGAGAAGCATTCCCGTGGCGTCGTTTTGGCCGATGTCGGCGTCGTTTTTCGCTGTGCTCAAACACTACCATCTTCTCGAGCAAAATGGTCACTATCCTGTAAACGTATCAGAAGACGGTGAGAAACGTGTGGATTATATTCCGGGGAACTCGTCAATTCGTCTGGCAGATTTTCCACTTAATGATGGAAGTTGGCGCAACCGAAGATTGTTGGAATTGTCCTTGAATGCTATACCATGGATGCAGAAATCGCAATATCTGTTATTTCCTTCCATATACGAGCTTGAGCCTCGAGCTATTGATGCTTTGAAATCCGAGTTCTCTATACCCATTTACACTGTTGGCCCTGCCATACCTTCTTTTGGTAATAGCCTCATTGATGACATTGGCTACTTCCAATGGCTTGACAACCAACCCTCTGGCTCTGTATTGTACATCTCTCAAGGGAGTTTTCTTTCGTTTTCCAATGAACAAATTGATGAAATTGCGGCCGGTGTTCGCGAAAGTGGCGTTCGATTCTTGTGGGTGCAGCCCGGAGAGAGTGATAAGTTGAAAGAGATGTGTGGGGATAGGGGACTTGTTTTGGCATGGTGTGATCAATTGAGAGTGTTGCAGCATCATTCTATTGGGGGGTTTTGGTCTCATTGTGGCTGGAATTCCACCAGAGAAGGAGTTTTTAGTGGTGTTCCTTTTTTGGCCTTTCCAATATTAATGGACCAACCACTAAACGGTAAGTTGATAGTAGAGGAATGGAAGGTGGGGTGGAGGGTGAAGAAGGAGGTGAAAAAGGACACTTTGATAACAAAAGATGAAATTGCTAATCTTATTAAGAGGTTTATGCATTTGGGTGGGGATGAAGTGAGAGATATGAGGAAAAGAAGCAGAGAGCTGAAGCAGATATGTCACCGTGCAATTGCAAGTGGTGGATCATCAGAATCCAATATCAATGCTTTTCTCTTGCATATATTACAGGATGCCAAGCCTCATTAAGAACATAGTTATTTGGTACTTGGTCCTTGTACGCTGTTACTCATATTTTACATTATTACAAACATGTATTTTTGACGGAAAACCGTCAAAAACCCAGCATTAATGAACAAAAAAAAAAACTCTTTAAGTGAGTAACAATGCTGGTTTTGTTTTGATCCTCCAATTTCTTTTATATTAATTCTCCCGGCTAGAGTGTTGGATCCTTTATCAAATAAGGCCTAGTATTTCATATTTAAAAAATAAAAAAAAAAAAAAAA

SEQ ID NO: 3005 - DNA, 1175 bp, Triticum aestivum
  misc_feature (1)..(1175): Ceres cDNA ID no. 21572653
  misc_feature (1)..(1175): Ceres CLONE  ID no. 568389
  misc_feature (1)..(1175): Also known as  Ceres CDNA ID no. 24356433
gttggttcggtcctcctatccgtcgtccttctccacccagccgccggcccgtcgtcctttacacgcccccacccgcgggcctccgccgcgttccccaccgcgtccacgtctggagctcctcgaccccatcccgtccgcggcggtgaccatctgcagcctcctcctcccaggggccgcgcctctttctctgctcggctgggcggcagtgaagtgggcaggggatccattcagcctgatttatcctctcggtgatccacaggtggagctagtatcaacaatgtcagatcctggtacggatagcaatatgcagcagcttgtcccaatggcaccaccggcaagggtttctggtggtgaactagtggcaaaggcttctgttgctgacagtggaaagcagctggtgctggtggagggtagaggaaagagctcaggaggggtcaagctacgggaggatgtggaggacatagaggtgaagctgaagcgcatcatggacaatgtccctgtccgtgccagcaacacctctgggtcctccgctggttctggctctggcgacttccaccagtatcggcaaatgaggagaagggaacaggaccgaataacgaggatggagactgattacgaaaagaggaagcaggtggccgaattcaatctgcggagggaggaaagactgaaagcagccgaggagcgtacatccaagaagcgcctgaaacgccaaaagaagaagcagcgtaagaatgaaaagcgggccaaaccaagcggtggtggcgaggaacccaatagcgaagcagtgcctaagcaggttgaggagccctcagacgacgacgacgacgagggttcggattacgagggcgacgacaagttcaagcaatgcaaatgaagttgctgttgaactactgccgttcctggatattacttttcatcactagagatgaggaagacttggggcatgaactaacatcaggcgcttgtttttgtagtaatagacttggaaacatacatgctagattgggggcattgtgcgccctgttagtttgttttggaaacgcttgtctgctgtaagatggcaaccggatgccggtgggtgcgcattttcctggacggtagatggggacggcgcattggcttcttgttatgaaatacggagtgttatgcaccttttcccaaaaaaaaaaaaaaaa

SEQ ID NO: 3006 - protein, 198 aa, Triticum aestivum
  misc_feature: GI Number: 62204451; NR Description: Unknown (protein for
  misc_feature: GI Number: 31240511; NR Description: ENSANGP00000021234 [Anopheles gambiae] >gi|21287802|gb|EAA00123.1| ENSANGP00000021234
  misc_feature: GI Number: 62658716; NR Description: PREDICTED: similar to
  misc_feature: GI Number: 61815137; NR Description: PREDICTED: similar to
  misc_feature: GI Number: 50758092; NR Description: PREDICTED: similar to adaptor protein with pleckstrin homology and src homology 2 domains
MSDPGTDSNMQQLVPMAPPARVSGGELVAKASVADSGKQLVLVEGRGKSSGGVKLREDVEDIEVKLKRIMDNVPVRASNTSGSSAGSGSGDFHQYRQMRRREQDRITRMETDYEKRKQVAEFNLRREERLKAAEERTSKKRLKRQKKKQRKNEKRAKPSGGGEEPNSEAVPKQVEEPSDDDDDEGSDYEGDDKFKQCK

SEQ ID NO: 3007 - DNA, 1465 bp, Triticum aestivum
  misc_feature (1)..(1465): Ceres cDNA ID no. 21572654
  misc_feature (1)..(1465): Ceres CLONE  ID no. 568524
  misc_feature (1)..(1465): Also known as  Ceres CDNA ID no. 25088246
agtaggccgccttccccattccggccatagtcaaaccaaaccaaatcctcgcctcgccaccatggccgacggcgccggcagcggcaggtcccgcctcagcgccctccccaacgacctgctccgccacatcgtcaccttcctccccgtcatggaagccgcccgcgccgccaccctcggccgcggctggcgccacctctggcgctcatacccgctcgtcctcaaggatgccgacatccccgagcgcgcgcgcgacgccgcaatcccccgagtcctcgccgaccacccgggccacttccgcgccgtcatcctctacgactgccggctcgcctcactggaccgcgagctccccgcctggccgcgcctcctcgtcgacaagcgcacggagaagctcgttctcgcctacagttgggtcgtgaaccagcccaacccggggcgccttcttcccgccgacatcctccgctgcgactcgctccaggagctcaccctggacttctggacgttccccagcggcgccgaggtcgttcttccccgcctccggattctcgccatggtaaggattggcataagcgagcaggaactggagtccttgatcgctgccagccccgttctagagtcccttcggctcaccctcaatagccccaagcacgtccggctccgcagccaaagcctccagtgcgcgctcgttgggctatccagagtggaggagttcaccctggtggacacgccgctcctggagcggctctacttgttcctgccgcctactggtgtggtggggttcagaatcgcttgtgctcccaacctgcaggtgctcggctacctggacacaagagctcacaagctgcagattggtaacagcgtcatcgggtcagacacaatggtgagcgcaagcactgtggttcgaagcgtcaagatattggcgttaactgtgaattttggtgtctttggggaggttaagatgctggccagcttcctcagatgctttcccaatattgacacgctgcacattgagtctgcaccgcatgatccatctgtaactgccaatgaatccagtggggagtatcatgccaagttctggcaggagatcagtccgatttgttgcttgagatcacatatcaagaagatggttattcacgattaccgaggggatcaaaatgaatttgagttcctcaagttcattgccatgaatgcccaggagctgcagtccttactgattgtgccgcatgaaggaattttgtcttcagctgacaaggtgaatgagataaaagacaaattgcagtgtctacagtttccaacaggtatctctgcagtgctgcagttgtcacctaaagcaggcactggtttgcgcttggagaaagcatccaatcttacaatcgatgacccttttgaatggtgaatccatggttaattcgctgtatgtttacatgcctgatccatactttttgaggaatcaaaaaaaaaaaaaaaa

SEQ ID NO: 3008 - protein, 443 aa, Triticum aestivum
  misc_feature: PFam Name: F-box; PFam Description: F-box domain
  misc_feature: PFam Name: Pkinase; PFam Description: Protein kinase domain
  misc_feature: PFam Name: FH2; PFam Description: Formin Homology 2 Domain
  misc_feature: PFam Name: Pyr_redox_2; PFam Description: Pyridine
  misc_feature: PFam Name: Amelogenin; PFam Description: Amelogenin
  misc_feature: GI Number: 50901870; NR Description: putative ribosomal RNA apurinic site specific lyase [Oryza sativa (japonica cultivar-group)] >gi|20521321|dbj|BAB91835.1| ribosomal RNA apurinic site specific lyase-like [Oryza sativa (japonica
  misc_feature: GI Number: 38346010; NR Description: OSJNBa0035O13.12 [Oryza sativa (japonica cultivar-group)] >gi|50930653|ref|XP_474854.1|
  misc_feature: GI Number: 38346009; NR Description: OSJNBa0035O13.11 [Oryza sativa (japonica cultivar-group)] >gi|50930651|ref|XP_474853.1|
  misc_feature: GI Number: 34912332; NR Description: putative ribosomal RNA apurinic site specific lyase [Oryza sativa (japonica
  misc_feature: GI Number: 53793449; NR Description: ribosomal RNA apurinic site specific lyase-like [Oryza sativa (japonica cultivar-group)] >gi|53792272|dbj|BAD52905.1| ribosomal RNA apurinic site specific
MADGAGSGRSRLSALPNDLLRHIVTFLPVMEAARAATLGRGWRHLWRSYPLVLKDADIPERARDAAIPRVLADHPGHFRAVILYDCRLASLDRELPAWPRLLVDKRTEKLVLAYSWVVNQPNPGRLLPADILRCDSLQELTLDFWTFPSGAEVVLPRLRILAMVRIGISEQELESLIAASPVLESLRLTLNSPKHVRLRSQSLQCALVGLSRVEEFTLVDTPLLERLYLFLPPTGVVGFRIACAPNLQVLGYLDTRAHKLQIGNSVIGSDTMVSASTVVRSVKILALTVNFGVFGEVKMLASFLRCFPNIDTLHIESAPHDPSVTANESSGEYHAKFWQEISPICCLRSHIKKMVIHDYRGDQNEFEFLKFIAMNAQELQSLLIVPHEGILSSADKVNEIKDKLQCLQFPTGISAVLQLSPKAGTGLRLEKASNLTIDDPFEW

SEQ ID NO: 3009 - DNA, 1476 bp, Triticum aestivum
  misc_feature (1)..(1476): Ceres cDNA ID no. 21572655
  misc_feature (1)..(1476): Ceres CLONE  ID no. 568779
  misc_feature (1)..(1476): Also known as  Ceres CDNA ID no. 24356678
accgaaccatcccgatcccccatcgtctccgttagcttcccctcccccgctcccgaatccggcgcaccatcgtcgaaaccctaaccctagccccacaccagccatggcgcccgccaccggcgcgacccgggccgtggtcctccgcctcgacgacctgtccctcccgccgcggtacctcaccgtcgcgtcccacctccccgtctccgacctcctcagcttcctccccctcccctcctcctccttctacctcaccaccgacggccgcccgctcgcgccctccgcgcccgtcgcctccctcgcgccgtccggctcgctccagctccgcctccgcgcgctccgcggcgggggcggcgatggcgggtccacctgcgccgagtcccgcgactgctacctctccatgtacctcgcgaagaagcccgacaaggccgaccccaacgaggcccgcctctcccgcttcacctgctgcgcgctctcgggggagccccttgccgcgcccgccgtcgtggatcgcctcggcaacctgttcaacaaggaggccctcgtcgaggcgctcatccacaagcgcctgcccaaggcgctctcgcacatccgtgggctcaaggacatgatccccatccacctgcaccccaagcccaacgcggcggaccaggaggtccgtttccagtgcccagtcactgggttcgagctcaacggcaagtcccagttcctcgcgctccgtggatgcggccacgttctgagcgtgaaggctctcaaggaggtgaagtcgtcctcgtgtttggtctgccataaggagttcgatgaggcggacaagatgcccatcaatgggaccgaggaggaggtggaagtgttgaggcagaggatggaggaggagagagggaagctcaaggagaagaaggataagaagctggcgaatgggctcagtgggagtaagcatgctgttgctgcggttgcagatgctgagaagttggagaatgggaagaaaggggaggctgccccagcaaagcggtttaaggccgcagatcatgcaccggctcatgcaaacaagaaagtgtatgcgtcaattttcacttcttccaataagtctgatttcagggagacatactcatgccggtcactccccctgggaaggaattaaatcgatgttggggagattccaatggcatggaggtgaacctcgtgtactgattcagcgattagcttcataccatggctcgcccataagttctggtatttttgttttagctgttggtgttatctatgcttgattgctgtgtggagctttctagttttcactcgcagagaagcaatatgtttttataaatgatttgtgaaatatgtaatagctgtaacacatatcattgagtccagtcttctagcaatttgtctgagtaatgctctagttttcattcaaagagaagcaatatgttcttataaatgctttgtgaaatatgtaatggttgaaaaaaaaaaaaaaaa

SEQ ID NO: 3010 - protein, 343 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: GI Number: 20562921; NR Description: unknown [Deschampsia
  misc_feature: GI Number: 27735473; NR Description: Similar to chromosome 20
  misc_feature: GI Number: 32484231; NR Description: MGC64388 protein
  misc_feature: GI Number: 30794468; NR Description: RIKEN cDNA 2410001C21 [Mus musculus] >gi|37589960|gb|AAH49072.2| RIKEN cDNA 2410001C21 [Mus musculus] >gi|13435927|gb|AAH04803.1| RIKEN cDNA 2410001C21 [Mus musculus] >gi|23813881|sp|Q99K95|CT43_MOUSE Protein C20orf43
  misc_feature: GI Number: 66910233; NR Description: 2410001C21Rik protein
MAPATGATRAVVLRLDDLSLPPRYLTVASHLPVSDLLSFLPLPSSSFYLTTDGRPLAPSAPVASLAPSGSLQLRLRALRGGGGDGGSTCAESRDCYLSMYLAKKPDKADPNEARLSRFTCCALSGEPLAAPAVVDRLGNLFNKEALVEALIHKRLPKALSHIRGLKDMIPIHLHPKPNAADQEVRFQCPVTGFELNGKSQFLALRGCGHVLSVKALKEVKSSSCLVCHKEFDEADKMPINGTEEEVEVLRQRMEEERGKLKEKKDKKLANGLSGSKHAVAAVADAEKLENGKKGEAAPAKRFKAADHAPAHANKKVYASIFTSSNKSDFRETYSCRSLPLGRN

SEQ ID NO: 3011 - DNA, 1264 bp, Triticum aestivum
  misc_feature (1)..(1264): Ceres cDNA ID no. 21572656
  misc_feature (1)..(1264): Ceres CLONE  ID no. 569080
  misc_feature (1)..(1264): Also known as  Ceres CDNA ID no. 24433862
acctgttccattccaattccatccccgtccccgtgatcgagcacacaactccaattccccaagcttaaccccatggccggctaccccccaccccccggctccggctacccctacggcgccgctggcggctacggagccccaccgccctccggccagaagccccccaaagaaggcaagacctcttcctcctccggccccgacccctaccacggtgctccgcccccgcagcagccttacggcggaggcggcggcggctacggagccccaccgtcctacggccagaagcctcccaaggaaggcaagacctcctactcctccggctccgacccctaccacggcgctccacccccgcagcagccttacggcgggggcggcggaggcggctacgggcagcagccctacggcgcccagccaccttcgtccgccgcgccgtacggggggccgcccgccgagcagccctacgcaggaggcggcgccggtgggtacgggagcccgttcgcggcgctggtgccgtccacgttcctgccggggacggaccccaacgtggtggcgtgcttccaggcggcggaccgcgacggcagcgggatgatcgacgacaaggagctgcagtccgcgctctctgggttcagcagccagagcttcagcctccgcaccgtccacctcctcatgtacctcttcaccaacaccaacgtccgcaagatcgggccaaaggagttcacttctgtgttttacagtcttcagaattggaggggcatatttgagaggtttgaccgtgaccaaagtggtagaattgatgcaccagaactgcgtgatgctcttctagatcttggatattccgtttctcctactgtgctagacttgcttgtgtctaaatttgacaagactgggggcaagaacaaagcggttgaatatgacaacttcattgaatgctgccttacagtgaagggcctgaccgagaagttcaaggagaaggacacggcgtactcggggtctgcgactttcggctacgaggcgttcatgctgaccgtgctccctttcctcatcgcatgatggcgctgcagtgcttcagggctcagcgtatgtatcgtcccagctttttttcgaaaagatgtatcgtcccagctgtatcgaaacggttgctagagctgttttgccactagctctgttaccggctgtataatactggcacttcggtgttgttattagtactgctttgctgaccagacaagtcttttggaggattcgaacaaaaaaaaaaaaaaaa

SEQ ID NO: 3012 - protein, 325 aa, Triticum aestivum
  misc_feature: PFam Name: efhand; PFam Description: EF hand
  misc_feature: PFam Name: Drf_FH1; PFam Description: Formin Homology Region 1
  misc_feature: PFam Name: Extensin_2; PFam Description: Extensin-like region
  misc_feature: PFam Name: 7tm_1; PFam Description: 7 transmembrane receptor
  misc_feature: PFam Name: Collagen; PFam Description: Collagen triple helix
  misc_feature: GI Number: 31711842; NR Description: At5g04170 [Arabidopsis thaliana] >gi|9955572|emb|CAC05499.1| EF-hand Calcium binding protein-like [Arabidopsis thaliana] >gi|19698991|gb|AAL91231.1| EF-hand calcium binding protein-like [Arabidopsis thaliana]
  misc_feature: GI Number: 6624721; NR Description: putative cysteine
  misc_feature: GI Number: 30681239; NR Description: calcium-binding EF-hand
  misc_feature: GI Number: 4314390; NR Description: putative calcium binding protein [Arabidopsis thaliana] >gi|25407902|pir||D84673 probable calcium binding protein [imported] - Arabidopsis thaliana >gi|15225885|ref|NP_180317.1| calcium-binding EF hand family
  misc_feature: GI Number: 30681234; NR Description: calcium-binding EF-hand
MAGYPPPPGSGYPYGAAGGYGAPPPSGQKPPKEGKTSSSSGPDPYHGAPPPQQPYGGGGGGYGAPPSYGQKPPKEGKTSYSSGSDPYHGAPPPQQPYGGGGGGGYGQQPYGAQPPSSAAPYGGPPAEQPYAGGGAGGYGSPFAALVPSTFLPGTDPNVVACFQAADRDGSGMIDDKELQSALSGFSSQSFSLRTVHLLMYLFTNTNVRKIGPKEFTSVFYSLQNWRGIFERFDRDQSGRIDAPELRDALLDLGYSVSPTVLDLLVSKFDKTGGKNKAVEYDNFIECCLTVKGLTEKFKEKDTAYSGSATFGYEAFMLTVLPFLIA

SEQ ID NO: 3013 - DNA, 1445 bp, Triticum aestivum
  misc_feature (1)..(1445): Ceres cDNA ID no. 21572657
  misc_feature (1)..(1445): Ceres CLONE  ID no. 569092
  misc_feature (1)..(1445): Also known as  Ceres CDNA ID no. 24356472
aacaacaaacagaatcaggcaacaaacgacctaccatccatctttccaaggcgatcgacgtcgacttagaccgtctcatcatccatcaatggctcgccgcggcggtttcttcgggtatgacccgtatgactactactacccgacctcctacggctacgacgcctacccgtactatagccccgccgctgccgatcccttcttcatggacgccgagcctctcgtcacggagcggctgcgccccgcccgccggagggccccggcgcggcacgacggcggcttcttccctggcttcggcgccgccgagccggccgcgcggaccatggcgcgtcccaggcccagcagcgggtccccgaagagcagcccggactgctttgaggtggaggtcacgggccccgagcccgactcgccgcccgcgattccaaagaagcaggcgccgtcggcggaggaggccgcggtgagggtgcaggcggcggcgcgtgggctgcttgctcgccgcatggtgcgggaggtgcgcgcggtggagcggcaggcggaggccgtggccgcgaggttgtcggccgaggcggaggcgctgcgcgcggacgcccgtgcgcggatcggcctcggggaggagctcatgcggctgctgctgcgtctcgacggcgtgcacggcgcccgggagtaccgcaggagggtcacccggcgtgtgctcgcgctccaggacgccgttgacgcgctcgaggccatgtcggcggtggtgaccgccaatgcgacggaagttcaggatgcagcggacgaagcagaggatgggatagaaccggagttggagctgccgattgaggacaacactgcggcggattctctggatgccgagacaaccgacatggcggcgatggaggttgacgcggcgagtaccgtcgttgttgacgaggacggccagattgagaccgaactggtggcggaagtggagaaggcctcggaggcggagggcgagtgggagatggtggccacgggggacggcgacgtctccactggcgaggaggaccatgcaccacccgaggcactgcagcagcagcaagaaccagcaggagaggagaagaagacggtgaccaccggcggggtggacgcgaagaaactgatggagatggtggcggcgctgtgcgaacggagcgcgcagcagtgcgctctgattggtgccctggcggagcgggtcgacacactggagcgcgccgtccggcgggtggaggaggctgaccggcgccgccggaggaacaagaagaccaacaaggacggcaagaagaacacaagtagcttctacagcgactagtagatgataaatagatccaattgtgtgattttgcaatcttggattgtggagcaatctgtattcgattgactttttcttgcgttttagttcatctttgcaatctaaaattaagaatattctgtcaaaaaaaaaaaaaaaa

SEQ ID NO: 3014 - protein, 405 aa, Triticum aestivum
  misc_feature: PFam Name: BAG; PFam Description: BAG domain
  misc_feature: PFam Name: Aldedh; PFam Description: Aldehyde dehydrogenase family
  misc_feature: PFam Name: GRP; PFam Description: Glycine rich protein family
  misc_feature: PFam Name: Bindin; PFam Description: Bindin
  misc_feature: GI Number: 4185307; NR Description: unknown [Zea mays]
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66776103; NR Description: LigA [Anaeromyxobacter dehalogenans 2CP-C] >gi|66858140|ref|ZP_00402169.1| LigA
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MARRGGFFGYDPYDYYYPTSYGYDAYPYYSPAAADPFFMDAEPLVTERLRPARRRAPARHDGGFFPGFGAAEPAARTMARPRPSSGSPKSSPDCFEVEVTGPEPDSPPAIPKKQAPSAEEAAVRVQAAARGLLARRMVREVRAVERQAEAVAARLSAEAEALRADARARIGLGEELMRLLLRLDGVHGAREYRRRVTRRVLALQDAVDALEAMSAVVTANATEVQDAADEAEDGIEPELELPIEDNTAADSLDAETTDMAAMEVDAASTVVVDEDGQIETELVAEVEKASEAEGEWEMVATGDGDVSTGEEDHAPPEALQQQQEPAGEEKKTVTTGGVDAKKLMEMVAALCERSAQQCALIGALAERVDTLERAVRRVEEADRRRRRNKKTNKDGKKNTSSFYSD

SEQ ID NO: 3015 - DNA, 1887 bp, Triticum aestivum
  misc_feature (1)..(1887): Ceres cDNA ID no. 21572658
  misc_feature (1)..(1887): Ceres CLONE  ID no. 569286
  misc_feature (1)..(1887): Also known as  Ceres CDNA ID no. 24356479
attttccacagccactcgccgttctgctgaattgtccaggccaccatgaggcgaaatagtatcttgcttgtgtgctttagtctacgcccctacgatggcctcaaggaaatattgcccgtccatggttgttgatttcgtacaccattgttccctggaaaaggaaagaaccagccccgcgattccaggataccagcttcgctttcgatccaagatataaaagaaaattcagcgaaagcaggagctgtgaagctaccctggcggaagaatcggctgaaagcggcagggtgaaggaaggatccactccactgccggggaaagatgcggccttactttgatcccgagtatgagaacttcaatcagcggatcaaccctcctcgggtctgcatcgacaacaacacatgccgcgactgcaccctggtgaaggtggacagcatgaacaagaatggcattctgctggaggtggtgcaggtcctgagcgatcttgacctcaccatcctgaaagcgtacatcacctcggatggcggatggttcatggatgtgttccatgtgctggataagcaagggcacaaggtgaccgatgagaagaccattcagtacatagagaaggccttaggtccgggcagcaacataccgggagcggcgaagggcagcaattcgcctgggagatcagtcgggatgcactcgatcggcgaccacaccgccatcgagctcaaggggcccgacagaaccggcattctctccgagatctttgccgtcctggcggagctccagtgcaacgtgatggcggccgaggtgtggacgcacaggacgagggtggcctgcgtggtgtacgtcaacgacgtgtcctcggggcaggcgatcgaggacgcgtgccgcctggccgggatcgaggagcggctgcggcacgtgctccgcgggcacggcggcggagacgacgacggcggcgacggccggggagcgcacaccaacttctccgccggctccacccacgtggaccgccggctgcaccagctgatgcacgccgacatggacttgggcggcgacggtgcgccgcagggccgtcccgcggccgacgacggcacggcggtgaccgtggagcactgcgaggagaaggactactcggtggtgaacgtgcggtgcagggatcggcccaagctgctgttcgacatcgtctgcacgctgacggacatgcagtacgtcgtcttccacgccgccgtcgcctccgagggcatctacggcgtccaggagctgtacattcgccgcaaggacgggcgcacgctgctgaaggacgaggcggagaaggtgaccaagtgcctcgaagcggcgatctccagaagagtctccgagggattcacgcttgagctctgcggcagggacagggtggggctgctgtcggacgtgacgagggtgctccgggagcacggcctgacggtgacgagggccgacgtgacgacggtgggggagcaggccgtgaacgtcttctacgtgcgtgacgcgtcggggcagccggtggacatgaagaccatcgagggcctccggggacaggtcggccagaccgtcatgctcaacgtcaagaaggtgcccggtgacaaggcgccggagcgggctgctggcagcatggccaagaccagcttcttctccttcggcggcctcttcgccaaactcggagcataatttccgtcgctgatccttaccgtcgtgaaaattgttgtaaaatggccacagctagagtagtccgtatggcagctcttggtgtacttttctctaacaagtttccccatttcctcgattttttcgagcatccgataatctttcgaagagagagataaaggatcctttcccaagagggaggaggtgcgatgatgatgcctaaaaaaaaaaaaaaaa

SEQ ID NO: 3016 - protein, 451 aa, Triticum aestivum
  misc_feature: PFam Name: ACT; PFam Description: ACT domain
  misc_feature: GI Number: 51964082; NR Description: PREDICTED P0470G10.34 gene product [Oryza sativa (japonica cultivar-group)] >gi|50909425|ref|XP_466201.1| putative ACT domain-containing protein [Oryza sativa (japonica cultivar-group)] [Oryza sativa
  misc_feature: GI Number: 21593552; NR Description: unknown [Arabidopsis thaliana]
  misc_feature: GI Number: 22138098; NR Description: ACR4 [Arabidopsis thaliana] >gi|15221589|ref|NP_177067.1| ACT domain containing
  misc_feature: GI Number: 42572033; NR Description: ACT domain containing
  misc_feature: GI Number: 25370627; NR Description: protein F4N2.2 [imported] - Arabidopsis thaliana >gi|6730631|gb|AAF27052.1| F4N2.2
MRPYFDPEYENFNQRINPPRVCIDNNTCRDCTLVKVDSMNKNGILLEVVQVLSDLDLTILKAYITSDGGWFMDVFHVLDKQGHKVTDEKTIQYIEKALGPGSNIPGAAKGSNSPGRSVGMHSIGDHTAIELKGPDRTGILSEIFAVLAELQCNVMAAEVWTHRTRVACVVYVNDVSSGQAIEDACRLAGIEERLRHVLRGHGGGDDDGGDGRGAHTNFSAGSTHVDRRLHQLMHADMDLGGDGAPQGRPAADDGTAVTVEHCEEKDYSVVNVRCRDRPKLLFDIVCTLTDMQYVVFHAAVASEGIYGVQELYIRRKDGRTLLKDEAEKVTKCLEAAISRRVSEGFTLELCGRDRVGLLSDVTRVLREHGLTVTRADVTTVGEQAVNVFYVRDASGQPVDMKTIEGLRGQVGQTVMLNVKKVPGDKAPERAAGSMAKTSFFSFGGLFAKLGA

SEQ ID NO: 3017 - DNA, 1710 bp, Triticum aestivum
  misc_feature (1)..(1710): Ceres cDNA ID no. 21572659
  misc_feature (1)..(1710): Ceres CLONE  ID no. 569590
  misc_feature (1)..(1710): Also known as  Ceres CDNA ID no. 24356449
attcatgccccgcgtcgtcctgcctgcctgcctcagctcccctccccgtgaagtagactgcgaaaaaagacgtcgtcgcacgtacacgcacacgtacagtacagacgcaggcgaggcaaccaacaccgcaccgcagccgcccgcaccaccgcgaggcaaaagcagccaccatccctgcgctagcgtccgaccgccgcaagtcccagcccaacaaaaggtcgctgttgttcgtagacggagctcgatccgcagccatggtgtcgtccccgtccccttcccctcctaccttcacttctgcggtgagctcgcgttgcttctaccttttctccttgcgatgtgtgtatgttgcttgtgagcttgtgagctgcaatgctaagctgtaatcgtcaggtgtccgagaccaagcggcatggtggtgtcccgacgacggcctcggagaagctggaccagaagtacgcccactccgcgacgccgctgcacggccacggccacggcggcggcggcggtgccaagaagacgccgcggcgggggaggagcgagggcggcgccgccgactcggccgcgtatgtcgcggcggtgtcctgctccgactgccgcttcaagcagcgcgccctggcgccggcgtcgccgggagccgtcatccgctcgctgttcgtgtccctcacccgacgctccactccgcgctcctcgccgtctcccacgtcggcctcggagggtgatgggggtgagggcgagcagtggcgcctggccgcggccgacctctcgcggcggctcgccgcggccacgcggacgcgggacgacgcggtggaggagacctcccggctgaagcagtccctcgcggagctggagctcaagctggcgcgcctcgaggcccgcgtgctccccacgccggccgccgccgtcttccccgtcgagtccttcctccgcgccgtctccacggcgcgcgccaccgtgcggaacctcacgcgcgcgctctccacgcacctgcgcagccccgcgagccccggccccaacctcgagagcttcctcaaccgcgccttccacgcggacttcgagctggacaccgagggcgacgtccacacggcggacccggcgggccggtgcgaggccaacctcgcggcgtaccacgccgtggcggcgctgacctgggaggaggtgctcgtccacgggacgaagcactacagcgacgggctgagccggttctgcgacgccaagatgagcgaggtggtgtcctccctcgggtgggcgcgcgcgcggccctggccggagccgctgctgcaggccttcttcctggcggccaagggcgtgtggggggtgcgcctgctggcgcggtccgtgcacccgccgctgcccgtcgtgcgcgtggaccgcggcgcgcgcttcgactcgcggttcatggaggacgccgcggcctcgcgcgccgggcggctggagccggccagcgtgaagatgatggtggcgccggggttccacgtgtacgtcgccggcgccggcgtggtcaagtgcaaggtcgtgtgcttctacaacaacggccgcgccggcggccacatgggtggcgggagcagcggcaacggcggcgaggggttgggcggtagctgtagcgatatgaatggtggtggtacggatgcggtgaagagctgtcagagtagcagagtgtagtcaaaaaaagacacgaggatagttatttgtgtggcaaaaaaaaaaaaaaaa

SEQ ID NO: 3018 - protein, 429 aa, Triticum aestivum
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66775827; NR Description: OsmC-like protein [Anaeromyxobacter dehalogenans 2CP-C] >gi|66858407|ref|ZP_00402419.1| OsmC-like protein [Anaeromyxobacter
  misc_feature: GI Number: 66776896; NR Description: LigA [Anaeromyxobacter dehalogenans 2CP-C] >gi|66857361|ref|ZP_00401413.1| LigA
  misc_feature: GI Number: 66777367; NR Description: Queuine/other tRNA-ribosyltransferase [Anaeromyxobacter dehalogenans 2CP-C] >gi|66856924|ref|ZP_00400984.1| Queuine/other
MLSCNRQVSETKRHGGVPTTASEKLDQKYAHSATPLHGHGHGGGGGAKKTPRRGRSEGGAADSAAYVAAVSCSDCRFKQRALAPASPGAVIRSLFVSLTRRSTPRSSPSPTSASEGDGGEGEQWRLAAADLSRRLAAATRTRDDAVEETSRLKQSLAELELKLARLEARVLPTPAAAVFPVESFLRAVSTARATVRNLTRALSTHLRSPASPGPNLESFLNRAFHADFELDTEGDVHTADPAGRCEANLAAYHAVAALTWEEVLVHGTKHYSDGLSRFCDAKMSEVVSSLGWARARPWPEPLLQAFFLAAKGVWGVRLLARSVHPPLPVVRVDRGARFDSRFMEDAAASRAGRLEPASVKMMVAPGFHVYVAGAGVVKCKVVCFYNNGRAGGHMGGGSSGNGGEGLGGSCSDMNGGGTDAVKSCQSSRV

SEQ ID NO: 3019 - DNA, 1518 bp, Triticum aestivum
  misc_feature (1)..(1518): Ceres cDNA ID no. 21572661
  misc_feature (1)..(1518): Ceres CLONE  ID no. 569652
  misc_feature (1)..(1518): Also known as  Ceres CDNA ID no. 24356476
tcgaagcagaggagcagtccatttcttttcccttctgaatagcgtgtgcgcgccccaaaaagacacggtccgccgtcgaccacgcaggcgagtcgttagaagagaagtgaggcagcggcagggagggaggggaggagcgccgccatggcctcacgcttcaactcccgcatctcctccggggacttgaggtcggggagctcgctgacggtgggggagcggctctgcgcggtggtcctgcccttcgtcgccatcgccgagttcgtcttcttcgcgctcaccgactgcctggccggcatctgctcccctccctcggcctcctcctcctcgcacccgcgcagagatccctccgccccgtccttcttcctcatggccaagaaggggagccaccaccaccaccacctcctccgccgccgcgtcgcgccgggctgctcctccctcagcttccgcgacctcgcccgcctcgccgacgagtccagatgcttctcggtgaacgaggtggaggcgctgttcgagctctacaagaagatcagctgctccatcatcaacgacggcctcatccacaaggaagaacttcagctagcattattcaagactcctagtgggcagaatctttttcttgatagggtttttgatttgtttgatgagaagaaaaatggagtaatagagtttgaggagtttattcatgctctcagtgtctttcatccattggcacctgtggaagacaagatcaactttgcatttaggctctatgatttgagacagactggctttattgagcgcgaggaggtgatgcaaatggttattgccattttgaatgaatctcatgtggaattatcgcatgaccttcttgaggccatcctagacaagacatttgaggatgctgataccgatagggatggaaaaatttgccaagaagagtggaaggaatttgtgttacgccatcctaaactattgaagaacatgactctaccctatctaagggacgtcacaacagcgttcccaagttttgttttcaataccgcggttgaagactaaacatcacaaggcttgtacttgatggtgacaagttggttgctgattgcgtcagccgttgagaattgggatgctgagaaagagagcagccatgttaaggatggctgttgcttcaggatggacatcagataatcaacccggcaactgaagagtcccattcatgatggcaaattggcagctaacggcgtctggtgtgcattgtgttgtactaactgtatatacaccattcattcaagaacaggacagcgtgatatgaggagtctaagttgctcatatacatagataggaggaatctaagttccgcaaatgccagccagttccgcgcaattttgtgaatgctaacttgtgatgttgtagcgtccattatctagactatcctaatcctagcgccaacatatgtcatggctaagccatgattgatgtatatataatcgaaaacctttccgagaaaaaaaaaaaaaaaaaaaacgaaaaaaaaaaaaaaaa

SEQ ID NO: 3020 - protein, 296 aa, Triticum aestivum
  misc_feature: PFam Name: efhand; PFam Description: EF hand
  misc_feature: GI Number: 34913062; NR Description: putative calcium sensor
  misc_feature: GI Number: 56785307; NR Description: calcineurin B-like [Oryza sativa (japonica cultivar-group)] gi|56784147|dbj|BAD81532.1| calcineurin B-like [Oryza sativa
  misc_feature: GI Number: 66765939; NR Description: calcium sensor
  misc_feature: GI Number: 21593228; NR Description: calcineurin B-like
  misc_feature: GI Number: 29150248; NR Description: calcineurin B-like protein 10 [Arabidopsis thaliana] >gi|15234011|ref|NP_195026.1|
MASRFNSRISSGDLRSGSSLTVGERLCAVVLPFVAIAEFVFFALTDCLAGICSPPSASSSSHPRRDPSAPSFFLMAKKGSHHHHHLLRRRVAPGCSSLSFRDLARLADESRCFSVNEVEALFELYKKISCSIINDGLIHKEELQLALFKTPSGQNLFLDRVFDLFDEKKNGVIEFEEFIHALSVFHPLAPVEDKINFAFRLYDLRQTGFIEREEVMQMVIAILNESHVELSHDLLEAILDKTFEDADTDRDGKICQEEWKEFVLRHPKLLKNMTLPYLRDVTTAFPSFVFNTAVED

SEQ ID NO: 3021 - DNA, 1754 bp, Triticum aestivum
  misc_feature (1)..(1754): Ceres cDNA ID no. 21572662
  misc_feature (1)..(1754): Ceres CLONE  ID no. 569673
  misc_feature (1)..(1754): Also known as  Ceres CDNA ID no. 24356738
aattctttcaaattttgcgcaaatctaacgagataccccaaatcttccaattctcctccctccctcccttccacccaggcgcaggcagcgggcgcgcggccgacctgccccccagccagccgcgtcgccgccactgcgactggcggcggcgcccgcgctccgatggtcgggatgtaccagaagcagctcctcgacgcccccttcgccctaaacggccactgcgccgaccagccacgccacgcgccggccgccgccgccgccgccgcttccccctcgccgtatccgcccaacccctcctcctcctcgggcgctgccccctcgccgcacgcgcaggcggatggcgccggccagccgcgtcggctgttccacgcgctcgtcggggggatcctgcagcgcggggccggaggcggcaacggcgcggctggggatctgggggcgctggtgtcgtgggcgcgggaggtcgccgtggatccctgcgcgaagcggccggcggacaggccgaggaagcggcaggtgctggccttgcggcgcgcgcgctacctcaagatggaggacgtggcggaccaggccgaactccccagcttctccaagaaaaggaagtacagaactaaggaccagtcagaaagaccaaggaaagggccaaccccaacaaggaaatccgagaggctagctaggagaatggtactcatgacatcagtgcttctcacgcaaaggaaaaagattggagtaggtgagcagtttcaggctgagatacctgactggactgggccaccttcagacgcagagctttcttggtacaggaatgacccgaacacctcaaagatgctaggaagcagaacttggccacctgaaggttatgtcttacagacaaatattgtggtagctggacagggaaggcctgaatcatgtaattgcccatatccaggaaacttctattgcagattacatcacatcaacaccgccagggatcggctaaggtctgaaattggtcaagttttcacggaatggaaatttgatttgatgggtgagcaggtttctaagatgtggagtattgaggagcaactgaagtttgctgcagttgagcagttggttcctgtgtttgaaaataagagtttttgggcgatagcggcaaaacattttgcctcgaagaccagggtggacttggtgcggtactacctcaatgttttcctcatgagaagagtttcaaaccagtgcaggctgagtctgttggagattgatagtgatgaggatgaagcagaggaagaggaggatgaagatcaatctgatggctccaattcgtcccagaggccccaggatgtccaagaggtgaagaagattttctgagtctgctgacagctacctggcatgcgtttctgcatgcgcgcccgttttgatgtgctgagacactcatcaccttgagtgatcgatccttcagtcgctcgcttagacctagccatccgttctgcgcagaaactcatgcgaattgcacaccattctcgttctcaatgcttgtgtcagggtaacgggcaagccagtcagttgtggcttgatgctcaaagagctcatctgatatgaatgttttcccgtgtacaggaaaaatgaaatacaggtcttaaagactaaagtgggtagaaaacaaatggtcattggtttcgtttctttcgtgaagagttgagacttgagagggtcaaaacccaaaacccgtttactgtgtctttattccccagtttggtacagcaaaaaaaaaaaaaaaa

SEQ ID NO: 3022 - protein, 393 aa, Triticum aestivum
  misc_feature: PFam Name: ELM2; PFam Description: ELM2 domain
  misc_feature: PFam Name: FH2; PFam Description: Formin Homology 2 Domain
  misc_feature: PFam Name: Extensin_2; PFam Description: Extensin-like region
  misc_feature: PFam Name: Vitellogenin_N; PFam Description: Lipoprotein
  misc_feature: GI Number: 56784258; NR Description: MYB transcription
  misc_feature: GI Number: 34908364; NR Description: P0529E05.8 [Oryza sativa (japonica cultivar-group)] >gi|18461195|dbj|BAB84392.1| P0529E05.8
  misc_feature: GI Number: 42570671; NR Description: myb family transcription
  misc_feature: GI Number: 28394109; NR Description: putative MYB family transcription factor [Arabidopsis thaliana] >gi|27754610|gb|AAO22751.1| putative MYB family transcription factor [Arabidopsis thaliana] >gi|4335752|gb|AAD17429.1| putative
  misc_feature: GI Number: 30102658; NR Description: At1g13880 [Arabidopsis thaliana] >gi|8778387|gb|AAF79395.1| F16A14.9 [Arabidopsis thaliana] >gi|15222974|ref|NP_172841.1| ELM2 domain-containing
MVGMYQKQLLDAPFALNGHCADQPRHAPAAAAAAASPSPYPPNPSSSSGAAPSPHAQADGAGQPRRLFHALVGGILQRGAGGGNGAAGDLGALVSWAREVAVDPCAKRPADRPRKRQVLALRRARYLKMEDVADQAELPSFSKKRKYRTKDQSERPRKGPTPTRKSERLARRMVLMTSVLLTQRKKIGVGEQFQAEIPDWTGPPSDAELSWYRNDPNTSKMLGSRTWPPEGYVLQTNIVVAGQGRPESCNCPYPGNFYCRLHHINTARDRLRSEIGQVFTEWKFDLMGEQVSKMWSIEEQLKFAAVEQLVPVFENKSFWAIAAKHFASKTRVDLVRYYLNVFLMRRVSNQCRLSLLEIDSDEDEAEEEEDEDQSDGSNSSQRPQDVQEVKKIF

SEQ ID NO: 3023 - DNA, 1402 bp, Triticum aestivum
  misc_feature (1)..(1402): Ceres cDNA ID no. 21572663
  misc_feature (1)..(1402): Ceres CLONE  ID no. 569927
  misc_feature (1)..(1402): Also known as  Ceres CDNA ID no. 24360273
attctgctgactcgaagcccacgagaggcagccgcagccggcagccgcggccatttggaaccctccggccatcccgtacttaattgcggcggccattagtcagccatgatcggatccttgcccggtgctctgcatgtgctgccccggcgctaatcttactctgcaacaaatcgccaccccgcttggcaactcaagctagaatcgaggagagcaacggggagaatctttccaagaacccggacaaaacgaactgagagagcatctgtggagcagctgcttgtggaggaactcttgagatatatagatagattgattgattgctgggagcgagagaccgaggagcgatggggtgcatctcctccaaggtgctgagcaggtcggggagcctgcgggggaaggccggccaggggctccagaggagcagcctggtcgaggagatcatcctctccaactccaagaggaacggcgaccagttcctcgccctcctccgcacctccagctccgccgccaggacgagcaaggtcgacgccgccgagcagatcgagacgatcaacgtgtctgaccttctcgccgggctggaggaggagaacgcaccggaaggcgccgaggagcggggcgatgatcggaaaccagacggcggcaaagcttcgtcgcctcggtgcgcatacgatggcgccgccggaagggcggtcagcttccgcaccctggaggagttcgacgcgctggtgtcgcggtgcggctcgccggtgaaagcggagcctgcaccagcaccagcacctgagccagacgcgtccgtggagccgccgccgcagagcagctccacggagcaagacgcgatagccacagcgagcagcggtccggaactaggggaggcgcccggcggcgcgaagaggcgggcgagggcgaggcagctcggcgagctgagcgcgacgccgggcttcgacttcagcaagtccggcagcctgagggactggctgctcggcggcgggcagatgttctcgccgggctcctacgtcacgcccaagttcggcagcgtggcgacggcaccgcccgagtccgcagagcacgcggagcgcacggtgtttgatccggagctggtggcgcagctggaggaggccatggaggagctctcggtggacgaggagcgcgtgctgagggaggtcttggaggtaatcgaagccggagaaacacagaggttggagaggcgacatgcccaggagccggaagtgttggcggtgattgtgcatgattaggtgtcagtttgatgatgattttagtagttttttgttaccgttttagagtgcttgtgatgtgatttgtgaatcctttgtaaggagaaatgtacagcaaagattttattttttcaattttttcgtgttgtttcccaaaaaaaaaaaaaaaa

SEQ ID NO: 3024 - protein, 302 aa, Triticum aestivum
MGCISSKVLSRSGSLRGKAGQGLQRSSLVEEIILSNSKRNGDQFLALLRTSSSAARTSKVDAAEQIETINVSDLLAGLEEENAPEGAEERGDDRKPDGGKASSPRCAYDGAAGRAVSFRTLEEFDALVSRCGSPVKAEPAPAPAPEPDASVEPPPQSSSTEQDAIATASSGPELGEAPGGAKRRARARQLGELSATPGFDFSKSGSLRDWLLGGGQMFSPGSYVTPKFGSVATAPPESAEHAERTVFDPELVAQLEEAMEELSVDEERVLREVLEVIEAGETQRLERRHAQEPEVLAVIVHD

SEQ ID NO: 3025 - DNA, 1469 bp, Triticum aestivum
  misc_feature (1)..(1469): Ceres cDNA ID no. 21572664
  misc_feature (1)..(1469): Ceres CLONE  ID no. 570134
  misc_feature (1)..(1469): Also known as  Ceres CDNA ID no. 24356716
acccacacctctctctgcctgcccatttcctctctccctcttcctcccctcgccgtgggctccacccgtcagcctgccgcgtagtagagactagagagagagagcgacaagggagagggggctagcagctagcgagagaagagaaggaaagggcgccggaggaaggagatgggagaggagaggaaggcaggggagcaggcggcggaggcggcggcccgcgcggcggagcaggcgcgggagctgcaggacgccgccgccgcgctgctctcgcggacgtgggcggaggaggaggcgctgcgccgccgcgccgccgcgctcagggaggacctcgcccgcctgcgcaaggccgccgccaacgcacaaaccgaaaaggtccacgaggacttggatcgagcgtcatgcctcataagtgatggtgacattgcggcgattctccctagcaaggcgcatggcacttttttgaagctgttattgggaccagtgaatctccgcgcaaggaaggaggtacagctcaaggtgaaagaggaatacaatagctacagggataggactgccatagtgtttcttggttttccgatgattctgttgtttcttcggtcatggctatggaatggatgttttccagcattgccagttcagctatatcaggcctggctgttattgctctatacaactttagctttgcgagagaacatattgcgagttaatggaagtgatatccgtccttggtgggtatgccatcactattgtgccatgctgatggctctggtgagcctcacatgggggattaagggacaacctgattgtgcccgcaaacagagaggtgtcgagttgtttctgtgctgggctgtgatgcaaggttttgccatgatgttgcagaacagatatcaacgtcaaagactatatactcgaattgctttggggaaggctaaaaggatggacgtcgtgtggggcgagactgctggtgttgaaggccaactattgctgttgtgtcccatcctctttctcttgcaggtctttgagggttatgttggatttttacttcttcggacagctcatagagggatcattcctgagtggcaggttgtggtgtgtgggatcctgcttattgcaatggcaattggcaactttgcaaacacagtggacacattgatggttaagtccagattcaaagcaaagatgaagaagtccaagagcaaacgagatcttgctgcatgcacgtcaccgactcgctcatcgctgacaaattcggcagctggagcttgaaatggagacgctcccatcatatgaacattgcccatattcaatcaggggctatcaaaattgtaaagtattagttttttggccaccagctccttgtgctgacagtctctgtcaaagctcatacccatgtaatcatcaaacgactcggttgcttatggtgtcaggttgagggtaactaagaataaactgtaaaaaaaaaaaaaaaa

SEQ ID NO: 3026 - protein, 365 aa, Triticum aestivum
  misc_feature: PFam Name: TMPIT; PFam Description: TMPIT-like protein
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 30354641; NR Description: Transmembrane protein
  misc_feature: GI Number: 13994300; NR Description: transmembrane protein induced by tumor necrosis factor alpha [Homo sapiens] >gi|13241761|gb|AAK16442.1| transmembrane protein induced by tumor
  misc_feature: GI Number: 29789387; NR Description: transmembrane protein induced by tumor necrosis factor alpha [Mus musculus] >gi|28436931|gb|AAH46757.1| Transmembrane protein induced by tumor
MGEERKAGEQAAEAAARAAEQARELQDAAAALLSRTWAEEEALRRRAAALREDLARLRKAAANAQTEKVHEDLDRASCLISDGDIAAILPSKAHGTFLKLLLGPVNLRARKEVQLKVKEEYNSYRDRTAIVFLGFPMILLFLRSWLWNGCFPALPVQLYQAWLLLLYTTLALRENILRVNGSDIRPWWVCHHYCAMLMALVSLTWGIKGQPDCARKQRGVELFLCWAVMQGFAMMLQNRYQRQRLYTRIALGKAKRMDVVWGETAGVEGQLLLLCPILFLLQVFEGYVGFLLLRTAHRGIIPEWQVVVCGILLIAMAIGNFANTVDTLMVKSRFKAKMKKSKSKRDLAACTSPTRSSLTNSAAGA

SEQ ID NO: 3027 - DNA, 1855 bp, Triticum aestivum
  misc_feature (1)..(1855): Ceres cDNA ID no. 21572665
  misc_feature (1)..(1855): Ceres CLONE  ID no. 570832
  misc_feature (1)..(1855): Also known as  Ceres CDNA ID no. 24356464
agccaaaggcaaggccgaaaccgcgtcggctcacggagtccaccaccagtctcctcccctcctcctcctcctacccccgcctccaaggcccctccgcccgcccgccgacctggtccgctggtccggggtgctctgtccggcacgaatccagcggcgcttgttgcggaatgcggggagttcattggtgagccgctatgggttgcttcccgtgcttcgattcgggcgccgacggggagctgctctaccccaagcagggcggcggaggcggcggaaatggcacgggcggacggactgtgtccgcggcatcgtcctccggcgtcggcgcccgcgaggagagacccatggtcccgccgcgcgtcgagaagctccccgcaggggctgagaaggcaagggcaaaaggcaatgccggaatgaaggagctttcagatctcagggatgccaatggcaatgtcctctctgcgcagacattcaccttccgccagcttacagctgccacgaggaacttcagggaggaatgcttcattggggagggagggttcggacgtgtttacaagggccgtcttgatggaggccaggttgttgctataaagcagctcaatagggatggaaaccaaggaaacaaagaatttctggtggaggtcctcatgctcagtttgctgcatcatcaaaaccttgttaatttggttggttattgcgctgatggagagcaacgccttctggtgtatgagtatatgccccttggatcattggaagaccatctccatgatctccctcctgataaggaaccgttggactggaacactaggatgaaaattgcagctggtgctgctaaagggctggaatacctccatgacaaggcacaaccaccagttatatatagagacttcaagtcatcaaatattctattgggtgatgatttccatccaaagctgtcagactttggtctcgctaaattgggtcctgttggtgacaagtctcatgtctctacacgtgtgatgggaacatacggctattgtgctccagaatatgctatgacagggcaacttacagtcaagtcagatgtctatagctttggagtggtgttgcttgagttgattactggccggaaggccattgacagcaccagacctcatggggaacaaaacctcgtgtcgtgggcacgccctcttttcaatgacaggcggaagctcccaaagatggctgatccagggctgcagggacgatatcccatgcgtgggctctaccaagccctcgctgtggcgtcaatgtgtattcagtcagaggctgcttcgcgaccacttatcgctgatgttgtgactgctctttcctacctggcgtcccaaatttatgatcctaatgcgatccatgcctcgaaaaaggcaggtggtgaccagcgaagtagggtttctgatagtggaaggacgctcctgaagaatgatgaggcaggcagctctggacacaagtcggatcgagatgattcccccagggagcctcctccgggtatccttaatgacagggagaggatggtggctgaggcgaagatgtggggtgcgaacctgcgggagaagacgcgtgctgctgccaatgcacaggggagcctcgattctccaactgaaatcggatagcggcagtcgtcaacctgtggccttgtgttttctctctgtcgattgtgcttgctttcgattggcggggaaagatgaattgggtgctttccggtggtgttagatgtgtacatttataggggcaaaacaaaaacaaaacaaaacaagaggagaattgggtggctttgtactggatatggtcgtacctgtaaattctcggaaaattttgcgacgatggaaaaaaaaaaaaaaaa

SEQ ID NO: 3028 - protein, 476 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase family
  misc_feature: GI Number: 37625033; NR Description: protein kinase-like
  misc_feature: GI Number: 30679773; NR Description: protein kinase family
  misc_feature: GI Number: 7413555; NR Description: protein kinase-like [Arabidopsis thaliana] >gi|11259782|pir||T48301 protein kinase-like
  misc_feature: GI Number: 10445209; NR Description: protein serine/threonine
MGCFPCFDSGADGELLYPKQGGGGGGNGTGGRTVSAASSSGVGAREERPMVPPRVEKLPAGAEKARAKGNAGMKELSDLRDANGNVLSAQTFTFRQLTAATRNFREECFIGEGGFGRVYKGRLDGGQVVAIKQLNRDGNQGNKEFLVEVLMLSLLHHQNLVNLVGYCADGEQRLLVYEYMPLGSLEDHLHDLPPDKEPLDWNTRMKIAAGAAKGLEYLHDKAQPPVIYRDFKSSNILLGDDFHPKLSDFGLAKLGPVGDKSHVSTRVMGTYGYCAPEYAMTGQLTVKSDVYSFGVVLLELITGRKAIDSTRPHGEQNLVSWARPLFNDRRKLPKMADPGLQGRYPMRGLYQALAVASMCIQSEAASRPLIADVVTALSYLASQIYDPNAIHASKKAGGDQRSRVSDSGRTLLKNDEAGSSGHKSDRDDSPREPPPGILNDRERMVAEAKMWGANLREKTRAAANAQGSLDSPTEIG

SEQ ID NO: 3029 - DNA, 2072 bp, Glycine max
  misc_feature (1)..(2072): Ceres cDNA ID no. 21572666
  misc_feature (1)..(2072): Ceres CLONE  ID no. 573481
  misc_feature (1)..(2072): Also known as  Ceres CDNA ID no. 23379807
aacccattggatcttcttcttctccttttgtactctcattcacattcttataggctaattaacatacactctcttccaaagttgagtactttgccaaaaaaaaaaaaaaaaagttttccctttgagaaagaaaacccaaagacagtcttttgatcattttgagcagttgcattccttgttttcttccattttgggtcccctcaaaagtagtttcaaaagggttcctcttcctccacagatatcatggcagatcataccccgggttcaggaaccgtttctgttgaagcttcttcacaagaaagaaggaaacttccaaactttctcctatccgtgagacttaagtatgtgaagcttggttaccactacttgatctccaatgctatgtaccttttactcataccccttcttggtgtagcttctgctcatctttcaacaatctcttaccaagatgttgtccaactatgggaaaatctcaagttcaatcttgtctcagtgactctatgttctagccttatagtgttccttgtcaccttttacttcatgagccgtccaaggggtgtttacttggtggattttgcgtgctacaagccagagccagattgcacttgcacaagggagattttcatgcacaggtctgtggaaactggtgtgttttcggaggagaacttggcctttcagaagaagatacttgagaggtctggtttgggacaaaagacttacttgcccccagcaatcttgagtatccctccaaacccttgtatggctgaagcaaggaaagaagctgagcaagtgatgtttggagccattgaccagcttctggagaaaactggtgtgaaggctaaggatattgggattttggtggtgaattgcagcttgttcaatcccacaccttctctctctgcaatgattgtgaaccactacaagctgagagggaatatccaaagttataatcttggtggcatgggttgcagtgctggacttatctctatagaccttgccaaacagctcctccaggttcatccaaactcttatgccttagtggtgagcatggagaacatcactctcaactggtattttggcaacaacaggtcaatgctagtctcaaattgtctcttcagaatgggtggagctgcagttctactctccaacaagtcttctgatcgcagaagagccaaataccaactgatccatacagtgcgtactcacaagggtgcagatgacagatcatatggttgtgtcttccaagaagaagatgagaagaaaacaattggtgtggcactctcaaaggacttaatggctgttgcaggagaagccctcaagaccaatatcacaacacttggcccattagtccttcccatgtcagaacagctcttgttttttgcaactttggtggctagaaaagtgttcaagatgaaaataaagccatacataccagacttcaagctagcttttgagcacttttgcatccatgctggaggaagagcagtgttggatgagttggagaagaatcttgagctctctgattggcacatggagccttcaagaatgacactgaacaggtttggcaacacttctagcagttccttgtggtatgaattggcctacactgaagctaaagggaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcctaaagtggcaaccattagttcctaagttaaacaacctcttgcatttttttgggaggaggaaattaatttacttgaggttttcattgttaatcttaggaggtgtgcaaaatttagaagagaagattactcccagctgatttgatcttgtgctagtgtgttcaagtcgtaagagtgtgcatacaattattgtccaatgaaatttattacacgatttttcataaaaatgtattacgtttactacttgacctttcaaaggttcatgaaatttgattttttaagttgctaaaaaaaaaaaaaaaa

SEQ ID NO: 3030 - protein, 517 aa, Glycine max
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 29417540; NR Description:
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
  misc_feature: GI Number: 14334714; NR Description: putative
MADHTPGSGTVSVEASSQERRKLPNFLLSVRLKYVKLGYHYLISNAMYLLLIPLLGVASAHLSTISYQDVVQLWENLKFNLVSVTLCSSLIVFLVTFYFMSRPRGVYLVDFACYKPEPDCTCTREIFMHRSVETGVFSEENLAFQKKILERSGLGQKTYLPPAILSIPPNPCMAEARKEAEQVMFGAIDQLLEKTGVKAKDIGILVVNCSLFNPTPSLSAMIVNHYKLRGNIQSYNLGGMGCSAGLISIDLAKQLLQVHPNSYALVVSMENITLNWYFGNNRSMLVSNCLFRMGGAAVLLSNKSSDRRRAKYQLIHTVRTHKGADDRSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWRALRTINPAKEKNPWMDEIHEFPVHVPKVATISS

SEQ ID NO: 3031 - DNA, 1928 bp, Glycine max
  misc_feature (1)..(1928): Ceres cDNA ID no. 21572667
  misc_feature (1)..(1928): Ceres CLONE  ID no. 573806
  misc_feature (1)..(1928): Also known as  Ceres CDNA ID no. 23478863
atcttcaaagctaagacgtaaagtagtaagcagtttcatcattttttctttttttctctcttttggtacattggaaagaaagaaaggaagcttcaatttcttccaataaagcgtgttttagaacgtgcttttaaggtatatatatatatatataactacatataccaaaaaactgatttgcagctgaaattgctttcgttcattagtatttagtttttcacaagctagggaagacatgggagaagtggctgatgaaggtcaatatttcagatcagaaatagctctattgaattactcggatgcaaccttcaaacccccactttcttctctgttgatacacattgatccactcataatacccaatggccacacttgttctgcatcagaatctgatccatcacccacttctcagcaccatcagcaggagcagcatcccaaagatgcctggcttccaatcactgaatcaagaaatggaaatgcctattatgcagcctttcatattcttaattccaacattggattccaggctctcatgcttcccgttgccttcgccactcttggttgggcatggggtacagtatgtttgtcactagcatttgtttggcaactctatgccatatttcttcttgttcagcttcacgaatccgtccccggaattcgtcacagcagatacctcttccttgccatggctgccttcggtaaaaagttagggaaggtggcagcattattcccggtaatgtacctttcaggaggcacatgcgtcatgataatcatcaccggtggtgggaccctgaaacaattattgaagacgctttgcgacaacgatgatcatgttcatgagcaaataacatgtaatgcccacgcgcttagcggggctgagtggttcttggtgtttacctgtgtcgccattctcattgcacagttgcccaacctcaactcaatggccatggtttctctcgtcggcgccgttacctccgttacttattgcaccctcttttgggttctctctgttaagaatggtaggcccaacaacgtatcctatagctcatccctgcagtcccaagaacacacaccagtggctaagatcaatggcgttctcaatgccattggaatcattgtgctagccttcagaggacacaatgttttgcccgaaatacaggggacgctgccttcaaatttcgaacaaacatccaaaagaccaatgcgaagaggagttagcatatcatatgtactcatttccatgtgcatgtttcccctcgcaattgccggattttgggcctatggaaaccagataaatgacgggggattgttaacttcgttcccacaattccacaagaggcaaatcacaaaattctctatgggtgcaatatatgttctagtaataatacattgtttaaccagctttcaaatatatgcgatgcctgtttttgacaacctggagataagatacacgagcataaagaatcagagatgtccacgattggtgagaacatgcataagactattctttggggggttgacattttttatttcggtcacgttcccattccttccacgcctatcagcactactcggaagcatgacccttgtgcccattacatatgcatacccttgtttcatgtggctatccctcaagaagcctcgtccaagaggttttgtttggtgcttcaacgttgcactcggttgtgtagggatgcttctcagtgctcttttggtagctgcagctatacggactctagctctcaatggcctagatgctaacttcttcaaaccataacaattaatattatgccatccaacagcaactagtatattgccaacaatttattttaatctactgttagtgatatacagaaaatcatttttgaacatgatactccagtaatacaaacgttaagttttgaattaaaaaaaaaaaaaaaaaaaaa

SEQ ID NO: 3032 - protein, 513 aa, Glycine max
  misc_feature: PFam Name: Aa_trans; PFam Description: Transmembrane amino
  misc_feature: GI Number: 452593; NR Description: ORF [Lilium longiflorum]
  misc_feature: GI Number: 21436363; NR Description: putative lysine and histidine specific transporter protein [Arabidopsis thaliana] >gi|17529318|gb|AAL38886.1| putative lysine and histidine specific
  misc_feature: GI Number: 5688864; NR Description: amino acid
  misc_feature: GI Number: 28393033; NR Description: putative amino acid permease [Arabidopsis thaliana] >gi|18418590|ref|NP_567977.1| amino
  misc_feature: GI Number: 21593132; NR Description: amino acid permease-like
MGEVADEGQYFRSEIALLNYSDATFKPPLSSLLIHIDPLIIPNGHTCSASESDPSPTSQHHQQEQHPKDAWLPITESRNGNAYYAAFHILNSNIGFQALMLPVAFATLGWAWGTVCLSLAFVWQLYAIFLLVQLHESVPGIRHSRYLFLAMAAFGKKLGKVAALFPVMYLSGGTCVMIIITGGGTLKQLLKTLCDNDDHVHEQITCNAHALSGAEWFLVFTCVAILIAQLPNLNSMAMVSLVGAVTSVTYCTLFWVLSVKNGRPNNVSYSSSLQSQEHTPVAKINGVLNAIGIIVLAFRGHNVLPEIQGTLPSNFEQTSKRPMRRGVSISYVLISMCMFPLAIAGFWAYGNQINDGGLLTSFPQFHKRQITKFSMGAIYVLVIIHCLTSFQIYAMPVFDNLEIRYTSIKNQRCPRLVRTCIRLFFGGLTFFISVTFPFLPRLSALLGSMTLVPITYAYPCFMWLSLKKPRPRGFVWCFNVALGCVGMLLSALLVAAAIRTLALNGLDANFFKP

SEQ ID NO: 3033 - DNA, 1741 bp, Glycine max
  misc_feature (1)..(1741): Ceres cDNA ID no. 21572668
  misc_feature (1)..(1741): Ceres CLONE  ID no. 574910
  misc_feature (1)..(1741): Also known as  Ceres CDNA ID no. 24356246
agttagatttcagaattggaagaaaaaacagcatggggtttagagtgcgaaatctgaatcccgtattccgaacttgcataacaaggctttcgtcttcaaattttcttcctccggtgctggaatcacttaattcccatccattagagtcttgtttaaccgaaaatcccgcgttcaaaatcccaaggagatggcatttgggtcatagtcattcacaccatgatgaccgccaccactaccacaaagagggagagaacattttccggttgggtctcgccgccgacatcggtttggccaccggaaaagccttcaccggctatctttccggcagcactgccattatcgccgatgccgcgcattccgtatccgatgtggttcttagtggcatagctttgttgtctttcaaggttgccaaggcgccgagagataaagaacacccatatggacatggtaagtttgagactctaggagctcttggaatctcttgcatgcttttggcgaccggaggtggcattgcatggcatgctgtagacattttgatgggattgttctcatctggtcctgaaatggttagccaggcattggcacatgggcacgggcaaagccacggacatggtggacatcaccatggaattaacatggatcatcccatccttgctttaaatatgacaattgtgtcaataggtgttaaagaagggctttactggataacaaaacaagctggtgagaagcaaggcagtgggctaatgaaagcaaatgcatggcatcatcgttcagatgcaatttcatctgtagttgctctcgttggagttggagggtctattcttggagtgaagtttctagatcccctcgctggacttcttgtctcaggcatgattttgaaagctggagctgaaactggttaccagagcgtcttggaattggtggatgctgcaatccctgaacaacatttggatcctattaaacaaacaatattgcaagttgatggtgtcaaggggtgccatcgtttaagaggaaggagagctggttcgtatctttatcttgatgtacatattgaggttgatcctttttctagtgtaagtgctgcacatgacattggtgaaaatgttcgtcatcaaattcacaagtctcatcctactgtggttgaagttttcatacacatagatcctgccatgtcacatgtttcttgtcagcaagatagttggagtggaggcatggaccatagcagtattgttcctgctgaggaggatagtaatattaaaggaattgtttctgatatcatctcatcaaactttccacagatgtcagttgagtgcataacacgtcacatgtttcaaagcaagatagttcttcaaattgaggtttccatgccacctgatatcccaattggacatgcaatggaaatggcaaagcaagcagaggaagagattttgaaggctgtctccaatacaattcatgttggcattcagctacgtttggggcaaccattcccacagatcaatcttacttagaaccatccatggatggtggaaagccgatttttttgcaactccatgcatccttttagtatgatttaagttaaatagattattacaatattgctctgctgcaacttctacctagtctcatacaatttcatactagcccatttgagaggttcgcaggaggtggaaaggtgaggaaacctactaaaaactcaatatatttggcgcccatttgacgtttgacaaaaaaaaaaaaaaaa

SEQ ID NO: 3034 - protein, 491 aa, Glycine max
  misc_feature: PFam Name: Cation_efflux; PFam Description: Cation efflux family
  misc_feature: GI Number: 30690804; NR Description: cation efflux family protein / metal tolerance protein, putative (MTPc1) [Arabidopsis
  misc_feature: GI Number: 46321960; NR Description: COG0053: Predicted
  misc_feature: GI Number: 52842251; NR Description: cation efflux family protein [Legionella pneumophila subsp. pneumophila str. Philadelphia 1] >gi|52629362|gb|AAU28103.1| cation efflux family protein [Legionella pneumophila subsp. pneumophila str.
  misc_feature: GI Number: 20089506; NR Description: cation efflux system protein [Methanosarcina acetivorans str. C2A] >gi|19914415|gb|AAM04061.1| cation efflux system protein
  misc_feature: GI Number: 20092180; NR Description: cation efflux system protein (cadmium/zinc/cobalt) [Methanosarcina acetivorans str. C2A] >gi|19917408|gb|AAM06735.1| cation efflux system protein
MGFRVRNLNPVFRTCITRLSSSNFLPPVLESLNSHPLESCLTENPAFKIPRRWHLGHSHSHHDDRHHYHKEGENIFRLGLAADIGLATGKAFTGYLSGSTAIIADAAHSVSDVVLSGIALLSFKVAKAPRDKEHPYGHGKFETLGALGISCMLLATGGGIAWHAVDILMGLFSSGPEMVSQALAHGHGQSHGHGGHHHGINMDHPILALNMTIVSIGVKEGLYWITKQAGEKQGSGLMKANAWHHRSDAISSVVALVGVGGSILGVKFLDPLAGLLVSGMILKAGAETGYQSVLELVDAAIPEQHLDPIKQTILQVDGVKGCHRLRGRRAGSYLYLDVHIEVDPFSSVSAAHDIGENVRHQIHKSHPTVVEVFIHIDPAMSHVSCQQDSWSGGMDHSSIVPAEEDSNIKGIVSDIISSNFPQMSVECITRHMFQSKIVLQIEVSMPPDIPIGHAMEMAKQAEEEILKAVSNTIHVGIQLRLGQPFPQINLT

SEQ ID NO: 3035 - DNA, 1665 bp, Triticum aestivum
  misc_feature (1)..(1665): Ceres cDNA ID no. 21572669
  misc_feature (1)..(1665): Ceres CLONE  ID no. 575570
  misc_feature (1)..(1665): Also known as  Ceres CDNA ID no. 23392139
ccttctcgttgagagtttcttctcgccctctctatccgctcctcgcgagcgatggttggcgacctctccctcctcgcctccgcctccgcctcccccgtcatcctcgcgccctccaaggagctccatggcgtcctgccgttccaggggaagaggtcccagcaggacgcggggagaagcgccgccgtgcagctctccccgcagcagcacctcctcgagggcgcctaccaggcgcagcagcccctgcagatgatggtccccgggatcggccaggctgccgccgctgcctaccagaccttcgacagcgccgcgctcatcgacgtgcaagattcccaccccgattcggttcgacttagccttgggattgctgagcagtgtgcaaggcaagagaaaatcctaaagtttctaatgtcaggttctgatgtcaaagaacttgatgcctctttgcttactgaatttacgggacatcagatgctatcagctaatatgggtggtcaaccatatttctctgatgataagttatctgtctatgagtttggattggaggagcctctgcagtatctagcaaaaaatcaacttatcatccctgatgacaagttatccatctatgagtttggattggaggagcctctgcagtatctatcagaaaatcaacttatcatccctgatccacttttggaatttgctcagtcccaaggtgcccttgctatagatgaaaatggccgggtcatcttcactggcagtggagacgagatgagagacttactttcggttttcttagagttcaatgtacctaaacgagaagcaagtggttgcaaggctgcatatttagttccatacttcgacaggaaaaggggccgaaatagtagtcaatccaattcaaaatcagcaagcaccgcagttgatgctccaaaaagcaatgcaaatgtgaaagcaaaatctccatcgaagaagaaacagaaaggaaaaaccatcaatgaacgtgacatgtatcagaacaattatttccatgccagcgaagcttttttctcaatccttttggacaaggacagaagcagctcgacaattctctcactgaagaaagcaggccctgagatcactgaactgttgacacagtgctcaattggcattgctggaactggcctggctgttcttctgtcggtcgtgtgcaaggttgctatcggcgggaggactccttttgccgccacccgtcttctgcacacaggcgttgggtttgggctcttctggctctcccatgcggtaaatggattgcgggacacaatcaccagtgtattcagaggcccggttgacacaaagttggaggatgaggttgccgtgaagatacaaagaagcatgaacgatattctcttcagggccgtaagtctcctggcaatcactgctttgaggtttgcatgagctgttcctacactgctgtaacttgacgcacctcgattcaccttttggttcaggagtacagtactgtaggactaagtgccaaataccttcatgattcatgagggcctcatagaaaatgcgcaactttgtaaattgtacagaattttgctggcagctcagtgtatatggaagatagattttgcctgttctgaacgttaattaagctaatgatcaatatactttgtatttcttgttacaaaaaaaaaaaaaaaa

SEQ ID NO: 3036 - protein, 453 aa, Triticum aestivum
  misc_feature: GI Number: 21594458; NR Description: unknown [Arabidopsis thaliana]
  misc_feature: GI Number: 23308297; NR Description: At4g02920/T4I9_20 [Arabidopsis thaliana] >gi|15450579|gb|AAK96561.1|
MVGDLSLLASASASPVILAPSKELHGVLPFQGKRSQQDAGRSAAVQLSPQQHLLEGAYQAQQPLQMMVPGIGQAAAAAYQTFDSAALIDVQDSHPDSVRLSLGIAEQCARQEKILKFLMSGSDVKELDASLLTEFTGHQMLSANMGGQPYFSDDKLSVYEFGLEEPLQYLAKNQLIIPDDKLSIYEFGLEEPLQYLSENQLIIPDPLLEFAQSQGALAIDENGRVIFTGSGDEMRDLLSVFLEFNVPKREASGCKAAYLVPYFDRKRGRNSSQSNSKSASTAVDAPKSNANVKAKSPSKKKQKGKTINERDMYQNNYFHASEAFFSILLDKDRSSSTILSLKKAGPEITELLTQCSIGIAGTGLAVLLSVVCKVAIGGRTPFAATRLLHTGVGFGLFWLSHAVNGLRDTITSVFRGPVDTKLEDEVAVKIQRSMNDILFRAVSLLAITALRFA

SEQ ID NO: 3037 - DNA, 1864 bp, Triticum aestivum
  misc_feature (1)..(1864): Ceres cDNA ID no. 21572670
  misc_feature (1)..(1864): Ceres CLONE  ID no. 576170
  misc_feature (1)..(1864): Also known as  Ceres CDNA ID no. 24356487
gtctagaaaacctccgcgacagctgacctgcgccgccgccgccatggacgccgccaccggaagccgcctccgcgccttcgagagctggatgcgggagcacggcgtcgtctgcagcgacgcgctccgcctcgacgccagcgaggccggcggcgtctacgtgcgcgcgctcgccgcgctccgggagggcgacgtcgttgccaccatcccgcgccgcgcgtgcctgacgccgcgcacgtccggggccgcggcggccatcaaggacgcgcagctcggtggcacgctcgctctcgccgtcgccgtcatgtacgagcgcgcgcggggcgccgattcgccgtggtacgactacctccgcctgatcccggactgcgagcccgtgccgctcgtctggcccgaggacgaggccgcgcgccttctcgccggcaccgagctcgataagacagtgaagcaagacagggaattcctttgtgaggattggaaagaatgtatcgagccactcatttcttctggagaattgggggtcaagccagatgatcttagcctggagaaatattttgcggctaaaagtcttctttcatcaaggtccttccgtatagataaatatcatggttctggaatggttcccctggctgacctttttaatcacaagactgatggcgaacatgttcacttcactaagtcagacgcctcagactctgatgaggaagaagatggtgataatcaaagcaatacagactcagatgaagaaggtgacgatgatcaaaacaatgtagaattagttgaagaagaagatggcgatgatcaaagcaatgcttctgctgatgaacagtcaactgttgaaaattccaccgccaatccttcaggtgaaggatataacgatgaagatttggaaatgattattgtgagagaagccaatccaggggatgaggtttataatacatatggtaccatgggaaatgctgctttgcttcatcggtatggttttacagaactcgacaacccatacgacattgtcaacatcgacttgacactggttactaagtggtgctcgtccaagtactcccatcgatatgcaaaagcaagggtatcactatggcataagctgggctattcaggctgcaccagcgaagatgccgagtactttgagatctcatacgatggagagccccagcttgaatttgtgatcctcctttacattatcttcttggagcctgaagtttatgacaagttggtctgcatagctgaggatctggttggcgatgatgaccaggacgatgagcaggataccattgacagttttgctaaggttgtcaaagtaacaagacccgccaaaaacggggtcgaaaaactgcctgatgtgaagaagctactgcagagtgagagcattggctctgcacttgcatccattgctgacacccgggagagcctctatggttccagcactctaaaagatgacgaggagaagctcagaacatgctctcccgtcggtgaaaggaacctttaccattccctggtgctgcgggtgagcgagaggaagatacttggcagattgaggaaacatgcgtctagttggtttaagaccaagaagaggaagcatatctagtgttcaaattttctggtcagcaagcagctgtaactcttttgccttgtgaaatgggtggatatgttagattctgaaatgatagggccagttgaatttacatctggcatttgttactcttcctgtaatggtgtgacttagctcattttcatttctccccttctgaagttcagatcatttgaagatgcaccctcggagtttaagtagttgagacatgccagtttgtgatgctatgattaccttcatttaacaaaaaaaaaaaaaaaa

SEQ ID NO: 3038 - protein, 518 aa, Triticum aestivum
  misc_feature: PFam Name: SET; PFam Description: SET domain
  misc_feature: GI Number: 34907380; NR Description: P0471B04.24 [Oryza sativa (japonica cultivar-group)] >gi|21952799|dbj|BAC06215.1| P0018C10.16 [Oryza sativa (japonica cultivar-group)] >gi|22202682|dbj|BAC07340.1| P0471B04.24 [Oryza sativa (japonica
  misc_feature: GI Number: 28829640; NR Description: similar to Arabidopsis thaliana (Mouse-ear cress). Hypothetical 59.5 kDa protein
  misc_feature: GI Number: 50252331; NR Description: putative ribulose-1,5 bisphosphate carboxylase/oxygenase large subunit N-methyltransferase, chloroplast precursor [Oryza sativa (japonica
  misc_feature: GI Number: 18490888; NR Description: FLJ21148 protein [Homo
  misc_feature: GI Number: 33357824; NR Description: Chain C, Crystal Structure Of The Set Domain Of Lsmt Bound To Melysine And Adohcy >gi|33357823|pdb|1P0Y|B Chain B, Crystal Structure Of The Set Domain Of Lsmt Bound To Melysine And Adohcy Of A Set Domain
MDAATGSRLRAFESWMREHGVVCSDALRLDASEAGGVYVRALAALREGDVVATIPRRACLTPRTSGAAAAIKDAQLGGTLALAVAVMYERARGADSPWYDYLRLIPDCEPVPLVWPEDEAARLLAGTELDKTVKQDREFLCEDWKECIEPLISSGELGVKPDDLSLEKYFAAKSLLSSRSFRIDKYHGSGMVPLADLFNHKTDGEHVHFTKSDASDSDEEEDGDNQSNTDSDEEGDDDQNNVELVEEEDGDDQSNASADEQSTVENSTANPSGEGYNDEDLEMIIVREANPGDEVYNTYGTMGNAALLHRYGFTELDNPYDIVNIDLTLVTKWCSSKYSHRYAKARVSLWHKLGYSGCTSEDAEYFEISYDGEPQLEFVILLYIIFLEPEVYDKLVCIAEDLVGDDDQDDEQDTIDSFAKVVKVTRPAKNGVEKLPDVKKLLQSESIGSALASIADTRESLYGSSTLKDDEEKLRTCSPVGERNLYHSLVLRVSERKILGRLRKHASSWFKTKKRKHI

SEQ ID NO: 3039 - DNA, 1517 bp, Triticum aestivum
  misc_feature (1)..(1517): Ceres cDNA ID no. 21572671
  misc_feature (1)..(1517): Ceres CLONE  ID no. 576306
  misc_feature (1)..(1517): Also known as  Ceres CDNA ID no. 25088256
atacctacatagtcttctgccagtttgagtactcacgacgaacgccgtccacacgccccagagcacttcgaacacgaggccgccagcgagcatgggcaagggagctggcgccgccggcgtggacgagccgctgctcccggagctctcgggcgggcacggcggcggggcgtcggtctccggcgcggtgttcaacctgtccacgagcatcatcggcgccggcattatgtcgatcccggcggcaatgcgcgtgctcggggtcgtccccgcgctcgccctcatcgcggccgtcgccctcctctccgacgtctccgtggagttcatgctgcggtacacggcctgggccagcggcacgccctcgtacgcggggatcatgggcgacgcgttcggccgccgcgccggcgccgcggcgctcaacatcttcatagccttcaccaccgccggcaccctcgtcgtctacctcatcatcataggggatgtgctgtccgggagcgtggaggggggaggcgagcacgccggggtgctgcaggagctgttcggccggcagtggtggaccggcagggagtttgtgatactggccacggccgtcgtcgttctgctgccgctggtgctcctccgccgcgtcgattcgctgaggtacacatcggcagtgtccatccttctggcggcggtgttcatgctcatcacgatggggatcgcggtctacactgtcttcaccggcactgcgaagatgccgcggatgctgccggacttctccaccctcgcgtcccccttcgagctcttcaccgccgtcccggtcatcgtcgtcgccttcaccttccacttcaacgtgcacccgatccgcgcggagctcagcaagacgtcggacatgaagtcggcggtgcgcatctcgctggtgctctgcgccgccatctacgccgcggtgggcttcttcggcttcctcctcttcggggacgccaccatgcccgacgtgctcgccaacttcgaccgcagctccggctccggcgtcccgcaggcgctcaacgacgccgcgcgcctcagctacgcgctgcacctcgtgctcgtcttcccgctcctccactactcgctccgcgtcaacgtcgacgagctcctcttcccaggccgccgcccgctggccaccgacacgcgccgcttcgtggcgctcacggccgtgctcatggcggtgctctacgtgctcgccatcgccatccccagcatctggacgctcttccagtactcgggctccacgttcgccgtctgcatatcgcttatcttccctggcgccatcgttctcagggatgttcacggaatagcgaagaggaaagacaaggcaatggcagcgatgatgatcactctggcggtgatcacgagcagcatcgccattgcttccaacgtcatgagctccatcaagggcgaagtgaaaggtgttaatgccggagctagctagcatgtacagtttcattatttatatagctataatataaatcaaaattctttcacccgcaaaaaaaaaaaaaaaa

SEQ ID NO: 3040 - protein, 450 aa, Triticum aestivum
  misc_feature: PFam Name: Aa_trans; PFam Description: Transmembrane amino
  misc_feature: PFam Name: Pyr_redox_2; PFam Description: Pyridine
  misc_feature: PFam Name: Pkinase; PFam Description: Protein kinase domain
  misc_feature: PFam Name: Podocalyxin; PFam Description: Podocalyxin
  misc_feature: PFam Name: Atrophin-1; PFam Description: Atrophin-1 family
  misc_feature: GI Number: 34907894; NR Description: P0439E11.11 [Oryza sativa (japonica cultivar-group)] >gi|14587360|dbj|BAB61261.1|
  misc_feature: GI Number: 42569800; NR Description: amino acid transporter
  misc_feature: GI Number: 15241555; NR Description: amino acid transporter
  misc_feature: GI Number: 9758059; NR Description: amino acid
  misc_feature: GI Number: 51535770; NR Description: putative system A
MGKGAGAAGVDEPLLPELSGGHGGGASVSGAVFNLSTSIIGAGIMSIPAAMRVLGVVPALALIAAVALLSDVSVEFMLRYTAWASGTPSYAGIMGDAFGRRAGAAALNIFIAFTTAGTLVVYLIIIGDVLSGSVEGGGEHAGVLQELFGRQWWTGREFVILATAVVVLLPLVLLRRVDSLRYTSAVSILLAAVFMLITMGIAVYTVFTGTAKMPRMLPDFSTLASPFELFTAVPVIVVAFTFHFNVHPIRAELSKTSDMKSAVRISLVLCAAIYAAVGFFGFLLFGDATMPDVLANFDRSSGSGVPQALNDAARLSYALHLVLVFPLLHYSLRVNVDELLFPGRRPLATDTRRFVALTAVLMAVLYVLAIAIPSIWTLFQYSGSTFAVCISLIFPGAIVLRDVHGIAKRKDKAMAAMMITLAVITSSIAIASNVMSSIKGEVKGVNAGAS

SEQ ID NO: 3041 - DNA, 1636 bp, Glycine max
  misc_feature (1)..(1636): Ceres cDNA ID no. 21572672
  misc_feature (1)..(1636): Ceres CLONE  ID no. 578132
  misc_feature (1)..(1636): Also known as  Ceres CDNA ID no. 24356250
cacactcctcccatcatcacaccatgctcacagttctggttctcctctcactccttcttaccatctccacttcccacaatatatcataccctcatttccaacaactcaatgtcaaacaaataatcctcacagaaaccaaactctacccaaacccaacccaaccctccaaacacccccacaataaaaaactcaacagtgccaccgaagcatcttcatcagcaaaatataaactgaagctagttcacagagataaagtccccacctttaacacctaccacgaccaccgaacccgattcaatgcacgaatgcagcgagacaccaaaagggccgcctccctcctccggcgcctcgctgccggaaaacccacctacgccgcggaggcattcgggtcggacgtggtttccggaatggagcaaggaagcggagaatacttcgtgagaatcggagttggaagcccacctcgaaaccagtacgtggtcatggactcaggcagcgacattatatgggtccaatgcgaaccctgcacccaatgctaccaccaatccgaccccgttttcaaccccgccgattcctcctccttctccggcgtctcctgcgcctccaccgtctgcagccacgtcgacaacgccgcctgccacgagggacgctgccgctacgaagtttcctacggcgacggctcctacaccaaaggcacactcgcactcgagacaatcacgttcggaagaaccctaatccgaaacgtggccatcgggtgcggccaccacaaccagggaatgttcgttggcgccgccgggcttttgggcctcggaggtgggcccatgtcctttgtgggccaactcggaggtcagaccggcggtgcctttagttattgtttggtcagcaggggaatcgagtcgtccggattactcgaattcggacgagaagcaatgcccgtaggcgctgcatgggttcccctgatccacaacccgagagcccagagtttttattacattgggctttcgggcctgggagttgggggcctgcgggtgtccatatccgaagatgtttttaaactatccgaattgggcgatggtggggttgttatggacaccgggaccgccgtgacgcggcttccgacggtggcgtatgaggctttccgggatggttttattgcccagaccacgaacctgccccgggcttcgggagtatccatttttgacacgtgttatgacttgttcgggtttgtgtcggttcgggttccaaccgtgtcgttttacttctcgggtgggcctattttgaccctgccagctaggaactttttgatcccagtcgatgacgtgggaactttttgcttcgcctttgctccttcttcttctggtctttccatcatcggaaatattcagcaagaagggattcagatttcggttgatggagctaatgggtttgtgggatttggacccaatgtttgttgagtaatagtaatagtaatagccattgccatgtatatcaaccaacgatatgaatttttctagtcttagtcatgtaacatataaaagaaacaactaggtcgtcgtgcatgtggtaattaattaactattgtatttaaaataataagttgtttcggtttttgattgagatgccaaaaaaaaaaaaaaaa

SEQ ID NO: 3042 - protein, 1636 aa, Glycine max
  misc_feature: PFam Name: Asp; PFam Description: Eukaryotic aspartyl protease
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Lipoprotein_5; PFam Description: Transferrin
  misc_feature: GI Number: 15231010; NR Description: aspartyl protease family
  misc_feature: GI Number: 19424106; NR Description: putative chloroplast
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 21594980; NR Description: chloroplast nucleoid DNA
CACACTCCTCCCATCATCACACCATGCTCACAGTTCTGGTTCTCCTCTCACTCCTTCTTACCATCTCCACTTCCCACAATATATCATACCCTCATTTCCAACAACTCAATGTCAAACAAATAATCCTCACAGAAACCAAACTCTACCCAAACCCAACCCAACCCTCCAAACACCCCCACAATAAAAAACTCAACAGTGCCACCGAAGCATCTTCATCAGCAAAATATAAACTGAAGCTAGTTCACAGAGATAAAGTCCCCACCTTTAACACCTACCACGACCACCGAACCCGATTCAATGCACGAATGCAGCGAGACACCAAAAGGGCCGCCTCCCTCCTCCGGCGCCTCGCTGCCGGAAAACCCACCTACGCCGCGGAGGCATTCGGGTCGGACGTGGTTTCCGGAATGGAGCAAGGAAGCGGAGAATACTTCGTGAGAATCGGAGTTGGAAGCCCACCTCGAAACCAGTACGTGGTCATGGACTCAGGCAGCGACATTATATGGGTCCAATGCGAACCCTGCACCCAATGCTACCACCAATCCGACCCCGTTTTCAACCCCGCCGATTCCTCCTCCTTCTCCGGCGTCTCCTGCGCCTCCACCGTCTGCAGCCACGTCGACAACGCCGCCTGCCACGAGGGACGCTGCCGCTACGAAGTTTCCTACGGCGACGGCTCCTACACCAAAGGCACACTCGCACTCGAGACAATCACGTTCGGAAGAACCCTAATCCGAAACGTGGCCATCGGGTGCGGCCACCACAACCAGGGAATGTTCGTTGGCGCCGCCGGGCTTTTGGGCCTCGGAGGTGGGCCCATGTCCTTTGTGGGCCAACTCGGAGGTCAGACCGGCGGTGCCTTTAGTTATTGTTTGGTCAGCAGGGGAATCGAGTCGTCCGGATTACTCGAATTCGGACGAGAAGCAATGCCCGTAGGCGCTGCATGGGTTCCCCTGATCCACAACCCGAGAGCCCAGAGTTTTTATTACATTGGGCTTTCGGGCCTGGGAGTTGGGGGCCTGCGGGTGTCCATATCCGAAGATGTTTTTAAACTATCCGAATTGGGCGATGGTGGGGTTGTTATGGACACCGGGACCGCCGTGACGCGGCTTCCGACGGTGGCGTATGAGGCTTTCCGGGATGGTTTTATTGCCCAGACCACGAACCTGCCCCGGGCTTCGGGAGTATCCATTTTTGACACGTGTTATGACTTGTTCGGGTTTGTGTCGGTTCGGGTTCCAACCGTGTCGTTTTACTTCTCGGGTGGGCCTATTTTGACCCTGCCAGCTAGGAACTTTTTGATCCCAGTCGATGACGTGGGAACTTTTTGCTTCGCCTTTGCTCCTTCTTCTTCTGGTCTTTCCATCATCGGAAATATTCAGCAAGAAGGGATTCAGATTTCGGTTGATGGAGCTAATGGGTTTGTGGGATTTGGACCCAATGTTTGTTGAGTAATAGTAATAGTAATAGCCATTGCCATGTATATCAACCAACGATATGAATTTTTCTAGTCTTAGTCATGTAACATATAAAAGAAACAACTAGGTCGTCGTGCATGTGGTAATTAATTAACTATTGTATTTAAAATAATAAGTTGTTTCGGTTTTTGATTGAGATGCCAAAAAAAAAAAAAAAA

SEQ ID NO: 3043 - DNA, 1449 bp, Triticum aestivum
  misc_feature (1)..(1449): Ceres cDNA ID no. 21572673
  misc_feature (1)..(1449): Ceres CLONE  ID no. 579699
  misc_feature (1)..(1449): Also known as  Ceres CDNA ID no. 24356745
aaaagagatgagcctcccgtttgatcgtagcagagtggttttgattgtgccagtgcggctacgactgctaccccgcgcccgcgcccgcgccgacgagagcagaagaagcgaagcgaattctagaaggagccgtaaataaatactcctcctagccggtgagagcaacgccaacgcccatagttccgtcccataccatacaaccactagctagcaaccagagattcactgccgccgccgccgccgcttgcattggaggcgctcttgcaggagcctaaggctgtgccatcttcgttcttcggcgacgaccgcgaaaattgtagggctggcagactggtggccggccggcgcggcggccgaagcccaagcccaagagatggggagcatggacggccacccgctccagggcaaccacggctacgcccacgtccctgccggcagcaacaacgacgaggacgacgcgtcgccgccgccctcggccggtggggggtcctcgggttcggggcgccggccgcgcggcaggcccccggggtccaagaacaagcccaagccccccgtcgtggtgacgcgggagagccccaacgcgatgcgctcccacgtgttggagatcgccagcggggccgacatcgtcgaggccatcgcggccttctcccgccgcaggcagcgcggcgtctcagtcctcagcgggagcggcgccgtcaccaacgtcacgctgcgccagcccgcagggaccggggcggccgccgtcgccctaagggggcggttcgagatactctccctgtctggcgccttcctcccggcgccggcgccgcccggggcgacggggctcgccgtgtacctcgcgggcgggcaggggcaggtggtcgggggcagcgtgatgggggagctgctcgcgtcgggccccgtcatggtgatcgcggccacgttcggcaacgccacgtacgaaaggctgccgctggatcaagacgctgaggagggcgccgtgctgtccgggtcggagggcgccgccacgcagctggagcagcagggcagcggaggcgccgccgtgcccccaccgatgtacgccgtgccgcagacgccgcccggcgacatgttcgggcagtggggacaggcagccgtggcgcggcctccaccgacgtcattctagcactgcaccggcgaggcgaatcgcgcgcgcagttcttctacctagctagtttagctttctgcttcttccctagttgtttgcctagcttccattatcttgttaattaatgtgctatgtcatgcatgggtacttgtatgatattttttttccttttttgttttcattcctcttccgtctttgaagcttgggaatgtgaaattcctacacgaatcaagaactcaaggaacaatggctgctcctcaatcagcttcttataaaaaaaaaaaaaaaaaaaaaaaaaaaaaaaagaaaaaaaaaaaaaaaaa

SEQ ID NO: 3044 - protein, 256 aa, Triticum aestivum
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 50941343; NR Description: DNA-binding protein-like [Oryza sativa (japonica cultivar-group)] >gi|29467557|dbj|BAC66727.1| DNA-binding protein-like [Oryza sativa (japonica cultivar-group)] >gi|37806155|dbj|BAC99660.1|
  misc_feature: GI Number: 50252749; NR Description: putative DNA-binding
  misc_feature: GI Number: 30102700; NR Description: At1g20900 [Arabidopsis thaliana] >gi|6319180|gb|AAF07197.1| ESCAROLA [Arabidopsis thaliana] >gi|20532086|sp|Q9S7C9|ESCA_ARATH Putative DNA-binding protein ESCAROLA >gi|15218067|ref|NP_173514.1| [Arabidopsis
MGSMDGHPLQGNHGYAHVPAGSNNDEDDASPPPSAGGGSSGSGRRPRGRPPGSKNKPKPPVVVTRESPNAMRSHVLEIASGADIVEAIAAFSRRRQRGVSVLSGSGAVTNVTLRQPAGTGAAAVALRGRFEILSLSGAFLPAPAPPGATGLAVYLAGGQGQVVGGSVMGELLASGPVMVIAATFGNATYERLPLDQDAEEGAVLSGSEGAATQLEQQGSGGAAVPPPMYAVPQTPPGDMFGQWGQAAVARPPPTSF

SEQ ID NO: 3045 - DNA, 1349 bp, Triticum aestivum
  misc_feature (1)..(1349): Ceres cDNA ID no. 21572674
  misc_feature (1)..(1349): Ceres CLONE  ID no. 579777
  misc_feature (1)..(1349): Also known as  Ceres CDNA ID no. 23723756
gtcagaaaaaagatgctcttttaggggaaaacaccccccgtcgccatgctggtgctggcgccgggcgtcaggctctaaacccacctagggtttcggccggcggcgatgcgggccgccagtgtgccgcgctactccgtcggcgccggcgccggggccggggcggtcttcctcggcgacggcgacgtcgaccccgaggcgctcaccgaggaggacagcctcgtcggcggcggcgactccaactccgtggattgcttgcatggatcatacagcagctctttaagcctccacggtgtcagagttgacgaggatcactccgctcttgagaacagcagcaggcctcctagtcatattaatatcctaacgccacaagatgttgtacccatcgaagtggcacggtctagattcctggacatcatcattgaccattttattggccagaatgttatcgaggtgggagaaccctctctctatgactctatcctggccagcaatagaatcaacaaaagaaagcaacaagaggtacaatacgaaggcgacccgaggtttgctttgcccttgatgtacatagccaacttgtatgagtctttggtgagcgacgtcaatgcacgtcttgcttccttgactggatcccgtgagaaaactatgggggtagctcttgaagctgccggcggcttgtacaggaagctgactcaaaagtttcccaagaaaggaaattgtagcttcaggaggagggagctggctacttctaatgcaacaaagacaaagtttcctgaacttgtagtacaggaagaaaagcgggtccgttttgttgtaatcaatggtttggtgatcatagagaggccaaataatatgagaatgcaggatgctgaatggttcaaaagattgaccggtcgaaatgaagtggccatttcatcaagagattacaaattctattcacctcgacacaagtacaggcgaaccctgcagccagtatttgacattcctggcacgtccgttttgtcagaggatgagacttctccattggtttgttcttcagaatttcgtccaccattcgagccgagcagccctgcaaagttctgcgacgagtgcggttcgccgtatctaagggcgacatccaagttctgttcagagtgtggcaccaagaggctagggatctgactgagttaagcaattttgtcacagatcaatgttgtttcttttttctgcggggagttcaatgttgtttcggccatgtcgcagaaccctgtagaacgggttttggttgctgtaactgaacttgagttcactcttgccttcaatggtaatatatatcgatggatgtgactccctcatgaaaaaaaaaaaaaaaa

SEQ ID NO: 3046 - protein, 350 aa, Triticum aestivum
  misc_feature: GI Number: 30677982; NR Description: pentatricopeptide (PPR)
MRAASVPRYSVGAGAGAGAVFLGDGDVDPEALTEEDSLVGGGDSNSVDCLHGSYSSSLSLHGVRVDEDHSALENSSRPPSHINILTPQDVVPIEVARSRFLDIIIDHFIGQNVIEVGEPSLYDSILASNRINKRKQQEVQYEGDPRFALPLMYIANLYESLVSDVNARLASLTGSREKTMGVALEAAGGLYRKLTQKFPKKGNCSFRRRELATSNATKTKFPELVVQEEKRVRFVVINGLVIIERPNNMRMQDAEWFKRLTGRNEVAISSRDYKFYSPRHKYRRTLQPVFDIPGTSVLSEDETSPLVCSSEFRPPFEPSSPAKFCDECGSPYLRATSKFCSECGTKRLGI

SEQ ID NO: 3047 - DNA, 1438 bp, Glycine max
  misc_feature (1)..(1438): Ceres cDNA ID no. 21572675
  misc_feature (1)..(1438): Ceres CLONE  ID no. 580025
  misc_feature (1)..(1438): Also known as  Ceres CDNA ID no. 24356243
acttacccttttgtttcaggtatccattctcatccactatcttagagactccaatggaggatccgtttagcaatttgccagatgaaattctaagctgcatagtttcttttctgccactagaaaccagcctcatatctactaggtggagagacctgtggaaccaagcccttgttagacatggaagcacacaagacgacgtagctagtgttgttgctggttttctgtctcgttttgaagagcttgatccattaaaacatcctcgcaaacttcattttcacttttctgatcaagacactgcactctttgcatccattgcaaccaacagtaagcttcttcttgatttccctgctgggatcaaagacctcaaaaagcagtatgagctcaagtttatactcaacaagcatcacatcacacacaacactgtcccccccactttcttagtcaaaactctttatttgaaatcagtgagtcatttgactagtgagttgatttcctccatcgtttcaaatttagagcatcttgagaagttggtgattgttgagtgcaccgggttgcaatctttgttcattgagtctgaatcaaagcttcacgagttaaccatattagattgcccccagttgaagtctctccatcttagaacttctaagcttaaaagtttcagacttgatggacctcttccaacgatttggccagaatcccatttcaaccttagccatgccatgcttaatttcagacttggaccaagctgtgctgacttcaaggctcaatatttcaaccaaacactgttgacaataaagaattgtgaagctctcactttatgtgagtggacttttcaggaattgatatggccatcgatttctccaagtgggaactttatattctataaaataagagagctatggtggattcacaaccataggggtgaaaatagcatggacaccttagtctcctttttgaaattatgtcctgccttggagcaactttttgtgacgaatgattctacaagttattcggctccacggtccaattcatattgtttaacgcaagaaactgaatatagtacaaaattggagcatctaaaacggataaagtttatgggatttacaaatcgagtggatgaaatctcagtggcaaagaaattgattgaattagtcaagggagagcctccaaagatagagacatcggatgagagttgcttgaatgtagtgatcgtgcagtgatttttttttttttatgtagaaaggaaaattatacgaacaagtcatttcccatgctctttcaggctggggctggcatagcgttataattcagaagagataaaatatgtcacttttggagcctttgtttctatatatccttttctgcaatgtaatcttgtaggggacagcacatctttaaatatggtatgattcattttacggcaaaaaaaaaaaaaaaa

SEQ ID NO: 3048 - protein, 388 aa, Glycine max
MEDPFSNLPDEILSCIVSFLPLETSLISTRWRDLWNQALVRHGSTQDDVASVVAGFLSRFEELDPLKHPRKLHFHFSDQDTALFASIATNSKLLLDFPAGIKDLKKQYELKFILNKHHITHNTVPPTFLVKTLYLKSVSHLTSELISSIVSNLEHLEKLVIVECTGLQSLFIESESKLHELTILDCPQLKSLHLRTSKLKSFRLDGPLPTIWPESHFNLSHAMLNFRLGPSCADFKAQYFNQTLLTIKNCEALTLCEWTFQELIWPSISPSGNFIFYKIRELWWIHNHRGENSMDTLVSFLKLCPALEQLFVTNDSTSYSAPRSNSYCLTQETEYSTKLEHLKRIKFMGFTNRVDEISVAKKLIELVKGEPPKIETSDESCLNVVIVQ

SEQ ID NO: 3049 - DNA, 1153 bp, Triticum aestivum
  misc_feature (1)..(1153): Ceres cDNA ID no. 21572676
  misc_feature (1)..(1153): Ceres CLONE  ID no. 584955
  misc_feature (1)..(1153): Also known as  Ceres CDNA ID no. 24356483
ccatccaccgaatccccaaaaccctagcagcgaaatcgcctcgatcgaaaaagttcttcgtctccctctcgcggtatcaagcgcagctccgtcgatcccccacctaagagcagtgatggcgcagtcaggcaacaacgacgccgccccgatcagcacccagcccgcggcggaggaggtgacggtggagaggacgcccgaggaggaggaggccaggctgaggtacctcgagttcgtgcagcaggcggcggcgcaggcggtcgtgctggccgccgcggcctacgcctacgccaagcagggcgcaggcccgctccgcctcggcgtcgaccacgtcgaggggaccgtcaaggccgtcgtcggccccgtctacgaccgctaccacgccgtgccgctcgacctcctcaagttcctcgaccgcaaggttgatgagtctgtccaggagcttgatcgtcgtgtcccaccggtcgtgaaggaggtgccaacctatgcccgctctgcagcagctgaggtgcagaagacaggcataatgggcacagcaactggactggccaagtcggccattgctcgcgctgagccaaaggcccgcgacttgtatacccgctacgagcctgtggccgagcgcaaggctgccgaagcctgggctgccctgaaccgcctcccgctcgtcccctcagtgacccgtgccgtcctccccacagctgcacagctctcagccaagtacaactctgccgtgcttgatggtgctaagcgtggcaactccgtcgctacctacctcccgcttgtcccaacggagcgcatcgcaagggtttttgcctacccggcagctgaccctgcgcctgccacagctcctgagatgcagcccatcccgacgcagtaacaataagagctacccggagttttattattacctaatagctgtaggagtcggtatctcgatgtagtgtcttgtctggcttgtggtggacagtggtactatatgtggatggtcactgtggtatccgcctctgttgaggggattcgaatgctgttgctgtgcagcaacacctgctttgtgttttagtttgttcttcatgaaccactgtgtgtaatgctttgaatcaaagttacaggaaacaccatctgtaaattcattactgttttaaaaaaaaaaaaaaaa

SEQ ID NO: 3050 - protein, 252 aa, Triticum aestivum
  misc_feature: PFam Name: REF; PFam Description: Rubber elongation factor
  misc_feature: GI Number: 7596762; NR Description: stress related protein, putative [Arabidopsis thaliana] >gi|21537353|gb|AAM61694.1| stress related protein, putative [Arabidopsis thaliana] >gi|17380640|gb|AAL36083.1| AT3g05500/F22F7_5 [Arabidopsis
  misc_feature: GI Number: 5802955; NR Description: stress related protein [Vitis riparia] >gi|15214303|sp|Q9SW70|SRP_VITRI Stress-related
  misc_feature: GI Number: 33332330; NR Description: rubber synthesis protein
  misc_feature: GI Number: 37622210; NR Description: small rubber particle
  misc_feature: GI Number: 3319925; NR Description: Hev b 3 [Hevea brasiliensis] >gi|3319923|emb|CAA11304.1| Hev b 3 [Hevea brasiliensis] >gi|3319921|emb|CAA11303.1| Hev b 3 [Hevea brasiliensis] >gi|14423933|sp|O82803|SRPP_HEVBR Small rubber Hev b3
MAQSGNNDAAPISTQPAAEEVTVERTPEEEEARLRYLEFVQQAAAQAVVLAAAAYAYAKQGAGPLRLGVDHVEGTVKAVVGPVYDRYHAVPLDLLKFLDRKVDESVQELDRRVPPVVKEVPTYARSAAAEVQKTGIMGTATGLAKSAIARAEPKARDLYTRYEPVAERKAAEAWAALNRLPLVPSVTRAVLPTAAQLSAKYNSAVLDGAKRGNSVATYLPLVPTERIARVFAYPAADPAPATAPEMQPIPTQ

SEQ ID NO: 3051 - DNA, 534 bp, Triticum aestivum
  misc_feature (1)..(534): Ceres cDNA ID no. 21572677
  misc_feature (1)..(534): Ceres CLONE  ID no. 585049
  misc_feature (1)..(534): Also known as  Ceres CDNA ID no. 23720399
aagcacaaaaggcggagcctccagcagctcaaatggtgagggcgttggatctcgccgcggcgagaggcttcgccgccgccgcagccgactccgtgcagcgcgcgcccggcgccgtcgtgggtctgccctttgtcctcgtggccgcggtcgccgtcgtggccatcgcggcgttcggctgcgccgacgacgggagggccaagcgacgccgccgcgagcgctggggcagcggcagcggcgccggctacggaggcgacggggccggcggcggcggctgcggcggcggaggcggtcacggaggcggcgggggcggcggttgaggagctgagcgcgccacgcgagggggtggctccatcctgtctacctgaccctgacggacggctcggcttactctgcttctctttagaatttcatcgtctcgttgaatgtatctgcgcttctgcagtatagatcgggtgtaagatacttgtatgcttatggacgccattttgctatgtcatagtggctgtttcgattgttccaacaaaaaaaaaaaaa

SEQ ID NO: 3052 - protein, 94 aa, Triticum aestivum
  misc_feature: PFam Name: GRP; PFam Description: Glycine rich protein family
  misc_feature: PFam Name: TT_ORF1; PFam Description: TT viral orf 1
  misc_feature: PFam Name: Chorion_1; PFam Description: Chorion protein
  misc_feature: PFam Name: Protamine_P1; PFam Description: Protamine P1
  misc_feature: PFam Name: Bindin; PFam Description: Bindin
  misc_feature: GI Number: 1362587; NR Description: spermatid-specific
  misc_feature: GI Number: 1044963; NR Description: protamine [Monodonta
  misc_feature: GI Number: 16554779; NR Description: no on or off transient A
  misc_feature: GI Number: 17821; NR Description: glycine-rich_protein_(aa1-291) [Brassica napus]
  misc_feature: GI Number: 33243114; NR Description: P1 protamine [Styela
MVRALDLAAARGFAAAAADSVQRAPGAVVGLPFVLVAAVAVVAIAAFGCADDGRAKRRRRERWGSGSGAGYGGDGAGGGGCGGGGGHGGGGGGG

SEQ ID NO: 3053 - DNA, 1505 bp, Glycine max
  misc_feature (1)..(1505): Ceres cDNA ID no. 21572678
  misc_feature (1)..(1505): Ceres CLONE  ID no. 588762
  misc_feature (1)..(1505): Also known as  Ceres CDNA ID no. 25891157
gggagactcttggtgtaagtgttgttcttccgatttggttcaatcaaatcaatgatgttgaggaggaggggttctgtgacctccttctattccaaattcatcgattctcacaatcttaattgtgggcgttcctcttcgaatccccatcgcgtcgctgcttctgcaacttcattcgatatctcttccgcttctgcgtctaaagctacgaccgacttcgtgtcgttgacccgccactatggaaggtgctattgggagctctccaaagctcgtctcagcatgcttgtggttgcaacatctgggactgggtttgtcttggggagtggtagtgctgttgatctttcggcactttcttgcacttgcttgggtaccatgatggttgctgcatctgctaactctttgaatcaggtgtttgagatcaataatgatgctaaaatgaagagaacaagtcgcaggccactaccctcaggacgcatcacaatacctcatgcagttggctgggcatcctctgttggattagctggtacggctctactagctacgcagaccaatatgttagctgctgggcttgctgcttccaacctaattctgtatgcatttgtatatacacccttgaagcagattcatcccataaatacatgggtgggagctgttgtcggtgctattccaccacttttgggatgggctgcagcttctaatgatatttcactaaatggaatgattcttccagctgctttgtatttttggcaaataccacattttatggccctagcctatttgtgtcgtgatgactatgctgctggagggtttaagatgtactctcttgctgatgcatctgggcatagaacagcattggtggctttaaggaactctatatatctaatccctttggggttcttggcttatgattggggtttgacttctggatggttttgtcttgagtccgctgcacttacacttgcaataagcgctgcagcattttcattctatagaaaccgtaccaaagaaaaggcaaggagaatgttccatgccagtcttctttacctccctgtgtttatgtctgggcttttgattcaccgtcgttctgaaaacgaacaattcttagaagacaaagcaaagggttttgtgaaatctgcatcctctacggagtcttcagagttggatgatgataacggcgatcaaaatatcaaggccaggcgtccctatcggactgaagcgcgtcctcccgtatcgtatgcctctgttgcaccttttccctttttgcctgctccatcatataacttcccttgatatctgtcagttatacggattttgtatgacttcaacattttctcggccaagttttgtttggttaagttgatatattcattgaaatgatacattctaatttgtctgtttaagccgttaaggttgttttatgtgccacaataaaaattgaagatgcatctgtaatctgaaataaatgagattttgtttcttttaaaaaaaaaaaaaaaaaaaaaaaaaaa

SEQ ID NO: 3054 - protein, 411 aa, Glycine max
MMLRRRGSVTSFYSKFIDSHNLNCGRSSSNPHRVAASATSFDISSASASKATTDFVSLTRHYGRCYWELSKARLSMLVVATSGTGFVLGSGSAVDLSALSCTCLGTMMVAASANSLNQVFEINNDAKMKRTSRRPLPSGRITIPHAVGWASSVGLAGTALLATQTNMLAAGLAASNLILYAFVYTPLKQIHPINTWVGAVVGAIPPLLGWAAASNDISLNGMILPAALYFWQIPHFMALAYLCRDDYAAGGFKMYSLADASGHRTALVALRNSIYLIPLGFLAYDWGLTSGWFCLESAALTLAISAAAFSFYRNRTKEKARRMFHASLLYLPVFMSGLLIHRRSENEQFLEDKAKGFVKSASSTESSELDDDNGDQNIKARRPYRTEARPPVSYASVAPFPFLPAPSYNFP

SEQ ID NO: 3055 - DNA, 1205 bp, Glycine max
  misc_feature (1)..(1205): Ceres cDNA ID no. 21572679
  misc_feature (1)..(1205): Ceres CLONE  ID no. 595977
  misc_feature (1)..(1205): Also known as  Ceres CDNA ID no. 24356269
acttacgccaaatctgagacagaagaaaggaaccatgctctctctgtttcatctttctttcaacataagtacataacataaccctttcttttgttttcttttccattcacaccacttagttagtgtctctttctgtatctaacaatggacgagtttctcttgaaagctgagaaggccaacgccattccaagacacaacaacaacaatattttggccttcgtttccaaagcccttcgcattctcgaactctgcctcgccctcctcctcctctcgtggatcctcacgcgcctccccttcgcgctcgcgctctccgccgagttcctccgccgcctcttcgccttcgccgccagccccctcttcgtcttcgccgtctccaacgccatcatcgccgccctcctcgctcagtcccgccgcctctcgtccccccactccgccgacgcactctaccgcgagttcctccaaacgcgcaccgccgtctccgaacctcacgcgccgccgtcaccgacaccgccggagcccgtgttccacgacaagcagatcatcgccgatatggtgcaggacacgccttccgccgacgccgcggctgccgcgaagtaccgccggagtcagtcggagaagataaaggtagacgctgccggaaagccgccgcgccgaaaacagctcctgcggtcggtgacggcggcgcgtgaggttcggagacggcggtgcgcgtttggaggaactcgcggtagagtgcgtcgtcgtcgatggaggttggagtcgtgccggacgggaacacaatgtcggagacatcgaactgcagctacagcaaggtgcctccggtgacggtgacggtgacggcgcagttctcggcggcggatagggaggcgagagtgttgaggtacagggagaagaggaagaaccgtaagttcgagaagacgattcgttacgcatcgagaaaagcatatgcggaggcgaggccaaggatcaaagggaggtttgcgaaacgcactgacccggaccctctggctggatacggcgtcgttccgtcgtgttgatttcgctatgatgttaatcatatatatcattatatgaatatgaatgatgctgttgtttttgctgtatatacactatgctcttttcttttttgtttgaattatgcaatgtaaagttgcaaaaacacatttgtgatagattttgtagtttgttgaaaaaaaaaaaaaaaa

SEQ ID NO: 3056 - protein, 226 aa, Glycine max
  misc_feature: PFam Name: CCT; PFam Description: CCT motif
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: GI Number: 60459257; NR Description: CONSTANS-like b [Pisum
  misc_feature: GI Number: 61611682; NR Description: CONSTANS-LIKE b [Pisum
  misc_feature: GI Number: 4091804; NR Description: CONSTANS-like protein 1
  misc_feature: GI Number: 22655308; NR Description: CONSTANS-like B-box zinc finger protein [Arabidopsis thaliana] >gi|20198235|gb|AAM15476.1| CONSTANS-like B-box zinc finger protein [Arabidopsis thaliana] >gi|4559372|gb|AAD23033.1| CONSTANS-like B-box zinc finger
  misc_feature: GI Number: 21553854; NR Description: zinc finger protein
MDEFLLKAEKANAIPRHNNNNILAFVSKALRILELCLALLLLSWILTRLPFALALSAEFLRRLFAFAASPLFVFAVSNAIIAALLAQSRRLSSPHSADALYREFLQTRTAVSEPHAPPSPTPPEPVFHDKQIIADMVQDTPSADAAAAAKYRRSQSEKIKVDAAGKPPRRKQLLRSVTAAREVRRRRCAFGGTRGRVRRRRWRLESCRTGTQCRRHRTAATARCLR

SEQ ID NO: 3057 - DNA, 1689 bp, Glycine max
  misc_feature (1)..(1689): Ceres cDNA ID no. 21572680
  misc_feature (1)..(1689): Ceres CLONE  ID no. 597111
  misc_feature (1)..(1689): Also known as  Ceres CDNA ID no. 24356258
gtactgaagaaaacggcgattgagagggagagtttgagaatggtgaagaaggaggagttcttgagagaaaacggcgacaacgaaaaccgttccgtctcgcggagtgacttccctcccaacttcatcttcggagttgccacttctgcatatcagatagaaggtgcttgtaaggagggtggtagaggtcctagcatatgggatgcctttacacacacggaaggaaaaattcttgacaaaagcaatggtgatgttgcagttaatcattatcatcggtacatggaagatattgatcttatagccaagttgggatttgatgcttatagattttcaatttcttggtctcggattttccccgatggcttaggaacgaaaatcaatgacgaagggataactttttataacaacattattaatggtcttcttgaaagaggtatacaaccttatgtaactttgtaccattgggatcttccgctgcatcttcacgagtcgatgggaggatggttaaataaacaaatcatagagtactttgctgtttatgcagatacttgctttgcaagttttggggatagagtgaagaactggattactattaatgagccccttcaaactgcagtcaatgggtatgatgttgcaatttttgctccaggaagacgagaaaattctcttatagagccatatttggcagcacatcatcagattttggcccatgcagcagctgtttccatataccggagcaaatacaaggataagcaagggggacaagtgggctttgtggtagattgtgaatgggcagaggctaattccgataagattgaagataaatctgctgctgcaagacgcctggattttcagcttggctggttcttgcatccactatattatggagactatcctgaagttatgcgtgaaagacttggagatcagcttcccaagttttcagaggaggataagaaaattcttttgaatgctttggactttattggtctaaatcactatacgtcaaggtttatttctcatgtgacagaatgcgccgaagaaaaccattactacaaggtgcaagagatggagagaattgtggaatgggaaggtggccaggccataggtgagaaggcagcatcagagtggctctatgttgttccctggggtctacggaagattctcaattatgtatcacaaaaatatgctactccgatatttgtcacagagaatggtatggatgatgaagataatgataacttgccgttacatgagatgctagatgacaaactgagagttcgctatttcaaaggatatcttgcgtcagttgctcaggctataaaggatggagcagatgtaaggggatactttgcgtggtcattactagacaactttgaatgggctcaaggttatacaaaacgctttggattggtctatgtagattataaaaatgggctcagcaggcaccccaagtcttctgcatattggttttcacggtttctgaaagctggtgaaaacaagaagggtaaagaagagtagcttactttcttcattatgtgtctttccataccagatacaaggaataaaataaagtaagcacagaattccacctttatcagtacttggaagctttgtatgggctataatgccatttctctacatttttctcactatcgaatttcattcccaaattgtgtgaaaaaaaaaaaaaaa

SEQ ID NO: 3058 - protein, 491 aa, Glycine max
  misc_feature: PFam Name: Glyco_hydro_1; PFam Description: Glycosyl
  misc_feature: GI Number: 31580730; NR Description: latex cyanogenic beta
  misc_feature: GI Number: 37202036; NR Description: At5g36890 [Arabidopsis thaliana] >gi|10178206|dbj|BAB11630.1| beta-glucosidase [Arabidopsis thaliana] >gi|51969662|dbj|BAD43523.1| beta-glucosidase -like protein [Arabidopsis thaliana]
  misc_feature: GI Number: 56785274; NR Description: putative latex cyanogenic beta glucosidase [Oryza sativa (japonica cultivar-group)] gi|56784325|dbj|BAD82346.1| putative latex cyanogenic beta glucosidase [Oryza sativa (japonica
  misc_feature: GI Number: 34907636; NR Description: putative beta-glucosidase [Oryza sativa (japonica cultivar-group)] >gi|19386689|dbj|BAB86071.1| putative beta-glucosidase [Oryza sativa (japonica cultivar-group)] >gi|22093598|dbj|BAC06894.1|
  misc_feature: GI Number: 21537259; NR Description: beta-glucosidase,
MVKKEEFLRENGDNENRSVSRSDFPPNFIFGVATSAYQIEGACKEGGRGPSIWDAFTHTEGKILDKSNGDVAVNHYHRYMEDIDLIAKLGFDAYRFSISWSRIFPDGLGTKINDEGITFYNNIINGLLERGIQPYVTLYHWDLPLHLHESMGGWLNKQIIEYFAVYADTCFASFGDRVKNWITINEPLQTAVNGYDVAIFAPGRRENSLIEPYLAAHHQILAHAAAVSIYRSKYKDKQGGQVGFVVDCEWAEANSDKIEDKSAAARRLDFQLGWFLHPLYYGDYPEVMRERLGDQLPKFSEEDKKILLNALDFIGLNHYTSRFISHVTECAEENHYYKVQEMERIVEWEGGQAIGEKAASEWLYVVPWGLRKILNYVSQKYATPIFVTENGMDDEDNDNLPLHEMLDDKLRVRYFKGYLASVAQAIKDGADVRGYFAWSLLDNFEWAQGYTKRFGLVYVDYKNGLSRHPKSSAYWFSRFLKAGENKKGKEE

SEQ ID NO: 3059 - DNA, 1075 bp, Glycine max
  misc_feature (1)..(1075): Ceres cDNA ID no. 21572681
  misc_feature (1)..(1075): Ceres CLONE  ID no. 600159
  misc_feature (1)..(1075): Also known as  Ceres CDNA ID no. 23703618
agcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctgtaatgttgcaagattaatttagtaatttgctcgattcttagatttatgtatctttacggggacttttaatttctcacacattatatgaatatactttcttttacagattgtcaatgagtacaatgaattgcttgctactcaacttgaataaaaaaaaaaaaaaaa

SEQ ID NO: 3060 - protein, 1075 aa, Glycine max
  misc_feature: PFam Name: BRAP2; PFam Description: BRCA1-associated protein 2
  misc_feature: PFam Name: zf-UBP; PFam Description: Zn-finger in
  misc_feature: PFam Name: zf-C3HC4; PFam Description: Zinc finger, C3HC4
  misc_feature: GI Number: 42569332; NR Description: zinc finger (C3HC4-type
  misc_feature: GI Number: 50905721; NR Description: BRAP2-like protein [Oryza sativa (japonica cultivar-group)] >gi|49387526|dbj|BAD25059.1| BRAP2-like protein [Oryza sativa
  misc_feature: GI Number: 42569859; NR Description: zinc finger (ubiquitin-hydrolase) domain-containing protein [Arabidopsis
  misc_feature: GI Number: 42560359; NR Description: IMP protein [Xenopus laevis]
  misc_feature: GI Number: 50414834; NR Description: LOC403394 protein
AGCGAATCCTCCTCCTCGTCCTCCTTCTCCACCTCTCTCTTCAATTTCTCTTCTGGAAACCCGAGAATCGAGGAGACCCGTGGCCTCATGCATCTCTTCCCAGACGACACTCCTTCTACTCTACCCGTTGGACGGAAGCCTCTCGTTTGCGTTGTCGGCGTCCCAAATCACATGACCTATGCGGATTTCTGCCAGTTCTGTGGTTCCTTCATTCAGCACATGCTAGAGATGCGCATAGTCAGGATGGATGGGATGGAGGATCAGTACAGTGTTTTAGTTCGCTTTGACGATCAAGACTCCACCGACAGCTTCTACAAGCACTACAATGGCCGCCGTTTCTCTTCTCTCGAGGTTGAGGTTTGCCGTGTTCTTTTCACATTAGACGTGCAGTACACTGGCTCCATTGAACATGCACAACCCTCCAATGCTACTTCAACTGAACTGCCTACTTGTCCTGTTTGCCTTGATCAGGACACCGGTGGAATTCTTACAACTATATGCAACCATTCTTTCCATTGTTCCTGTATTTCTAAATGGGCAGATTCTTCTTGTCCTGTATGCCGCTATTGCCAGCAGCAAGCTGAAAAATCTATATGTTTTGTTTGTCAAACCACTGAGAACCTATGGATATGTGTTATATGTGGGTATGTTGGCTGTGGAAGATACAAGGGAGGGCATGCTATAATACACTGGAAAGAGACACAGCATTGCTATTCCCTAGAAGTGGAAACAAAACGAGTTTGGGATTATGTGGGAGACAACTATGTTCATAGACTTATTCAGTCCAAAACTGATGGGAAGTTGATTGAGCTGAACACTCAGTGTGCGCATGCAGACAATGGATGTGGAAGTTGCAGCTGTGAAGATAATGCCATGAATGAGGCTATACTTAATAGTAAAGTTGAAGCTGTAATGTTGCAAGATTAATTTAGTAATTTGCTCGATTCTTAGATTTATGTATCTTTACGGGGACTTTTAATTTCTCACACATTATATGAATATACTTTCTTTTACAGATTGTCAATGAGTACAATGAATTGCTTGCTACTCAACTTGAATAAAAAAAAAAAAAAAA

SEQ ID NO: 3061 - DNA, 1719 bp, Triticum aestivum
  misc_feature (1)..(1719): Ceres cDNA ID no. 21572682
  misc_feature (1)..(1719): Ceres CLONE  ID no. 615194
  misc_feature (1)..(1719): Also known as  Ceres CDNA ID no. 24356523
ctccattcccttccggctttcccccacccaacaaccagccccccacctcctcctcctcctcccaccacttctcctccaccctcgccgccggtcacgggatccgacgctctcctcttctacgtcgccggaccggtcgccgagggtgaggcataaccgccggccaagggaggagcgttccggtgctgagctctgccgcccagatctgagctcgggggaaaaagtcaaagtcaggatcttttcttgccgtgcttctcgctccatggatacctcccccgccgccagcgcggcgtcctactggtgctacagctgcgaccgcttcgtgcgcgccgcgtcgtcgccggaggggggcggcgacgtcgcctgcccggactgcggcggcgggttcctcgaggagatgcgccggaccccgccggccccggcctacctccgccgcccgcgcgcgcaccacgccaacgacctgcgcctccgccgcagccgccgggccgccgctgctgctgccgcggccgcctccgctgggggagggggcgaccgcgcgccgttcaacccggtcatcgtgctgcggcgctcggcgctcggcgcgggggcggcagcgggggaagacaacaacggcgacgacgacagcgcgctcgccgcggccagcagcttcgagctcttctacgacgacggggcgggctcgggcctccgcccgctgccggagagcatgtcggacttcctcatggggtccggcttcgagcgcctcctcggccagctcgcgcagatcgaggccggcgggctcacccgggcccgcgagaccccgccggcgtccaaggcggccgtcgagtccatgcccaccgtcgccatcgcggcctcccacgtcgccgccgactgccactgcgccgtctgcaaggagcccttcgagctcggcgccgaggccagggagatgccctgcgcccacatctaccacgaggactgcatcctcccctggctgcagctccgcaactcgtgccccgtctgccgccacgagatgcccaccgacaccgcggcggcaaggtcacaggccgccagcgccggggccgaggaggagaccaccgtgggcctgaccatctggaggctgcccggaggcgggttcgccgtcgggaggttcgccggcgggaggaggcccgaggagagggagctcccggtcgtttacacggagatggacggcggtttcaaccacggcggcgcgccgaggaggatctcgtgggggtcaaggcagagccggtcgaccgagaggagcgccattcgacgcgtcttccgcaatatgtttgcctgcttcggccgcggtcattcggcgagctcccacgcttcgtcctcccacatgaggcccgaggagatgaccgaggcatcggatcattccgccgtgttcagccatggctcgagaagccggagcatgagctggaggctggaagacggccatgccgacacgatggtgcagagatagtcctgaactctgaacccaaagaaaaaaggttgctgattgcttctgttttatgtttttatgtatttatagaagaaagaaaggaaacacgacgatttgtagaacagaattggtgttgtacataggagcagcaatctgctatattagttacaggggagatgtccactgtgattctgaattgagcatttggaacctaggtgataaattgttttgttggtactagcaaacaatgtgtttgatgatttttaaaaaaaaaaaaaaaa

SEQ ID NO: 3062 - protein, 399 aa, Triticum aestivum
  misc_feature: PFam Name: Pyr_redox_2; PFam Description: Pyridine
  misc_feature: PFam Name: zf-C3HC4; PFam Description: Zinc finger, C3HC4
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: GI Number: 50949043; NR Description: putative RING-H2 finger protein [Oryza sativa] >gi|14719329|gb|AAK73147.1| putative RING-H2
  misc_feature: GI Number: 52353630; NR Description: putative ring-H2 finger
  misc_feature: GI Number: 17380612; NR Description: AT5g59550/f2o15_210 [Arabidopsis thaliana] >gi|15450687|gb|AAK96615.1| AT5g59550/f2o15_210 [Arabidopsis thaliana] >gi|18424254|ref|NP_568910.1| zinc finger (C3HC4-type RING
  misc_feature: GI Number: 57899217; NR Description: RING-H2 finger
  misc_feature: GI Number: 34906008; NR Description: putative RING-H2 finger protein RHC2a [Oryza sativa (japonica cultivar-group)] >gi|15289983|dbj|BAB63678.1| putative RING-H2 finger protein RHC2a
MDTSPAASAASYWCYSCDRFVRAASSPEGGGDVACPDCGGGFLEEMRRTPPAPAYLRRPRAHHANDLRLRRSRRAAAAAAAAASAGGGGDRAPFNPVIVLRRSALGAGAAAGEDNNGDDDSALAAASSFELFYDDGAGSGLRPLPESMSDFLMGSGFERLLGQLAQIEAGGLTRARETPPASKAAVESMPTVAIAASHVAADCHCAVCKEPFELGAEAREMPCAHIYHEDCILPWLQLRNSCPVCRHEMPTDTAAARSQAASAGAEEETTVGLTIWRLPGGGFAVGRFAGGRRPEERELPVVYTEMDGGFNHGGAPRRISWGSRQSRSTERSAIRRVFRNMFACFGRGHSASSHASSSHMRPEEMTEASDHSAVFSHGSRSRSMSWRLEDGHADTMVQR

SEQ ID NO: 3063 - DNA, 2250 bp, Triticum aestivum
  misc_feature (1)..(2250): Ceres cDNA ID no. 21572683
  misc_feature (1)..(2250): Ceres CLONE  ID no. 615208
  misc_feature (1)..(2250): Also known as  Ceres CDNA ID no. 23414649
cttttcttctgctccttcccaccgccgcgggcgacatggcgagcagagaccggtgctagggtttgcgccgccgccgccaccaccgcccactccccacccccctcccccacctccgtcgaccccagccactcccgagcccttcctccgtcggaccacatctcagcccaattcctccgccgcggaagcccaggtcgcggcccaagctcgccccgacgcccagtcgccgccgagcttgtctccgaggtactcaaagctcctaagatggcggatgaggaacatgctcaaacctctcggaagagggttgcagataaacaaatcaacaaggacaatcctgagcttgatgatgactcaccggagcaagagggaggaacatttaagaaagctagtgaggaagtgatggcaacccgaaaaattgtgaaggttcggcgccagcagccgtcgtcagctccttcttctaatcctttctctgcaattaagtttaccacaagtgattccagtgttcaagcaagtattcctgtctcaaaacctccaccgtctgatgtcacaacgtcaaatgtaaggggctcaattgagaaagctgatgaggccagcaatggaagtgggaaagatgttgacaagaatgcagattctaatgaggtagcagagattcaaaaggatgaatcgggcctgaatgagtcaaatgcagaaaacaagtcgaatgcgccaatggaagcacactcttcgcttactgaaactgataacaaggcaggcagcacggaggttggaactggtgaggataaagtgctggttggagaacccaaggtagatagcagcaagacatctggaatcgagggtaaaacagaagatgaagctgctaaagtgaatgaaggtggagatgaagataaaagcagcaaggacggcgctgagaagaaagatgaatctgaatcagggaccaaggatgaagtgaatgaaggtggagatgaagataaaagcagcaaggacggtgctgagaagaaagatgaatctgaatcagggaccaaggatgtatcaccaacacctctgttctcttttatgaatgtgtcaagtggtcataacgccttcacaggactggctggaactgggttttcagcctcgtcattttcctttggctcagcttctaaagaaagcacaaatgctcccctatttgggctaaagaacgacagcgcatccttcccttctttcaatatcggtggtacgaacaacaacgggagttctgttccatcgcttgtcgctgcagcagaagcaccaaagaaattcatcatgccagagggcccagtggagacaggcgaagagaacgagatggccgtgttcaccgcggactctgcaatgtacgagtacctcgacgggggctggaaagaaagaggaaaaggggagctaaagctgaacatcccagtgtccggcggcgagaggtcccggctcgtcatgagggccaagggcaactaccggctggtcctgaacgcgagcctgtacgatgacatgtcgctgaaggacatggagaagaagggcgtgacgttcgcctgcatcaacagcaccggcgactcgccgggcaggctcaccacgttcgccctcaagttcaaggacactggcgtcagggatgatttcaaagccgcggtggaggcgcacaaggcgaagaaggcctcggacgcgatgcccaagacgcctgagagctcccccaaggtgtctgatgactgaaagagaccgccctggttgcgtgtttcgatgatgtgtatgcgggtttggaggggggagaggggctggctgaagttgtcctcgttcattcggagtctaaagtgcaccattttctgtattctgtatccccatgtcgtgatgccttaagatacattttgcatgcacgcggttacttggtttcctgctgccgttttggaacggtgggtggtctgttgaacatttaattgttgagtcacaattttagcttaactggagagacgagggagaaaggcgaagagaacgagatggccgtgttcaccgcggactctgcaatgtacgagtacctcgacgggggctggaaagaaagaggaaaaggggagctatattcagtaatcagtaatgtctggaaatgagtcattcgtcagtggtgtatgcgttgagctctgtgtattgcagcaggtttcttgcccgataaatgtccgttcatttcctcacatatcccttttgtagaagactagcgaaagggctataaaaatcataattttcagaaaaaaaaaaaaaaaa

SEQ ID NO: 3064 - protein, 482 aa, Triticum aestivum
  misc_feature: PFam Name: Ran_BP1; PFam Description: RanBP1 domain
  misc_feature: PFam Name: S-antigen; PFam Description: S-antigen protein
  misc_feature: PFam Name: Extensin_2; PFam Description: Extensin-like region
  misc_feature: PFam Name: DMP1; PFam Description: Dentin matrix protein 1 (DMP1)
  misc_feature: GI Number: 21536684; NR Description: unknown [Arabidopsis thaliana]
  misc_feature: GI Number: 45655754; NR Description: lipoprotein [Leptospira interrogans serovar Copenhageni str. Fiocruz L1-130] >gi|45602725|gb|AAS72200.1| lipoprotein [Leptospira interrogans
  misc_feature: GI Number: 66853052; NR Description: brefeldin A resistance
  misc_feature: GI Number: 6322945; NR Description: Suppressor of mutant AC40 subunit of RNA polymerase I and III; nucleolar protein that is immunologically and structurally related to rat Nopp140, a nonribosomal protein of the nucleolus and coiled bodies.; Srp40p
  misc_feature: GI Number: 295671; NR Description: selected as a weak suppressor of a mutant of the subunit AC40 of DNA dependant RNA
MADEEHAQTSRKRVADKQINKDNPELDDDSPEQEGGTFKKASEEVMATRKIVKVRRQQPSSAPSSNPFSAIKFTTSDSSVQASIPVSKPPPSDVTTSNVRGSIEKADEASNGSGKDVDKNADSNEVAEIQKDESGLNESNAENKSNAPMEAHSSLTETDNKAGSTEVGTGEDKVLVGEPKVDSSKTSGIEGKTEDEAAKVNEGGDEDKSSKDGAEKKDESESGTKDEVNEGGDEDKSSKDGAEKKDESESGTKDVSPTPLFSFMNVSSGHNAFTGLAGTGFSASSFSFGSASKESTNAPLFGLKNDSASFPSFNIGGTNNNGSSVPSLVAAAEAPKKFIMPEGPVETGEENEMAVFTADSAMYEYLDGGWKERGKGELKLNIPVSGGERSRLVMRAKGNYRLVLNASLYDDMSLKDMEKKGVTFACINSTGDSPGRLTTFALKFKDTGVRDDFKAAVEAHKAKKASDAMPKTPESSPKVSDD

SEQ ID NO: 3065 - DNA, 828 bp, Triticum aestivum
  misc_feature (1)..(828): Ceres cDNA ID no. 21572684
  misc_feature (1)..(828): Ceres CLONE  ID no. 615383
  misc_feature (1)..(828): Also known as  Ceres CDNA ID no. 23719353
gaatctagccagccagccagccacaaccaatcccaatccaagaagcagagggaggagctttggcagagtgagagagaagcagaggacgatgggcacgccggtgggaatggcgactctagcggctctggcgctggtgctgtgcgtctccatggacgggtgcgccgccgctgagtacaaggtgggcggtctggacgcgtggggggtgccgccgtccaccaagccggacgtgtacgtgcggtgggccaagtccgtccccgtcaagctcggcgacgccctcttcttcctctacccgcccagccaggacagcgccgtgcaggtcactgccaaggccttcgccgcctgcgacgtgtccgacccgctgctcaagctggaggacggcaactccgtcttcaacctcaccaagcccgggcgggcctacttcagcagcgccgccccggggcgctgccgcaagggccagaagctgtcggtggacgtgcctggagccgatgggaagctgctcaagccgtcggcggacgacgaggccgcgctcaaggcgctctctgcgctgccgcctgccgctgccccgtccgaggcgctcccctcgctctcgcccggccccgacgacgacgacgactccgctgcctcctccatggtcgccggatccgtcctaggtctcgcggccgctttcatcctcctgtggctgtgatgtgatgtgagatgctcttcttcttcttcctcccatccatttcaatttcattttttttgtcagatgagaaacatgaatttatttgtttggattggattatataagaagtataattgattgattgattaaaaaaaaaaaaaaaa

SEQ ID NO: 3066 - protein, 198 aa, Triticum aestivum
  misc_feature: PFam Name: Cu_bind_like; PFam Description: Plastocyanin-like
  misc_feature: GI Number: 46359847; NR Description: At1g64640 [Arabidopsis thaliana] >gi|45773786|gb|AAS76697.1| At1g64640 [Arabidopsis thaliana] >gi|42562941|ref|NP_176645.3| plastocyanin-like
  misc_feature: GI Number: 34146796; NR Description: At2g25060 [Arabidopsis thaliana] >gi|4559346|gb|AAD23007.1| similar to early nodulins [Arabidopsis thaliana] >gi|34395732|sp|Q9SK27|ENL1_ARATH Early nodulin-like protein 1 precursor (Phytocyanin-like protein)
  misc_feature: GI Number: 51971833; NR Description: early nodulin-like 1 predicted GPI-anchored protein [Arabidopsis thaliana] >gi|51969612|dbj|BAD43498.1| early nodulin-like 1 predicted GPI-anchored protein [Arabidopsis thaliana]
  misc_feature: GI Number: 2760838; NR Description: putative phytocyanin [Arabidopsis thaliana] >gi|25407844|pir||A84664 probable phytocyanin [imported] - Arabidopsis thaliana >gi|15225779|ref|NP_180240.1| plastocyanin-like domain-containing
  misc_feature: GI Number: 2493319; NR Description: MAVICYANIN >gi|7430870|pir||S72218 mavicyanin - zucchini >gi|1836088|gb|AAB46871.1| mavicyanin=12.752 kda small blue copper-containing stellacyanin-like glycoprotein/type I
MGTPVGMATLAALALVLCVSMDGCAAAEYKVGGLDAWGVPPSTKPDVYVRWAKSVPVKLGDALFFLYPPSQDSAVQVTAKAFAACDVSDPLLKLEDGNSVFNLTKPGRAYFSSAAPGRCRKGQKLSVDVPGADGKLLKPSADDEAALKALSALPPAAAPSEALPSLSPGPDDDDDSAASSMVAGSVLGLAAAFILLWL

SEQ ID NO: 3067 - DNA, 1688 bp, Triticum aestivum
  misc_feature (1)..(1688): Ceres cDNA ID no. 21572685
  misc_feature (1)..(1688): Ceres CLONE  ID no. 615987
  misc_feature (1)..(1688): Also known as  Ceres CDNA ID no. 23414336
aaaaaacagggtaatcccacctcgcctcggcgctccccaagccccgcagcatcgcgtacgagtgcgtataccgtatgtatctacagtgaggcggcgcggggcaagggtttcgtctccggcggcggcgacggcggcggcggcggcggaggaggctagatctgggagggatggggaacagaataggagggaggaggaaggccggggtggaggagcggtacacgaggccgcaggggctgtacgagcacagggatatcgaccagaagaagctacgcaagttgatcctcgaggccaagctcgcgccctgctacccgggggctgacgacgccgcggggggtgacctggaggagtgccccatctgcttcctgtactacccaagccttaaccgatcaaaatgttgctcgaaagggatatgtacagagtgctttcttcaaatgaaaccaactcatactgctcgacctacacaatgcccattctgcaaaacccccaactatgctgtggagtatcgtggtgtaaagacaaaggaggaaaggagcatagagcaatttgaagaacagaaagtcattgaagcacagatgagggtgcggcagcaagcacttcaagacgaagaggataagatgaaaagaaaacagagtaggtgctcttctagcagaacaatcgctccaacaacagaagtggagtatcgagatatttgcagcacatcctattcagtgccatcgtaccaatgtacccagcaagaaactgaatgttgttcgtctgagccttcatgttctgctcaggctaacatgcggtctttccattctaggcatactcgtgatgataacatagacatgaacatagaggacatgatggttatggaagcgatttggcgttcaattcagcaggagcaaggaagtataggaaatccttcttgtgggagctttatgccttttgagcaaccaacgcgtgagaggcaggcattcgttgcagctcctcctctagaaatgccccatcctggtggattttcttgtgctgttgctgctatggctgagcaccagccatcaagcatggatttctcttacatgactggtagtagtgcgttcccagtctttgacatgttccgccgaccgtgcaacattgctggtggaagcatgggtgctgcggaaagttcaccagatagctggagcgggatagcgccaagttgcagcagaagggaagtggtaagagaggaaggagagtgctcaaccgaccacttgtcagagggtgcagaggccgggacaagctatgccggctcggacattgtggtggatgcggggacaatgctaccgttgccttttgctgacaattacagtatggttgcaagccatttccgtcctgagagcatcgaagaacaaatgatgtattccatggctgtttctttagcagaagctcatggtagaacgcacacgcaagggttggcatggttgtaacgcgatgattgtgacgtttactgccttctctcccgcactatcgttgttctgccccccttctgctcttttttgccaccccgtgttcggccgttttgtttctcctttttgcatgtgttgcatcatggtttgatatagttcccgctatagctctccattattgcttatatgttgtaaaatggaatatgaggaagaaatagaaaagagaatgagtcagtgttcttgatgccaaaaaaaaaaaaaaaa

SEQ ID NO: 3068 - protein, 425 aa, Triticum aestivum
  misc_feature: GI Number: 8052547; NR Description: F3F9.7 [Arabidopsis thaliana]
MGNRIGGRRKAGVEERYTRPQGLYEHRDIDQKKLRKLILEAKLAPCYPGADDAAGGDLEECPICFLYYPSLNRSKCCSKGICTECFLQMKPTHTARPTQCPFCKTPNYAVEYRGVKTKEERSIEQFEEQKVIEAQMRVRQQALQDEEDKMKRKQSRCSSSRTIAPTTEVEYRDICSTSYSVPSYQCTQQETECCSSEPSCSAQANMRSFHSRHTRDDNIDMNIEDMMVMEAIWRSIQQEQGSIGNPSCGSFMPFEQPTRERQAFVAAPPLEMPHPGGFSCAVAAMAEHQPSSMDFSYMTGSSAFPVFDMFRRPCNIAGGSMGAAESSPDSWSGIAPSCSRREVVREEGECSTDHLSEGAEAGTSYAGSDIVVDAGTMLPLPFADNYSMVASHFRPESIEEQMMYSMAVSLAEAHGRTHTQGLAWL

SEQ ID NO: 3069 - DNA, 1844 bp, Triticum aestivum
  misc_feature (1)..(1844): Ceres cDNA ID no. 21572686
  misc_feature (1)..(1844): Ceres CLONE  ID no. 616565
  misc_feature (1)..(1844): Also known as  Ceres CDNA ID no. 24356503
aatccgcgttaaattcgtgaactcttcttccgtgcagcgtgcgtgcgtgtgtgtggcctcaaagctcagctcggctggtgctagcttgcttcgaacgttcgtgaactcttcttgcgtgcgtgcgtggtcgtgtggctgagagctttgctctggtgcttcgatcatggcgggcgtggccgtggcgccggtgctgctgcttctgctgctcgccgtcgcggggcttccggcggccggggggctcggggtgaactggggaacgatggcgtcgcaccagctgccgcccagcaccgtggtgcggatgctgcaggacaatggcatcaagaaggtgaagctgttcgacgcggacgctgagccgctgggcgcgctcgccggctccggcatcgaggtcatggtggccatccccaacaagatgctcgacatgatgaccgactacgacaccgccagggagtgggtgcacaagaacgtcagcgcctacaacttcggcggcggcgtcaacatccgatatgttgccgtcgggaatgagccgtttctgtcgtccctgaatggcacgttcctgaatgtcacgttgccggccctacagaacatccagaaggccctcgacgaggccggcgtcggcgacaccgtcaaggccaccgtaccgctgaacgccgacgtgtaccaatcccccaaggacaacccggtgccgtcggccgggcggtttcggccggagatctccggcctcatgacggagatcgtgcagttcctcaaccagagcggcgcgcccttcacggtcaacatctacccatacctgagcctctacggcaacgacgacttcccgctggacttcgccttcttcgacggcgccagctcccccgtggtcgacggcaacatccagtacaccaacgtgttcgacgccaacttcgacacgctcgtgtcggcgctcacggcggccggcgtaggcggcctgccggtgatcgtcggcgaggttggctggccgaccgacggtgaaaagcacgccacggccgcctacgcgcagcgcttctacacgggcctgtttcggaagctggcgagcaacgccggcacgccgctgcggcccaaccagtacatcgagatctacctcttcagcctcatcgacgaggacgtcaagagcgtggatccgggctacttcgagcggcactggggcgtgatgcgctatgacggccagcccaagtacgccatggacccgaccgggcagggccggaacacggcgctggtgggggcccggggcgtggagtacctcccgcgggtgtggtgcgtgctcaacgccaacgcggggaacatgagcaggctcgcggacaacgtgggctacgcgtgctccaacgccgactgcacctcgctcagcctcgggtcgacgtgcaacggcatggaccccgcggggaacgcctcctacgccttcaacgcctacttccaggtgcaggaccaggacgagcaggcgtgcggcttcgacgggctcgccgtgcgcacgcggcaggacccctccacgggcacctgcaacttcaccatacagctcgagaccacctccgcggcggcggggcggccgacagttctcttgacgacggccctgctggccttggttcttgcggccatggtgaccatgctctgagcgcgaatctgattgctatatatggcggtgctagttagtagtgattggagcagttaattaactatacaaggaaggagctagctagatgttacacacttgtagttgtagatattcttttggtttgtatacgcgatacgccactgtagtatgtatgtatgatcacaggggcccatggacctcggattccaagggtttatttagatgtataaaaaaaaaaaaaaaa

SEQ ID NO: 3070 - protein, 485 aa, Triticum aestivum
  misc_feature: PFam Name: Glyco_hydro_17; PFam Description: Glycosyl
  misc_feature: PFam Name: X8; PFam Description: X8 domain
  misc_feature: GI Number: 18483232; NR Description: 3-glucanase [Sorghum bicolor]
  misc_feature: GI Number: 37223500; NR Description: beta-1,3-glucanase,
  misc_feature: GI Number: 48374979; NR Description: putative 3-glucanase
  misc_feature: GI Number: 50919115; NR Description: putative beta-1,3 glucanase [Oryza sativa (japonica cultivar-group)] >gi|28269434|gb|AAO37977.1| putative beta-1,3 glucanase [Oryza
  misc_feature: GI Number: 50942473; NR Description: putative 3-glucanase [Oryza sativa (japonica cultivar-group)] >gi|30060382|dbj|BAC75843.1| putative 3-glucanase [Oryza sativa (japonica cultivar-group)] >gi|38637171|dbj|BAD03423.1| putative
MAGVAVAPVLLLLLLAVAGLPAAGGLGVNWGTMASHQLPPSTVVRMLQDNGIKKVKLFDADAEPLGALAGSGIEVMVAIPNKMLDMMTDYDTAREWVHKNVSAYNFGGGVNIRYVAVGNEPFLSSLNGTFLNVTLPALQNIQKALDEAGVGDTVKATVPLNADVYQSPKDNPVPSAGRFRPEISGLMTEIVQFLNQSGAPFTVNIYPYLSLYGNDDFPLDFAFFDGASSPVVDGNIQYTNVFDANFDTLVSALTAAGVGGLPVIVGEVGWPTDGEKHATAAYAQRFYTGLFRKLASNAGTPLRPNQYIEIYLFSLIDEDVKSVDPGYFERHWGVMRYDGQPKYAMDPTGQGRNTALVGARGVEYLPRVWCVLNANAGNMSRLADNVGYACSNADCTSLSLGSTCNGMDPAGNASYAFNAYFQVQDQDEQACGFDGLAVRTRQDPSTGTCNFTIQLETTSAAAGRPTVLLTTALLALVLAAMVTML

SEQ ID NO: 3071 - DNA, 1412 bp, Triticum aestivum
  misc_feature (1)..(1412): Ceres cDNA ID no. 21572687
  misc_feature (1)..(1412): Ceres CLONE  ID no. 616750
  misc_feature (1)..(1412): Also known as  Ceres CDNA ID no. 0
tttttacagccatttcctaatcccaccactccaagacgccaagaggggcatcacgatccgtccaaacccgacctcccccggagaaatcccctcccgtcaaaatcctccaatagacgagatgctccgcgctagcgccgcctctcccgcgctcccaccctgtcggtctcggtccgcagagccatgctcctgtcgccgccaaccccgtggccgcgcgtcaagcccgtgcgcttgaatcgtctcccgcagtgcaaagaccggctcctctcgcttccccgcggccggcggccgagggcgccgcggcggctcggcgtgtgcatggccgagatggcctgggtcgggagcgagtcgccccgagagcttggggtttctgacggggagggggacacgatgctgggaggcgacaagttgcccggtccgagggcggaggcggcggccatccggtggacgcccgtcgaggcggcgctgaatcgcatgagtaaatggctggtggctgtttcttttgctcttgcagctctttggaagcgtgatgctgaaattatgtgggctttgatgggtgcggttgcgaacactgtgctttcgtccattcttaaaaagctgctcaaccacgaaaggccggcaccggctttgcggtctgatcctgggatgccatcatcccatgcccaatccattttctatgctgcaacatttctagttctttcagtgttctcctggcttgggacaaattatctggcaatgattcttggggctacaactgtagcattggcctcctatctatcatggctacgggtgtcgcagcgtctccacacactgaaccagattctcgtgggcgctgctgtaggatcagccttcagcgctctgtggttcgcgctctggcatttgctcgtgcgggaagcttttgcttcctcgttgtgggtccaaattccagtcgtccttggttcagtagtgttctctgtttccttcgtcgtctacatcattcagcactggctcaaggatgagtaatgatatagatagcacgcaacaggttaatggacagtgaaaccaatcggccagagaaggttttatccgcactctctgggaattacacgcagaaaggagctcgcacaatggttcactaaacagaacagacagcagttttgatttactactgtatatcattgatccgtgtaacatatatcagacgattggtgcttgcttgcttggcttgttcattcatgcttcatttttctcggatgctgttgatgctgatgcaattctggatgtaacacggcaatatgcagctgatgctgatgcaattctggatgtaacacagtcatatgcagttgttgctgatgcaattctggatgtaacacagtgaatcattcagtatcatcgtcgtgtgcaataggagatcttttgacaaaaaaaaaaaaaaa

SEQ ID NO: 3072 - protein, 1412 aa, Triticum aestivum
TTTTTACAGCCATTTCCTAATCCCACCACTCCAAGACGCCAAGAGGGGCATCACGATCCGTCCAAACCCGACCTCCCCCGGAGAAATCCCCTCCCGTCAAAATCCTCCAATAGACGAGATGCTCCGCGCTAGCGCCGCCTCTCCCGCGCTCCCACCCTGTCGGTCTCGGTCCGCAGAGCCATGCTCCTGTCGCCGCCAACCCCGTGGCCGCGCGTCAAGCCCGTGCGCTTGAATCGTCTCCCGCAGTGCAAAGACCGGCTCCTCTCGCTTCCCCGCGGCCGGCGGCCGAGGGCGCCGCGGCGGCTCGGCGTGTGCATGGCCGAGATGGCCTGGGTCGGGAGCGAGTCGCCCCGAGAGCTTGGGGTTTCTGACGGGGAGGGGGACACGATGCTGGGAGGCGACAAGTTGCCCGGTCCGAGGGCGGAGGCGGCGGCCATCCGGTGGACGCCCGTCGAGGCGGCGCTGAATCGCATGAGTAAATGGCTGGTGGCTGTTTCTTTTGCTCTTGCAGCTCTTTGGAAGCGTGATGCTGAAATTATGTGGGCTTTGATGGGTGCGGTTGCGAACACTGTGCTTTCGTCCATTCTTAAAAAGCTGCTCAACCACGAAAGGCCGGCACCGGCTTTGCGGTCTGATCCTGGGATGCCATCATCCCATGCCCAATCCATTTTCTATGCTGCAACATTTCTAGTTCTTTCAGTGTTCTCCTGGCTTGGGACAAATTATCTGGCAATGATTCTTGGGGCTACAACTGTAGCATTGGCCTCCTATCTATCATGGCTACGGGTGTCGCAGCGTCTCCACACACTGAACCAGATTCTCGTGGGCGCTGCTGTAGGATCAGCCTTCAGCGCTCTGTGGTTCGCGCTCTGGCATTTGCTCGTGCGGGAAGCTTTTGCTTCCTCGTTGTGGGTCCAAATTCCAGTCGTCCTTGGTTCAGTAGTGTTCTCTGTTTCCTTCGTCGTCTACATCATTCAGCACTGGCTCAAGGATGAGTAATGATATAGATAGCACGCAACAGGTTAATGGACAGTGAAACCAATCGGCCAGAGAAGGTTTTATCCGCACTCTCTGGGAATTACACGCAGAAAGGAGCTCGCACAATGGTTCACTAAACAGAACAGACAGCAGTTTTGATTTACTACTGTATATCATTGATCCGTGTAACATATATCAGACGATTGGTGCTTGCTTGCTTGGCTTGTTCATTCATGCTTCATTTTTCTCGGATGCTGTTGATGCTGATGCAATTCTGGATGTAACACGGCAATATGCAGCTGATGCTGATGCAATTCTGGATGTAACACAGTCATATGCAGTTGTTGCTGATGCAATTCTGGATGTAACACAGTGAATCATTCAGTATCATCGTCGTGTGCAATAGGAGATCTTTTGACAAAAAAAAAAAAAAA

SEQ ID NO: 3073 - DNA, 1937 bp, Triticum aestivum
  misc_feature (1)..(1937): Ceres cDNA ID no. 21572688
  misc_feature (1)..(1937): Ceres CLONE  ID no. 617338
  misc_feature (1)..(1937): Also known as  Ceres CDNA ID no. 0
ccggtccagcgctggtacggcggcgttcaacttcgttcccaagccaaatcccccaaccaaaacccagagcgagcccgcggcggcgagcaccaccaccaccaccagatggaccccgcggcggagatggatgccggcgagccggacgccctgctccgcgcggcggccgacttcgcctcctacccagggacgcatggcgaggacacagtgaggcagttcctggaacagttccctctgcctaagctgctaggtgtattgcagagccaggcagacgtacctgagacggttgaaactgttgcagcgtgcttggacaaagtattttcatctagatatggagcatcgcttctaccaagctatggtgaatttattcaagctgggttgctcacaaactcgaatagtatcagacaattggcctgcaaatcggtggtacatcttcttgacaaggctggagatattgctgttgccgtggacacatttgtacagcacaatctgtaccctcttctgatcaactgcttgattgagggagacgaagagatctcagcaattgttttggatgccataaagcgtctagcagaaattcctacagggaccgatatcatatttccaccagatggtcaaggattgcaactcaacaaagtggcagcccagtcatcctcaatggcacagattcgcattctatccttgatagctaagctctttggtgcatcaagttgtactgctactgcaattcgtgactcaaaccttctcagcttatttgaggacgagataaaggatagaaaagatatgcttaagaccctgagtgcactagaagtcctctatgagcttgaggagcaccctcacagcaatatgttcttgttaaagaccagtttgcttcaacacataactgatgtgatcaacgatccctcaactgattctattgtacggtcaagggcatcattgatcagtgggaggcttctttcttcagctgatgcttttatgactatagaaaaatcttgtgttacgaatctgctcttggccatagacaaaatattgaggacggaggaaggtcaaaatactgatgaaattgagagcgcattggagaccttaggactaattggtacaacaactcaaggatcatgcttgttgctctctgatccaacaaatattgccagacatgtggtagaaatgtcctttgataggcagggcagaggtaaacagctggccgctttacatgcctttggaagcatatgtggtgttgatcgacaagaagaccagatgaaactggatgatcatcaagcagaagagtgcctgaagcgcttagtctacagtgcagcatcaaacagtccaaaattaactccttcagctcttcttctatcaattctacaacaagatccaggcgttcggattgctggttatagagtactgtcaggactggttgtccgagaatggtgcctaagggaagtttgctcaaagccagagataattggaattgttacggatccaaaaatggagacaacaaaacttggcatggaggcacggtatgcttgctgtgtggcaatcaacaaagccttgtcatcgtcgcaccttcttcatgaaccgagcctttctgaactcattggaaagctgaacgaggcggtcagaaggggtccatatctttccgagaagaggcagcgtgtggaggcacagccggtggtcggtaccatggagaggttttaaggtggcctttcgagctcttcggcccagaaaccaagcaccctctgtgcttgatgcatgtacattagatgcaactgtgtatgttcttacctgaacttgtgtgacaaggatgatgatatcagagcttcagttctgttcggttttgtgatacaaaatcggtggatgctgcttcatgccattccatcttacaattacagttaccagtaaaagttaagcggacgacatcttcagcaaaaaaaaaaaaaaaa

SEQ ID NO: 3074 - protein, 1937 aa, Triticum aestivum
CCGGTCCAGCGCTGGTACGGCGGCGTTCAACTTCGTTCCCAAGCCAAATCCCCCAACCAAAACCCAGAGCGAGCCCGCGGCGGCGAGCACCACCACCACCACCAGATGGACCCCGCGGCGGAGATGGATGCCGGCGAGCCGGACGCCCTGCTCCGCGCGGCGGCCGACTTCGCCTCCTACCCAGGGACGCATGGCGAGGACACAGTGAGGCAGTTCCTGGAACAGTTCCCTCTGCCTAAGCTGCTAGGTGTATTGCAGAGCCAGGCAGACGTACCTGAGACGGTTGAAACTGTTGCAGCGTGCTTGGACAAAGTATTTTCATCTAGATATGGAGCATCGCTTCTACCAAGCTATGGTGAATTTATTCAAGCTGGGTTGCTCACAAACTCGAATAGTATCAGACAATTGGCCTGCAAATCGGTGGTACATCTTCTTGACAAGGCTGGAGATATTGCTGTTGCCGTGGACACATTTGTACAGCACAATCTGTACCCTCTTCTGATCAACTGCTTGATTGAGGGAGACGAAGAGATCTCAGCAATTGTTTTGGATGCCATAAAGCGTCTAGCAGAAATTCCTACAGGGACCGATATCATATTTCCACCAGATGGTCAAGGATTGCAACTCAACAAAGTGGCAGCCCAGTCATCCTCAATGGCACAGATTCGCATTCTATCCTTGATAGCTAAGCTCTTTGGTGCATCAAGTTGTACTGCTACTGCAATTCGTGACTCAAACCTTCTCAGCTTATTTGAGGACGAGATAAAGGATAGAAAAGATATGCTTAAGACCCTGAGTGCACTAGAAGTCCTCTATGAGCTTGAGGAGCACCCTCACAGCAATATGTTCTTGTTAAAGACCAGTTTGCTTCAACACATAACTGATGTGATCAACGATCCCTCAACTGATTCTATTGTACGGTCAAGGGCATCATTGATCAGTGGGAGGCTTCTTTCTTCAGCTGATGCTTTTATGACTATAGAAAAATCTTGTGTTACGAATCTGCTCTTGGCCATAGACAAAATATTGAGGACGGAGGAAGGTCAAAATACTGATGAAATTGAGAGCGCATTGGAGACCTTAGGACTAATTGGTACAACAACTCAAGGATCATGCTTGTTGCTCTCTGATCCAACAAATATTGCCAGACATGTGGTAGAAATGTCCTTTGATAGGCAGGGCAGAGGTAAACAGCTGGCCGCTTTACATGCCTTTGGAAGCATATGTGGTGTTGATCGACAAGAAGACCAGATGAAACTGGATGATCATCAAGCAGAAGAGTGCCTGAAGCGCTTAGTCTACAGTGCAGCATCAAACAGTCCAAAATTAACTCCTTCAGCTCTTCTTCTATCAATTCTACAACAAGATCCAGGCGTTCGGATTGCTGGTTATAGAGTACTGTCAGGACTGGTTGTCCGAGAATGGTGCCTAAGGGAAGTTTGCTCAAAGCCAGAGATAATTGGAATTGTTACGGATCCAAAAATGGAGACAACAAAACTTGGCATGGAGGCACGGTATGCTTGCTGTGTGGCAATCAACAAAGCCTTGTCATCGTCGCACCTTCTTCATGAACCGAGCCTTTCTGAACTCATTGGAAAGCTGAACGAGGCGGTCAGAAGGGGTCCATATCTTTCCGAGAAGAGGCAGCGTGTGGAGGCACAGCCGGTGGTCGGTACCATGGAGAGGTTTTAAGGTGGCCTTTCGAGCTCTTCGGCCCAGAAACCAAGCACCCTCTGTGCTTGATGCATGTACATTAGATGCAACTGTGTATGTTCTTACCTGAACTTGTGTGACAAGGATGATGATATCAGAGCTTCAGTTCTGTTCGGTTTTGTGATACAAAATCGGTGGATGCTGCTTCATGCCATTCCATCTTACAATTACAGTTACCAGTAAAAGTTAAGCGGACGACATCTTCAGCAAAAAAAAAAAAAAAA

SEQ ID NO: 3075 - DNA, 1445 bp, Glycine max
  misc_feature (1)..(1445): Ceres cDNA ID no. 21572689
  misc_feature (1)..(1445): Ceres CLONE  ID no. 621002
  misc_feature (1)..(1445): Also known as  Ceres CDNA ID no. 24356230
aactttcactggtgtcgtctggtctccatgcaccttctcaaatttcctcgctctccatcttccttcgggaatgcgttctttctggtgggtcatcatgttttggacataagagtgttccgtaagaaccagagatgtttcagagcgtccatatcgtgttcggctgttaggaacggttctattgagcaactaagtgatgcacggcttatatactccgtcgctccatctatgggccacaaccaggagtctcatccagaatcacattttagagttcccgcgattgtcaatgctctagaagaaatgcagctcacttccaagttccgtggcccagaggtaattgaacttcaacattttgagcctgcttcagttgatgatattgcaagtgtgcatgcaagagcctatgtttctgggcttgaaaaggttatggatcaagctgtggagaaaggccttattttccttgatggttcaggaccaacatatgccactgccactaccttccaggagtcaatagttgcagccggtgctggattagccttagttgactcagtggttgcatgttcaaagataaagggagatgcacccactggttttgctctgataagaccaccaggacatcacgcagttccacaaggacctatgggattctgcatttttggaaatgtggccattgcagcccgttattctcagcgtgttcatggattgaagcgtgtgtttataattgactttgatgttcatcatgggaatggaacaaatgatgctttctatgatgatccagatgtatttttcctttcatttcaccaagatggaagctatcccggtactggtaaatttgatgaagttggaagtggagatggtgaaggaaccacattaaatctgcctcttcctggaggttcaggtgatactgctattagaactgtgttcgatgaagtcattgtaccatgtgctcaaagatttaaaccagacatcattcttgtttctgctgggtatgacggccacgtgttggatccactagctaatcttcaatatacaactggaacatattacatgctagcgtccagtatcaaacaactagcgaaagatttatgtgggggccgatgtgtgtttttcttggagggaggatataatctgaagtctctttcatattccgtggcagacacattccgtgctcttcttggggaccgaagcttggcatctgagtttgataaccctaacattttgtacgaagagccatctacaaaagttaagcaagctattcagaagataaaacacattcattccctgtgaggtcaaaatagaaactgacatgacaagcatctaaatgtctagcattaataatttccttttctgtgggttcaatctataagtacatgtctttacactcttgggtgggcattctcccacttatcacatagaagcaaaaccattgtacaggaaaaaaaaaaaaaaaa

SEQ ID NO: 3076 - protein, 417 aa, Glycine max
  misc_feature: PFam Name: Hist_deacetyl; PFam Description: Histone
  misc_feature: GI Number: 21360523; NR Description: AT4g33470/F17M5_230 [Arabidopsis thaliana] >gi|15529220|gb|AAK97704.1| AT4g33470/F17M5_230 [Arabidopsis thaliana] >gi|18418220|ref|NP_567921.1| histone deacetylase family protein
  misc_feature: GI Number: 52548847; NR Description: acetoin utilization
  misc_feature: GI Number: 52352410; NR Description: acetoin utilization
  misc_feature: GI Number: 52550445; NR Description: acetoin utilization
  misc_feature: GI Number: 52549274; NR Description: acetoin utilization
MHLLKFPRSPSSFGNAFFLVGHHVLDIRVFRKNQRCFRASISCSAVRNGSIEQLSDARLIYSVAPSMGHNQESHPESHFRVPAIVNALEEMQLTSKFRGPEVIELQHFEPASVDDIASVHARAYVSGLEKVMDQAVEKGLIFLDGSGPTYATATTFQESIVAAGAGLALVDSVVACSKIKGDAPTGFALIRPPGHHAVPQGPMGFCIFGNVAIAARYSQRVHGLKRVFIIDFDVHHGNGTNDAFYDDPDVFFLSFHQDGSYPGTGKFDEVGSGDGEGTTLNLPLPGGSGDTAIRTVFDEVIVPCAQRFKPDIILVSAGYDGHVLDPLANLQYTTGTYYMLASSIKQLAKDLCGGRCVFFLEGGYNLKSLSYSVADTFRALLGDRSLASEFDNPNILYEEPSTKVKQAIQKIKHIHSL

SEQ ID NO: 3077 - DNA, 1538 bp, Glycine max
  misc_feature (1)..(1538): Ceres cDNA ID no. 21572690
  misc_feature (1)..(1538): Ceres CLONE  ID no. 621686
  misc_feature (1)..(1538): Also known as  Ceres CDNA ID no. 24356233
aactttgcagttgttgcgactgaccttttcttcgatacctgagtctggacgttactaaagcaaccccagccatccatccaatttaaaaagccaacacggaaagctcagaactaccacatcgtcgccttcctctaaacgataaatttttgggattctgaaactagtgatatgttttcttgcatgaaggctgcatagtgaggaattcagtttgtgtattggaagctctagttcaacatgtcttctgtaagtaagggtgataagaaggcttccattgatgcagcatcatggttgttcaatgtggtcacgtctgtgggaataattcttgtcaataaggcactgatggctacgtatggttttagttttgctacaactttaactggtctgcattttgccacgacaaccttgttgacactcattcttaaatcactgggatatatccagacctctcatcttccagtatctgatataatcaaatttgtcttatttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggtgttgctgtctgtacggtcactgatgtcagtgtcaatgcaaagggtttcatagctgccgtaatagcagtctggagcacagccctgcaacagtattacgtgcattttcttcagaggaagtattctattgggtcatttaacttgttgggtcacactgcaccagcacaggcagcaagtttgcttctagtaggcccctttatggactactggttgacgggcaaacgagttgatgcctacggctatggtttgacatccacattgttcatcattctgtcttgcactatcgcagtagggacaaacctcagccagttcatctgcattggtaggttcacggctgtaacgttccaagtccttggtcacatgaagactattctggtcctgatcttaggattcattttctttggaaaagagggtctcaatctacatgttgttctaggcatgatcatcgcaatagcaggaatggtttggtatggcaatgcttcttctaagccaggggggaaagagcgtcgtagcttttccctccccaaaacacaagattatagttcactacctgtgtcctctgaaccagatacgaaggaatagaaaataatagagattcattagagagaaagtgctgaaacttctggtgaactgcatggaaaaatcagatgcccattaggcgagctgattcattttcttcacaccaggagtgaattcccaattatttatagatcatagtcatatcctatcttgtgtgttaatgaattgtttgggagagaaatgagaggaaacagcgttgttaagggatggaaaaatctacgttatgttccatttttttaagacagaaaatgttactgttacttttatagtaaaagtttaattccatttcaaaaaaaaaaaaaaaa

SEQ ID NO: 3078 - protein, 333 aa, Glycine max
  misc_feature: GI Number: 21593003; NR Description: unknown [Arabidopsis thaliana]
  misc_feature: GI Number: 21595054; NR Description: unknown [Arabidopsis thaliana]
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
MSSVSKGDKKASIDAASWLFNVVTSVGIILVNKALMATYGFSFATTLTGLHFATTTLLTLILKSLGYIQTSHLPVSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLFIILSCTIAVGTNLSQFICIGRFTAVTFQVLGHMKTILVLILGFIFFGKEGLNLHVVLGMIIAIAGMVWYGNASSKPGGKERRSFSLPKTQDYSSLPVSSEPDTKE

SEQ ID NO: 3079 - DNA, 610 bp, Zea mays
  misc_feature (1)..(610): Ceres cDNA ID no. 21572691
  misc_feature (1)..(610): Ceres CLONE  ID no. 622952
  misc_feature (1)..(610): Also known as  Ceres CDNA ID no. 0
actgaactagctagcagcagcagcagtttcctggtgagcttagtgcgtccagtgcctgacaactgtcgtctgtgctgtgctccgagagaagcttagagcgccagcaggcaagaagaagcttcggggtcatcggtcgccgccggaatgggagccagcctgtcttgcttcggcgggtcagaaggcgggtactacgccgacgagccggggtacgagcagccgcggcggtcgtccaggaaggtgcggccgagcgacgaggacggcctgtggtacgtaggcgagcgcgacgtcgacatgaaggcgtcggcgttcatcgccaggttccatgccaccgcctcgagctaggccctgcaggagtgtccatgtgcacggcgccgatcatataccaccatgtgaaatctttagtctatctgtgtctctcgagcctgctcatgcctctgctcgagataatctctctagtcactagcgcttccttcttccttcttccccgactgatggttagcttagttcgcttcattttccgttaattactactgtacgtgcttgacactatacttaagccccatgcatgtcaatatatccatctacttactctcttaaaaaaaaaaaaaaa

SEQ ID NO: 3080 - protein, 65 aa, Zea mays
MGASLSCFGGSEGGYYADEPGYEQPRRSSRKVRPSDEDGLWYVGERDVDMKASAFIARFHATASS

SEQ ID NO: 3081 - DNA, 1284 bp, Glycine max
  misc_feature (1)..(1284): Ceres cDNA ID no. 21572692
  misc_feature (1)..(1284): Ceres CLONE  ID no. 625886
  misc_feature (1)..(1284): Also known as  Ceres CDNA ID no. 24359985
ctcttaaaaagttaacccctcttctccctgaagaaaaaaaccaagtcctctgttcgtgttcctcgtttcacatggcttccccaaacccaaaagagatcgttgcagagattcctacctatatcagagtcttcagcgacggcaccgtggaaaggccaagagaaacaccctttgtgccaccctcaattgatgaccctcaaaccggagtctcatccaaagacatcgtcatctcacaaaaccccttagtctctgctcgaatttaccttccaaaacttaccacaataaatcaagttcccatcttggtcttctttcacggtggtggcttctttttcgaatccgctttctcccaactctaccaccaccacttcaacaccttcgtttcccaaacaaattgcatagtagtctccgtggagtacaggctcgccccggagcaccctctccccgcatgttacctcgattgttgggaagctctcaaatgggtcgcatcccattccagcgaaaatagccccatcaacgcagaacagtggttaattagccacggcaatttccaaagagttttcattggaggtgacagtgcaggtggcaacatcgttcacaacattgccatgcgtgctggcactgagcctttaccttgtggtgttaagttactaggagctattttcgcccacccttacttctgcagctcatacccaattgggtcagaacctgttacagggcatgaacagagtttaccctatgtggtttgggattttgtttacccttctgtacccggtggcattgataaccctatggtcaacccagtggctcctggggcgcctagtttggctgaattggggtgttccaagattattgtgtgtgtggctagcgaggataaactaagggatagaggggtttggtactatgaagctgtgaagaagagtgggtggaaaggggatctggagttgtttgaggagaatggtgaggatcatgtttatcatatcttccatccggaatctgagaatgccacgaagttgatcaaacgcttgggtttgtttctgaatgagtagaataaatgtctttgcttgatttctcctgttgtgttgtgtgagaatatgaataacaacaaccatggaatggttcctctgtgatctgaaattctgaatattgtgattttgtgttccttgttctcttcctctgttccagtttttgttactgtttgggttttactttcctatatgatgtaaaatttacacatggaataacgtggaaaaagtaggtggtgcggtgatgcgaaaaaaaaaaaaaaaa

SEQ ID NO: 3082 - protein, 323 aa, Glycine max
  misc_feature: PFam Name: Abhydrolase_3; PFam Description: alpha/beta
  misc_feature: PFam Name: COesterase; PFam Description: Carboxylesterase
  misc_feature: GI Number: 56692178; NR Description: 2-Hydroxyisoflavanone
  misc_feature: GI Number: 56692180; NR Description: 2-hydroxyisoflavanone
  misc_feature: GI Number: 51535286; NR Description: putative PrMC3 [Oryza
  misc_feature: GI Number: 51535269; NR Description: putative PrMC3 [Oryza
  misc_feature: GI Number: 51535273; NR Description: putative PrMC3 [Oryza
MASPNPKEIVAEIPTYIRVFSDGTVERPRETPFVPPSIDDPQTGVSSKDIVISQNPLVSARIYLPKLTTINQVPILVFFHGGGFFFESAFSQLYHHHFNTFVSQTNCIVVSVEYRLAPEHPLPACYLDCWEALKWVASHSSENSPINAEQWLISHGNFQRVFIGGDSAGGNIVHNIAMRAGTEPLPCGVKLLGAIFAHPYFCSSYPIGSEPVTGHEQSLPYVVWDFVYPSVPGGIDNPMVNPVAPGAPSLAELGCSKIIVCVASEDKLRDRGVWYYEAVKKSGWKGDLELFEENGEDHVYHIFHPESENATKLIKRLGLFLNE

SEQ ID NO: 3083 - DNA, 1275 bp, Glycine max
  misc_feature (1)..(1275): Ceres cDNA ID no. 21572693
  misc_feature (1)..(1275): Ceres CLONE  ID no. 626585
  misc_feature (1)..(1275): Also known as  Ceres CDNA ID no. 23708595
cgaaacaagggtaaaatacaagacggcaaacccaaacccaaccttcaattcaattcaagcagatagtgttgtttgtttcccccttcttcctccttcatcagcatagcattgttgtctcccctacaccataaaccctaaatccacgatgttgacttcagcatcctcatcatcctccatcttctccttcacccctaaaaccctaaccatacccccacagcaacctcgcttcaccgtccgggcccactccaaaccccccattctccccaacctcaaaaccctcgccggcgccgcggtcttcgccgccgtcgcgctccaattcccctccaccgcacgtgcctcccctccgcctcctctcgaaaccgaccaccgcctcaacgtcgaggagtccctctcccctctctccgacctcctcgaaaccaacgccgaggccctcgccgcgctcaagtccctcctccagcagaagctcgagctcggcgaggacgacgaggcgctcgccatcctcaagcgcctcatcgccgcgcagcccgacgccgccgactggaagttcctcgcggcgcgcctcaccgcggagacaggcgactcggactccgcgcgcggctactacgaggaggtcctcgccgcgaacccgctctctttcgaggcgctcttcgagaacgcgctgctgatggaccggtgcggcgagggggaggccgcgatgcggcgcctcgaggaggcgctgcgagtggcggaggaggacaagatggcgaaggaggccagagacgtaaagctcatcatggcgcagatcatgtttcttcagaaaaacgtggatgaagcgttagtaatttataatcagctcacgaaagaggatcctagggatttcaggccttatttttgtagaggcatgatttatagcttgcttgataggaatgaagaagctaaggagcagtttgcaaaatacagggaattgagtccaaagaagtttgaggttgatgggtatttgagaacccctttgtcaaggatgaagctgtttagcactgatgagagttgagaaatagtaataataaatttgcggcaattggaataaggatgcaaaaaccgagttaaattcttttgcattagctatctatgctatattgctatgccactcttgaaaagatgggtgggtgtaaaagttgtttgtattaatagagagaatgatagagaaataatgattattgttgagttctggtgaattgaactcagtaacagtggggctgcttttgcctttaaaaccaaaaaaaaaaaaaaaaaaaaaaa

SEQ ID NO: 3084 - protein, 293 aa, Glycine max
  misc_feature: PFam Name: Extensin_2; PFam Description: Extensin-like region
  misc_feature: PFam Name: Pyr_redox_2; PFam Description: Pyridine
  misc_feature: PFam Name: TPR_1; PFam Description: Tetratricopeptide repeat
  misc_feature: PFam Name: Cation_efflux; PFam Description: Cation efflux family
  misc_feature: PFam Name: TPR_2; PFam Description: Tetratricopeptide repeat
  misc_feature: GI Number: 21617936; NR Description: unknown [Arabidopsis thaliana]
  misc_feature: GI Number: 21553360; NR Description: unknown [Arabidopsis thaliana] >gi|18413971|ref|NP_568104.1| chloroplast lumen common
  misc_feature: GI Number: 28416459; NR Description: At4g39470/F23K16_100 [Arabidopsis thaliana] >gi|15215656|gb|AAK91373.1| AT4g39470/F23K16_100 [Arabidopsis thaliana] >gi|18420460|ref|NP_568061.1| chloroplast lumen common family
  misc_feature: GI Number: 57900694; NR Description: unknow protein [Oryza
  misc_feature: GI Number: 228938; NR Description: Hyp-rich glycoprotein
MLTSASSSSSIFSFTPKTLTIPPQQPRFTVRAHSKPPILPNLKTLAGAAVFAAVALQFPSTARASPPPPLETDHRLNVEESLSPLSDLLETNAEALAALKSLLQQKLELGEDDEALAILKRLIAAQPDAADWKFLAARLTAETGDSDSARGYYEEVLAANPLSFEALFENALLMDRCGEGEAAMRRLEEALRVAEEDKMAKEARDVKLIMAQIMFLQKNVDEALVIYNQLTKEDPRDFRPYFCRGMIYSLLDRNEEAKEQFAKYRELSPKKFEVDGYLRTPLSRMKLFSTDES

SEQ ID NO: 3085 - DNA, 1209 bp, Glycine max
  misc_feature (1)..(1209): Ceres cDNA ID no. 21572694
  misc_feature (1)..(1209): Ceres CLONE  ID no. 627169
  misc_feature (1)..(1209): Also known as  Ceres CDNA ID no. 0
aacgttttatcctttcagctttaagctcaccgaactaactcagcattcaacaacaatggtgatgctcatccgttgctcttgcttcttcgctcgccctcgcttctcacaacctcaattctacggcaacaacaccaaacccttactcccagggaaattagcttttctttctctaaaacctgacaagggtgttccacactttgaagatacgcttgatgggtcttctaagatttcatgtttgctgcactgctcaaagtgtaaggaagacatacaccaaaggttcccatcactgatatttgttgcgagcaatgttttgatgttctctatgcctaacacagctttggctgaaacgtgtgaggctgataactctgttttcaatatgcctatactgctggcagtagcactcattggagccacagttggagggttgcttgctcgacaaagaaggaatgaattacagcgggtaaacgagcaattgatccaaatcaatgcagctttacggaagcaagccaaaattgagtcctatgcacctagtttgagttatgctcccattggtggtggtaggatacttgataatgaaattattgttgacccaaagaagcaagagctaatttctaagttgaaaaatggaaagaactttctaaggaatcaacaaccagataaagcattcacggagtttaagaatgcacttgagcttgcccagaatctgaaggatcctattgaagagaaaaaagctgctagaggcctaggagcctcactgcaaagacagggaaagtaccgagacgctattaaataccattctatggttttgggcatctcggaacgggaagaagaggactcaggcagtacagaagcatttggtgcaattgctgattgttacactgagcttggagagcttgagaaagcaggccaattctatgacaagtatattgcaagactggaaaaggactaatctttacaccgtttaacatttcttgaaagaaataaccagtgttggattactagactttcatcatggcttgtcaccatctgtttcatgcggattttccctttcctttctgatcctctctatggaacttcagattattcagttcctatttatttttaggttggaaatgctcaaagctatatgtatttccaagattgtgtaatgttagtcctttagacgagcaagggaaatatttgtgtttatcggcaaaaaaaaaaaaaaaa

SEQ ID NO: 3086 - protein, 297 aa, Glycine max
MVMLIRCSCFFARPRFSQPQFYGNNTKPLLPGKLAFLSLKPDKGVPHFEDTLDGSSKISCLLHCSKCKEDIHQRFPSLIFVASNVLMFSMPNTALAETCEADNSVFNMPILLAVALIGATVGGLLARQRRNELQRVNEQLIQINAALRKQAKIESYAPSLSYAPIGGGRILDNEIIVDPKKQELISKLKNGKNFLRNQQPDKAFTEFKNALELAQNLKDPIEEKKAARGLGASLQRQGKYRDAIKYHSMVLGISEREEEDSGSTEAFGAIADCYTELGELEKAGQFYDKYIARLEKD

SEQ ID NO: 3087 - DNA, 582 bp, Glycine max
  misc_feature (1)..(582): Ceres cDNA ID no. 21572695
  misc_feature (1)..(582): Ceres CLONE  ID no. 628560
  misc_feature (1)..(582): Also known as  Ceres CDNA ID no. 24356262
gaggtgttcgaagttggaccatgcaaagatggttaccaaatgggtctcttaatcggccaaagattctccgaaaccataaggagtagagtggcctcagacctcattctacaaaaccagcttcgaccctttgcccactcccctcattcacagtcacttctcaaaccacttttttataacaatcaaaccaaattcccaaggtattgggatgaacttttggggacagcagcaggaagcggtgtgccatttcttgatggtgaacaaggagggaagaaaggcaggagtgttggagaactttgctgagggagagaagtatgctgagcatttcctgaggaagtatgtgcgcaacagaactcctgagattatgccctccatcaacagcttctttgctgacccaagtcgcaactaagttgctttgaataaataaaggtttatgtgagatatgaattctattatggttaaagacagattgtatcgtgcttttagaaaacaaaatgtggttgttgctttctctggccgtgcagtgtgtttgctgtggttgagaataataatactgattttattgcattaaaaaaaaaaaaaaaa

SEQ ID NO: 3088 - protein, 582 aa, Glycine max
  misc_feature: PFam Name: B12D; PFam Description: B12D protein
  misc_feature: GI Number: 4530585; NR Description: B12D protein [Ipomoea batatas]
GAGGTGTTCGAAGTTGGACCATGCAAAGATGGTTACCAAATGGGTCTCTTAATCGGCCAAAGATTCTCCGAAACCATAAGGAGTAGAGTGGCCTCAGACCTCATTCTACAAAACCAGCTTCGACCCTTTGCCCACTCCCCTCATTCACAGTCACTTCTCAAACCACTTTTTTATAACAATCAAACCAAATTCCCAAGGTATTGGGATGAACTTTTGGGGACAGCAGCAGGAAGCGGTGTGCCATTTCTTGATGGTGAACAAGGAGGGAAGAAAGGCAGGAGTGTTGGAGAACTTTGCTGAGGGAGAGAAGTATGCTGAGCATTTCCTGAGGAAGTATGTGCGCAACAGAACTCCTGAGATTATGCCCTCCATCAACAGCTTCTTTGCTGACCCAAGTCGCAACTAAGTTGCTTTGAATAAATAAAGGTTTATGTGAGATATGAATTCTATTATGGTTAAAGACAGATTGTATCGTGCTTTTAGAAAACAAAATGTGGTTGTTGCTTTCTCTGGCCGTGCAGTGTGTTTGCTGTGGTTGAGAATAATAATACTGATTTTATTGCATTAAAAAAAAAAAAAAAA

SEQ ID NO: 3089 - DNA, 1427 bp, Triticum aestivum
  misc_feature (1)..(1427): Ceres cDNA ID no. 21572696
  misc_feature (1)..(1427): Ceres CLONE  ID no. 630408
  misc_feature (1)..(1427): Also known as  Ceres CDNA ID no. 24356753
agttcacatccacctcatactttctcttgcaacaagtcagtaaagattccgtttggagagcgagagcgagagctccggtgtaaaatcgatgggtctggacgtaggagagatcggcatgggcgcagatttgagcctggatttgaagatgttcgcggccaagagcctggggcgggtcagggaagcgccggcggccgccatggacgactgtatccggaggctggaggaggagaagagcaagatcgaggtgttccggcgcgagctccccctctgcgcgcgcctcctcgccgacgtgattgatgtgatgaagaaggaggtggaggagaagaagagaggcggcgatcgaggagaggacagggaggacgccggcgcaggcgacaagagcaactggatgagcaccgcgcagctctggaccggcgattccgtccggggggacgatgcttccgagaagcaggatgagaggaggaggtcgtcggagccggaatctcgcgacggcgctggcttgccgtccaaggccgtgggctccggcgcgccggcgttcgcgccgccgagtttgaggaaggatgacaaggctgtgcggatgccggatctgccgtttctgtcgccggcaccgatcaagacctctccggctgctgctaccggcggcgctgaagaaagccgccgccagcttgttggattcgcgcaagaagcggcgagggctgcagccgccctggcaccggctgccccttccctaagcctccaggcgcagtcgcagcagacagcacagcagcagcagcagcaagcgaggaaggcgcggcggtgctggtcgccggagctgcacctccagttcgtcactgccctgcaccaactcggtggtccccaagttgctactccaaagcaaatcagggagctgatgaaggtggatggcctgaccaatgatgaagtgaagagccatctccagaaataccgtctgcacaaccgaagggcgccaggatctccggcagccaaccggccgatcgtgctcatgggagggctctggataactcaggagcagagcagctcccagtcagggggatcacctccggggcccctaaacttctcaagctcaggcgtagctgcctcatcggtgacggtcagcggcgaggaggaagatggcagatccgagagctatggctggaaatgatcaacaagttatattagtgtttgttcagagatttccatggcgcgcgatgacagtggtatcttgagagattcctgagacaggattatagtgtagtcttttttgttgtatgcagggtgatcaagccttgagtgctttgagatgaaactcttgctgttattatgtaagtacatcgggaagaggttataccagttacaattttgcggatatgttaatctaaaaaggttggggcagagctacaattttcgcccagagaaaaaaaaaaaaaaaa

SEQ ID NO: 3090 - protein, 356 aa, Triticum aestivum
  misc_feature: PFam Name: Myb_DNA-binding; PFam Description: Myb-like
  misc_feature: GI Number: 50933785; NR Description: putative cytoskeletal protein-like protein [Oryza sativa (japonica cultivar-group)] >gi|33146555|dbj|BAC79732.1| putative cytoskeletal protein-like
  misc_feature: GI Number: 18419989; NR Description: myb family transcription
  misc_feature: GI Number: 14532434; NR Description: AT4g37180/C7A10_180
  misc_feature: GI Number: 30690890; NR Description: myb family transcription
  misc_feature: GI Number: 21554044; NR Description: unknown [Arabidopsis thaliana]
MGLDVGEIGMGADLSLDLKMFAAKSLGRVREAPAAAMDDCIRRLEEEKSKIEVFRRELPLCARLLADVIDVMKKEVEEKKRGGDRGEDREDAGAGDKSNWMSTAQLWTGDSVRGDDASEKQDERRRSSEPESRDGAGLPSKAVGSGAPAFAPPSLRKDDKAVRMPDLPFLSPAPIKTSPAAATGGAEESRRQLVGFAQEAARAAAALAPAAPSLSLQAQSQQTAQQQQQQARKARRCWSPELHLQFVTALHQLGGPQVATPKQIRELMKVDGLTNDEVKSHLQKYRLHNRRAPGSPAANRPIVLMGGLWITQEQSSSQSGGSPPGPLNFSSSGVAASSVTVSGEEEDGRSESYGWK

SEQ ID NO: 3091 - DNA, 1547 bp, Triticum aestivum
  misc_feature (1)..(1547): Ceres cDNA ID no. 21572697
  misc_feature (1)..(1547): Ceres CLONE  ID no. 630431
  misc_feature (1)..(1547): Also known as  Ceres CDNA ID no. 24356515
gtcgcctcgtgccctccgcctcacccacctcgcctgaatcggcgccacaccgtgtacgttcgccgcgtccgcaccaccacgagcgcgagaccgatggccgtcgccccgtcgccgcaagccacggcggccgccgccgccctctccaggcacagatccgccgccgtcccaccagtgccgaggagcgtgcgggtggccaccgcggcgaggaggccgggctggacgcgggcgagggccgggctggtggcccgcgccgttgttgcagccaagggtgagcttgcgagctccgatacgggcggtcatgaggttttgatgtttgaggcccttcgtgaagccatgatagaggagatgactttggatccaaccgtgtgcatgattggtgaggatgtcggtgactatggaggttcatacaaggtatccaaaggcttgtctgagatgtttggagacctccgcgtccttgatacccctattgctgagaactcttttactggtatgggaatcggagcagcaatgcaggggctcaggccagttgttgaagggatgaacatgggtttccttctccttgcctacaaccaaatctcaaacaactgcggtatgcttccttatacctcgggcggccagttcaaaatcccaattgtgatccgaggccctggcggtgttggtcgtcagcttggtgcggagcactcgcagcgccttgagtcctacttccagtctatcccgggcattcaaatggtcgcttgctctaccccttacaatgcgaagggccttctgaaggctgccataaggagcgataaccctgtggtgctgttcgagcatgtccttctgtacaacctgaaggagaagatccccgacgaggaatacatctgctccctggaggaggccgagatggtgcgtccaggctcgcagctgaccatcctgacatactcccgcatgaggtaccacgtgatgcaggccgtcaagacgttggtgaacaaggggtacgacccggaggtgatcgacatcaggtcgctgaagccgttcgacctgcacaccatagggaactccatcaagaagacccaccgcgtgctgatcgtggaggagtgcatgcggacaggcggcatcggcgccagcctgaggtcggccatcatcgacaacttctgggacgagctggatgctcgccccgtgtgcctgtcgtcgcaggacgtgccgaccccgtacgccgcgaccctggaggacgcgaccgttgtgcagcccgcgcagatcgtggccgcggtggaggagatctgccaatagtaacgctgtcatgagttacatgtttcgaggattcagaagcagcgtgcgtgtccagtttgctttgtcgtgtaattagtgtgtttcgccatcccgtggacgttgtatcatactgggaagactgaagtgtacccttagctgttgtttcttggtccatctgcccattctatgtaagctgtgatgctcctgggttttgatcatccttctgcttggtcggtggaggatgtgtgctgctgttattcatttatttactacgtaccatcctaaaaaaaaaaaaaaaa

SEQ ID NO: 3092 - protein, 391 aa, Triticum aestivum
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
  misc_feature: GI Number: 2982328; NR Description: pyruvate dehydrogenase E1
MAVAPSPQATAAAAALSRHRSAAVPPVPRSVRVATAARRPGWTRARAGLVARAVVAAKGELASSDTGGHEVLMFEALREAMIEEMTLDPTVCMIGEDVGDYGGSYKVSKGLSEMFGDLRVLDTPIAENSFTGMGIGAAMQGLRPVVEGMNMGFLLLAYNQISNNCGMLPYTSGGQFKIPIVIRGPGGVGRQLGAEHSQRLESYFQSIPGIQMVACSTPYNAKGLLKAAIRSDNPVVLFEHVLLYNLKEKIPDEEYICSLEEAEMVRPGSQLTILTYSRMRYHVMQAVKTLVNKGYDPEVIDIRSLKPFDLHTIGNSIKKTHRVLIVEECMRTGGIGASLRSAIIDNFWDELDARPVCLSSQDVPTPYAATLEDATVVQPAQIVAAVEEICQ

SEQ ID NO: 3093 - DNA, 1212 bp, Triticum aestivum
  misc_feature (1)..(1212): Ceres cDNA ID no. 21572698
  misc_feature (1)..(1212): Ceres CLONE  ID no. 632992
  misc_feature (1)..(1212): Also known as  Ceres CDNA ID no. 24356671
agcacccaactcacctcactcagcccagtctcactcacaatggctactagcaccaagcttgcagctcttagctttcttgtccttgtgagcattgggttcgccaatgccgcaaggatgctcgctagttcctccagtgcttcaggtggagggggaggcggaggtggcgggggaggcggtgcatccggtgggagtggatatggttcaggttctgggtcaggtggaggcttaggatatagtgagagcggcggagattggggtaagaagtggaacttcgccaagggatttggtggtggaggaggagctggtggtggcggaggatcaatgggtggatccgggtctggttccggatccggcttcggtactggcagctctgcgactggctccgcatcggcccctagcagcaatggttatgctagtgctgatggtaagggtggaggcggcggcggaggtggcggtgcaaacggatctagcggaactggagccggagatggccttggcaagggatatggtgagagtggcgtttcaaaggcaccggctccagctgccggtggcgatggtaccagctactctgatgctggcggtagtggtaatggtggcggcggtggtaacaacggaaatggaggtggtgccggcgctggcgctggacaggccggtagcgacgacacttctggaggctttgcgaatggaggaggaagcggcaatggtggtggcgcaactggaggtgtcgttgaaggtccaagtgttggagttggatctggtgctgggtctggcgccggccagaccggtagcactggctcttatggcgagggatacgccacgggaatgggcggcggcatgggtggcggcactggtgagagccagaacggcggatctggcagtggtggaggtagtgggtccggatcaggtagtggaggataccactaaactaccctttattgagcaagcaagaaccggaccttggcatgtattttaatttccatcattttactagtatttcaaccgaaggactatgtgtcatacactaaggggactaaatagcattcgtggattagcatgtaagtcctacaactgttctagcgggcttgtgccaatagacgtgttaataataatgtgaaggagtacctcctttgtaattttctctatttcaagtcaaattgattgattccgccttccagtggctttttgagttttgacccaaaaaaaaaaaaaaaa

SEQ ID NO: 3094 - protein, 1212 aa, Triticum aestivum
  misc_feature: PFam Name: Dehydrin; PFam Description: Dehydrin
  misc_feature: PFam Name: GRP; PFam Description: Glycine rich protein family
  misc_feature: PFam Name: S-antigen; PFam Description: S-antigen protein
  misc_feature: PFam Name: NmrA; PFam Description: NmrA-like family
  misc_feature: PFam Name: Harpin; PFam Description: Harpin protein (HrpN)
  misc_feature: GI Number: 51091828; NR Description: putative glycine rich
  misc_feature: GI Number: 51090508; NR Description: putative glycine rich
  misc_feature: GI Number: 1532071; NR Description: glycine-rich protein [Zea
  misc_feature: GI Number: 50937669; NR Description: putative glycine-rich cell wall structural protein 1 precursor [Oryza sativa (japonica
  misc_feature: GI Number: 50937659; NR Description: putative glycine-rich cell wall structural protein [Oryza sativa (japonica cultivar-group)] >gi|34394662|dbj|BAC83969.1| putative glycine-rich
AGCACCCAACTCACCTCACTCAGCCCAGTCTCACTCACAATGGCTACTAGCACCAAGCTTGCAGCTCTTAGCTTTCTTGTCCTTGTGAGCATTGGGTTCGCCAATGCCGCAAGGATGCTCGCTAGTTCCTCCAGTGCTTCAGGTGGAGGGGGAGGCGGAGGTGGCGGGGGAGGCGGTGCATCCGGTGGGAGTGGATATGGTTCAGGTTCTGGGTCAGGTGGAGGCTTAGGATATAGTGAGAGCGGCGGAGATTGGGGTAAGAAGTGGAACTTCGCCAAGGGATTTGGTGGTGGAGGAGGAGCTGGTGGTGGCGGAGGATCAATGGGTGGATCCGGGTCTGGTTCCGGATCCGGCTTCGGTACTGGCAGCTCTGCGACTGGCTCCGCATCGGCCCCTAGCAGCAATGGTTATGCTAGTGCTGATGGTAAGGGTGGAGGCGGCGGCGGAGGTGGCGGTGCAAACGGATCTAGCGGAACTGGAGCCGGAGATGGCCTTGGCAAGGGATATGGTGAGAGTGGCGTTTCAAAGGCACCGGCTCCAGCTGCCGGTGGCGATGGTACCAGCTACTCTGATGCTGGCGGTAGTGGTAATGGTGGCGGCGGTGGTAACAACGGAAATGGAGGTGGTGCCGGCGCTGGCGCTGGACAGGCCGGTAGCGACGACACTTCTGGAGGCTTTGCGAATGGAGGAGGAAGCGGCAATGGTGGTGGCGCAACTGGAGGTGTCGTTGAAGGTCCAAGTGTTGGAGTTGGATCTGGTGCTGGGTCTGGCGCCGGCCAGACCGGTAGCACTGGCTCTTATGGCGAGGGATACGCCACGGGAATGGGCGGCGGCATGGGTGGCGGCACTGGTGAGAGCCAGAACGGCGGATCTGGCAGTGGTGGAGGTAGTGGGTCCGGATCAGGTAGTGGAGGATACCACTAAACTACCCTTTATTGAGCAAGCAAGAACCGGACCTTGGCATGTATTTTAATTTCCATCATTTTACTAGTATTTCAACCGAAGGACTATGTGTCATACACTAAGGGGACTAAATAGCATTCGTGGATTAGCATGTAAGTCCTACAACTGTTCTAGCGGGCTTGTGCCAATAGACGTGTTAATAATAATGTGAAGGAGTACCTCCTTTGTAATTTTCTCTATTTCAAGTCAAATTGATTGATTCCGCCTTCCAGTGGCTTTTTGAGTTTTGACCCAAAAAAAAAAAAAAAA

SEQ ID NO: 3095 - DNA, 939 bp, Glycine max
  misc_feature (1)..(939): Ceres cDNA ID no. 21572699
  misc_feature (1)..(939): Ceres CLONE  ID no. 635534
  misc_feature (1)..(939): Also known as  Ceres CDNA ID no. 23701333
attttcaccagctaccatatttagttatcagcaatggacttctactttggaaaccctcatccttatcccaatattcatcaatatcatgctcataattctgtagtcagcatgactccatcttcccctgagatcgcactatctgattatctcatgctcgatgactatgttgatcatcaagattctcgatcatcacaaagcactgagtcatcagaaaaagcaaccttctgtgatcccactcacggattcagcactggtgcaacctctaagaacaataacatgaagtgcaaaaatgggattaatgaaaacaaaagaggagtgggtccaaggatcgcgttcagaaccaaatcagagcttgagatcatggatgatggatacaagtggaggaagtacggcaagaagtctgtgaagagcaatcccaatctaaggaactactacaaatgttcaagtggaggatgcagtgtgaagaaaagggtggaaagggatagagatgactccagctatgtgataacaacttatgaaggtgtgcacaatcatgagagcccatttaccacatactacagccccatctccttcgtacattctgatactactttcaaatgacaccatctccaaccccttttctgctcttacacctccctagcttaattatgtgccgagaaaaagcttggaagattcgatcgagcaagggaagctgtgtcaatgcattgtctaattaatcttaattattttcatgctgtaataggttgaagagagtttctttacccttctttttccattttgtttttagatgagtttaatatctcacttaatgaaaaatcaacctttgttagttcatgtgacaaagaacatgattttccatgtgtaaagttgttcaaatcttaaaatagaatggaatgcttcgtcttgttacagttaataaattcaaaaaaaaaaaaaaaa

SEQ ID NO: 3096 - protein, 188 aa, Glycine max
  misc_feature: PFam Name: WRKY; PFam Description: WRKY DNA -binding domain
  misc_feature: GI Number: 16798362; NR Description: WRKY transcription factor 51 [Arabidopsis thaliana] >gi|29839597|sp|Q93WU9|WR51_ARATH Probable WRKY transcription factor 51 (WRKY DNA-binding protein 51) >gi|22328061|ref|NP_568995.2| WRKY family transcription factor
  misc_feature: GI Number: 56797587; NR Description: putative WRKY
  misc_feature: GI Number: 46394372; NR Description: TPA: WRKY transcription
  misc_feature: GI Number: 52353747; NR Description: WRKY transcription factor 67 [Oryza sativa (japonica cultivar-group)] >gi|46394388|tpg|DAA05132.1| TPA: WRKY transcription factor 67
  misc_feature: GI Number: 56797589; NR Description: putative WRKY
MDFYFGNPHPYPNIHQYHAHNSVVSMTPSSPEIALSDYLMLDDYVDHQDSRSSQSTESSEKATFCDPTHGFSTGATSKNNNMKCKNGINENKRGVGPRIAFRTKSELEIMDDGYKWRKYGKKSVKSNPNLRNYYKCSSGGCSVKKRVERDRDDSSYVITTYEGVHNHESPFTTYYSPISFVHSDTTFK

SEQ ID NO: 3097 - DNA, 1832 bp, Glycine max
  misc_feature (1)..(1832): Ceres cDNA ID no. 21572700
  misc_feature (1)..(1832): Ceres CLONE  ID no. 636867
  misc_feature (1)..(1832): Also known as  Ceres CDNA ID no. 0
atctctaactcttcttcttctgcatcattcctctgttgcagcaccggttaagaattttcgtggaacctattgtgttgagctgcgattgcatgtgggaatcgatttctgcagattaatcttggaagtttgatgtgattgcttggttttggtttgaagtggttttaatggggaatatactgaatctaaacaattcaaagactagacggaatgattcccatggggtcttgcaaggtgaatcctgcaagagacagaggttgtcaccaaactcttgtgaggacaacccaagactgattccgtcccttcctgatgagatatcaatacagattctagctagagttcctcggatttattatttgaatctgaagttagtttgtcgtgcttggaaggaaacctttgttagttctgaactattttgtgtgagaaaagagcttggaagcatggaggaatggctctacattttgacaaaggtcaacgatgataagcttttatggtatgccttggaccctctttccagaagatggcaaaagttgccgccaatgccaaaagttgggtttgaagatgaaacaaagaaaggtttgatttcctttccccttcggatgtggagcatgatgggttcaagtattcgaattgttgatgtcataatgagctggcttgggaggagagatgccctggactggatgcctttttgtggttgctccataggagctgttgatggttgcatctatgcattaggaggattttcaagagcttcagcaatgaaatatgtttggcagtatgatcccattaaaaactcttgggctgaggctagtccaatgtcagttggcagagcctattgcaagacaggtatattaaataataagctttatgttgttggaggggttactaggggtcgtggtggactaagccctctgcaatctgcagaagtatatgaccctcatacaggcatgtggtccctgttacctagcatgccttttgcaagagctcaagtgttgccaactgcttttttggctgacttactcaagcctattgccacaggaatggcttcatacaaaggaaggttatttgttcctcagagtttgtattgctggccattttttgttgatgttgggggtgaagtttatgatccaaatttaaattcatggcttgaaatgccaattggtatgggtgaaggctggcctgcaaggcaagctggaacgaaattgagtgttacggtcgatgatgatctatatgcacttgatccttcaaattctcttgacagtgcaaagatcaaggtatatgattatgaaggtgatacttggaaagttgcagcaggagatgttcctattcatgatttcaccgaatcggaatctccttatctcttggctggtttacttggaaaacttcatgtaataactaaagatgctaatcacaacattacagtgttgcaggctgacatgcaaaatgaacatgctgagtcagctttctctcaatcaatattgtcatcaccagataactcgatcagtgaagatgctgaatcttctgcagaaacacagggagaattttggaaggttcttgcaactaggagtggtagatctgctgaactagttaactgtcaatcccttaaaatatgaaagtaaaaatgggggcaggggtggtttagagtccttttgtggttatgatttgtgagtatatttctgttggttggtatgattgtaaatgatttcctttacaaattattcataatatgtaaccaagaacacaattaaaactatagttagcaagaacatcattcaaacacactacaaaataaatgaaggttttcaacattaagttgggtaaaaaaaaaaaaaaaa

SEQ ID NO: 3098 - protein, 481 aa, Glycine max
MGNILNLNNSKTRRNDSHGVLQGESCKRQRLSPNSCEDNPRLIPSLPDEISIQILARVPRIYYLNLKLVCRAWKETFVSSELFCVRKELGSMEEWLYILTKVNDDKLLWYALDPLSRRWQKLPPMPKVGFEDETKKGLISFPLRMWSMMGSSIRIVDVIMSWLGRRDALDWMPFCGCSIGAVDGCIYALGGFSRASAMKYVWQYDPIKNSWAEASPMSVGRAYCKTGILNNKLYVVGGVTRGRGGLSPLQSAEVYDPHTGMWSLLPSMPFARAQVLPTAFLADLLKPIATGMASYKGRLFVPQSLYCWPFFVDVGGEVYDPNLNSWLEMPIGMGEGWPARQAGTKLSVTVDDDLYALDPSNSLDSAKIKVYDYEGDTWKVAAGDVPIHDFTESESPYLLAGLLGKLHVITKDANHNITVLQADMQNEHAESAFSQSILSSPDNSISEDAESSAETQGEFWKVLATRSGRSAELVNCQSLKI

SEQ ID NO: 3099 - DNA, 1830 bp, Glycine max
  misc_feature (1)..(1830): Ceres cDNA ID no. 21572701
  misc_feature (1)..(1830): Ceres CLONE  ID no. 636914
  misc_feature (1)..(1830): Also known as  Ceres CDNA ID no. 0
acccaaaaaaattcaaaaaacacaaacaacaacctttgacacaacatagtggagcaagaagaatcgaagttgtttggtttctgttttttttttttttttctttttctcctatgtaatgcatcagaagaaatccgaagtccagatcggaaaagaaagcagtggcgtctcttccgatttcaaccaccacccactcccaatcctaactccgaacccaaaccaagatgctctccaatcactaacctccaccgcaccctacaaaagaccttccctcaccacccaaccccatctttccaaatccccaaccctccacaaattcccaaccctaaaaccacgccacgtcaccaccaccaccgccgccgccaccaccaccgttctctccctcctccgccgccgcctccgccaccgtctccgcctcttcctcttcctcttgctccccttcttctacttcctcgtctcccaccccacaaactccttcctcctcgatttcctctccgccttctccttctccgccgcgctcttgttctctctcaacctcgccctccctcgaatcccctccctccgcctcttcctcaacctcaagcccaaggccaggtccggcctcaaactcccaatcttctggaccgtgggagcccgcccaggcccggcccaggcccaaccccagcccgcgggccttcgcttatccgtggtgccctacgcgaacggcgacgtgtacgagggggagctgaagggagggaagtgttgtgggagtggggtttactattacagtatgagtggaaggtatgagggggattgggtggatgggaagtacgatgggttcggggtggagacgtgggcccgggggagccggtaccgagggcagtaccggcaagggttacggcacgggttcggggtgtaccggttctacaccggggatgtttatgccggggagtggctgagtggacagagtcatgggtgtggggttcacacgtgcgatgatgggagcaggtatgtcggggagttcaagtggggcgttaagcatggccttggacactaccattttagaaatggcgatacatatgctggcgaatactttgcggataagatgcatggatttggggtatacagttttgctaatggccatcgttatgaaggatcctggcatgaaggcaaaaggcaaggtcttggaatgtatacatttagaaatggagaaacccagtctggtcactggcaaaatggagtccttgacattccaagcacacagagtaccacctatcctgtttcccctgttggggtcaatcattccagagtacttaatgcagtccaggaagcaagaagagcagctgagaaagcctatgatgtggccaaggtagatgagagggttaatagagcagtagctgccgctaacagagcagccaatgcagctagagtagctgctgtcaaggccgtgcaaaaccaaatgcttcataatgttaacagcacgagcatcccaattcccattgtgtgaggctgtcagctgcaaacttttgatagtagagatgcacgagattgtcagaagaggtcggtagtttaaactgctttgtttacaccgtcatcatcactgctggctgaatgaaatcaagcagatttattatccatctgccacgagtcttgtatagagggaggaagggtgatggcttccacatggtaaaatactacatatacatactatattttttccctttgcctacattttgtaaatttacttagatgtaaatgctggtgtgcgggtgaaacctcaacccagctactgttgtaagatcgcttggtaaaataaggagagaaacaaacatctagccaaaaaaaaaaaaaaaa

SEQ ID NO: 3100 - protein, 455 aa, Glycine max
MHQKKSEVQIGKESSGVSSDFNHHPLPILTPNPNQDALQSLTSTAPYKRPSLTTQPHLSKSPTLHKFPTLKPRHVTTTTAAATTTVLSLLRRRLRHRLRLFLFLLLPFFYFLVSHPTNSFLLDFLSAFSFSAALLFSLNLALPRIPSLRLFLNLKPKARSGLKLPIFWTVGARPGPAQAQPQPAGLRLSVVPYANGDVYEGELKGGKCCGSGVYYYSMSGRYEGDWVDGKYDGFGVETWARGSRYRGQYRQGLRHGFGVYRFYTGDVYAGEWLSGQSHGCGVHTCDDGSRYVGEFKWGVKHGLGHYHFRNGDTYAGEYFADKMHGFGVYSFANGHRYEGSWHEGKRQGLGMYTFRNGETQSGHWQNGVLDIPSTQSTTYPVSPVGVNHSRVLNAVQEARRAAEKAYDVAKVDERVNRAVAAANRAANAARVAAVKAVQNQMLHNVNSTSIPIPIV

SEQ ID NO: 3101 - DNA, 1306 bp, Glycine max
  misc_feature (1)..(1306): Ceres cDNA ID no. 21572702
  misc_feature (1)..(1306): Ceres CLONE  ID no. 638412
  misc_feature (1)..(1306): Also known as  Ceres CDNA ID no. 24356304
aagatgtttccccatttgttccctattctcttctcccatcttcttcactctcagcatgaaataataggcgtgcgttttcacccttcaaacaatgacgacaatggtggctcaacgcatcatcatcgtcactttcttcacgcttcttcttcttcaacacctaaccttcgccaccgctactgcactttgccaattctcttttctcgacggaaacacgctctacaattacaccctctcttctcccattcgcaacttccctcacggcatcctcagcgaagatggattttacaaagtggcagtaaatgataccacactttggtttcagctttgcgatggaatgattttcaatcacgatcctccaatatgtgctgactgctgggattgtggagggccaaaacattgtgggatggagtgcaatgcacttgtggcaaacaacgttggaggttatcatgtatgcacagccataggacgtggccctaaaatagatgttgatattattgataagaaaaacccccacactggtgtcattgttaaaatgtcaaacagtggccctaagtacaactgttcgctagctgtgtctgttctttgcaatttaaatggagtgcaaggaccgcaagctctggagagattaggggcctgtgattatgttactgagctaaagcacccatctggctgtgccatcattataaatgttcatggaggagggtgggggtggtttggcaccttactgatcattgttttgtgcctttttgctgcatatctcttggctggtatagtttaccgatttttcttcctcgggattcgtggtatagatattatccctaaccttgacttctgggttagcttgcctaggagaacacagagtctgtgtacatctttggtgaggaagtttaagggaccgtctgaaggttaccggagctcttattctcctgtgaacttctgagattatattttcaattctggatttatctggtgaatacattacgtataatctcccaaacaaggccaacattctgcagacaaatgcggaaaaattccatagaaatctgtaattcttgttctgattgtccctccatgaatttagcatttaacattcttttgtctctctgaaagaaaaggagaaagaggaggaggaaaaaaaaaaaagataaaacaaaaaagaaagtctagcatgattcttaaagaaaagaggaactataatggagctaatccaattgttttggtagacattctttggtttataattagataattgaatgaaaatgtaacttgtcttttgttactttgaccattaaaaaaaaaaaaaaaa

SEQ ID NO: 3102 - protein, 282 aa, Glycine max
MTTMVAQRIIIVTFFTLLLLQHLTFATATALCQFSFLDGNTLYNYTLSSPIRNFPHGILSEDGFYKVAVNDTTLWFQLCDGMIFNHDPPICADCWDCGGPKHCGMECNALVANNVGGYHVCTAIGRGPKIDVDIIDKKNPHTGVIVKMSNSGPKYNCSLAVSVLCNLNGVQGPQALERLGACDYVTELKHPSGCAIIINVHGGGWGWFGTLLIIVLCLFAAYLLAGIVYRFFFLGIRGIDIIPNLDFWVSLPRRTQSLCTSLVRKFKGPSEGYRSSYSPVNF

SEQ ID NO: 3103 - DNA, 1427 bp, Triticum aestivum
  misc_feature (1)..(1427): Ceres cDNA ID no. 21572703
  misc_feature (1)..(1427): Ceres CLONE  ID no. 639168
  misc_feature (1)..(1427): Also known as  Ceres CDNA ID no. 23461530
cacttgtgtactgcaacactacagccaacactacagcactagcacgagcgagcaagttccagagaagttcgaccacagcgcgcgaccatgtcgtcgaggcaagaccagcgcgaggcgagggccgaggccgacgctcgccgcgcggcggacgagatcgcgcgcgcgcgggacgagcgggtgatgcaggcggagatggacgcgcgacgcgcggcggacgagattgcgcgcgcccgcgcggaccgcgagcacggcgcactgggcggcggtgcctacgccgagcacccgagcggcggcggcggcatcctggggagcatgcaggagggcgccaagtccctggccagcgcggtcggccgcacgttcggcggcgccaaggacaccgccgccgacaagacctaccaggcggcggacgccaccgggaacacgatgggcgagtacaaggactacaccgccgagaaggccaaggagaccaacgacagcgtcgcgcacaagacgagcgagaccgcggaggccaccaggaacaagctcggcgaggccaaggactgcaccgtcgagaaggcgacggaggccaaggacaccgtggcgcagaagacgaacgagaccgctgaggctaccaagaacaagctgggagagtacaaggacgccttggccgggaagacgcaggaggccaaggacagcaccatgcagaaggcccaccagacgaaggacgccgccgccgagaaggcgaggcaggccaaggacgtgacacagcagaaggccggcgagtacacggacgccaccaaggggaccgcgcaggaagccagggacaggtccatggcgaccacgcagacccacgatgccgataggggtcagcaagggaccggtctgttcggggcgctgggcaacatgacgggcgcgatcaaggagaagctgacggttggctcgggcacgcagcagcacgacgccggagggcacggcctccggctgggcagcgaggacgagcgcgcggtgaaggagcgcgcggcggagaaggcggcgtccgtgtacttcgaggagaaggaccggctggccaaggagcgcgcggcggagcgggtggacaagtgcgttgagaagtgcgtggaagggtgcgtcggctcctcctgcgcccaccgcaagggcaagatgtgagcggccgggcgtcccacgtgaccgaccgcgggcgcgtcttcggtgcgacgtgcacacgtatcgcgttctcgtgccatccatgccgtcactccgagcatggcggcgacaataaacttttaactcctagtggagctccagtagaaccttcgttttcaatttcctttttactttttttgaggatcaagttccttttactactgcctttgtctaagtagtgtgtgcgtcccttagtttggtgaatcgtaaatgctctactgctttgttttacaaaaaaaaaaaaaaaa

SEQ ID NO: 3104 - protein, 351 aa, Triticum aestivum
  misc_feature: PFam Name: LEA_4; PFam Description: Late embryogenesis
  misc_feature: PFam Name: TolA; PFam Description: TolA protein
  misc_feature: PFam Name: Caldesmon; PFam Description: Caldesmon
  misc_feature: PFam Name: Glutenin_hmw; PFam Description: High molecular
  misc_feature: PFam Name: E-MAP-115; PFam Description: E-MAP-115 family
  misc_feature: GI Number: 66776103; NR Description: LigA [Anaeromyxobacter dehalogenans 2CP-C] >gi|66858140|ref|ZP_00402169.1| LigA
  misc_feature: GI Number: 66777445; NR Description: LigA [Anaeromyxobacter dehalogenans 2CP-C] >gi|66856850|ref|ZP_00400911.1| LigA
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66777991; NR Description: TPR repeat [Anaeromyxobacter dehalogenans 2CP-C] >gi|66856185|ref|ZP_00400253.1| TPR repeat [Anaeromyxobacter
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MSSRQDQREARAEADARRAADEIARARDERVMQAEMDARRAADEIARARADREHGALGGGAYAEHPSGGGGILGSMQEGAKSLASAVGRTFGGAKDTAADKTYQAADATGNTMGEYKDYTAEKAKETNDSVAHKTSETAEATRNKLGEAKDCTVEKATEAKDTVAQKTNETAEATKNKLGEYKDALAGKTQEAKDSTMQKAHQTKDAAAEKARQAKDVTQQKAGEYTDATKGTAQEARDRSMATTQTHDADRGQQGTGLFGALGNMTGAIKEKLTVGSGTQQHDAGGHGLRLGSEDERAVKERAAEKAASVYFEEKDRLAKERAAERVDKCVEKCVEGCVGSSCAHRKGKM

SEQ ID NO: 3105 - DNA, 1402 bp, Triticum aestivum
  misc_feature (1)..(1402): Ceres cDNA ID no. 21572704
  misc_feature (1)..(1402): Ceres CLONE  ID no. 639223
  misc_feature (1)..(1402): Also known as  Ceres CDNA ID no. 24356802
atagcctggttcagtgcgtgcctgcatcttctcagccgtcctcttcttccttcctgctactggtaacctgcgagagggcgttggcctccaatggcgagggctcctgtgtttccggcgctcctgtgcctcgcggtcctcgcgctggccggcggcgccgacgcgaggaagatggtcggcgtgtacgagctcaagagaggggatttctccgtcaagatgaccaactggggcgccaccatcatgtcgatcctcgtccctgattccaaagggaatttggctgatgttgtgctgggcatggacaccctcgctgagtatgttaatgatacctcttactttgggccgctgaatgggagggtggcgcagagaatggccaggggccgcttcgtcctcgacggcaaagtgtaccatacctacatcaacgacggaaagaacgcaattcatggtggcaaaagggggttcagcaaggtcatatggacggtgaaggagtacgtcgccggcggcgactccccatacatcaccatgtactaccgcagcttcgacggagagcaaggattccccggagacctggacgtgtacgcgacgtaccagctgacgggcccgtacgagctgagcatccgcacgaacgcgacggcgctgaacaaggcgacgccggtgaacttcctgcagcacgtgtacctgaacctgggcggggagggcagcggcgatatcctgggccacacgctccagctctccgcgtcccggtacaccccgctggacgtggagatgctcccgtcgtcgggccgcgtcgaccccgtggccggcacgagctacgacttccgcacgccgacgcccatcggcgcgcgcatccggcaggtcatgggcggcaaagtctacgggtacgacatcaactacgtcatcgacggggaaggcatgcggaaggtggcggcggtccgggacggcaagtccgggcgcgcgctggagctgtgggccaaccagccggccatgcagctctacaccggaaacttcctgaaccacaccaaggggaagggcggcaagctgtacgagcagtacggcgggttttgccttgagacccaggcgtacccggacgccgtgaaccaccccgagttcccgtcggtgacggtgaggcccggccaggtgtacaagcacgacatgcgcttcacgttctccttctagctaaggctggaatgaatatggctgcggtacggtagtaccaccattggttaatggatcgtagatgtgttccctctggatttggaggtggcgcgattcgtgggactggatgcggttatgccgtgagcccagagcggctacggtgtttgaaaaataaaatcatgcgtttgtgcagtgcaaatgatccgctcaataagaaaatggaagaaaatggtgtgcaaaaaaaaaaaaaaaa

SEQ ID NO: 3106 - protein, 359 aa, Triticum aestivum
  misc_feature: PFam Name: Aldose_epim; PFam Description: Aldose 1-epimerase
  misc_feature: GI Number: 50909807; NR Description: putative non-cell-autonomous protein pathway2; plasmodesmal receptor [Oryza sativa (japonica cultivar-group)] >gi|50725243|dbj|BAD34245.1| putative non-cell-autonomous protein pathway2; plasmodesmal
  misc_feature: GI Number: 50920801; NR Description: putative aldose 1-epimerase [Oryza sativa (japonica cultivar-group)] >gi|40882679|gb|AAR96220.1| putative aldose 1-epimerase [Oryza
  misc_feature: GI Number: 15824567; NR Description: non-cell-autonomous
  misc_feature: GI Number: 15824565; NR Description: non-cell-autonomous
  misc_feature: GI Number: 2739168; NR Description: aldose-1-epimerase-like protein [Nicotiana tabacum] >gi|7430313|pir||T01933 probable aldose
MARAPVFPALLCLAVLALAGGADARKMVGVYELKRGDFSVKMTNWGATIMSILVPDSKGNLADVVLGMDTLAEYVNDTSYFGPLNGRVAQRMARGRFVLDGKVYHTYINDGKNAIHGGKRGFSKVIWTVKEYVAGGDSPYITMYYRSFDGEQGFPGDLDVYATYQLTGPYELSIRTNATALNKATPVNFLQHVYLNLGGEGSGDILGHTLQLSASRYTPLDVEMLPSSGRVDPVAGTSYDFRTPTPIGARIRQVMGGKVYGYDINYVIDGEGMRKVAAVRDGKSGRALELWANQPAMQLYTGNFLNHTKGKGGKLYEQYGGFCLETQAYPDAVNHPEFPSVTVRPGQVYKHDMRFTFSF

SEQ ID NO: 3107 - DNA, 1221 bp, Triticum aestivum
  misc_feature (1)..(1221): Ceres cDNA ID no. 21572707
  misc_feature (1)..(1221): Ceres CLONE  ID no. 644332
  misc_feature (1)..(1221): Also known as  Ceres CDNA ID no. 24356675
atattacatcaggaaggattcgggggcagagtgttggttcctcgatccaatttcaaatttgatacctttatgtcgatcggtcgatcgatctccgccgggcagcgccaccgcactcgagtttttgtggtggcgcaagactccggcgaggtaggcaacctcgtcttcaaaatcaatctgaagcatctcttctccccctccccctccccctcccagccggaggcggaggaagaggaaccccatgcccaagcccaacccgaggccgtcgcgtgcttcaagcaaatcgaccaattcgagagcatgacgttcgcggcctctgcatctggtgacgtcatcgtcgccgctaactacgccgacagcggccggaccctgatctacgacgccgccgccggcggcgtctcccccgggccggagatgcgctccgtcaagcaccacctgttcctcgtcccggtcggagaccgcatgttcttcgccatgtccgcctactcgcgcctggacttcccccgggggggaccctggttcgaggctctgcagcagcagcccctcccctgcggcggcggcggccgctgggcctggagcgcccttcctgacctgcccggcatcgctcgtggccggagggaggacgtcagggcctacttcgtcgcgggcgcgcgcgtctggatctccctgcacctccagggcacctattcattcgacacggcgcgccaacggtggcgcaaggagggcgcctgggagctgcccgtggagggccgggcattcctggtgcccgactttctgggcagcggccggcggctgctcttcggcatctgctcctcttgggggaatcgccacttctgtgccgtcgacatggacgctaggccgccggcgatcctcaggtcctggcctgaggcacggcccaccgtcgcgtgggccgcgggatatgtaggatgctccttcctcccccaggtgagctactttgggtgcggcaggttttgcatttcgatgacgaatcagaccaacgaggagaatcgacgcagcgtcgtctccttcaaggccgtcgaggtcaccgccgagctgcagctgatcgaacgccggtccagcctctacttgatgccacaaagctcacgcgggtcgcccgctaatgtaatctagtttgccaataaatccccctttgtaaaaatccatctttgtattgtactatcaaaatcagtctgtttctctgtcaaaacaaaaaaaaaaaaaaaa

SEQ ID NO: 3108 - protein, 352 aa, Triticum aestivum
MSIGRSISAGQRHRTRVFVVAQDSGEVGNLVFKINLKHLFSPSPSPSQPEAEEEEPHAQAQPEAVACFKQIDQFESMTFAASASGDVIVAANYADSGRTLIYDAAAGGVSPGPEMRSVKHHLFLVPVGDRMFFAMSAYSRLDFPRGGPWFEALQQQPLPCGGGGRWAWSALPDLPGIARGRREDVRAYFVAGARVWISLHLQGTYSFDTARQRWRKEGAWELPVEGRAFLVPDFLGSGRRLLFGICSSWGNRHFCAVDMDARPPAILRSWPEARPTVAWAAGYVGCSFLPQVSYFGCGRFCISMTNQTNEENRRSVVSFKAVEVTAELQLIERRSSLYLMPQSSRGSPANVI

SEQ ID NO: 3109 - DNA, 1235 bp, Glycine max
  misc_feature (1)..(1235): Ceres cDNA ID no. 21572709
  misc_feature (1)..(1235): Ceres CLONE  ID no. 650874
  misc_feature (1)..(1235): Also known as  Ceres CDNA ID no. 23617127
aatcaagtaatgaacacagattagaccaataggagttggctgctttaaagttcaacgcctaaaacccaaaagcaggggaattcttcttttacacattcagttcatttccttattttctcaacaaaacaaccgagagttcgtcatatctgtatctgtatatatacctatacctatacctatatcgtatccgcatttccgaaaggatatatcttatttagggtttttgtgactgtgctccacaaccgagtcgccatggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttggaaattcagtcgcctcaactcgctttctattgcaagatgaatttaacattcaaactacgcaatgtgataattgcattattggtttcatgttttgccttcaacaaattgcatgtatattctctattgttgccatgattgtgggaagcgatgaaattcaagaggcttctcagttgctgtcttgtttggctgactttgtgtactgcacggtctgtgcatgcatgcagactcagcacaagattgagatggacaagcgagacgggaaatttggaccccaaccagcaatggcagtgcctcctatgcagcagatgtcacgcattgatcaacaagttcctccttcggttgggtatgcaccacaaccagcttatggacagcctgctcaaggatatcctgctccgggttatcctcctactggttacccccctgctgcttatcctccaccaggatatcccccttctggctaccctaagtgattggtctacagcgcaccaattgatcgtgcttcatagaacaagggaacatgtttgtggtgaaatacaacagttcgattgattaattaatttccattagtcttataattcgtgaattaaccttataatccctatcgtgatgtccattctgatacttcgacttctgtttgtatattgttcccgttggtgttcatacatagttcacatgtttcgcttgttatgtgcaaaaaaaaaaaaaa

SEQ ID NO: 3110 - protein, 248 aa, Glycine max
  misc_feature: PFam Name: PLAC8; PFam Description: PLAC8 family
  misc_feature: GI Number: 21554542; NR Description: unknown [Arabidopsis thaliana]
  misc_feature: GI Number: 41529812; NR Description: PGYRP protein [Chlamydomonas reinhardtii] >gi|41529814|emb|CAD32174.1|
  misc_feature: GI Number: 13543234; NR Description: Unknown (protein for
  misc_feature: GI Number: 9755790; NR Description: glycine/proline-rich protein [Arabidopsis thaliana] >gi|45752720|gb|AAS76258.1| At5g17650 [Arabidopsis thaliana] >gi|11357316|pir||T51469
  misc_feature: GI Number: 6469591; NR Description: unknown [Eufolliculina uhligi]
MASQESIEKMQARQNYRNLWHTDLMRSIQADTPYCCLALWCAPCVSYLLRKRALYDDMSRYTCCAGYMPCSGRCGESKCPEFCLCTEVFLCFGNSVASTRFLLQDEFNIQTTQCDNCIIGFMFCLQQIACIFSIVAMIVGSDEIQEASQLLSCLADFVYCTVCACMQTQHKIEMDKRDGKFGPQPAMAVPPMQQMSRIDQQVPPSVGYAPQPAYGQPAQGYPAPGYPPTGYPPAAYPPPGYPPSGYPK

SEQ ID NO: 3111 - DNA, 1564 bp, Glycine max
  misc_feature (1)..(1564): Ceres cDNA ID no. 21572710
  misc_feature (1)..(1564): Ceres CLONE  ID no. 657772
  misc_feature (1)..(1564): Also known as  Ceres CDNA ID no. 24356316
atacgaccacacactccaaaatgagtccgtgtcttcatctactcctacaagtactatgttgtacgttgattttgccgcatgcagtagtaacggcgttcacggtgatcatgtccgattccggcgtgccgtccaccctagttgacggtccacaaacgggattttccatgaaccaagacggttcccgaaccgacaagcgagagcaagaagcagtgtacgacatcatgcgagccaccggaaacgcttgggccaccgacatccccgacgtgtgccgcggccgctggcacggcatcgagtgcatgcccgacaaggacgacgttttccacgtcgtttccctctcattcggagcactctccgatgataccgcttttccgacatgcgacccaacccgctccttcatctcagcctccatcgccaacctccctcacctcaagaccttgttcttttaccgttgtttcagttacaaccctcagcccatcccatccttcttgggcctattgggcccgtccttgcaaaccttggtcctcagagaaaacggccacgttgggcccattcctgttgaattgggcaacctcacccgtttgagggtacttgatcttcacaaaaacaacctcaacggctccatacccatctccttgggccgtatcactggtttaaggtctttggatttaagcggcaacaaaataaccggttccatacccggttttgccttcccctctttgaacgtattggaccttagccagaaccttctcatgggctcaattccttctaccttttgggactgctactctctcatcaaattggatttcagtcgcaaccggctcgtgggcccattgccggagaagcccatgggcctgaaggatctcatgcttttggatttaagctacaatcgtatccaaggcccatttccgggatcactcaagagcctgagttctcttcaggccttgatcctcaaaggaaacccaatgggctcgacgagcatacccgatgatgggttcgatggtatgaaggccctaatgatccttgttttgtctaatatgaattggcatgggccggtcccagaatcactaggcaagttgcgaaaccttcgggtgcttcatctggatggcaaccacttcaatgggtcaattccgaagagttttcgagatttgagaagccttagtgaattgaggctgaatgataatgggcttattgggtcggtcccatttgacagagaaatggtatggaggatgaaaaggaagctaaggttgaataataattcagggctttgctatgatgcaagtagtggtttaggggatagcatggattccacatttgatttaggtatcagtttgtgtgacacttcgaatccagggtcggttaggacagtgcaacatctttcggctacccaaaagttaatgcccgtcacatcagatgctgtggaagcacttacttcatggtcactgggactaactacttttgtactgtttttctataattttgttgtcagttgtaaatattcatatcaatagcaaaagaatctcaggatgcccttgtcagcacctaggaagcaaaaaaaaaaaaaaaa

SEQ ID NO: 3112 - protein, 495 aa, Glycine max
  misc_feature: GI Number: 34912808; NR Description: P0501G01.13 [Oryza sativa (japonica cultivar-group)] >gi|12313679|dbj|BAB21084.1|
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 34894182; NR Description: P0439B06.12 [Oryza
  misc_feature: GI Number: 15230865; NR Description: leucine rich repeat
  misc_feature: GI Number: 48843812; NR Description: putative leucine-rich
MSPCLHLLLQVLCCTLILPHAVVTAFTVIMSDSGVPSTLVDGPQTGFSMNQDGSRTDKREQEAVYDIMRATGNAWATDIPDVCRGRWHGIECMPDKDDVFHVVSLSFGALSDDTAFPTCDPTRSFISASIANLPHLKTLFFYRCFSYNPQPIPSFLGLLGPSLQTLVLRENGHVGPIPVELGNLTRLRVLDLHKNNLNGSIPISLGRITGLRSLDLSGNKITGSIPGFAFPSLNVLDLSQNLLMGSIPSTFWDCYSLIKLDFSRNRLVGPLPEKPMGLKDLMLLDLSYNRIQGPFPGSLKSLSSLQALILKGNPMGSTSIPDDGFDGMKALMILVLSNMNWHGPVPESLGKLRNLRVLHLDGNHFNGSIPKSFRDLRSLSELRLNDNGLIGSVPFDREMVWRMKRKLRLNNNSGLCYDASSGLGDSMDSTFDLGISLCDTSNPGSVRTVQHLSATQKLMPVTSDAVEALTSWSLGLTTFVLFFYNFVVSCKYSYQ

SEQ ID NO: 3113 - DNA, 1753 bp, Glycine max
  misc_feature (1)..(1753): Ceres cDNA ID no. 21572711
  misc_feature (1)..(1753): Ceres CLONE  ID no. 661641
  misc_feature (1)..(1753): Also known as  Ceres CDNA ID no. 23691829
attttaaacttaccaccttcattacatcttacattcgcgtgattcctgaaaaatacaaaatttgaggaacatttgtctctcatcaatggctgccacgagaccggtgcagtgtttgttacgaagggtttgcagaggaagtaggactattggggttgccacagaagttaatgcttcttcttcttctcagaaaatcatcgacaaggaatatgaacacagtgctcacaattaccatcctcttccgattgtatttgctcaagcaaagggaacctctgtttgggatccagagggaaacaaatatcttgattttctatcaggttactctgctgttaatcagggacactgccatcctaaaattctgaaagcattgcaagaacaggcagaaaggttgactgtgagctctcgagccttctacaatgatcgcttcccagactttgctgagtatgtgacaaacatgtttggttatgatatggtacttcctatgaataccggtgctgaaggtgtggaaacagcactgaagttagcacgaaagtggggttacgaaaagaaaagaattcccaaagatgaggctattattgtctcatgttgtggctgcttccatggtcgtacactaggtgtcatatctttgagctgtgacaatgaagctacccgtggttttggtcctttattacctggcaatcttaaagttgattttggtgatgcagaagcccttgaacaaatttttaaagaaaaaggagagcacatagctgcatttattttagaacctgtccaaggtgaagctggggtgatatttcctccagatggttatttaaaagctgttagagatctttgctccaaatataatgtcttgatgattgctgatgaaattcaaactgggttagcaagaacggggaagatgctggcttgtgagtgggaagaagttcgcccagatgttctgatactagggaaagcattgggtggaggagttataccagttagtgcagttcttgcagacaaagatgtgatgctttgtatacaacctggacagcatggaagtacctttggtggaaatccaatggccagtgcagttgcaattgcctctctagaagtaataaaaaatgagagactcgttgagagatctgcccaaatgggagaggagcttactggtcagctgcttaagattcagcagcaatacccagactatgtgaaggaggtacggggaagaggattgttcattggagtggagtttaacagcaaaaaattgttcccagtatcaggctatgagctatgcaaaaaattgaagtatagaggagtccttgccaagccaacacatgatgcaattatccgctttactcccccactttgcataagtgtggatgagatccaacaaggttccaaggcactggctgatgttctggaaattgatctaccaaagttgcagaagacaaagccaatagatgctgctccagttgccactagtgcatgcgatcgttgtggtagagtcttgtattaaccataaaaagacacgtatgaattgcatgtgcctttagttttccttggaaaaaaatatatcacatgaagaatgttactccttatacatgaacagctggaaactatgttccaatattccatatatcatcataatataagttcatgatatatgtgataggtagctgtataaataaatatataggagttagaggactcattgtataactttcaatggttaatttgcgagataagatatatgattttattatggcaaaaaaaaaaaaaa

SEQ ID NO: 3114 - protein, 467 aa, Glycine max
  misc_feature: PFam Name: Aminotran_3; PFam Description: Aminotransferase
  misc_feature: GI Number: 9757738; NR Description: ornithine aminotransferase [Arabidopsis thaliana] >gi|15237392|ref|NP_199430.1| ornithine aminotransferase, putative / ornithine--oxo-acid aminotransferase, putative [Arabidopsis
  misc_feature: GI Number: 27527063; NR Description: ornithine
  misc_feature: GI Number: 9957234; NR Description: ornithine
  misc_feature: GI Number: 53749407; NR Description: ornithine--oxo-acid
  misc_feature: GI Number: 57230112; NR Description: ornithine-oxo-acid transaminase, putative [Cryptococcus neoformans var. neoformans JEC21] gi|58261240|ref|XP_568030.1| ornithine-oxo-acid transaminase, putative [Cryptococcus neoformans var. neoformans
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPMASAVAIASLEVIKNERLVERSAQMGEELTGQLLKIQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 3115 - DNA, 1220 bp, Glycine max
  misc_feature (1)..(1220): Ceres cDNA ID no. 21572712
  misc_feature (1)..(1220): Ceres CLONE  ID no. 661878
  misc_feature (1)..(1220): Also known as  Ceres CDNA ID no. 25088273
aaaaattcattcccttctctcgatggaggcaaagtcactgctcaagggttcatcacttaaaccttcttatcccatccataagctttcaaaaaccacgatgatgacacccaactgcgttagattcagtttcaactacaactcatgcctcatattcgcaaatgggtacccttcttcttcacttccactttctcttcagaataagcccagaaaatcggcatcagtggttgtgagtgcccgaaggaaagacaagaaagaagatacccatagctctgttcccaaacccgacgaggtcactggtttcttccccgaagctgtgctccttaaaaagagaacagttgaggaagaagggaagcttctcccggagtttgaagatgctgatgaaagagaactctttgaagcgctgatgcttgagctggatagtgatatggatgttgatatattgcgccactatgaggttatgtacttaattcatgagaagcatgaagaggaggttgtagctgtcaatgagaaaattcaagactttttgagggagaagaaaggtcaggtttggagattgaatgattggggtatgagaaggctagcttacaaaataaaaaaagctaacaatgcccactacatgttgataaactttgagttggatgccaaatatatcaacgatttcaagactctgttggaccaagatgaaagagttattcggcatctggtgataaagagggatgaggcaatcactgaagattgccctcctcctccggattttcatacactgcgtggaaatgcagatgatgatgaggacgaagaatttgatgaagattatgatggtgactgggatggtgaagatgaggaggatggcgatgaaggcgaggatgatattatttttgtagatggtgatgaagatgatatagattctagaaaacagacatcagcaaatgttagacaaccagatataagaaaattgagggctgagaacgtaagtaggtaagtggatgctatcttatatcctttgattcttttgttcatttgtttccataggaatgcagagcagttctaaactttatggctctaactataggaatatctaagtaactagagtttcttgtttgcttatatggtcatatataaaatgtttgtgtgatgaatagcaaggggttgctgataccagcaaacacagaaaatgaaaaagattcgcaatgtcaaattcatacagaaaaaaaaaaaaaaaa

SEQ ID NO: 3116 - protein, 1220 aa, Glycine max
  misc_feature: PFam Name: Ribosomal_S6; PFam Description: Ribosomal protein S6
  misc_feature: PFam Name: Upf2; PFam Description: Up-frameshift suppressor 2
  misc_feature: GI Number: 20856347; NR Description: AT3g17170/K14A17_29 [Arabidopsis thaliana] >gi|15620810|dbj|BAB67768.1| RPS6-like protein [Arabidopsis thaliana] >gi|18377866|gb|AAL67119.1| AT3g17170/K14A17_29 [Arabidopsis thaliana]
  misc_feature: GI Number: 21553777; NR Description: unknown [Arabidopsis thaliana]
  misc_feature: GI Number: 29654191; NR Description: ribosomal protein S6 [Coxiella burnetii RSA 493] >gi|29541457|gb|AAO90397.1| ribosomal
  misc_feature: GI Number: 48732176; NR Description: COG0360: Ribosomal
  misc_feature: GI Number: 49076654; NR Description: PA4935 [synthetic construct]
AAAAATTCATTCCCTTCTCTCGATGGAGGCAAAGTCACTGCTCAAGGGTTCATCACTTAAACCTTCTTATCCCATCCATAAGCTTTCAAAAACCACGATGATGACACCCAACTGCGTTAGATTCAGTTTCAACTACAACTCATGCCTCATATTCGCAAATGGGTACCCTTCTTCTTCACTTCCACTTTCTCTTCAGAATAAGCCCAGAAAATCGGCATCAGTGGTTGTGAGTGCCCGAAGGAAAGACAAGAAAGAAGATACCCATAGCTCTGTTCCCAAACCCGACGAGGTCACTGGTTTCTTCCCCGAAGCTGTGCTCCTTAAAAAGAGAACAGTTGAGGAAGAAGGGAAGCTTCTCCCGGAGTTTGAAGATGCTGATGAAAGAGAACTCTTTGAAGCGCTGATGCTTGAGCTGGATAGTGATATGGATGTTGATATATTGCGCCACTATGAGGTTATGTACTTAATTCATGAGAAGCATGAAGAGGAGGTTGTAGCTGTCAATGAGAAAATTCAAGACTTTTTGAGGGAGAAGAAAGGTCAGGTTTGGAGATTGAATGATTGGGGTATGAGAAGGCTAGCTTACAAAATAAAAAAAGCTAACAATGCCCACTACATGTTGATAAACTTTGAGTTGGATGCCAAATATATCAACGATTTCAAGACTCTGTTGGACCAAGATGAAAGAGTTATTCGGCATCTGGTGATAAAGAGGGATGAGGCAATCACTGAAGATTGCCCTCCTCCTCCGGATTTTCATACACTGCGTGGAAATGCAGATGATGATGAGGACGAAGAATTTGATGAAGATTATGATGGTGACTGGGATGGTGAAGATGAGGAGGATGGCGATGAAGGCGAGGATGATATTATTTTTGTAGATGGTGATGAAGATGATATAGATTCTAGAAAACAGACATCAGCAAATGTTAGACAACCAGATATAAGAAAATTGAGGGCTGAGAACGTAAGTAGGTAAGTGGATGCTATCTTATATCCTTTGATTCTTTTGTTCATTTGTTTCCATAGGAATGCAGAGCAGTTCTAAACTTTATGGCTCTAACTATAGGAATATCTAAGTAACTAGAGTTTCTTGTTTGCTTATATGGTCATATATAAAATGTTTGTGTGATGAATAGCAAGGGGTTGCTGATACCAGCAAACACAGAAAATGAAAAAGATTCGCAATGTCAAATTCATACAGAAAAAAAAAAAAAAAA

SEQ ID NO: 3117 - DNA, 1951 bp, Glycine max
  misc_feature (1)..(1951): Ceres cDNA ID no. 21572713
  misc_feature (1)..(1951): Ceres CLONE  ID no. 664576
  misc_feature (1)..(1951): Also known as  Ceres CDNA ID no. 24356272
acgatgtgccatcatcctattctgttgcctttgcaagtttaggaattaaccttctttggctcccacaatttttcacttggcagttcattctttctaatggcaatattctccactctactactttacttcggatacatcgtacatgtataaataaatacacaccctttttttttcttcttcgatcttcatccttctccgttcatttctgtactactcgaactcggtaagcctctctttgtttatgtgatctgcattgcatgcatatgcaaatgggtgtcatgggcaaggcaagatccgttgcagcaacgagtgggagaatattgaacgaggcagtgagcttcgttgctttctgcgtgctcgaccttgtcgattttcttctatgttttgttttcaaagctgtggatttgtgggttgaggcagagttcagaccctgctattgttcctcggcgaaggaagcaataacgagcagtgggaagatcttggtttcagagcaaggtggagaatccaagatcgtgtcccttcttagctcaacgaagcttcagttggaggacatctctgataccctctactctagaccctctttggtctctgaggtctcgaggctaaccattaatgagcttaagaggctcaagttggaggacccggttttgcagtccaagagaggaaactcgcgctgttccacgttcactgtcaacaccaccattgttgaaatgctacagggtaagattggaagacaccttactcaccccattcctagatggtctgactgtgattgcaaactatgcacaagttggatctcaactccatcctctcctcatgataataccaccaatgccaaagccactctctttgttaagtcccaatgccccatcacagatgaagggggagaagatgtggtgttcatacatgggttcatatcatcgtcattattttggagcgagacagtgttcccaaacatgtcgagtgctgcaaagtcgtgttaccggttatttgcggttgatctgcttgggtttgggaggagtccaaagccgagcgagtcgctgtacacattaagagagcatttagagatgatagagaggtcggtgttggaggcccataaggttaagtccttccacattgtggcccattcccttggatgcattctagcacttgcccttgccgtcaaacaccctcaatctgtcaagtcactcaccttgcttgccccgcccttctatccggtgccaaagggtgaaacacaggctactcaatatgtcatgagaaaggttgctccaaggcgcgtgtggccacccatggcgtttggagcgtccttggcatgctggtacgaacacataactagggtcatttgcttgctcatttgcaagaaccaccgtctctgggaatttctagccaaactcatcactcgaaacagggtcaggacgttcttgcttgaagggttcttttgccacactcacaacgcggcatggcataccctacacaacattatatgtggaaccgcggggaaaattggatcctatttggaggctgttagagaaaaccgtaattgcaaagtgaccatatttcatggcaaaaacgatgaagtgatcccagttgaatgcagctacgaggtgcaaaaacgaattccacgtgcccaagttagagttattgacaacaaagaccacataactattgttgttggaagacagaaagcctttgctcgagagttggaggagatttggggcactactactaccaaccacaactagataattactatatgctgcacgttgtgccaatgcacttacgtccagacctacaactactggattaaatttatgttcaaactttccctctgtcgtcaaccccaagtgtttgtatctttttcttataagaaaaatgtctatttaacactagtttggataattaaatcacataacctgctataaagcaaaagagagtaaaaaaaaaaaaaaaa

SEQ ID NO: 3118 - protein, 1951 aa, Glycine max
  misc_feature: PFam Name: Abhydrolase_1; PFam Description: alpha/beta
  misc_feature: GI Number: 6633825; NR Description: F1N19.24 [Arabidopsis thaliana]
  misc_feature: GI Number: 53764136; NR Description: COG0596: Predicted hydrolases or acyltransferases (alpha/beta hydrolase superfamily)
  misc_feature: GI Number: 21224596; NR Description: putative epoxide hydrolase [Streptomyces coelicolor A3(2)] >gi|13940314|emb|CAC37878.1| putative epoxide hydrolase
ACGATGTGCCATCATCCTATTCTGTTGCCTTTGCAAGTTTAGGAATTAACCTTCTTTGGCTCCCACAATTTTTCACTTGGCAGTTCATTCTTTCTAATGGCAATATTCTCCACTCTACTACTTTACTTCGGATACATCGTACATGTATAAATAAATACACACCCTTTTTTTTTCTTCTTCGATCTTCATCCTTCTCCGTTCATTTCTGTACTACTCGAACTCGGTAAGCCTCTCTTTGTTTATGTGATCTGCATTGCATGCATATGCAAATGGGTGTCATGGGCAAGGCAAGATCCGTTGCAGCAACGAGTGGGAGAATATTGAACGAGGCAGTGAGCTTCGTTGCTTTCTGCGTGCTCGACCTTGTCGATTTTCTTCTATGTTTTGTTTTCAAAGCTGTGGATTTGTGGGTTGAGGCAGAGTTCAGACCCTGCTATTGTTCCTCGGCGAAGGAAGCAATAACGAGCAGTGGGAAGATCTTGGTTTCAGAGCAAGGTGGAGAATCCAAGATCGTGTCCCTTCTTAGCTCAACGAAGCTTCAGTTGGAGGACATCTCTGATACCCTCTACTCTAGACCCTCTTTGGTCTCTGAGGTCTCGAGGCTAACCATTAATGAGCTTAAGAGGCTCAAGTTGGAGGACCCGGTTTTGCAGTCCAAGAGAGGAAACTCGCGCTGTTCCACGTTCACTGTCAACACCACCATTGTTGAAATGCTACAGGGTAAGATTGGAAGACACCTTACTCACCCCATTCCTAGATGGTCTGACTGTGATTGCAAACTATGCACAAGTTGGATCTCAACTCCATCCTCTCCTCATGATAATACCACCAATGCCAAAGCCACTCTCTTTGTTAAGTCCCAATGCCCCATCACAGATGAAGGGGGAGAAGATGTGGTGTTCATACATGGGTTCATATCATCGTCATTATTTTGGAGCGAGACAGTGTTCCCAAACATGTCGAGTGCTGCAAAGTCGTGTTACCGGTTATTTGCGGTTGATCTGCTTGGGTTTGGGAGGAGTCCAAAGCCGAGCGAGTCGCTGTACACATTAAGAGAGCATTTAGAGATGATAGAGAGGTCGGTGTTGGAGGCCCATAAGGTTAAGTCCTTCCACATTGTGGCCCATTCCCTTGGATGCATTCTAGCACTTGCCCTTGCCGTCAAACACCCTCAATCTGTCAAGTCACTCACCTTGCTTGCCCCGCCCTTCTATCCGGTGCCAAAGGGTGAAACACAGGCTACTCAATATGTCATGAGAAAGGTTGCTCCAAGGCGCGTGTGGCCACCCATGGCGTTTGGAGCGTCCTTGGCATGCTGGTACGAACACATAACTAGGGTCATTTGCTTGCTCATTTGCAAGAACCACCGTCTCTGGGAATTTCTAGCCAAACTCATCACTCGAAACAGGGTCAGGACGTTCTTGCTTGAAGGGTTCTTTTGCCACACTCACAACGCGGCATGGCATACCCTACACAACATTATATGTGGAACCGCGGGGAAAATTGGATCCTATTTGGAGGCTGTTAGAGAAAACCGTAATTGCAAAGTGACCATATTTCATGGCAAAAACGATGAAGTGATCCCAGTTGAATGCAGCTACGAGGTGCAAAAACGAATTCCACGTGCCCAAGTTAGAGTTATTGACAACAAAGACCACATAACTATTGTTGTTGGAAGACAGAAAGCCTTTGCTCGAGAGTTGGAGGAGATTTGGGGCACTACTACTACCAACCACAACTAGATAATTACTATATGCTGCACGTTGTGCCAATGCACTTACGTCCAGACCTACAACTACTGGATTAAATTTATGTTCAAACTTTCCCTCTGTCGTCAACCCCAAGTGTTTGTATCTTTTTCTTATAAGAAAAATGTCTATTTAACACTAGTTTGGATAATTAAATCACATAACCTGCTATAAAGCAAAAGAGAGTAAAAAAAAAAAAAAAA

SEQ ID NO: 3119 - DNA, 1384 bp, Glycine max
  misc_feature (1)..(1384): Ceres cDNA ID no. 21572714
  misc_feature (1)..(1384): Ceres CLONE  ID no. 668022
  misc_feature (1)..(1384): Also known as  Ceres CDNA ID no. 24727133
aagcaaagcttattgagtcttccctcctttgcataacaattattcctctctcttctcttctcttctcttctcccatggcttattccattcctctcatcatcaccttcttcttcttcctcttcggcactctctcccacgctcaagcccctgcatctttcctaatcccagtcaccaaagacgcttcaactctccaatacataacaacactttcatatggcacccctttggttcccaccccactggtgcttgatttaggaggtccttttctctggcttcactgtgcatcacgcaacacaccttcatcttcttccctcaccacccctcaccgttcccttcaatgcttcactgccaaaacccacaaatccaccaactcctttctctccagccccgtcgacgaagtcgaccagtaccaaccatgccaagtgttccccgaaaacagcatcaccggaaccatcgccgccgaaggagaactcgtggaagacctcatggcccttcaatcagccaaagaaaaaggacaacttgtggaacaccagagccgtttcacgtgttccccgaccaccctcttacacggcctcgccaagggtgccagaggcatggttggtctcggtaggtcccgcagctcgcttccttctcaggttttcgacaacttcagcacgcaccgaaaactcactctctgcctttcctcctccaaaggcgttgtcctcttgggcaacgtggcaacctacgagtccgaggttcttaaatctctcaccttcacaccccttgtcaccagcttccccacgcaggaatacttcatcaacgttaactccgtcaaaatcaacggtaagaggctgtccaacgagcatgagggtggtggaggggttttaactcttttgagcacaattgtgccctacaccaccatgcagagttccatctataactctttcaagacatcttttgaagatgctgctgtggctatgaacatcaccagagtggcctcggtggcaccctttgagctttgtttcagttccaggggctcgcaagtggggcccagtatgccggttattgagttggtgctgcagagtgagatggtgaagtggaccatacatggaagaaactccatggtgagagtgagcgatgaagtactgtgcttggggttcttggatggaggtgtgaaccccagaaactccattgtgattggagggtatcaattggaggatgtcatagtgcagtttgatttagccacttccatggtgggatttagttcctcccttgtcgccaaaaataccaagtgttccgattttaaatatgccagttccataactgcagactcgatttgaatattttaaccccccgctttgaggatgggctttctagtcctaaaaaaaaaaaaaaaaaaaaaaaa

SEQ ID NO: 3120 - protein, 414 aa, Glycine max
  misc_feature: PFam Name: Asp; PFam Description: Eukaryotic aspartyl protease
  misc_feature: GI Number: 32482806; NR Description: putative xyloglucanase
  misc_feature: GI Number: 7488910; NR Description: dermal glycoprotein precursor, extracellular - carrot (fragment)
  misc_feature: GI Number: 21537233; NR Description: EDGP precursor
  misc_feature: GI Number: 11191819; NR Description: conglutin gamma [Lupinus
  misc_feature: GI Number: 1401240; NR Description: 7S seed globulin precursor
MAYSIPLIITFFFFLFGTLSHAQAPASFLIPVTKDASTLQYITTLSYGTPLVPTPLVLDLGGPFLWLHCASRNTPSSSSLTTPHRSLQCFTAKTHKSTNSFLSSPVDEVDQYQPCQVFPENSITGTIAAEGELVEDLMALQSAKEKGQLVEHQSRFTCSPTTLLHGLAKGARGMVGLGRSRSSLPSQVFDNFSTHRKLTLCLSSSKGVVLLGNVATYESEVLKSLTFTPLVTSFPTQEYFINVNSVKINGKRLSNEHEGGGGVLTLLSTIVPYTTMQSSIYNSFKTSFEDAAVAMNITRVASVAPFELCFSSRGSQVGPSMPVIELVLQSEMVKWTIHGRNSMVRVSDEVLCLGFLDGGVNPRNSIVIGGYQLEDVIVQFDLATSMVGFSSSLVAKNTKCSDFKYASSITADSI

SEQ ID NO: 3121 - DNA, 1346 bp, Triticum aestivum
  misc_feature (1)..(1346): Ceres cDNA ID no. 21572716
  misc_feature (1)..(1346): Ceres CLONE  ID no. 677588
  misc_feature (1)..(1346): Also known as  Ceres CDNA ID no. 23475531
aagagccctatagcccaaatggcagctctcctgaaccctacggctcggcgcctcaccctcgctgcctgccgccgcctctctacggcgccggcggtggagcccctcgtggctcactggagcacccaagcaagatacaattccagtctggtggaggttaatggcggatttggggagatggttgccgacacaaagaggtactacgtgcttggaggcaaaggtggtgttgggacaacaagcatggcagcatcgcttgctatgaagtttgccaaccatggtgaaccgacgctcatagtttctatgcacccagcacattcactgggtgatacatttgaacaagacctgagtggcggtaatattgtacctgtcaatggagtcgactctctttttgctgccgagattggccatgttaatacaaaggaggaatcttctaatagtggatcttttatgcgtaatatactggacaagatagggcttggagtccttgctgatccgctgggaaagaataagctgcatgaaatgctgatgaaaactcctggatttggagaagccgttgcaatttcgaagctgatgcaaatcgtcgaactgcaagagagcaataaatttaggcgcatagttttggataccgcggcaactgggcatacacttaaccttttatctgctacaactttaatggagaagctccttggtatggccaataaggctgtgaatttagcgtcatccttcccagctcttaaatcagctttcgggaaagaccaaatagatcctgccaggatagaggtgctaagaaagcagattgccagagtacatgagcttatgcaagatccacaatcaactgaatttatcattctgacgattcctacggtgatggctatcaccgagtcgtcaaggtttcatgcatctttgaagaaggatggtgcgtcagcaacaaggcttgtcgtaaatcaagtattgcccccctctacatctgagtgcagattttgttctacaaaacgcaaggaagaagcacgtgccctgaatatgataagcaatgatcgtgaacttggcggcctagagctaatccaagcgccacttctcgatgtggaggtcagaggcgcccctgctctcagattcttcggcgatgtggtctggaaatagacgctaggatgccaggccgtgacgagaattttgttatttcatctgaaactccacagtactggtggcggcactcaaattgtctagaaatgtggttgaatctggagaaaagatgaaacccagcaggataccagactgttcaggctgtagacgtttggtaggttcttaaataagaaacggagtattagttgctgccctcaaaaaaaaaaaaaaaa

SEQ ID NO: 3122 - protein, 1346 aa, Triticum aestivum
  misc_feature: PFam Name: ArsA_ATPase; PFam Description: Anion-transporting
  misc_feature: GI Number: 30681260; NR Description: anion-transporting
  misc_feature: GI Number: 9759337; NR Description: arsenite translocating
  misc_feature: GI Number: 5824321; NR Description: ATPase [Solanum tuberosum]
  misc_feature: GI Number: 6056208; NR Description: putative ATPase
  misc_feature: GI Number: 50912707; NR Description: putative ATPase [Oryza sativa (japonica cultivar-group)] >gi|46390107|dbj|BAD15543.1| putative ATPase [Oryza sativa (japonica cultivar-group)] >gi|46390644|dbj|BAD16127.1| putative ATPase [Oryza sativa
AAGAGCCCTATAGCCCAAATGGCAGCTCTCCTGAACCCTACGGCTCGGCGCCTCACCCTCGCTGCCTGCCGCCGCCTCTCTACGGCGCCGGCGGTGGAGCCCCTCGTGGCTCACTGGAGCACCCAAGCAAGATACAATTCCAGTCTGGTGGAGGTTAATGGCGGATTTGGGGAGATGGTTGCCGACACAAAGAGGTACTACGTGCTTGGAGGCAAAGGTGGTGTTGGGACAACAAGCATGGCAGCATCGCTTGCTATGAAGTTTGCCAACCATGGTGAACCGACGCTCATAGTTTCTATGCACCCAGCACATTCACTGGGTGATACATTTGAACAAGACCTGAGTGGCGGTAATATTGTACCTGTCAATGGAGTCGACTCTCTTTTTGCTGCCGAGATTGGCCATGTTAATACAAAGGAGGAATCTTCTAATAGTGGATCTTTTATGCGTAATATACTGGACAAGATAGGGCTTGGAGTCCTTGCTGATCCGCTGGGAAAGAATAAGCTGCATGAAATGCTGATGAAAACTCCTGGATTTGGAGAAGCCGTTGCAATTTCGAAGCTGATGCAAATCGTCGAACTGCAAGAGAGCAATAAATTTAGGCGCATAGTTTTGGATACCGCGGCAACTGGGCATACACTTAACCTTTTATCTGCTACAACTTTAATGGAGAAGCTCCTTGGTATGGCCAATAAGGCTGTGAATTTAGCGTCATCCTTCCCAGCTCTTAAATCAGCTTTCGGGAAAGACCAAATAGATCCTGCCAGGATAGAGGTGCTAAGAAAGCAGATTGCCAGAGTACATGAGCTTATGCAAGATCCACAATCAACTGAATTTATCATTCTGACGATTCCTACGGTGATGGCTATCACCGAGTCGTCAAGGTTTCATGCATCTTTGAAGAAGGATGGTGCGTCAGCAACAAGGCTTGTCGTAAATCAAGTATTGCCCCCCTCTACATCTGAGTGCAGATTTTGTTCTACAAAACGCAAGGAAGAAGCACGTGCCCTGAATATGATAAGCAATGATCGTGAACTTGGCGGCCTAGAGCTAATCCAAGCGCCACTTCTCGATGTGGAGGTCAGAGGCGCCCCTGCTCTCAGATTCTTCGGCGATGTGGTCTGGAAATAGACGCTAGGATGCCAGGCCGTGACGAGAATTTTGTTATTTCATCTGAAACTCCACAGTACTGGTGGCGGCACTCAAATTGTCTAGAAATGTGGTTGAATCTGGAGAAAAGATGAAACCCAGCAGGATACCAGACTGTTCAGGCTGTAGACGTTTGGTAGGTTCTTAAATAAGAAACGGAGTATTAGTTGCTGCCCTCAAAAAAAAAAAAAAAA

SEQ ID NO: 3123 - DNA, 1234 bp, Triticum aestivum
  misc_feature (1)..(1234): Ceres cDNA ID no. 21572717
  misc_feature (1)..(1234): Ceres CLONE  ID no. 678957
  misc_feature (1)..(1234): Also known as  Ceres CDNA ID no. 24356811
atctaccactccaagctaagctcagtttcaagtaagaaagaaaagcaagccatggcttcttcagccgtcctgctacttattctgatggttgtggccgcgacggtgcatggccacacccatacccctggaggcactccggcggcactgttctgggaggcggccctcccggactcgccgatgcccgagtccatcgcccacctcgtgcagaagggcaccgatcactcgccgctccagcagcaccattctgccgccatgatcctgcccaacgcgtgcctcggctactcctacaggatcatatgcaatagtcctgcccaacaggcgtcgtctgtggaaggcctcttcttccgcgagtccgacatgcgtgtggggcgcaccatgacggttgccctgccggcgttcgacccggcgccgttcctcccgcgcaaagctgccgagaggattcccttcggcaacctcgcggatgccctctataggttcggcatcacgccgggctcccaagaggcggcccgggtaggcgagacactgagcgcctgccgcgaggcgcctctcgccggctcacggaaggcgtgcgccacgtcgctggagggggtcgtgctgagcgccacgcgtatgctggcgacgagccggcccttggtcgcggcggcgtccgcacttcccaactccggcctgccgcgccgcacgtacactgtgcaggctatcaagccactaggcggaggaggcggcggctacgtggcatgccacagcagggcttacccgtacgctgtgtacgagtgccacatgatggagggctcgtccgaggaggcgtacgtcgtctccatccgcggcggcagcggcctccctaccgtggacatggcggcggtgtgccacttcgacacctctaattggatcccagctcacccagccttcaagatcctgggcacccaccccggcggctcgcccgtgtgccactttcttccctacgccgacctcatgttcggcgtgaagatggccgacaatgcatagaatcttaacaacaaactacgtacaagcagagatgacctaaatgtcattagcaagaataaaaagtactcgtagtctatttgatcattatctatccgtaagttggctataccccatatctttatctttatctttacctaaaaataaagggaggaagttttcatagttctccatacgtcaccgctttatatctgttaattttatgttaatcaccgaatcaaaaaaaaaaaaaaaa

SEQ ID NO: 3124 - protein, 316 aa, Triticum aestivum
  misc_feature: PFam Name: BURP; PFam Description: BURP domain
  misc_feature: GI Number: 50947257; NR Description: putative dehydration-responsive protein RD22 precursor [Oryza sativa (japonica cultivar-group)] >gi|38567635|emb|CAE02617.1| RAFTIN1 protein [Oryza sativa (japonica cultivar-group)]
  misc_feature: GI Number: 15967095; NR Description: A2-134 [Panicum maximum]
  misc_feature: GI Number: 38567627; NR Description: RAFTIN1a protein [Triticum aestivum] >gi|38567625|emb|CAE02612.1| RAFTIN1a anther
  misc_feature: GI Number: 38567631; NR Description: RAFTIN1b protein [Triticum aestivum] >gi|38567629|emb|CAE02614.1| RAFTIN1b protein
  misc_feature: GI Number: 50933309; NR Description: 'putative dehydration-responsive protein, contains BURP domain, PF03181' [Oryza sativa (japonica cultivar-group)] >gi|48843767|gb|AAT47026.1| 'putative dehydration-responsive
MASSAVLLLILMVVAATVHGHTHTPGGTPAALFWEAALPDSPMPESIAHLVQKGTDHSPLQQHHSAAMILPNACLGYSYRIICNSPAQQASSVEGLFFRESDMRVGRTMTVALPAFDPAPFLPRKAAERIPFGNLADALYRFGITPGSQEAARVGETLSACREAPLAGSRKACATSLEGVVLSATRMLATSRPLVAAASALPNSGLPRRTYTVQAIKPLGGGGGGYVACHSRAYPYAVYECHMMEGSSEEAYVVSIRGGSGLPTVDMAAVCHFDTSNWIPAHPAFKILGTHPGGSPVCHFLPYADLMFGVKMADNA

SEQ ID NO: 3125 - DNA, 1378 bp, Triticum aestivum
  misc_feature (1)..(1378): Ceres cDNA ID no. 21572718
  misc_feature (1)..(1378): Ceres CLONE  ID no. 683310
  misc_feature (1)..(1378): Also known as  Ceres CDNA ID no. 24356535
agaacccggggagcgcgtgaggttttggttcttgaatcttgagaggcgaaagagaaagaaaggaagagagagcgacgccttgagagcaccagactgcgcagcaatggcgatgaaggcgaggttgttggcggcggcggcgacgtgcgtctgcctggcggcggcggcctccgccttcgacgtgccgaccgtggccttcgaggaagggttctcgccgctgttcggggacggcaaccttgtccgcgcgcgggatgacagggccgcccgcctcttgctcgatcgccgctccggttcgggattcatctcctcggattactacctgcacggcttcttcagcgcgtccatcaagctgcccagggactacacggccggcgtcgtcgtcgccttctacctgtcgaacggggacgtgtacgagaagacgcacgacgagctggacctcgagttcctgggcagccggtggggcgggcagtggcgggtgcagaccaacgtctacggcaacggcagcaccagccgcggccgggaggagcgctacctcctccccttcgaccccaccctcgaggcccaccgctactccatcctctgggcccccacccacatcatattctacgtggacgacacgccgatccgcgaggtggtccggcaccccggcatgggcggggacttcccggccaagcccatggcggtgtacgccaccatctgggacggctccgcctgggccacggagggcggcaagtacaaggtcaactacaagtacgcgcccttcgcctccgacttctccgacctctccctccgaggatgccgcgtcgccgacccggcggcgctgagcagcgacgccgccggcgggtgcgacctcctgaggctcatgacggccgactacgcggtcatgaccccgcagaagcgcgccgccatgcgcgcgttccgggcgcgccagatgacctacacggtctgctacgacgcggcgcggtacgcggccggcccgttcccggagtgcgacaactcggacgaggagaggggcacgttctgggcgtggggcgagtccaagaccgtggtcatgaagacgcgcggccgcgggcgccgcggccgggggagcaggaccggcgccggagcaaggggacgcgccggcgcggcgagcagctgagctcttacttgacaggacactaatggctatggatttgattgatttttgggcggcgttatatgatttcggtgtctctgtataggttggtcgtagggattagtagctcattgttttttactgctaggagtattactattctttgattcgttggatggcagctaataatatgatcagattattactatggctactttcggttttttttcttcaaaagcaccattttcagcaaaaaaaaaaaaaaaa

SEQ ID NO: 3126 - protein, 343 aa, Triticum aestivum
  misc_feature: PFam Name: Glyco_hydro_16; PFam Description: Glycosyl
  misc_feature: PFam Name: XET_C; PFam Description: Xyloglucan
  misc_feature: PFam Name: Peptidase_S8; PFam Description: Subtilase family
  misc_feature: GI Number: 50911745; NR Description: putative xyloglucan endo-1,4-beta-D-glucanase [Oryza sativa (japonica cultivar-group)] gi|51964238|ref|XP_506903.1| PREDICTED B1053A04.26-1 gene product [Oryza sativa (japonica
  misc_feature: GI Number: 50920185; NR Description: putative endoxyloglucan transferase [Oryza sativa (japonica cultivar-group)] >gi|29126333|gb|AAO66525.1| putative endoxyloglucan transferase
  misc_feature: GI Number: 17065244; NR Description: endoxyloglucan transferase, putative [Arabidopsis thaliana] >gi|38605150|sp|Q38908|XT30_ARATH Probable xyloglucan endotransglucosylase/hydrolase protein 30 precursor (At-XTH30)
  misc_feature: GI Number: 1244754; NR Description: xyloglucan endotransglycosylase-related protein gi|2129774|pir||S71223 xyloglucan endo-1,4-beta-D-glucanase (EC 3.2.1.-) XTR-4 -
  misc_feature: GI Number: 21618261; NR Description: endoxyloglucan
MAMKARLLAAAATCVCLAAAASAFDVPTVAFEEGFSPLFGDGNLVRARDDRAARLLLDRRSGSGFISSDYYLHGFFSASIKLPRDYTAGVVVAFYLSNGDVYEKTHDELDLEFLGSRWGGQWRVQTNVYGNGSTSRGREERYLLPFDPTLEAHRYSILWAPTHIIFYVDDTPIREVVRHPGMGGDFPAKPMAVYATIWDGSAWATEGGKYKVNYKYAPFASDFSDLSLRGCRVADPAALSSDAAGGCDLLRLMTADYAVMTPQKRAAMRAFRARQMTYTVCYDAARYAAGPFPECDNSDEERGTFWAWGESKTVVMKTRGRGRRGRGSRTGAGARGRAGAASS

SEQ ID NO: 3127 - DNA, 1544 bp, Triticum aestivum
  misc_feature (1)..(1544): Ceres cDNA ID no. 21572719
  misc_feature (1)..(1544): Ceres CLONE  ID no. 683375
  misc_feature (1)..(1544): Also known as  Ceres CDNA ID no. 24356539
gacatctcggtgtatcttccagcccccgcttcgcagcccacacccaaacaggagcccacgatggcccccgcatcccccgacgtccgcgcttgcgccggcctccccgccgccgtctccgccttcgccgacgccttcgtcgacttctccgtctccggcatcttcttccccaccaacccgcctcctcctccgtcccccacgcccaccaccttcctcccctccccatcccgcctcgtcgccatcggcgacctccacggcgacctccccaagtccctcaccgccctccgcctcgccggcctcctgccttccgccaacagccccggctccagcgccagctccacctcctggtccgccggccccaccctcgccgtccagctcggcgacatcctggatcgcggcggcgacgagctccgcctcctctacttcctccgtcgcctcagcatctccgccgccgcgcagggcggcgcgctcctccccatcctcggcaaccacgaggtcatgaacgtgtccggcgactttcgcttcgtcacgccgcagggcctgcaggagttctccggctgggccggctggtaccgcgctggcctcgccattaagcgccgctgtggcgggctcgagcagcccaagaaccccttcctcggcgtccccaaggccttccctggcatcaagcgggagttttgggacggcatccgatctcgcctcgccgctctccgcccggacggccccatcgcgcggaggttcttggctgatctgcccaccgtcctggtagtcggcgactcggtgttcgtccatggtggccttcttgaggccaatgtcgagtatggcctggagcggatcaatgcggaggtcagcgactggatccggggtgagcgtggcaacaatgccagggcgccagagtatgtgtgcggccgagacgctgtagtgtggctcaggaggttctctgaaggcttcaattgcgactgccagaggcttcagggcgttcgtgggatgatccctggagcaaagaggatggtaatggggcacacgatacagagtgagggaatcaatgcagtttgcggggcacaggccgtcagggtggatgttggtttgtcgagggggtgtggtaatgggctgccggaggtgcttgagatcaatggcggtggatcagaggtgagggtgatcacaacagatccagcagaggcctggcagtaccggaagcagaagccgaacaaagctgccacggcattggagaagaaaggggaggtaaaggatggacttgcattgttggtaagggagagccatgtattgaaaggtgtagaagctaaggcttagtttaggggtaacttgagggcagagattattttgccaactcttagttcaattggattgccatgcctaattgggggtaactcctgctagaggtgggaggcattggttgaaggtaatgttggttgattcaatatggttatccacggtagaaaggaaagcaaccttgatttatcaattccccttatttatgagggtgtgctaatccgattgcagattgctgatgtataaaaaaaaaaaaaaaa

SEQ ID NO: 3128 - protein, 414 aa, Triticum aestivum
  misc_feature: PFam Name: Metallophos; PFam Description: Calcineurin-like
  misc_feature: PFam Name: Extensin_2; PFam Description: Extensin-like region
  misc_feature: PFam Name: Pyr_redox_2; PFam Description: Pyridine
  misc_feature: PFam Name: LMBR1; PFam Description: LMBR1-like membrane protein
  misc_feature: PFam Name: GATase_2; PFam Description: Glutamine
  misc_feature: GI Number: 62733791; NR Description: At1g18480/F15H18_1
  misc_feature: GI Number: 58743497; NR Description: Putative [Brassica oleracea]
  misc_feature: GI Number: 23308175; NR Description: At1g18480/F15H18_1 [Arabidopsis thaliana] >gi|16226290|gb|AAL16125.1| At1g18480/F15H18_1 [Arabidopsis thaliana] >gi|18394613|ref|NP_564053.1| calcineurin-like phosphoesterase
  misc_feature: GI Number: 21536655; NR Description: unknown [Arabidopsis thaliana]
  misc_feature: GI Number: 25402861; NR Description: protein F15H18.4 [imported] - Arabidopsis thaliana >gi|6714305|gb|AAF26001.1|
MAPASPDVRACAGLPAAVSAFADAFVDFSVSGIFFPTNPPPPPSPTPTTFLPSPSRLVAIGDLHGDLPKSLTALRLAGLLPSANSPGSSASSTSWSAGPTLAVQLGDILDRGGDELRLLYFLRRLSISAAAQGGALLPILGNHEVMNVSGDFRFVTPQGLQEFSGWAGWYRAGLAIKRRCGGLEQPKNPFLGVPKAFPGIKREFWDGIRSRLAALRPDGPIARRFLADLPTVLVVGDSVFVHGGLLEANVEYGLERINAEVSDWIRGERGNNARAPEYVCGRDAVVWLRRFSEGFNCDCQRLQGVRGMIPGAKRMVMGHTIQSEGINAVCGAQAVRVDVGLSRGCGNGLPEVLEINGGGSEVRVITTDPAEAWQYRKQKPNKAATALEKKGEVKDGLALLVRESHVLKGVEAKA

SEQ ID NO: 3129 - DNA, 1363 bp, Triticum aestivum
  misc_feature (1)..(1363): Ceres cDNA ID no. 21572720
  misc_feature (1)..(1363): Ceres CLONE  ID no. 684129
  misc_feature (1)..(1363): Also known as  Ceres CDNA ID no. 24356761
aaaatgtccaaaacccaaaagaagaggcaaacaagcccaaaccctttcaacgagcccccaaccccaagcagccgctgccgcgccgcaatcgtccatggcggctcagccgccgtctttcggtgcgccggcggcagccggagacaccaagcgcaccccgaagcggaagcccaagacaaaaccagctgccccctccgccctaaaccctaactgggcccagctccagtccaagctccctgcatccacgttcctcggcaagcgcaagcaccgccccgccccttctccgccccctgagccgtctcctaccccggaggcggcggagctgagtttcaagcttgagccgacctctgacgacaccagcttgacgaaggcgttggcgctggattgcgagatggtcggggttggggccggtggcagcaagagcgccctcgccagggccaccttggttaattcctttggcaacgttgtatatgatgaatatgtgcgaccaatggagcgaattgtggactaccgtacccatattagtgggattagacctaagcacatgaataaagccaaagatttctcgatcgttcagaaggatatagctgagcttatcacaggaagggttcttgttggacatgccttacaccatgatcttaaggtcctgctactaggtcacccaaaaaaggacataagagacacctcagaatatgaggttttccgacgggagggcaagcggagatcgttgaaagatcttgctgctcaagaactttctgttaagatacaacagcaagagcactgcccgattgaggatgctcgcgcagcaatgttcatttacaagaagcacaagaaaagttgggagaagaacaagaaagagcaattcaggttcaagaacaagcagaagaagcgaggcaataagaaatctgctgaagccaatgagaaggaccccaatgtcccaatagttctactgtaggaaacatagatgtaaggggggccagggccaagcagtgtcgtgcttaacatggatttcacgacgccaaagggtatgccgtgtgggaatttcagatggaacctgtcaagaactcaagatcagcacgccaacctgggaatttctccagatgaaccatgaacttcggtaccatgctggacgggtagatggcgatgccgtgattatatctgttgattctgatttttctaggccgcatatgtttcagggattgattgcaaattgtgtggctgattattcctcacatcacatgtgacgaaacttcacacatgcgtgcaggttctgtaacaagatatttacatgaccagctgaaaaatggcgcagccgataatatttggttgttggtaaaaaaaaaaaaaaagaaaaaaaaaaaaaaaa

SEQ ID NO: 3130 - protein, 285 aa, Triticum aestivum
  misc_feature: PFam Name: Exonuc_X-T; PFam Description: Exonuclease
  misc_feature: GI Number: 21593535; NR Description: exonuclease, putative [Arabidopsis thaliana] >gi|18400624|ref|NP_566499.1| exonuclease
  misc_feature: GI Number: 8777491; NR Description: exonuclease-like protein
  misc_feature: GI Number: 49899970; NR Description: Xpmc2h-prov protein
  misc_feature: GI Number: 50757227; NR Description: PREDICTED: similar to XPMC2 prevents mitotic catastrophe 2 homolog; Xenopus prevents
  misc_feature: GI Number: 50781722; NR Description: PREDICTED: similar to XPMC2 prevents mitotic catastrophe 2 homolog; Xenopus prevents
MAAQPPSFGAPAAAGDTKRTPKRKPKTKPAAPSALNPNWAQLQSKLPASTFLGKRKHRPAPSPPPEPSPTPEAAELSFKLEPTSDDTSLTKALALDCEMVGVGAGGSKSALARATLVNSFGNVVYDEYVRPMERIVDYRTHISGIRPKHMNKAKDFSIVQKDIAELITGRVLVGHALHHDLKVLLLGHPKKDIRDTSEYEVFRREGKRRSLKDLAAQELSVKIQQQEHCPIEDARAAMFIYKKHKKSWEKNKKEQFRFKNKQKKRGNKKSAEANEKDPNVPIVLL

SEQ ID NO: 3131 - DNA, 1231 bp, Triticum aestivum
  misc_feature (1)..(1231): Ceres cDNA ID no. 21572721
  misc_feature (1)..(1231): Ceres CLONE  ID no. 684955
  misc_feature (1)..(1231): Also known as  Ceres CDNA ID no. 24356445
attagcatcttcttcgatcgaccagaccaatcactcgatgccggcgccgagcaacttcctcaagtccatggccgccgccggcgccgcgaagcacggaggaggagagcaccatcaggccgccacgacggcgaggaagcagcagcacgccgtcggcttcccgaggctgtccacctccagcaaggcgctcgtgctgctgcccatcctcctcctcgccttcatctacctcttcgtgtaccccaaggagttcgagctgcagtcgctgatgagctcctgcgtcccgccgccgggcaccttcaccgccgccaacggctccaccaccctgtcaacagccatcgcatacacccggaagcccgacttccggctgctcatcggcatcctgacccgggccgacgtgtacgagcggcgccacctgctgcgcatggtgtacgggctccagctcgccgccgacccggcgctggcggcgcaggtggacgtgcggttcgtcttctgccgcctctacaaggacgaccagcgcgtgctgatcccgctggagatcctggcgcacggggatgtgatcgtgctggacgggtgcgaggagaacctcaacggcgggaagacgcacaccttcttcaccgccgtggcggacctgtacgccgacgcgccctacgactacgtgatgaaggcggacgacgacatcctgatccggctgccggcgctggtggcgtcgctgggggcgatgccgcgggaggacatgtactacggcgccaccatcccgtgcaacagcatggaccccgggaggggatacatgtccgggatggggtacgcgctgtcgtgggacctggtgcagtgggtggccggcgccggcgaggtcacccggggccgcaccgtcgggccggaggacaggatgaccggggagtggctgagggtgggcgggaaggggaagaacaggttcaacgccaagccggccatgtacgactacccgctgccggtgcccgtggaccagtgctcccacgaattcgtgccggacaccattgccgtgcaccgcctcaaggacaacccgcgctgggcgcacgcgctcggatacttcaacttcaccgccggcctcaagccctctaagttctacaagttcgacccctagttgtttctttttggacaagttttttacatttaaaaagagttgctcatttctacttgtacctatatatcatcattgattttggagaagcttgtatgaacaaaaaaaaaaaaaaaa

SEQ ID NO: 3132 - protein, 359 aa, Triticum aestivum
  misc_feature: PFam Name: Galactosyl_T; PFam Description: Galactosyltransferase
  misc_feature: PFam Name: FH2; PFam Description: Formin Homology 2 Domain
  misc_feature: GI Number: 21537037; NR Description: unknown [Arabidopsis thaliana]
  misc_feature: GI Number: 55741077; NR Description: hypro1 [Zea mays]
  misc_feature: GI Number: 14719291; NR Description: unknown [Zea mays]
  misc_feature: GI Number: 188864; NR Description: mucin
  misc_feature: GI Number: 31232507; NR Description: ENSANGP00000004655 [Anopheles gambiae] >gi|30174516|gb|EAA13969.2| ENSANGP00000004655
MPAPSNFLKSMAAAGAAKHGGGEHHQAATTARKQQHAVGFPRLSTSSKALVLLPILLLAFIYLFVYPKEFELQSLMSSCVPPPGTFTAANGSTTLSTAIAYTRKPDFRLLIGILTRADVYERRHLLRMVYGLQLAADPALAAQVDVRFVFCRLYKDDQRVLIPLEILAHGDVIVLDGCEENLNGGKTHTFFTAVADLYADAPYDYVMKADDDILIRLPALVASLGAMPREDMYYGATIPCNSMDPGRGYMSGMGYALSWDLVQWVAGAGEVTRGRTVGPEDRMTGEWLRVGGKGKNRFNAKPAMYDYPLPVPVDQCSHEFVPDTIAVHRLKDNPRWAHALGYFNFTAGLKPSKFYKFDP

SEQ ID NO: 3133 - DNA, 1068 bp, Triticum aestivum
  misc_feature (1)..(1068): Ceres cDNA ID no. 21572722
  misc_feature (1)..(1068): Ceres CLONE  ID no. 685243
  misc_feature (1)..(1068): Also known as  Ceres CDNA ID no. 23475393
gtcataaattctctcccctttcccggatcacacaacctctctccgagtctcctctcttttccagcttttccctccccccaccaaacttccaccccttcctcgagacctccggccacccacccgccaaggcctccctccgctccgcgctgtccccgctggaccaccgcagcactcccctgtccgatcgggaacgaggagagtgtgccacaggagagcgcgatccgtccgtccggccccaagacgagcgccatggcagacgccggctctcatatcgccgccgtcgtcgccacctccatctgcgcccactgtcaacgagaaattccatcgtcaaacatcgacttgcattcctacactgtgctcgtaaccttcaaaagtgcgagcactgtggagaaatggttcccaggaagcttatggaagaacactacaatgaaaatcacgctccggtaaattgctccctgtgcaaagaaaccttgcgaccggagatacttgatcttcacaaaagtgaacagtgcacacagaggatggttgcgtgtgcatattgtgagtacgaattgcctgcaattgatattcatgaacatcaggatgtatgtggaaaccgaacggagttttgtcaaacatgcaagaagtatattagacttcgtgaatggatagggcatgaaatgcagtgccacgttagctcaaatggttctgaagaatcatcaagtgccagaaccattccagagagagaagtgcggcctcctccaccggtacgaccagcgcgtgctgtgcctgctgcacaacacaggcgacttctctttacgattgctgtaactggaatcgccgtcatggttggatcaatactgttccagaaggaggagagtttctaggtccggcagccatggacttcatatgccagagttgttttcaacagtagtatgataagataatataatcttttgatgtataatgttatccccatattcagttggcacgtcttgcttgcttaagagtacagttccagtcatggccttgttggaagaatcgaaataaccatccaaatatttgttgttctcaaaaaaaaaaaaaaaa

SEQ ID NO: 3134 - protein, 1068 aa, Triticum aestivum
  misc_feature: PFam Name: zf-TRAF; PFam Description: TRAF-type zinc finger
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 21593788; NR Description: unknown [Arabidopsis thaliana]
  misc_feature: GI Number: 1869901; NR Description: XIAP associated factor-1
  misc_feature: GI Number: 40288191; NR Description: XIAP associated factor-1 isoform 1 [Homo sapiens] >gi|49257444|gb|AAH73156.1| XIAP
  misc_feature: GI Number: 34872552; NR Description: similar to FLN29 gene
GTCATAAATTCTCTCCCCTTTCCCGGATCACACAACCTCTCTCCGAGTCTCCTCTCTTTTCCAGCTTTTCCCTCCCCCCACCAAACTTCCACCCCTTCCTCGAGACCTCCGGCCACCCACCCGCCAAGGCCTCCCTCCGCTCCGCGCTGTCCCCGCTGGACCACCGCAGCACTCCCCTGTCCGATCGGGAACGAGGAGAGTGTGCCACAGGAGAGCGCGATCCGTCCGTCCGGCCCCAAGACGAGCGCCATGGCAGACGCCGGCTCTCATATCGCCGCCGTCGTCGCCACCTCCATCTGCGCCCACTGTCAACGAGAAATTCCATCGTCAAACATCGACTTGCATTCCTACACTGTGCTCGTAACCTTCAAAAGTGCGAGCACTGTGGAGAAATGGTTCCCAGGAAGCTTATGGAAGAACACTACAATGAAAATCACGCTCCGGTAAATTGCTCCCTGTGCAAAGAAACCTTGCGACCGGAGATACTTGATCTTCACAAAAGTGAACAGTGCACACAGAGGATGGTTGCGTGTGCATATTGTGAGTACGAATTGCCTGCAATTGATATTCATGAACATCAGGATGTATGTGGAAACCGAACGGAGTTTTGTCAAACATGCAAGAAGTATATTAGACTTCGTGAATGGATAGGGCATGAAATGCAGTGCCACGTTAGCTCAAATGGTTCTGAAGAATCATCAAGTGCCAGAACCATTCCAGAGAGAGAAGTGCGGCCTCCTCCACCGGTACGACCAGCGCGTGCTGTGCCTGCTGCACAACACAGGCGACTTCTCTTTACGATTGCTGTAACTGGAATCGCCGTCATGGTTGGATCAATACTGTTCCAGAAGGAGGAGAGTTTCTAGGTCCGGCAGCCATGGACTTCATATGCCAGAGTTGTTTTCAACAGTAGTATGATAAGATAATATAATCTTTTGATGTATAATGTTATCCCCATATTCAGTTGGCACGTCTTGCTTGCTTAAGAGTACAGTTCCAGTCATGGCCTTGTTGGAAGAATCGAAATAACCATCCAAATATTTGTTGTTCTCAAAAAAAAAAAAAAAA

SEQ ID NO: 3135 - DNA, 1044 bp, Triticum aestivum
  misc_feature (1)..(1044): Ceres cDNA ID no. 21572723
  misc_feature (1)..(1044): Ceres CLONE  ID no. 686634
  misc_feature (1)..(1044): Also known as  Ceres CDNA ID no. 25088283
agcggacacgctcggggcgaccaacactagacaatagccacggcagaatatgccgcgaacggccagcggcagtggccggaatcggccggcggggcggcggcggccagacgagggccacggccaggaggaggcggcggctggcggaaggggccgcggcctggaggaggcggcggccggcggagcagtcgcggccggaggacgagggagccgacggatcgagggcggggctggacaggcggctggcggcgacaggcggacggggccggcctgggagcgcccgccggcggagagcagcgggacctgcgagagctggcctccggcggcagaggcccgaccagggagagccaaaggccggcgcgcggcggccggacctcaagcggcagtcagagacgaggcggcggcggcccgaaccaaatcccgacggagggcggtagtggaagccggcggcggccaaatgaggtcagtggcggacgtcccggtctgggatgcagcgggctgcaggaaccagcggccggaaccgacgaggaacggcggctcggggtggaatctgcgacctcctttgtccagatcgagaccgatctcgcacggacagaacctgggaacgatggacaggcaaagtagaggagcggcagcagaggaaactgcacgcgtgaaaggcaacagccaagcagaggcaagagacgatttggagcagcgcagccaggaaaggatgatcacggcggcgcgattggatcgagcacgagttgcagtgtgcgaaaaaagaaccaaggctctaataccagctctaataccatgttagggaattatgcaacttgatattattatgaggccaaagccatcatatatacatgtacaagagaatgccagagactagaatacaaaaggccaaaggccatcctcaatataactctaacactgtccatgctgtttagtgcatctagtatgcttgagattcacatgttagtaattgcaatcgtcatgtttaatattctggaattaatggaaattatgcctaatttttcagtggcaaaaaaaaaaaaaaaa

SEQ ID NO: 3136 - protein, 249 aa, Triticum aestivum
  misc_feature: PFam Name: eIF-3c_C; PFam Description: Eukaryotic
  misc_feature: PFam Name: Glutenin_hmw; PFam Description: High molecular
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776103; NR Description: LigA [Anaeromyxobacter dehalogenans 2CP-C] >gi|66858140|ref|ZP_00402169.1| LigA
  misc_feature: GI Number: 25028434; NR Description: putative translation initiation factor IF-2 [Corynebacterium efficiens YS-314] >gi|39931290|sp|Q8FPA7|IF2_COREF Translation initiation factor IF-2
  misc_feature: GI Number: 32141270; NR Description: probable translational initiation factor [Streptomyces coelicolor A3(2)] >gi|39931282|sp|Q8CJQ8|IF2_STRCO Translation initiation factor IF-2 >gi|24413891|emb|CAD55362.1| probable translational
MPRTASGSGRNRPAGRRRPDEGHGQEEAAAGGRGRGLEEAAAGGAVAAGGRGSRRIEGGAGQAAGGDRRTGPAWERPPAESSGTCESWPPAAEARPGRAKGRRAAAGPQAAVRDEAAAARTKSRRRAVVEAGGGQMRSVADVPVWDAAGCRNQRPEPTRNGGSGWNLRPPLSRSRPISHGQNLGTMDRQSRGAAAEETARVKGNSQAEARDDLEQRSQERMITAARLDRARVAVCEKRTKALIPALIPC

SEQ ID NO: 3137 - DNA, 1626 bp, Triticum aestivum
  misc_feature (1)..(1626): Ceres cDNA ID no. 21572724
  misc_feature (1)..(1626): Ceres CLONE  ID no. 686799
  misc_feature (1)..(1626): Also known as  Ceres CDNA ID no. 24356550
agagaagtcatcttcctctcagatcccaagctactatggatcgaatccagaaaattactcccaatcccaagaactacgttgtgctccatcgtctcatcgtctcatcgctcgtcttgctgctgtcatgcacggcgacgagctgtgagcaaaccccaccactgatctcccggctcgccaaggacctcaacacctccctctacaccatcaccatcaaggccgacaagtcgccgctcctcctcgacatcgccggctcgctcgtttggtcgacgtgcccgccgccatcggcgcagagcactgtggcatgcgggtccggtaagtgcggcggcgtggccagccagcagtgcccacgcaactgcctgcacgtggacggcggccagttaggagagtcagggtcgggatgcgcctgcgccagcaacccggtcagccgtcagtgctccaccgccggcctcacgagcttcgcaatgtcggccaacgccaccgacggcgcgatggagcttcccccggaagagtcgttcgccgtcctcggcgcgtgcgcgccggacagcctgccgaggtcgctccccgcgggcgtcaccggcgtggcggggttctcccggcgcccgctctcgctgccgtcgcagctcgccgcccagcgcggcttcggaggtaagttcgccctgtgcctccccgtcttcgccatcttcggggactcgcctgtgaacctgacggcgcccgggcaagcgccgggctacgtcgactacacgaccgtcataccatacaccccgctcctcaccaacccggcgaaccccgccggatactacatccccgtcaagggcatctccgtgtcgtggcacgaggccgacgcccaggcggtcctccccagcgccgcgctagagctcgaccccggcgccggcaccggcggcgtcgtgctcagcaccgccacgccctacatgatcatgcgccccgacgtgtacgaaccgttcgccaaggccttcgacgtcgcctttacaagggggaggaatgttccggcgacctccgtggagcgggtgccggcgccaaagccgttcgagatctgctacaatgccgggttcatgaggctgaagcggccgtcggcctacgacgtgcctcgcatccagctagagctgggcgccggcgccacgtggaagaactggacgctgtacggcgacaactacctagtgaaggtggacggggctttgtgcctggggatcctgccgacggggcccggcggcatgccagtcgacggcgagccggcggtggtgatcggcgcgaagcagctggagaacaacctgctggtgttcgacctggagaagcaggtgctcgggttcagcatgctgctggacttcgcgttgtccagttgtacaagctccaacttcttcagaaactagacagcacacctctgacttgagcagccggctccaagtatccaaggcgcagtgtacggtagaataagttcctgtgggcgtctcgtatcgaaaactactgtaatgtcgattttgcatggtgcccagtcccagttccggcactcggcagacacggtcttttaagatgtttattactgtgaattttcgcagaaaaaaaaaaaaaaaaaaaaaaaaaaaaaaaaaaaaacgaaaaaaaaaaaaaaaa

SEQ ID NO: 3138 - protein, 449 aa, Triticum aestivum
  misc_feature: PFam Name: Asp; PFam Description: Eukaryotic aspartyl protease
  misc_feature: PFam Name: Pyr_redox_2; PFam Description: Pyridine
  misc_feature: PFam Name: Peptidase_S8; PFam Description: Subtilase family
  misc_feature: GI Number: 34907236; NR Description: P0504E02.14 [Oryza sativa (japonica cultivar-group)] >gi|20160771|dbj|BAB89712.1|
  misc_feature: GI Number: 34907240; NR Description: P0504E02.16 [Oryza sativa (japonica cultivar-group)] >gi|20160773|dbj|BAB89714.1|
  misc_feature: GI Number: 34907234; NR Description: P0504E02.13 [Oryza sativa (japonica cultivar-group)] >gi|20160770|dbj|BAB89711.1|
  misc_feature: GI Number: 34907218; NR Description: putative dermal glycoprotein precursor [Oryza sativa (japonica cultivar-group)] >gi|20160762|dbj|BAB89703.1| putative dermal glycoprotein precursor
  misc_feature: GI Number: 57899195; NR Description: putative xylanase
MDRIQKITPNPKNYVVLHRLIVSSLVLLLSCTATSCEQTPPLISRLAKDLNTSLYTITIKADKSPLLLDIAGSLVWSTCPPPSAQSTVACGSGKCGGVASQQCPRNCLHVDGGQLGESGSGCACASNPVSRQCSTAGLTSFAMSANATDGAMELPPEESFAVLGACAPDSLPRSLPAGVTGVAGFSRRPLSLPSQLAAQRGFGGKFALCLPVFAIFGDSPVNLTAPGQAPGYVDYTTVIPYTPLLTNPANPAGYYIPVKGISVSWHEADAQAVLPSAALELDPGAGTGGVVLSTATPYMIMRPDVYEPFAKAFDVAFTRGRNVPATSVERVPAPKPFEICYNAGFMRLKRPSAYDVPRIQLELGAGATWKNWTLYGDNYLVKVDGALCLGILPTGPGGMPVDGEPAVVIGAKQLENNLLVFDLEKQVLGFSMLLDFALSSCTSSNFFRN

SEQ ID NO: 3139 - DNA, 1017 bp, Triticum aestivum
  misc_feature (1)..(1017): Ceres cDNA ID no. 21572725
  misc_feature (1)..(1017): Ceres CLONE  ID no. 696312
  misc_feature (1)..(1017): Also known as  Ceres CDNA ID no. 23733413
accatccttactcatcactcaccactcatcatctcccctccgcgtcaccggcgtgcgtgcgtcctcagtttgctccagttcagttgagttcaacagtttgcttctcgctttccctcccgtgatggacacgtcggcgtcccctggccccagctcgtccgcgccggagcctcggcaatgggccggcggtcgccccgggctggggtccgcggcgcttgagctggcctgcaaggtgctctgcgtcgtggcgacgtgcgccttcgccgcggtggggtcgctggtcggggcggtgtcggggtcggtgatcgggctggcgacggagagcggggtggtccggggcgccggcatcggcgccatctccggcgccgtcttctccatcgaggtcgccgaatcgtcgcgggacctctggcacaccagcgactcctccgtctggagcgtcctcttcatggtggacatcatcctcagcctgctgagcgggaggctggtccgcgagaaggtggggccggcggtgcagagcgccgtgcagagtcagataagcgccatcagctcgccgttcacggagcccagcgacctgttcgagaccggcggcgcgagagggctgccggcgcacgcgctccggcggctgccggcgatcaaggtcggcgcggacaccgcggtcgacgaggccggggaggcgctctgctgctcggtgtgcctgcaggaccttgaggtgggcgagtcggcgaggcgactgcccggctgccggcacgtcttccacgcgccctgcatcgaccgctggctcgtcaggcacgcctcctgcccgctctgccggcgagacatctgagcccggccgggcaccgccggccggtcgatcccctgcctgtaattaaattaaatcgccattgctcgccgtgcgtcgggtgcccgtaaggggaccggtggcaaaagaggccacttgtgtagcgatgcgtgaatgaattgggaatgtggaattgtggataagaaagaagaattgttcggggccgaaaaaaaaaaaaaaaa

SEQ ID NO: 3140 - protein, 1017 aa, Triticum aestivum
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 50948297; NR Description: putative NEP1-interacting protein [Oryza sativa (japonica cultivar-group)] >gi|42407817|dbj|BAD08961.1| putative NEP1-interacting protein
  misc_feature: GI Number: 27524902; NR Description: NEP1-interacting protein
  misc_feature: GI Number: 18855037; NR Description: putative zinc finger
ACCATCCTTACTCATCACTCACCACTCATCATCTCCCCTCCGCGTCACCGGCGTGCGTGCGTCCTCAGTTTGCTCCAGTTCAGTTGAGTTCAACAGTTTGCTTCTCGCTTTCCCTCCCGTGATGGACACGTCGGCGTCCCCTGGCCCCAGCTCGTCCGCGCCGGAGCCTCGGCAATGGGCCGGCGGTCGCCCCGGGCTGGGGTCCGCGGCGCTTGAGCTGGCCTGCAAGGTGCTCTGCGTCGTGGCGACGTGCGCCTTCGCCGCGGTGGGGTCGCTGGTCGGGGCGGTGTCGGGGTCGGTGATCGGGCTGGCGACGGAGAGCGGGGTGGTCCGGGGCGCCGGCATCGGCGCCATCTCCGGCGCCGTCTTCTCCATCGAGGTCGCCGAATCGTCGCGGGACCTCTGGCACACCAGCGACTCCTCCGTCTGGAGCGTCCTCTTCATGGTGGACATCATCCTCAGCCTGCTGAGCGGGAGGCTGGTCCGCGAGAAGGTGGGGCCGGCGGTGCAGAGCGCCGTGCAGAGTCAGATAAGCGCCATCAGCTCGCCGTTCACGGAGCCCAGCGACCTGTTCGAGACCGGCGGCGCGAGAGGGCTGCCGGCGCACGCGCTCCGGCGGCTGCCGGCGATCAAGGTCGGCGCGGACACCGCGGTCGACGAGGCCGGGGAGGCGCTCTGCTGCTCGGTGTGCCTGCAGGACCTTGAGGTGGGCGAGTCGGCGAGGCGACTGCCCGGCTGCCGGCACGTCTTCCACGCGCCCTGCATCGACCGCTGGCTCGTCAGGCACGCCTCCTGCCCGCTCTGCCGGCGAGACATCTGAGCCCGGCCGGGCACCGCCGGCCGGTCGATCCCCTGCCTGTAATTAAATTAAATCGCCATTGCTCGCCGTGCGTCGGGTGCCCGTAAGGGGACCGGTGGCAAAAGAGGCCACTTGTGTAGCGATGCGTGAATGAATTGGGAATGTGGAATTGTGGATAAGAAAGAAGAATTGTTCGGGGCCGAAAAAAAAAAAAAAAA

SEQ ID NO: 3141 - DNA, 1140 bp, Triticum aestivum
  misc_feature (1)..(1140): Ceres cDNA ID no. 21572726
  misc_feature (1)..(1140): Ceres CLONE  ID no. 696925
  misc_feature (1)..(1140): Also known as  Ceres CDNA ID no. 24356544
actttactttccactcgcaccgctcgccgtgacgcgtcgacggagccgccgagggagtctgccccgcttgcatccggtcggtgggtcggtcggggccatggtgaagctggcgacggcgagggaggcgcggctgtacgggccggcgctggcggtgcggcggtgggagtacatcaacgccggcgcgtacatgttcggcaccctgctcctggccgcggggctcgcggcgctgtgcgcgtccgagggcggcgtcggcgccacggacgccgggctcgccgtggccggcgtggcgctggcggtggtggcggccgtgaacgcgcacgacctgggcgcgcacctcgccggcgtggactgccgcgtcgggctcgcccggttcgacccccagctcggcatcgtcgagttcctcgcgcccgcgctccatgccgcaggctgcgtcctcgccatcgtcggcctcgcgctgcagctcttctcccagggcgacaagctggagaggcgcgctgccgacgcgctgctggcgggcgcggcactgtggctgctgggctcggtgctcagctcgtgccaggtgtacgagcgcgccgacggccgcgcgcagctgctgcagtccagcgtgcaggtccccgtcctcctcggcagcctgctcttcctcgtcgccgccgccctccaccgccggcgtgagcccgccctgccaggcgagagggaaagcgagagcgagaggtggattagcctgtgcgggagcgtgctgtgggtggcgggcgcactgttcaacgtgctcaaggtgttcgtgatgcaccagagcgacgcgccgcggctcgagaagctccgcggcggcgcgcaggagcggctcgcccgggaccgtgagggccgcgtgccgctggtctggaggtcggcggcgcagctgcgctgacggtcatggagcccaagcccaagccgcaagccggccgcctcgttgctttgttccaccattgttcggacgctcaagatggtaattaaggaggctggtgcaccaaggtataacagggcggccggcgccggtgaaactatactctgtttggtatctgtctagcagacttctccgttgtttcttctcttcttgtctggtattagtgaagtgtaagaacttttagcccaaaaaaaaaaaaaaaa

SEQ ID NO: 3142 - protein, 267 aa, Triticum aestivum
  misc_feature: PFam Name: Keratin_B2; PFam Description: Keratin, high
  misc_feature: GI Number: 66776103; NR Description: LigA [Anaeromyxobacter dehalogenans 2CP-C] >gi|66858140|ref|ZP_00402169.1| LigA
  misc_feature: GI Number: 31204765; NR Description: ENSANGP00000001657 [Anopheles gambiae] >gi|30177813|gb|EAA06779.2| ENSANGP00000001657
  misc_feature: GI Number: 50933659; NR Description: putative high-affinity potassium transporter [Oryza sativa (japonica cultivar-group)] >gi|50508930|dbj|BAD31835.1| putative high-affinity potassium
MVKLATAREARLYGPALAVRRWEYINAGAYMFGTLLLAAGLAALCASEGGVGATDAGLAVAGVALAVVAAVNAHDLGAHLAGVDCRVGLARFDPQLGIVEFLAPALHAAGCVLAIVGLALQLFSQGDKLERRAADALLAGAALWLLGSVLSSCQVYERADGRAQLLQSSVQVPVLLGSLLFLVAAALHRRREPALPGERESESERWISLCGSVLWVAGALFNVLKVFVMHQSDAPRLEKLRGGAQERLARDREGRVPLVWRSAAQLR

SEQ ID NO: 3143 - DNA, 1602 bp, Triticum aestivum
  misc_feature (1)..(1602): Ceres cDNA ID no. 21572727
  misc_feature (1)..(1602): Ceres CLONE  ID no. 697348
  misc_feature (1)..(1602): Also known as  Ceres CDNA ID no. 24356765
atcacacacacgcagcctctctgctccctccacccccctctctccccgtgagagctctagcgagagagagaagaaaggggccggcggccatggaccaggagagcagcatgggcgccgggcagctgcaggaggaggaggcgccggcggccatggcgaagtcggcgaagaggaggggcaagcagcagaggagggaggggggagggggagggaagaagaggcggcagcagcagcagcagcagcaggagtaccggctggtgagctacgaggagctgccggagtacatgaaggagaacgagttcatcctcaaccactaccgctccgagtggccgctgctgcacgccttcctcagcgtcttctcctggcacaacgagaccatcaacatctggacgcacctgctggggttcttcctgttcttgggcctcaccctctggcacctcgcccagtacttcccccaggtcgcccacctcatcggccacctctcctggcccatctccaaggtcgcagagaatgtctccagcaacataggcgacgtcctctccggcgcggcgtcgttcatgcaggcgagcccggggctggcgatggcggcagcggcgggggtggggccgacgacgcggtggcccttcttcgtgttcctggcgggcgccatgttctgcctgatgagcagctgcgcgtgccacctgctgtcgtgccactcgcaccgcctcaacctcttcctcatccgcctcgactacaccggcatcgccgtcatgatcgtcgtctccttcttcccgcccatctactacatcttccagtgcgagccgcgctggcaggtcgcctacctctccgccatctcgctcgccggcgccgccaccgtctacgcgctcatgtcgccccgcctcagcgacgccaagtaccgcgcccaccgcgcgctgctcttcgtcgggatgggcctgtcgggcgtcgtgccggccgtgcacgccgccgcggtcaactggcacgagccgcgccggaacgtcacgctggcgtacgagggcgccatggccgcctcgtacctcgtcggcaccgccttctacctcacccgcgtgcccgagcggtggaggcccgggatgttcgacctgtgcgggcagagccatcagatatttcacctgcttgtcatcgccggcgcgctcgcgcactacggcgccgccatcgtcttcctcagggtccgcgacgagatgggctgcccagccaactgatgcgcatgccatcgatcgttcacagtaccgtcaaattcttagtagttaaatggagacactctgcgtggtctctgcatccatccggagatggacacagcccaattattaccatcgaaatggcgttataccgtgaatgcagatgatacagcagatttgagatcagcaattaagaaaggcgttttgcttgcgagattggttaatttgtttgtagcagttagttatttgtttacagtttactgtggtgagtggattgatgcatggatgatacagcaattgttaattacagctctgaacctgtacatagagatgctcatggctgtttgtttctttgtataagatgtaaaacaagaagaaaaaattatgcagggcaagaaaaaaaaaaaaaaaa

SEQ ID NO: 3144 - protein, 374 aa, Triticum aestivum
  misc_feature: PFam Name: HlyIII; PFam Description: Haemolysin-III related
  misc_feature: PFam Name: Cupin_1; PFam Description: Cupin
  misc_feature: PFam Name: Cation_efflux; PFam Description: Cation efflux family
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 40805092; NR Description: adiponectin receptor 1
  misc_feature: GI Number: 50761224; NR Description: PREDICTED: similar to
  misc_feature: GI Number: 46485456; NR Description: adiponectin receptor 1 [Rattus norvegicus] >gi|38197440|gb|AAH61838.1| Adiponectin
  misc_feature: GI Number: 38018665; NR Description: progestin and adipoQ receptor family member I [Mus musculus] >gi|38259186|ref|NP_082596.2| adiponectin receptor 1; progestin and adipoQ receptor family member I [Mus musculus]
MDQESSMGAGQLQEEEAPAAMAKSAKRRGKQQRREGGGGGKKRRQQQQQQQEYRLVSYEELPEYMKENEFILNHYRSEWPLLHAFLSVFSWHNETINIWTHLLGFFLFLGLTLWHLAQYFPQVAHLIGHLSWPISKVAENVSSNIGDVLSGAASFMQASPGLAMAAAAGVGPTTRWPFFVFLAGAMFCLMSSCACHLLSCHSHRLNLFLIRLDYTGIAVMIVVSFFPPIYYIFQCEPRWQVAYLSAISLAGAATVYALMSPRLSDAKYRAHRALLFVGMGLSGVVPAVHAAAVNWHEPRRNVTLAYEGAMAASYLVGTAFYLTRVPERWRPGMFDLCGQSHQIFHLLVIAGALAHYGAAIVFLRVRDEMGCPAN

SEQ ID NO: 3145 - DNA, 2037 bp, Triticum aestivum
  misc_feature (1)..(2037): Ceres cDNA ID no. 21572729
  misc_feature (1)..(2037): Ceres CLONE  ID no. 698289
  misc_feature (1)..(2037): Also known as  Ceres CDNA ID no. 24356664
aaaatatcctccaattttcgccgtcatttcacggaaaggaaggagatagcggctgcgtcggcgccgaattccttgccggcgtggccgcgccggcaattcgggatgctcgacggcgatgttgcgtccggcgtcgatctcccccgctgtgctcgttgagtatgtggtgccgccgtccttgaaggcagacgtcctggccatggtaatgggggctgcgtgggccgttgccactgatggcaggcacggtgtccgggaaacggcggctgctcgcgctacggtgacggccggcccggagacggcctccgcgcggaagacggaggctgagcggtttctgtgtgctggagtttgctccggcggcgtggagaggagctgcagccggcgcatcgcaaagggatggaggcccccttctcccatcccagtcaccgattatatgtgggcgcaggtgatcgtcagagggaggaggatgagcggcagcatgcggcggatcctgaacctggggttgttcgaaggggtcaaacgcgcgtattcgctgcggcgcctgaacctggagctctccaaggtgaagtttttccacccgacggcacaagaggcggccgctcatggcaaggtgctgccaacactgacgccagcccaggccgaggccaccagcaggacaaggatctgcaacaccgatctggcgacggcggaggcggcggcgcccaagatcgatccgccaaaaaccgagctggtcataaagccaccggaagtctcctactccatccggtctcctcgctgcgttcatttcttgccaaccgcctcggagagcaaggtcgtcatggtcgaccgcgggaaccgcatgatacgcttcaacatcgtcaatagcccccactacaacgatacccaggacggccaagtccccaggcactcccgctacatcgattccatgccaagcctccacgggtacaaggaggcgccgctgaccatctccgtccctcccacgaacttacacctccttgacggcgaagacgcaggcgacctctacatcatcgatagcgtcctccatcccaacaaggcggacgtacgcccgcagttcgaggccctggtgtggagggggatcaccacgtccctcgcgtctcacaggttctggcactgcgacatcctcccgctgcccccgtggatcacgcaccacaggaatgccttcgtctatggtcacgccctcgtcggcgacaccatctgcttctccatctctggcccagagggcgatggcacctactgcttccacatggcgactcgccagtggagcaaagctggcgactggctcatgcccttccatggcaaggcagattacgtccctgagcttggactctggttcggcatcgcagacggcctcccctgcgctgctgacctctctggcgtcgtcggaggggaggagccgccgccagagaagatgcggatctgggtgcacgatgacctgccagaggagtggcagccaaaccaatttttcaagcccagggtcatcagccttggttctggcaagttcatggtcgtggacttcttggatgacatgcaattcgacaaggaatccaacgagatgtgtcttgaaaagcaattcgccctcttcactggtatggaagtagcctacagcaacggcaacggcaaaggcaagaatagcagaaatggtgccatcaaagacaatgaccacagtagtggcagcgagaatggcggcaaaggcaaaggcaaagggctgatccgtggcctccgtatgatcaagcacaaatccggtcgttacatgttcaacaaccatcagaggatcgaggaggtgctctgaatgattcagctagtcattctcaactttagctagtgtatgcaggcatgcattatggcacttaatttgctatctatcagtgtagcgttactgctccctgtttacagcaaggagtactgactcttccagtgctaagtcagcttaaataatccatattattgtatgatgaaacgtaccctaatttttaactccctggtgttattctggaccatttgcatctaaaaaaaaaaaaaaaa

SEQ ID NO: 3146 - protein, 562 aa, Triticum aestivum
  misc_feature: GI Number: 34907072; NR Description: OSJNBa0093F16.25 [Oryza sativa (japonica cultivar-group)] >gi|20161829|dbj|BAB90743.1| OSJNBa0052O12.1 [Oryza sativa (japonica cultivar-group)] >gi|20805238|dbj|BAB92905.1| OSJNBa0093F16.25 [Oryza sativa
  misc_feature: GI Number: 32487803; NR Description: OSJNBa0035I04.14 [Oryza
  misc_feature: GI Number: 34907070; NR Description: OSJNBa0093F16.24 [Oryza sativa (japonica cultivar-group)] >gi|20805237|dbj|BAB92904.1|
  misc_feature: GI Number: 15901602; NR Description: cell wall surface anchor family protein [Streptococcus pneumoniae TIGR4] >gi|25389341|pir||E95206 cell wall surface anchor family protein [imported] - Streptococcus pneumoniae (strain TIGR4)
  misc_feature: GI Number: 11359723; NR Description: proteophosphoglycan, membrane-associated [imported] - Leishmania major (fragment)
MLRPASISPAVLVEYVVPPSLKADVLAMVMGAAWAVATDGRHGVRETAAARATVTAGPETASARKTEAERFLCAGVCSGGVERSCSRRIAKGWRPPSPIPVTDYMWAQVIVRGRRMSGSMRRILNLGLFEGVKRAYSLRRLNLELSKVKFFHPTAQEAAAHGKVLPTLTPAQAEATSRTRICNTDLATAEAAAPKIDPPKTELVIKPPEVSYSIRSPRCVHFLPTASESKVVMVDRGNRMIRFNIVNSPHYNDTQDGQVPRHSRYIDSMPSLHGYKEAPLTISVPPTNLHLLDGEDAGDLYIIDSVLHPNKADVRPQFEALVWRGITTSLASHRFWHCDILPLPPWITHHRNAFVYGHALVGDTICFSISGPEGDGTYCFHMATRQWSKAGDWLMPFHGKADYVPELGLWFGIADGLPCAADLSGVVGGEEPPPEKMRIWVHDDLPEEWQPNQFFKPRVISLGSGKFMVVDFLDDMQFDKESNEMCLEKQFALFTGMEVAYSNGNGKGKNSRNGAIKDNDHSSGSENGGKGKGKGLIRGLRMIKHKSGRYMFNNHQRIEEVL

SEQ ID NO: 3147 - DNA, 2011 bp, Triticum aestivum
  misc_feature (1)..(2011): Ceres cDNA ID no. 21572730
  misc_feature (1)..(2011): Ceres CLONE  ID no. 700114
  misc_feature (1)..(2011): Also known as  Ceres CDNA ID no. 0
accgcctccctccttggttttgctgctcgatctcctctctctcttttttcttctctctccccctccctccctccatcgctcgccgtaaagaagccataggcaggcggataggagaggagcgagtagcgtagcagctcgtcagggtgcggaggagatcgagtggaggggaaagagaaaaaagagagcaatcgagtgtttctgctccccggctggaaagtatcccatcttttcttttccctggggaagctgaattggtcgattgattcgcgtgctgtgtgtgcgtgcgcggtcatggcgacgaggcggagctagccagtggaggagtcacgcttcttcttgatttcttcggcgccgaggggagaattattggtgtttgggaggtaggaggggtccgggagcaagctagctgatgtacggctcgccggcgtccaaggatctgaaccagccgccgccgccgatgaactcctccggcctcctcaggtacagatcggcgcccagcacgctgctcggcgaggtctgcgaggagttcctccagcccggcccccgcgccgccagccccgacgccgccgccgccgacaacgtcttctcccgcttcctggccgaccaccagatccgagacaccaagccgccgccgccgccgcccgtcgcccccggggcccacttccctgatgactccgccatggcgtcccagcagcaccagcagcagatgatgttccactcccagcaacagcaccagcagcagatgccccccgtcggcgtcgaggggctctaccgcaccgtcagctccgccgggatggactcggccgcggcggccaccgccggcggcgccagcagcctactccggcagagcagctcccccgccggcttcctcaatcatttgaacatggacaacgggtacgagagcatgctgaggcaaggcatgggcgtcggcttccggaacggcgccgccaacgccgccgccgcggccgtggactcctccggcggcgggggcggcaggctcaagggccagctcagcttctcgtcgcggcaggggtcgctcatgtcccagatctcggagatgggcagcgaggatctcggcggcagcagccccgagggcgccggaggcagccgcggctacatccccggctacccgatgagctcggggtgggaggagtcgtcgctcatgtcggagaacatgtccgggatgaagcgcccacgggactcctcagagcctgctgcccagaacgggctggcgcaccagttcagccttcccaagacctcgtcggagatggccgccatcgagaagttcctccagttccaggacgccgtgccctgcaagatccgggccaagcgcgggtgcgccacgcacccccgcagcattgccgagcgggtgaggaggacaagaatcagcgagcgaatcaggaagctgcaagaactcgtcccaaacatggacaagcaaaccaacacggctgacatgttggatctggctgtcgactacatcaaggagctccaggagcaggtcaaggtgatcaacgagagccgcgccaactgcacctgctcggcgagcaagcatcagcagtactctggttgagagaagaagctcatctctagaagaagctccactgtacaagacctggagaatttagaaacaagattatttgggggaagtgtaatgcatggtagtagcttttcgttttctttgcggtttgggtataagcaagcagaggcaggagggtgcgcaatggagcagtggcatcatcaaggattcaaggaagcaaagggtggagaagggagcaaggggaaggaagatggaggccggagaaagaattgtacagtatagtttttgctgtaacttcgctatatctggtgcattcccatagaaagttactgccattgttgtcagcactgctgcagggagctctaggctgccgtagcctctctctctctcatttaacaccatcactactcacgcggtcacagtccaaaaaccaataaaatatcgcaccggctttgcttaaaaaaaaaaaaaaaa

SEQ ID NO: 3148 - protein, 386 aa, Triticum aestivum
MYGSPASKDLNQPPPPMNSSGLLRYRSAPSTLLGEVCEEFLQPGPRAASPDAAAADNVFSRFLADHQIRDTKPPPPPPVAPGAHFPDDSAMASQQHQQQMMFHSQQQHQQQMPPVGVEGLYRTVSSAGMDSAAAATAGGASSLLRQSSSPAGFLNHLNMDNGYESMLRQGMGVGFRNGAANAAAAAVDSSGGGGGRLKGQLSFSSRQGSLMSQISEMGSEDLGGSSPEGAGGSRGYIPGYPMSSGWEESSLMSENMSGMKRPRDSSEPAAQNGLAHQFSLPKTSSEMAAIEKFLQFQDAVPCKIRAKRGCATHPRSIAERVRRTRISERIRKLQELVPNMDKQTNTADMLDLAVDYIKELQEQVKVINESRANCTCSASKHQQYSG

SEQ ID NO: 3149 - DNA, 1532 bp, Triticum aestivum
  misc_feature (1)..(1532): Ceres cDNA ID no. 21572731
  misc_feature (1)..(1532): Ceres CLONE  ID no. 700193
  misc_feature (1)..(1532): Also known as  Ceres CDNA ID no. 24360234
tacaccatcactcagtggtgctccgctctgctcagctcagcgccctccaccagtccgccccactccatcccgagctgagctgagccgccaccagcactagcggccaagctctagacgccggctgcctcaccgacgaggagaggataatggaggcgcggcggcggacgttgctggtggcgctggcggtgctggccctggcggcggcggcggcggaggggtacaacatcaccaagatcctggccgagtacccggagtactcgcagttcaacaagctgctgacgcagacgcggctggcgcaggacatcaacaagcgccgcaccatcaccgtgctcgtcgtggccaacggcgacatgggcggcctcgccggcgggggccgcacgctgcagaccatccgccacatgctccagattcacgtcctcgtcgactactacggcggcaagaagctccaccagctcgcccacggcgtcaccgcatgctccaccatgttccaggagtccggcgcggcccccggcatgtccgggtacgtgaacatcacgcagcaccggggcggcaaagtgacgttcacggcggaggacgcggaggacagcgcgccctcctccgccttcgtcaagtccgtcaaggagatcccctacgacctggcggtgctccagatcagcaaggtgctggcctcaccggaggccgaggcgcccgtggcggcgccggcgcccgtcaacatcaccgagctgctctccaagaagtactgcaagagcttcgccggcctgctggccgccgacgccgacgcctacagcaccatcaacgccaccaaggacaacgggctcaccctcttctgccccgtcgactccgccgtcgcctccttcatgcccaagtacaagaacctgacggccaagggccggacggccatcctgctctaccacgccgtgccggactactactcgctgcagctgctcacctccaacagcggcaaggtcagcacgctcgccacctccaacgtcgccaagaaggactacagcttcgacgtcgagaaggacggcgagaccgccgagctggacaccaaggtgaactcggcctcggtcacctacaccatcaaggacgacgacccgctcgccgtctacgccatctccaagttcctgcagcccaaggagctgtacaagatcgccaaggacatcgcccccgcgccggcgcccgaggcccccaagaagaagaagaccaccaagaagaagccctccgcggccgcctcgccctcggacgacgacgacgacgatgactccgccgcggactcgcccgacgactcctcatccgacgacgccaccgctgacaaggacggcgccgcgccgtccgcggtggccgggtgggtgacggccgccgtggccgtggcctcggcgctggcattggcagcttaataaggtgtgtgaactagtgtgtttttgtgctgagttctcccaaaattcgtggcccttgttatttagcgcgaaaaacaagaagggccatttcattcatatttattaccgcatgtcctaaaaaaaaaaaaaaaa

SEQ ID NO: 3150 - protein, 417 aa, Triticum aestivum
  misc_feature: PFam Name: Fasciclin; PFam Description: Fasciclin domain
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: APC_basic; PFam Description: APC basic domain
  misc_feature: GI Number: 21593810; NR Description: putative pollen surface
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21595125; NR Description: endosperm-specific
  misc_feature: GI Number: 14190409; NR Description: AT3g60900/T4C21_310
MEARRRTLLVALAVLALAAAAAEGYNITKILAEYPEYSQFNKLLTQTRLAQDINKRRTITVLVVANGDMGGLAGGGRTLQTIRHMLQIHVLVDYYGGKKLHQLAHGVTACSTMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADADAYSTINATKDNGLTLFCPVDSAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKIAKDIAPAPAPEAPKKKKTTKKKPSAAASPSDDDDDDDSAADSPDDSSSDDATADKDGAAPSAVAGWVTAAVAVASALALAA

SEQ ID NO: 3151 - DNA, 1231 bp, Triticum aestivum
  misc_feature (1)..(1231): Ceres cDNA ID no. 21572732
  misc_feature (1)..(1231): Ceres CLONE  ID no. 700200
  misc_feature (1)..(1231): Also known as  Ceres CDNA ID no. 24356527
cttaaacttaccggctcaacacgaattgacgtctgattctaagaaaaacacgaattgctgtcagtgtgccctcgtcgtcctccctccgtccatcgcactctgcgtgcggttaccccttctccttggcgtaccaagttcccctgccactcgcgtcgccggcagatatgctaatatctccaggactcgcggcgccggcggcctctcacccgtcccctttcctcgccgccgcctgcctcggcgaccgcgctgctctaggaggcctcgtccagccggccgcaacgacgtcgaagacccgctgctacagccgcccgctgctccgctatgcgaccgccgacgccgcttctattgcgggcagcgtatcgaccaatgacactcggtgccgcctggaccgcgacgagctccgcagggtctgccaagagcccgacctcgagggagcagttaacctgctcgacgaaatgcttacccggagaggcggcgccggcgcgtcgggccaactcgcgccggaagagcaggccgcggtcctccagtgctacgttgacgcgctctcgctggcctccctcagacgaggtcaccgcttgctcgccaagtccacgtcccggtactccgggatcgccatgcccatcgtgcacaggatcgccacgctgtactgcaagctcggcgcccctgccgacgcgcggcgcgtccttgagggagcgtcgaggccggcaccaggaaagcccgcggacgcggcgcaggccaagcggaaggaggcctacgagaaggtgcgcgagctgcacgaggagatacgcgcggcggggtacgtgccggacacccgcttcgtgctgcacgacatcgacgaggccgccaaagagcgcgccctcatgtaccacagcgagcgcctggccatcgcgttcgggctggtgagtaccccgcccggcacgccgctgcgggtcatgaagaacctccgcatctgcggggactgccacaccgccgtcaagctcatcgccaaggtgaccggccgcgagatcatcgtcagggacaacaagcggttccaccatttcaaggacggcgcctgctcctgcggggattactggtgagacgcctccaccgcaccattgacatccatttctctcttactgattactgggtaattcagtgtctctaccaagcctgtaaattttggcaggcttttggccttgtgtaagtggagagaacaatgaaggaatttgtttagccaacaaaaaaaaaaaaa

SEQ ID NO: 3152 - protein, 303 aa, Triticum aestivum
  misc_feature: PFam Name: FBA_1; PFam Description: F-box associated
  misc_feature: GI Number: 5668803; NR Description: F16N3.14 [Arabidopsis thaliana] >gi|25405224|pir||D96516 F16N3.14 [imported] -
  misc_feature: GI Number: 15220259; NR Description: lipoyltransferase,
  misc_feature: GI Number: 50941233; NR Description: putative pentatricopeptide (PPR) repeat-containing protein [Oryza sativa (japonica cultivar-group)] >gi|27817913|dbj|BAC55678.1| putative pentatricopeptide (PPR) repeat-containing protein [Oryza sativa
  misc_feature: GI Number: 20197649; NR Description: putative
  misc_feature: GI Number: 34912228; NR Description: P0415C01.16 [Oryza sativa (japonica cultivar-group)] >gi|20146256|dbj|BAB89038.1| putative pentatricopeptide (PPR) repeat-containing protein [Oryza
MLISPGLAAPAASHPSPFLAAACLGDRAALGGLVQPAATTSKTRCYSRPLLRYATADAASIAGSVSTNDTRCRLDRDELRRVCQEPDLEGAVNLLDEMLTRRGGAGASGQLAPEEQAAVLQCYVDALSLASLRRGHRLLAKSTSRYSGIAMPIVHRIATLYCKLGAPADARRVLEGASRPAPGKPADAAQAKRKEAYEKVRELHEEIRAAGYVPDTRFVLHDIDEAAKERALMYHSERLAIAFGLVSTPPGTPLRVMKNLRICGDCHTAVKLIAKVTGREIIVRDNKRFHHFKDGACSCGDYW

SEQ ID NO: 3153 - DNA, 1541 bp, Triticum aestivum
  misc_feature (1)..(1541): Ceres cDNA ID no. 21572733
  misc_feature (1)..(1541): Ceres CLONE  ID no. 701327
  misc_feature (1)..(1541): Also known as  Ceres CDNA ID no. 0
aaaaaaaaaatccctagcgagtctctctgcttcatcctgcatccagcgcaatggaacggaaagaggtcatggacctcggcagcggcgagcccaaggagatcatggacctcatcagcggcaagccgatggagaccataggcctcggcagcggcaaggtcgaggactatccctccgtgaggcggctccgcaaccggcggctcctcctctacctccggctccagggcttcgacactgcctacgatagcgttgtgcgcgagtcgggtgtgcagatgagcaagctacatctgcggcagctgctgatctggggccggtggagcgaagccctcaactacatcaggcgcttcctgccgccggcgtccaaagaccgtggccgcgaggcccgttccctcctcttcttcctcaacatgctctgggccctggacaacgtcgccgcgtgctccaagagcggcctcgtgagcgactctgcgcaccgcgacctccgcttcctgacgtccctctgcagtcgcagcgccaagctcccctccatcctccgatacacgctccagccgccgcagttcagggagtctctggactggatgctggtgagggagaaggcatcgttgattgtcgaagcctgggctcttgacactccggaattgaggcgcaacttacaattgcctgccggcccaggtctcccgcgggacgtgcttcccatcggtcccagtcgtccaaggcgccaccggagggaacgataccggcgggcaaaagcatctacaattgccaagtcctatctcaacaggaagaggagcctgctgtcttcaagtccacctcctggattgcttgatgatgcactcaactggatggctgatcttattgagggatgtttaaaagctggtaaaattccggagctccatcaagagctgccacttcagtcaaatggaaatgaaggtgcttctggttctccacttttgcagaccatgtttagtaccgtgacaaatccttctaaaaaccctgggatctcatcagtgacaaatgcaggtgttccaagttgcacaggtaggcctaaatgtacttggtgctcatcagttgcattttcaggtggtgcaatctcacagccttttagaacaccttggatcacatctgcctcaaatgcaggcccaatcaagcattctgttggaaggaaaaggaattcaggagaagttttggtcactgccgaggaagataatcctgataggaaaaggcaactgactgaactggagttggtgactgaagtggaagctggatcttgcagcgccaacttgatggctaactgagcgggcattactcgtggcgctccttcgagtcgatttgctgcctactgtgttggagcaccgagctatgctatgttacaaacttgagatttgcatgtctcctagctagaactacttttggtagtgttatgttatcaccatggagagcgacattacatccgtgtttccaagtgcttggtgtcgtgtgttaagttgtaaggggatcatgaatcagaactaaatcagatttattatataaaaaaaaaaaaaaaa

SEQ ID NO: 3154 - protein, 413 aa, Triticum aestivum
MERKEVMDLGSGEPKEIMDLISGKPMETIGLGSGKVEDYPSVRRLRNRRLLLYLRLQGFDTAYDSVVRESGVQMSKLHLRQLLIWGRWSEALNYIRRFLPPASKDRGREARSLLFFLNMLWALDNVAACSKSGLVSDSAHRDLRFLTSLCSRSAKLPSILRYTLQPPQFRESLDWMLVREKASLIVEAWALDTPELRRNLQLPAGPGLPRDVLPIGPSRPRRHRRERYRRAKASTIAKSYLNRKRSLLSSSPPPGLLDDALNWMADLIEGCLKAGKIPELHQELPLQSNGNEGASGSPLLQTMFSTVTNPSKNPGISSVTNAGVPSCTGRPKCTWCSSVAFSGGAISQPFRTPWITSASNAGPIKHSVGRKRNSGEVLVTAEEDNPDRKRQLTELELVTEVEAGSCSANLMAN

SEQ ID NO: 3155 - DNA, 1244 bp, Triticum aestivum
  misc_feature (1)..(1244): Ceres cDNA ID no. 21572734
  misc_feature (1)..(1244): Ceres CLONE  ID no. 703158
  misc_feature (1)..(1244): Also known as  Ceres CDNA ID no. 25088292
accgttcccgacctcattttttacagagactccggcgactccagtccatcgctcgtggaaaatctcagggtcaaagcaggaggcacaccttgatggcgcccctggagtcaggctcctcacagctcttcttcgacagcagtgcgatcgacggcccgttcgatgtctacgagtgcggtaccttggcaggcaccagagtcgtgccagatccacctccacctggaacctcttatggcaagcagagaagttccaggaatgctaaaaaggctcgtcgtgttcatggctctgaggaggtcgaggactgctggaacaggctattcttggaaggatatcaagccgatgtccgcgtatcgacgggcgatggcagccagatcttatcgcattcgtgcattcttggcatcagatctccggttctgagaagtatgttggaagaagctagaattgaacatggtttcagaaacatcctgatttccggtgtcccatcagaagtagtccgtgtcttcatcagatttctgtattcttcacgctttgagcagggtgagatgaagaagtatgcccttcatttgctcgtactctctcatgttttctcggtacaatcgctgaagatcgtctgcaccgaccagctcgagaggttttttcttgctcctgataacgtggtggacgttctacaactggctagactctgtgacgcaccaaggctctcgctcatctgtacccgtatgatcgttggagatttcaagaccatctctctgtcagaagggtggaaagtgatgagacgggccaacccaagcctggagcaagagcttcttgagtttcttgttgaagtggacacaagaaggcaagaaagagctaaaaggatggaggaaaagaaggtttatcttcagttgtatgaagctatggaagctcttgttcatatatgccgagacggttgtaggacgattggcccctgggatcagaaactcaagggcagtcaggttgtttgcaagtttcctgcctgcaagggcatcgagttgctcgtgcgccatttctcggcatgcaaaaaacgtgtgcctcgcggctgcgccaactgcaagcgcatgtggcagcttcttgagctgcattctcgaatgtgttccacaccagacacctgcagggttcctctatgcaggtgaggtcttgtctttgttggtcaggatcatttcatttagacacacaagttttctaggttaatacaacagatgtttgctttcataaaaaaaaaaaaaaaa

SEQ ID NO: 3156 - protein, 351 aa, Triticum aestivum
  misc_feature: PFam Name: BTB; PFam Description: BTB/POZ domain
  misc_feature: PFam Name: zf-TAZ; PFam Description: TAZ zinc finger
  misc_feature: GI Number: 34907566; NR Description: B1078G07.24 [Oryza sativa (japonica cultivar-group)] >gi|20161276|dbj|BAB90202.1| B1078G07.24 [Oryza sativa (japonica cultivar-group)] >gi|21952829|dbj|BAC06244.1| P0696G06.1 [Oryza sativa (japonica
  misc_feature: GI Number: 42561724; NR Description: TAZ zinc finger family
  misc_feature: GI Number: 42573822; NR Description: TAZ zinc finger family
  misc_feature: GI Number: 29367535; NR Description: unknown [Oryza sativa
  misc_feature: GI Number: 36955924; NR Description: BTB and TAZ domain protein 5 [Arabidopsis thaliana] >gi|18420081|ref|NP_568031.1| TAZ zinc finger family protein / BTB/POZ domain-containing protein
  misc_feature: Utility: Useful for making plants with enhanced tolerance to
MAPLESGSSQLFFDSSAIDGPFDVYECGTLAGTRVVPDPPPPGTSYGKQRSSRNAKKARRVHGSEEVEDCWNRLFLEGYQADVRVSTGDGSQILSHSCILGIRSPVLRSMLEEARIEHGFRNILISGVPSEVVRVFIRFLYSSRFEQGEMKKYALHLLVLSHVFSVQSLKIVCTDQLERFFLAPDNVVDVLQLARLCDAPRLSLICTRMIVGDFKTISLSEGWKVMRRANPSLEQELLEFLVEVDTRRQERAKRMEEKKVYLQLYEAMEALVHICRDGCRTIGPWDQKLKGSQVVCKFPACKGIELLVRHFSACKKRVPRGCANCKRMWQLLELHSRMCSTPDTCRVPLCR

SEQ ID NO: 3157 - DNA, 1560 bp, Triticum aestivum
  misc_feature (1)..(1560): Ceres cDNA ID no. 21572735
  misc_feature (1)..(1560): Ceres CLONE  ID no. 703342
  misc_feature (1)..(1560): Also known as  Ceres CDNA ID no. 23562256
acacgttgctcgctgctcggagagaggttcacacggctgcggttgtctcgtcgccgtcttggtctccccgtcccggtccgcgcgtcgcggttctcacatgaccaccgggccgcgctagttttcacggcgtggccatggccgtcgtcgtctgcgtcaccggcgccggcggcttcatcggctcctggatcgtcaagctcctcctcgcccgcggctacgccgtccgcggcacctcccgccgcgccgatgaccccaagaacgcgcacctgtgggcgctcgacggcgcggcggagcggctgacgatggtgcaggtcgacctgctcgaccgggccagcctccgcgccgccttccacggctgcgacggcgttatccacaccgcatcaccgatgcacgacacccccgaggagatcatcgagccggtgatcaccgggacgctcaacgtggtggagatggccgcggacgccggcgtccggcgcgtggtgctgtcctccaccatcggcaccatgtacatgaacccccaccgcgacccggacgcgccgctcgacgagtcgtgctggagcgacctcgactactgcaaacaaaccaagaactggtactgctacgccaagacgatcgcggagcggggcgcgtgggaggcggcgcgggcgctggggctggacctggcggtggtgatcccggtggtgacgctgggcgagctgctgcagccgagcatgaacaccagcaccaggcacatactcaagtacctcaccggcgaggccaaggcgtacgtcaacgagtcgcacgcctacgtgcatgtcaaggacgccgccgaggcgcacgtcagggtgctcgaggcgcccaacgccgggggacggcgctacgtctgcgccgagaggacgctgcaccgcggcgagctctgccggatcctcgccgggctcttcccggagtacccgattcccacaagatgtaaggacgaggtaaatccgccaaagaagggttacaagtacaccaaccagcctctgaaggaccttggcatgaagttcacccctgtgcaagaatacctctatgaagcggtgaaatccctgcaagagaagggattcattcagaaggcttctggcaacaaggggcttgctagtagagggagttcgccgcctcaaaattcaacggcgcccgtgtttatgtcgaaactttgatgggcttctgcacaaagtaacaatgcagttcgccgtcatgtgaattgtaattcatttgattaagtgatatgttgctggacagttcttgtatgtggcaaactgccaactttgtgtagtagcgccgtgttgcctggaacagtacaccgctacagagcaacttcagtgatgcatgccaaatattttccctggtcgatgttcttctaccaccacctagttgttcaccttgtctgactcagcgggtacaaaaacccgatcaagttggcacttggcagcagagcatacaagcgtgccctctttggagtctcgttcggagagtgatgctgttttggccaacttctgcttgttgttggtcgtgatcttgtttatgcgctttctcaaaaaaaaaaaaaaa

SEQ ID NO: 3158 - protein, 344 aa, Triticum aestivum
  misc_feature: PFam Name: Epimerase; PFam Description: NAD dependent
  misc_feature: PFam Name: 3Beta_HSD; PFam Description: 3-beta
  misc_feature: GI Number: 50905679; NR Description: putative cinnamoyl-CoA reductase [Oryza sativa (japonica cultivar-group)] >gi|49388016|dbj|BAD25132.1| putative cinnamoyl-CoA reductase
  misc_feature: GI Number: 28544967; NR Description: cinnamoyl-CoA reductase [Zea mays] >gi|28544965|gb|AAO42622.1| cinnamoyl-CoA reductase [Zea
  misc_feature: GI Number: 28544969; NR Description: cinnamoyl-CoA reductase [Zea mays] >gi|28544963|gb|AAO42621.1| cinnamoyl-CoA reductase [Zea mays] >gi|3668115|emb|CAA75352.1| cinnamoyl-CoA reductase [Zea
  misc_feature: GI Number: 28544961; NR Description: cinnamoyl-CoA reductase [Zea mays] >gi|28544959|gb|AAO42619.1| cinnamoyl-CoA reductase [Zea
  misc_feature: GI Number: 50898722; NR Description: putative cinnamoyl-CoA reductase [Oryza sativa (japonica cultivar-group)] >gi|47848519|dbj|BAD22372.1| putative cinnamoyl-CoA reductase
MAVVVCVTGAGGFIGSWIVKLLLARGYAVRGTSRRADDPKNAHLWALDGAAERLTMVQVDLLDRASLRAAFHGCDGVIHTASPMHDTPEEIIEPVITGTLNVVEMAADAGVRRVVLSSTIGTMYMNPHRDPDAPLDESCWSDLDYCKQTKNWYCYAKTIAERGAWEAARALGLDLAVVIPVVTLGELLQPSMNTSTRHILKYLTGEAKAYVNESHAYVHVKDAAEAHVRVLEAPNAGGRRYVCAERTLHRGELCRILAGLFPEYPIPTRCKDEVNPPKKGYKYTNQPLKDLGMKFTPVQEYLYEAVKSLQEKGFIQKASGNKGLASRGSSPPQNSTAPVFMSKL

SEQ ID NO: 3159 - DNA, 1543 bp, Triticum aestivum
  misc_feature (1)..(1543): Ceres cDNA ID no. 21572736
  misc_feature (1)..(1543): Ceres CLONE  ID no. 703754
  misc_feature (1)..(1543): Also known as  Ceres CDNA ID no. 24356574
accttccgtcgcggtgacttccaccgcaccatcccggccggcggtccacggatctcctccgaacaccttaacccaccgccattaatcaccatgtccagcatctcgggcacacacatcacggcgtagcctacgcctgcctgccatggacgcctcgtcgtcgtccacccccgcggcggcggcgccgccgccgcccacgcattccgtgctcgacaccatccagaacaagctgagcccgggcgtgctcctcatcgtggccatcctggccatggtgttcttcatcttcggcctgctcaacctgctggtgcagaacatcctccggctgcggcgcgcgcggcggcaccgcctgcgcgttgccgcgggcgacgtcgacggcagcagccccacggcgctccagggtcagctccagcagctgttccacctccacgacgccggcgtcgaccaggccttcatcgacgcgctccccgtcttcgtctaccgcgccatcctcggcgccggcgccggccaccgaaaggggggcggcgaccccttcgactgcgccgtgtgcctgtgcgagttcgccatggacgacgcgctccggctgctgcccacctgcggccacgccttccacgtgccctgcatcgacgcctggctgctctcgcactccacctgcccgctctgccgcggcagcgtcctcgccgccgacctctcgccagcttccagcccgatggtgctcgtcctcgagtccgacggtcgctccgacacggccgcggaggcgccgggtggaagggacgacaatgagaatgaggggtccccgaaggcagaggaggtcgtcgaggtgaagctcggcaagctccggtgcatggacggcagcaatggcggttcagagcatctcgccgccgatcaaaccgctggcagagacgacctcggacgtaggaggtgcctgtccatgggatcctacgagtacgtcatggacgaccacgccgcgctccgcgtcgccatcaagacgccagccaagaagcgcccgaggtcgcggcgccggcacgcgctctcggagtgcgacttcgggagcgacgtcgccaagagaggggcgtgggaagcggccgtgaaagaggccgccgcgccggagcccgacggagcgcgccgcggcgacgacgcgaggctgagcaacaaggacagcttctccgtgtccaagatctggatggtgcgcggcgccaagaaggaagacggccggacactggccggtacgaggcggtccgtgtcgttccggtggccggcgatggccgaggcgagcaggaacgacggcgccgaccgggagcgccgggacgtggagtcgcagtcaggaagcttcggcagcagcggcgccccgtcccttgcggaggagaggctgccgctcgcgcggacgaggacggcgccgctttgggccgccggcgggtggcaggcgaacagcagcagcgccggaagccattcctgaggcgcatttgatttttgcacatcttcttcgtcttgaaattcagtttgcaatttgaacgcagaagatggatttgttttaaaaaaaaaaaaaaaa

SEQ ID NO: 3160 - protein, 435 aa, Triticum aestivum
  misc_feature: PFam Name: zf-C3HC4; PFam Description: Zinc finger, C3HC4
  misc_feature: PFam Name: Mucin; PFam Description: Mucin-like glycoprotein
  misc_feature: PFam Name: Atrophin-1; PFam Description: Atrophin-1 family
  misc_feature: PFam Name: Cupin_1; PFam Description: Cupin
  misc_feature: PFam Name: MAGE; PFam Description: MAGE family
  misc_feature: GI Number: 51091716; NR Description: RING finger 1-like
  misc_feature: GI Number: 50946255; NR Description: putative RING finger 1 [Oryza sativa (japonica cultivar-group)] >gi|42407444|dbj|BAD10051.1| putative RING finger 1 [Oryza sativa
  misc_feature: GI Number: 4185131; NR Description: putative RING zinc finger protein [Arabidopsis thaliana] >gi|25411889|pir||H84566 probable RING zinc finger protein [imported] - Arabidopsis thaliana
  misc_feature: GI Number: 51535192; NR Description: putative RING finger 1
  misc_feature: GI Number: 10177512; NR Description: RING zinc finger protein-like [Arabidopsis thaliana] >gi|51970768|dbj|BAD44076.1| RING finger -like protein [Arabidopsis thaliana] >gi|15242616|ref|NP_198841.1| zinc finger (C3HC4-type RING
MDASSSSTPAAAAPPPPTHSVLDTIQNKLSPGVLLIVAILAMVFFIFGLLNLLVQNILRLRRARRHRLRVAAGDVDGSSPTALQGQLQQLFHLHDAGVDQAFIDALPVFVYRAILGAGAGHRKGGGDPFDCAVCLCEFAMDDALRLLPTCGHAFHVPCIDAWLLSHSTCPLCRGSVLAADLSPASSPMVLVLESDGRSDTAAEAPGGRDDNENEGSPKAEEVVEVKLGKLRCMDGSNGGSEHLAADQTAGRDDLGRRRCLSMGSYEYVMDDHAALRVAIKTPAKKRPRSRRRHALSECDFGSDVAKRGAWEAAVKEAAAPEPDGARRGDDARLSNKDSFSVSKIWMVRGAKKEDGRTLAGTRRSVSFRWPAMAEASRNDGADRERRDVESQSGSFGSSGAPSLAEERLPLARTRTAPLWAAGGWQANSSSAGSHS

SEQ ID NO: 3161 - DNA, 1499 bp, Triticum aestivum
  misc_feature (1)..(1499): Ceres cDNA ID no. 21572737
  misc_feature (1)..(1499): Ceres CLONE  ID no. 703802
  misc_feature (1)..(1499): Also known as  Ceres CDNA ID no. 24368658
gaaaaacttttcttttggggggtccccgacacgtcacagcacagcaccgctgctcccccggcgatggcctgcggcggcggcggcgagtctgaggcggagcggcgggcagagctgctgcgcgagataacggaggagggcggcttcgctttcgtcgcctcggcggagaaggcggcggcgggggacctgcgggcggcggaggcggcgcgggagatggcgtgggagcaactccactcggggccctggagcgaggtcggcagcgcgtggagggacgcctacgcgctcgcctgcctccacgtcgcgcgcctccgccgggccgccgccgaccgccgcgccgcgctccgggcgctcgacatggggctcatcatggggggaaacctcctccgcgccgatctcgaggccgccctggcctccatcgccgcggagccgagcgacggcgaaggtgacggcgcggaggctgtcgatgaggaagccaataggtggagggaagggctcgacaggaaccgtgacatcgccgatgccctcaaaattcttccaacaaagtctttatcttgtaaggaaatcgcaagacgatcgtgtatatctttggaggagtttatatgtgatcactttttacctgagacccctgttataatcagtggctgcatcgatcattggcctgcgatgacaaaatggaaggacatccagtacctaaagaagattgctggggatcggactgttcctgttgaggttgggaagagctatgtttgcagtgagtggaagcaggagcttatcacgttctcccagttccttgagaggatgtggtcaaccgcctgtccttcaaatttgacatatctagctcagcatccattatttgagcagattttagttattgacgtttggcagataaaagagcttcatgaagacataatggttcctgactactgttatgctggtggaggggaactccaatcacttaatgcttggtttggtccacacgggacagtgacaccattgcaccacgacccgcatcacaacattttagctcaggtcttgggcaggaagtatattagactctatcctggttctgtatccgaagacttatacccacacacagaaactatgttaagcaatactagtcaggtggatcttgacaacatagatatggatgagttcccaaaggtagaaaaccttgatttcatggactgcatattggaggaaggtgacatgctgtatattcctccgaaatggtggcattacgtcagatctctttcgattagtttctccgttagcttttggtggcgtacaacagttataagtccgagcgtgtaatgaaaacattttggtctttgatacatcaggaccggatctcaggactcaggaacttggtaagcctgactggacacattgtttcaacattctgtcgcccactgttgcgtggatgtagtcgtttgtacctacgattgcagatgtacgtggttatttttactatgattattttggacataaaaaaaaaaaaaaaa

SEQ ID NO: 3162 - protein, 414 aa, Triticum aestivum
  misc_feature: PFam Name: JmjC; PFam Description: JmjC domain
  misc_feature: PFam Name: Cupin_4; PFam Description: Cupin superfamily protein
  misc_feature: GI Number: 50947487; NR Description: N-acetyltransferase and Transcription factor-like protein [Oryza sativa (japonica cultivar-group)] >gi|42408989|dbj|BAD10244.1| N-acetyltransferase and Transcription factor-like protein [Oryza sativa (japonica
  misc_feature: GI Number: 21928039; NR Description: AT3g20810/MOE17_10 [Arabidopsis thaliana] >gi|20147203|gb|AAM10317.1| AT3g20810/MOE17_10 [Arabidopsis thaliana] >gi|30685945|ref|NP_850617.1| transcription factor jumonji (jmjC)
  misc_feature: GI Number: 62641259; NR Description: PREDICTED: similar to
  misc_feature: GI Number: 28317179; NR Description: GM21055p [Drosophila
  misc_feature: GI Number: 34859155; NR Description: similar to RIKEN cDNA
MACGGGGESEAERRAELLREITEEGGFAFVASAEKAAAGDLRAAEAAREMAWEQLHSGPWSEVGSAWRDAYALACLHVARLRRAAADRRAALRALDMGLIMGGNLLRADLEAALASIAAEPSDGEGDGAEAVDEEANRWREGLDRNRDIADALKILPTKSLSCKEIARRSCISLEEFICDHFLPETPVIISGCIDHWPAMTKWKDIQYLKKIAGDRTVPVEVGKSYVCSEWKQELITFSQFLERMWSTACPSNLTYLAQHPLFEQILVIDVWQIKELHEDIMVPDYCYAGGGELQSLNAWFGPHGTVTPLHHDPHHNILAQVLGRKYIRLYPGSVSEDLYPHTETMLSNTSQVDLDNIDMDEFPKVENLDFMDCILEEGDMLYIPPKWWHYVRSLSISFSVSFWWRTTVISPSV

SEQ ID NO: 3163 - DNA, 1573 bp, Triticum aestivum
  misc_feature (1)..(1573): Ceres cDNA ID no. 21572738
  misc_feature (1)..(1573): Ceres CLONE  ID no. 703856
  misc_feature (1)..(1573): Also known as  Ceres CDNA ID no. 24356688
gaaatcccaagcagcccccgcagttcgtctctccctccgctcagagccctcactcccccaactctcgccaggtggcggcgtcggcggcggcgggcgggcgatcggcggggcaggtccacggcgtccgtgcaccgggcaggcacgcgggagctgccggagcagctgccgaccgataggccgaccgtctggtcaagctgttcttaggatgaggtcctccaagactaatgggagcgtgcagaaggcagggagagttagccatgcccagggagaagggccgagctgggttcttgtcgcgggaggagttctggttagcacgctctcggtcagacttggatgcaagctgaagcagatgtttgataccaagaagcaaaatagtacatccagagccaaaagaagacctggagcttgtgaactacactccaatctgtaccggtttgatgatgaaaccaattgctactgctgtgtctcagatggtggagtggaaatcaagcaagcacctgcaagttctttatcgaaacctgatgaaccctcccttcctcttgcaaagataccagggccagaatcaagcaaagagaacagtggcgtcatgtggacgtcatcgcctgaccggcttgaagatcatcgcagaccattgcagtactcaaacagttctggctctccctgtgtttcagaatcaggatctgacatttatatcaagagagaggtcatacagaagttgagacagcacctcaggagacgtgatgagatgatcatggagatgcaagcacagatagctgatcttaagaactctctcagcatcgaggagacgcagaccgccaatttgcagtcccagctggatggtgccaatcgagatctgttcgaatccgacagggagatccagcagctaaggaagatcatcgcagatcattgtgtggctgaagcactctcccgcgacaagcccttgcaagctggaaactggcaaccagatgccgccaatgggcatgctaatggctatgctgatagcagcatcgatgaccctgagctgcactgtattggtattgagaagaggaacggcgaggcagagagggtggagatgctcaagagagaggtcggcgagctgaaggaggtcatcgaagggaaggacttcctgctccagagctacaaggagcagaaggtggagctctgctcgaagatgagagagctgcaggaaaggctctcggcacaggtgcccaacatcttgtaggatctactcgtcaacctcgctaaggcgcagtttgcaagggctaatgtagctagcaaattggtgtcgtcaagggattcacaggaaaagatttcgtcgcacgtgctagggtctttgcagaatgtttacattgatttgtttctttcctctcagtttctgtcattggttgctcagtgtcagaaaaagggcttagttttttctttttcagttgctagggctaaggtagctttagattgaacttggatgagtgttgtacaggtatttcggtcttgaggcgtgatcatgtaatgtgccccctcttttagctcagcgtggtttacgccggtgtggcttcgaataaaaaaaaaaaaaaaa

SEQ ID NO: 3164 - protein, 338 aa, Triticum aestivum
  misc_feature: GI Number: 21536672; NR Description: unknown [Arabidopsis thaliana]
MRSSKTNGSVQKAGRVSHAQGEGPSWVLVAGGVLVSTLSVRLGCKLKQMFDTKKQNSTSRAKRRPGACELHSNLYRFDDETNCYCCVSDGGVEIKQAPASSLSKPDEPSLPLAKIPGPESSKENSGVMWTSSPDRLEDHRRPLQYSNSSGSPCVSESGSDIYIKREVIQKLRQHLRRRDEMIMEMQAQIADLKNSLSIEETQTANLQSQLDGANRDLFESDREIQQLRKIIADHCVAEALSRDKPLQAGNWQPDAANGHANGYADSSIDDPELHCIGIEKRNGEAERVEMLKREVGELKEVIEGKDFLLQSYKEQKVELCSKMRELQERLSAQVPNIL

SEQ ID NO: 3165 - DNA, 1091 bp, Triticum aestivum
  misc_feature (1)..(1091): Ceres cDNA ID no. 21572739
  misc_feature (1)..(1091): Ceres CLONE  ID no. 704142
  misc_feature (1)..(1091): Also known as  Ceres CDNA ID no. 24356570
gctcatattagctgtgcgcctttgccaaatcacaccggcacgggttgggaaccaaggaaccgttcgtttgcgtttgcggagcggggcagagcagtgcggagggcatggaagcctcgcggttcggcttcggccgcgacatggcggcggcgttcaagttcgaccccaccgacgccgacatcgtcgcctcctacctcctcccccgcgcggtcggcctcgacgagccccacggccacgggcgcgccgtcatcgacgacgaccccatgagcctcccgccgtgggacctcatggagaagcacaaccacgggacaagccaccaggccttcttcttcgggcctcccaggaacgggggccccgtcaagcgcgtcgtgcccggcaagggcggcggcacgtggcaagggcagaatggcagcgtcgggaccgtcaccctgttctgcgatggcgatggcgatggcgcccgcgcgggagaggtggacatcagctacaggaggtacgacctcacctacaagcgcgcgagcgacaaggcccccagcggctgggtcatgagcgagtaccagatcacctcgccgccgctcttgagcacggtgctcacccgcatcgtattgaccgtcgccgccagggagcagaggaagcgacagccggccgacccggagccgtttgctcagcacggccctgacaaggtgctggccgtcgcagccgctgccgccgccgccgccgaacatcaacgggtttcaccaccgccagtgcagtcgggccctgacgcgcaagccgacgatggtgctctctaccatggcggtactagcgtcaccggcgtgggggagaacggtgggcactacactgttccgcttctgctcaacggccaagagtactacaaggacaagagccgcgtcaaacgcaaacggcggcgatatggggcatgagccatcctgatcgaacctgaatccagtcgggagacgcccgcccgtacatttggatcacggaatagcatgtatgtcatccgtttctaacttgtttctgtggatccttggttcttgacgttcctgggtttttaatcgggaaggatacatggcctgatttcaaaaaaaaaaaaaaaa

SEQ ID NO: 3166 - protein, 270 aa, Triticum aestivum
  misc_feature: PFam Name: NAM; PFam Description: No apical meristem (NAM) protein
  misc_feature: PFam Name: Mucin; PFam Description: Mucin-like glycoprotein
  misc_feature: GI Number: 53769500; NR Description: COG1478: Uncharacterized
MEASRFGFGRDMAAAFKFDPTDADIVASYLLPRAVGLDEPHGHGRAVIDDDPMSLPPWDLMEKHNHGTSHQAFFFGPPRNGGPVKRVVPGKGGGTWQGQNGSVGTVTLFCDGDGDGARAGEVDISYRRYDLTYKRASDKAPSGWVMSEYQITSPPLLSTVLTRIVLTVAAREQRKRQPADPEPFAQHGPDKVLAVAAAAAAAAEHQRVSPPPVQSGPDAQADDGALYHGGTSVTGVGENGGHYTVPLLLNGQEYYKDKSRVKRKRRRYGA

SEQ ID NO: 3167 - DNA, 1478 bp, Triticum aestivum
  misc_feature (1)..(1478): Ceres cDNA ID no. 21572740
  misc_feature (1)..(1478): Ceres CLONE  ID no. 704168
  misc_feature (1)..(1478): Also known as  Ceres CDNA ID no. 23465999
tcgcacggcgaagaacagggcacctctgaccgaacatagcagcatagcatctccccacgctctcacgcatcaccacagctacagcatcaagatcactagtagtagatcaactagccaggtatagctatggcgtccgagcagagtcgccgcgaggagcgcgcgcaggccgcggcgcagaaggcgaccgacgagctcgccgcggccaggcgggacatgcgcgagcccagcagcccaggacggcggaccggcatcttcggcaccgtgcaggagagcgcgcgctccctgatgggcgccgtccgcgacaccttctccggcggcgtccgggacacaaccacggcacacgacagccactccacaggcgccatggggaccgcgggggggaaactcaatgagtacgggagctacgcatcccagaaggccgatgaagggaaggagagcgcgagtgagatggcggaagccgccgcggggaagaccaaggagaccaaggatgcggccgcggagaagacgagggagatggcggacgccgccgcggggaagaccaaggagaccaaggacgcggcggtggagaagacgagggagatggcggacaccgccgcgacgaaggccgtggagaccaaggacgcggccgcagagaaggcgcgcggcgcgggggagatggtgacggagaaggcgaggagtgccaaggacacggcggctgacaaggcgagtggagcggcggagaaggcgaagggcgccaaggacgcagccttcgatacagcggagggtgccaaggagtacatggtggacaagaaggaggacgcccggcgagcgctcgccggctcggccaaggatagcaagggcgagacgaacgagtcggcgtggcaacagggccaggacgtgcggcggcgggcggcggagaaggccgaggaggttcgtcagcgcacgcaccaaccgccggaggaggggaggtcgaagtcggcaacggagaacatcttcgggtcggcgcaggggttgacggaggcgttcaaggagaagatgacgatgccgacggacgtgatcgagcggaagctcgctgagaggaaggggacgccgacggacgcgagcaggggcgaggcactgaacacggacgacgtgatgatgcgcgtgaaggaggcggaccagatgaccgggacagggtttaacgacgtcggcaagatgggcgaggagggcacgggcatgaaggcggcactgagggtcgacgatgaggaggacgtgatgctgcgggtgaaggcggcggaccagatgacagggcaggcgttcaacgacgtcggcccgatgggcgaggagggcacgggatggggtccggcgttgagggcgcggaaggacgcctgagagcgttgacacgtgcatgcactcctgttgcgtgtgagcgttttgtgtgacactttgtagtacaagctactcctgtagcaaatcaataaattatgcccggcaactttttatcaaaaaaaaaaaaaaaa

SEQ ID NO: 3168 - protein, 407 aa, Triticum aestivum
  misc_feature: PFam Name: LEA_4; PFam Description: Late embryogenesis
  misc_feature: PFam Name: S-antigen; PFam Description: S-antigen protein
  misc_feature: PFam Name: Glutenin_hmw; PFam Description: High molecular
  misc_feature: PFam Name: Fibrinogen_BP; PFam Description: Fibrinogen
  misc_feature: PFam Name: TolA; PFam Description: TolA protein
  misc_feature: GI Number: 485510; NR Description: embryonic abundant protein, group 3 - wheat (fragment) >gi|170692|gb|AAA34267.1| group
  misc_feature: GI Number: 56783701; NR Description: putative embryonic
  misc_feature: GI Number: 4539485; NR Description: BP8 [Betula pendula]
  misc_feature: GI Number: 282899; NR Description: embryonic abundant protein, 59K - soybean >gi|170010|gb|AAA33985.1| maturation polypeptide >gi|384333|prf||1905420A late embryogenesis abundant
  misc_feature: GI Number: 61658803; NR Description: RPGR [Sus scrofa]
MASEQSRREERAQAAAQKATDELAAARRDMREPSSPGRRTGIFGTVQESARSLMGAVRDTFSGGVRDTTTAHDSHSTGAMGTAGGKLNEYGSYASQKADEGKESASEMAEAAAGKTKETKDAAAEKTREMADAAAGKTKETKDAAVEKTREMADTAATKAVETKDAAAEKARGAGEMVTEKARSAKDTAADKASGAAEKAKGAKDAAFDTAEGAKEYMVDKKEDARRALAGSAKDSKGETNESAWQQGQDVRRRAAEKAEEVRQRTHQPPEEGRSKSATENIFGSAQGLTEAFKEKMTMPTDVIERKLAERKGTPTDASRGEALNTDDVMMRVKEADQMTGTGFNDVGKMGEEGTGMKAALRVDDEEDVMLRVKAADQMTGQAFNDVGPMGEEGTGWGPALRARKDA

SEQ ID NO: 3169 - DNA, 1595 bp, Triticum aestivum
  misc_feature (1)..(1595): Ceres cDNA ID no. 21572741
  misc_feature (1)..(1595): Ceres CLONE  ID no. 704820
  misc_feature (1)..(1595): Also known as  Ceres CDNA ID no. 24356554
aaaaaaaaaataaaaaaaacattcccaaaccctaagccctgcgtccacagtccgcccccaactctagggtttagtgacgaccgccttgcctcgcgcgatcctcctgcgcgccgatccggtcactcgcgctagtgcccacgccccagaggcggcggtggactggcgacgagggagggggcggatgcagacggaggcgagcgtggggatggccgccgcgaccgtggacggcgccgccgccgtcgccgcgcggaggtactcgacgcagcagcagcagcagccgcagccgcagcagcaccacaaccagcccaagcttgggacgacgctccacctcctcgccggcggcgtcgccggcgccgtcagcaagacctgcaccgcgccgctcgcccgcctcaccatcctgtttcaggtgcaaggaatgcactcagatgtggctacgatgcgcaacactagtatatggcgtgaagcgtcccgcattgtctatgaagaagggctacgagctttctggaaaggaaatcttgtaactattgcacatcggttaccttactcctcgattagtttctatacatacgagaaatataagaattggcttcagatgatacctggtctcgacagcaatggtggattgggtgccgatgttggtgtcagaatggtaggcggtggcttgtctgggataactgcagcttctttgacatatccactggacttggtacggacacgtctggctgctcagacgaacacagcctactacaggggcatatcccatgctctttttgcgatctgcagagatgagggtcccagggggttgtacaagggtcttggtcccactttactgggagtaggccccagtatagcaataagcttctcagtttatgaaactctgcgttcacattggctactagagcggccatgtgattcccctatctttatcagtttggcttgtggaagtctttcaggagttgcatcatcaacttttacatttccattggatcttgtaagacgccgcaagcagttggaaggtgcagctgggagggccaatgtctacaagacaggacttgttggaacgtttgggcatattattcagacagaaggttatagaggattgtatagagggatcttgcctgagtactgcaaagtggttcccagcgtcggcctcatttttatgacgtacgagacactgaagtccatgttcacaggaggggcatcagatgaatagatctccaatgtctgatcatgctcgacagttttgacacctgggccagagtagcattggaagtgattagggagggagggggaggaagagatgtgtttgtagcatatggtaggatttaggtggtgctaaattttggagttcataacgtagcagtatcatcaaacagtcttttatgtggctataggttttcttgtagtgcacccaagaagatcagtaagtgccataggtcttccaaaattttgctgtccacccttgttttgtgtatgttcacattttcagttggtaatgtactggctatcatcttcagcctggcgatttcatacctctggaatacggcctctgatataatttatgttgttacagtgaaaaaaaaaaaaaaaaaaaa

SEQ ID NO: 3170 - protein, 343 aa, Triticum aestivum
  misc_feature: PFam Name: Mito_carr; PFam Description: Mitochondrial
  misc_feature: GI Number: 34902034; NR Description: putative peroxisomal Ca-dependent solute carrier protein [Oryza sativa (japonica cultivar-group)] >gi|29893633|gb|AAP06887.1| putative peroxisomal
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
MQTEASVGMAAATVDGAAAVAARRYSTQQQQQPQPQQHHNQPKLGTTLHLLAGGVAGAVSKTCTAPLARLTILFQVQGMHSDVATMRNTSIWREASRIVYEEGLRAFWKGNLVTIAHRLPYSSISFYTYEKYKNWLQMIPGLDSNGGLGADVGVRMVGGGLSGITAASLTYPLDLVRTRLAAQTNTAYYRGISHALFAICRDEGPRGLYKGLGPTLLGVGPSIAISFSVYETLRSHWLLERPCDSPIFISLACGSLSGVASSTFTFPLDLVRRRKQLEGAAGRANVYKTGLVGTFGHIIQTEGYRGLYRGILPEYCKVVPSVGLIFMTYETLKSMFTGGASDE

SEQ ID NO: 3171 - DNA, 1436 bp, Triticum aestivum
  misc_feature (1)..(1436): Ceres cDNA ID no. 21572742
  misc_feature (1)..(1436): Ceres CLONE  ID no. 705402
  misc_feature (1)..(1436): Also known as  Ceres CDNA ID no. 23477101
agtacacacctcggtttggaacttggaagtcgagacacatacacacacacatactagatacatatccatacttctgttgctcattgcatctcctagttcagcaaattgccaaactgagacatgggaattgatcgtgtcaacacggcagccactggccgcggacgcaccgtctgtgtgaccggcgccggcggtttcatcgcgtcctggctagtgaagctcctcctggagaagggctacgccgtccacggcaccgtccggaaccctgatgacgtggcaaggaatgcgcacctgagagccttggaaggggcgacggagcgactgaccctcttccaggtggacctgcttgacaaggagagcctcgtcgctgctttccaaggatgcgaaggcgtattccacaccgcatgccccgtcaccgatgacccggaaaaaatgatcgagccggcagtgaacggaacgagaaacgtgttcaacgccgcggcagaggtgggcggcatccggcgtgtggtaatgacgtcgtcgatcggctccgtgtacatggatcctcgtcgtagcatcgatggggaggccgatgagacatgttggagcgacctcgagttctgcaagaacacaaagaattggtactgctatgcgaagacggtggcggagcaggccgcatgggagctcgccaaggagaggaagcttgaccttgtggtgatcaacccgtctctagtgttgggccctctgctacagatggcggtgaacgccagtacgtggcatattgccaagtatctggacggctcggtgcagacgtatgccaacgcggcacaggcgtacgtgcacgtccaggacgtcgcggacgcgcacgcgcgtgcgtacgagacgcccgatgcgcatggccggtacctctgcgcggggcgcacgctgcaccgtgccgaggtgtgtcgcatccttgccaagttcttcccggagtaccccgtgcccacgaggtgcaaggaaggggcgggcgagatgaagaagggttgtcggttcagcagtcggaggatcatggatctcggcgtcggcatcacgccggcgagccagtgtctctacgacacggtcaccagccttcaggacaagggcatcttaccacgtcgcgacgctgatatgtcctgacaactccatggtcaccttggtcaagttagcagcatgcatgcccgcttgatgattacaaagtcatggcatttaattctttatttacttcttagttgttcaaatataaggccctgtccagagcacctccaccccacaactccactccccaagttgatggagttacagttgaaaactgtggagcagctatttcctggctccacagctcccagaatttcgtggagctggtggatttccgaacaggccctaagtgtccattgtaaaagaatatgttatgatatgatgtttatccaaaaaaaaaaaaaaaa

SEQ ID NO: 3172 - protein, 336 aa, Triticum aestivum
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: GI Number: 50943383; NR Description: putative cinnamoyl-CoA reductase [Oryza sativa (japonica cultivar-group)] >gi|37805889|dbj|BAC99738.1| putative cinnamoyl-CoA reductase
  misc_feature: GI Number: 28544967; NR Description: cinnamoyl-CoA reductase [Zea mays] >gi|28544965|gb|AAO42622.1| cinnamoyl-CoA reductase [Zea
  misc_feature: GI Number: 28544969; NR Description: cinnamoyl-CoA reductase [Zea mays] >gi|28544963|gb|AAO42621.1| cinnamoyl-CoA reductase [Zea mays] >gi|3668115|emb|CAA75352.1| cinnamoyl-CoA reductase [Zea
  misc_feature: GI Number: 28544961; NR Description: cinnamoyl-CoA reductase [Zea mays] >gi|28544959|gb|AAO42619.1| cinnamoyl-CoA reductase [Zea
  misc_feature: GI Number: 50898722; NR Description: putative cinnamoyl-CoA reductase [Oryza sativa (japonica cultivar-group)] >gi|47848519|dbj|BAD22372.1| putative cinnamoyl-CoA reductase
MGIDRVNTAATGRGRTVCVTGAGGFIASWLVKLLLEKGYAVHGTVRNPDDVARNAHLRALEGATERLTLFQVDLLDKESLVAAFQGCEGVFHTACPVTDDPEKMIEPAVNGTRNVFNAAAEVGGIRRVVMTSSIGSVYMDPRRSIDGEADETCWSDLEFCKNTKNWYCYAKTVAEQAAWELAKERKLDLVVINPSLVLGPLLQMAVNASTWHIAKYLDGSVQTYANAAQAYVHVQDVADAHARAYETPDAHGRYLCAGRTLHRAEVCRILAKFFPEYPVPTRCKEGAGEMKKGCRFSSRRIMDLGVGITPASQCLYDTVTSLQDKGILPRRDADMS

SEQ ID NO: 3173 - DNA, 1694 bp, Triticum aestivum
  misc_feature (1)..(1694): Ceres cDNA ID no. 21572743
  misc_feature (1)..(1694): Ceres CLONE  ID no. 705524
  misc_feature (1)..(1694): Also known as  Ceres CDNA ID no. 24356564
aatcctccattcccagaccagaaccagagcaagctcggagcaccgctcccccgccccgccccgcccagcaaagttccatcgcgaagccgcgctgggaacgccgtccagccacgccacgcgcgatgagcttctcgtcggcgtgcaagcagcaggtgctgggcgccggcggcgaggaggcgagggaggaggagggggcgatggagctcatccccggcctgccggaggaggtggccgagaagtgcctcctccacctccccttcctctaccaccgcctgttccgcaccgtctcctccaactggaaccggttcctcaccgacgcgccgggggccgccgccaagggctcggctccgccggcggcgacggcgaccgtgtccctctcactgccgttcctcttcgccttcgccttcgaccccgtctcgcgccgcctccagtgccaggcgctcgaccccttctcccgccgctggctgctgctgcccccggtcccctgcggcgccgcggccggctcgttcgcggtggtgggcctccccgcacgcggcgagatctacgtaatcggcggcgtggaggagggcggcgacaaggccgtgagcagcgtggccgtgtacagcgcggcgaccaaccggtgggggcaggtggccggcatgaggacggcgagggggtacatggcggccggcgaggtgggcgggcgcgtggtggtggccggcgaggacggcgaggcggaggtgttcgacccggagtcggcgcggtggtcgcccgcagctccccggggcggcgcggccgtggcgaggtacaacgcggcggcggcgggcgggaagctgtacgtgacggaggggtgggcgtggccgttcgagcgcgcgccgcggggcgcggtgtacgacgcggcggcggacgcgtggtcggacatggcccgcgggatgcgggaggggtggacgggctcctgcgccgtgtccggcggccggatgtacatcgtggccgagtacggcgagtggcggctgaagcggtacgacgagccgcgcgacgagtggcggatggtggccggcggcggggtgccgcaggaggtgcggcggccgcacgtcgtcgcgggccagctggaggaggtcggctgcggcaggcgcaggatctacgtggtcggcgcgggcctcgacgtcgccgtcggcaccgtgtccgccgtccagagcggcgcggcggaggaggagcgggtggagtgggaggtcgtgaaggggcccgaggagttcgtcgggctcgcgccctgcaacgcgcaggtcctctacgcctgagacggacgccaacctcgtcggcgccggtcaccggcgggagaaagggaaaggagacccgaccctgggcccgcatgtcagttaccaacgcctccgtcatcaccgagctagtagctcactgctgacgccgcaggcccgcagcggtcgggcggctactagtgctgctagtacagccagccgagcgcacgggcgggcggcgaggcctgccatgcgggcccccggcgtcagccgccggtgcgagagcagccgagcgtgccctttatgcctgctgagcagagcagagcagagcagggaggaagcgtgcgtgcgtgcgtgtaaagagcaaaatgattacacctgcagcaatggctcgtagtagtccaccagactttatttcccgctttatcagagcattttccgcttgcgttaaaaaaaaaaaaaaaa

SEQ ID NO: 3174 - protein, 383 aa, Triticum aestivum
  misc_feature: PFam Name: F-box; PFam Description: F-box domain
  misc_feature: PFam Name: Kelch_1; PFam Description: Kelch motif
  misc_feature: PFam Name: GRP; PFam Description: Glycine rich protein family
  misc_feature: PFam Name: Pkinase; PFam Description: Protein kinase domain
  misc_feature: PFam Name: Cupin_1; PFam Description: Cupin
  misc_feature: GI Number: 51536380; NR Description: kelch repeat containing F-box protein-like [Oryza sativa (japonica cultivar-group)] >gi|51535613|dbj|BAD37556.1| kelch repeat containing F-box
  misc_feature: GI Number: 21593163; NR Description: unknown [Arabidopsis thaliana]
  misc_feature: GI Number: 50508810; NR Description: kelch repeat containing
  misc_feature: GI Number: 66776103; NR Description: LigA [Anaeromyxobacter dehalogenans 2CP-C] >gi|66858140|ref|ZP_00402169.1| LigA
  misc_feature: GI Number: 66778264; NR Description: LigA [Anaeromyxobacter dehalogenans 2CP-C] >gi|66856061|ref|ZP_00400131.1| LigA
MSFSSACKQQVLGAGGEEAREEEGAMELIPGLPEEVAEKCLLHLPFLYHRLFRTVSSNWNRFLTDAPGAAAKGSAPPAATATVSLSLPFLFAFAFDPVSRRLQCQALDPFSRRWLLLPPVPCGAAAGSFAVVGLPARGEIYVIGGVEEGGDKAVSSVAVYSAATNRWGQVAGMRTARGYMAAGEVGGRVVVAGEDGEAEVFDPESARWSPAAPRGGAAVARYNAAAAGGKLYVTEGWAWPFERAPRGAVYDAAADAWSDMARGMREGWTGSCAVSGGRMYIVAEYGEWRLKRYDEPRDEWRMVAGGGVPQEVRRPHVVAGQLEEVGCGRRRIYVVGAGLDVAVGTVSAVQSGAAEEERVEWEVVKGPEEFVGLAPCNAQVLYA

SEQ ID NO: 3175 - DNA, 995 bp, Glycine max
  misc_feature (1)..(995): Ceres cDNA ID no. 21572744
  misc_feature (1)..(995): Ceres CLONE  ID no. 709385
  misc_feature (1)..(995): Also known as  Ceres CDNA ID no. 24356333
aagcaaaaattacgcgcgggttttactctcgtgtacctctctcgctgcaacgctcaatctctcgactggtgctcgttgctcactttctctgttcttcacaatcctctctctctctctctctctctctctctctctctctctctctctctctctctgtctcgttgggttaaggactagagaatttccataggacttcaagaagacagtgggcaatgctgggcttttcatatggagaaatatttctgttgcttggagctactgctgctctgatagggccaaaggatttaccaatcatatgcagaacagcaggaaggctagctggtcgagctattggatatgtacaattggctcgtggtcagtttgacactgttatgcagcaatctcaagctcgccaggttcataaggaactgcaagacacaatggctcagctagatgccattcgccatgaaattcgaagtatatcaatcataaatcctggccctttgacgcggaggcttgtggatgatcctgaccagacatctatctcaaatgaaagtaggaaaccagaagaatctggacaagagaatagctcgatacccactgttatgaaggattcaacttcaatgtcatccaattcatgccatatgcaaaatcaagcaaccatttattccagattggtaaactcccctgccataaaaaatgagttgtcagcaagtagtaccgaagttgagaagatagaagataaactacagcttactgtcttaccaatttctgctgaaaatgctggactattaccaattcgtggggctgatgtgaaaggatctgacatagttcttgaagcaattgtggaggcagaggtcgctcataatgcaaaggaattcttttcacagccccaaaatcaaatatgattgatatggtattgattcttgttttttcttttcaagttcaggctagaaaatctgtcggagtctttgggttcaagagattattaattttttctgaaaaaaaaaaaaaaa

SEQ ID NO: 3176 - protein, 224 aa, Glycine max
  misc_feature: PFam Name: MttA_Hcf106; PFam Description: mttA/Hcf106 family
MLGFSYGEIFLLLGATAALIGPKDLPIICRTAGRLAGRAIGYVQLARGQFDTVMQQSQARQVHKELQDTMAQLDAIRHEIRSISIINPGPLTRRLVDDPDQTSISNESRKPEESGQENSSIPTVMKDSTSMSSNSCHMQNQATIYSRLVNSPAIKNELSASSTEVEKIEDKLQLTVLPISAENAGLLPIRGADVKGSDIVLEAIVEAEVAHNAKEFFSQPQNQI

SEQ ID NO: 3177 - DNA, 1696 bp, Glycine max
  misc_feature (1)..(1696): Ceres cDNA ID no. 21572745
  misc_feature (1)..(1696): Ceres CLONE  ID no. 709539
  misc_feature (1)..(1696): Also known as  Ceres CDNA ID no. 23666641
tctctctctctctctctctctctcacaagccacaatttcaacgccacaccaaaaattccactgcaccaccaccctccccatttgtacttttcttctcattctctttccactcccctgcattctgcacacaatctagctttacgtgcttctgggcaaccgcataaggttaaactgttaagcatatcattgaaatccttttgggattggaacttgatatgatcatttgtattggggagtaagaccttgttacttttgcaaatgctaaattttaataggatcagaagtcagcccaggacaaccagatctatgtctttgggaggcatggattacgtggatccaaaaaggaaaggcaattttgttggaaaagtttttcttgctgcagcattaacggcattatgcattatcatgatcaagagatctccatctttgaatcccccgagtccgttttccatccatgaaccaggtgtcactcatgttttagtgacaggaggtgcaggctatatcggctcacatgctaccctacgacttctgagggaaaattatcgtgtcaccatagtggataacctgtcacgaggaaatttgggtgctgtcagggttcttcaagacttatttccagaacctggaaggcttcaatttatatatgctgacttgggagataaagaatctgtaaataaaatattttcagagaataaatttgatgccgtgatgcactttgctgccgttgcatacgtgggagagagcacacttgaccctcttaagtattatcacaatattacatcgaataccttgttggtattggagtctatggcttaatatggtgtgaagacattaatatattctagtacgtgtgcaacatatggggaacctgaaaagatgcctattatagaaacaacagaacagaaaccaattaatccatacggaaaagccaagaagatggcagaagatatcatccttgatttttccaaaaattctaagatggcagtaatgattctgagatacttcaatgtgattggatcagacccagagggcagattgggtgaggctccaagacctgaacttcgtgaacatggccgaatttctggtgcctgctttgatgcagctcgtggtattacaactggcttaaaggttagaggaactgactacaagacaccggatggaacatgcatacgagactacattgatgtaactgatttggttgatgctcacgtgaaggctcttgagaaggcacaacctgctaaagtagggatctacaatgttggaactggaaagggtagatcagtgaaggagtttgtgaatgcttgcaaaaaggccacaggggtggacatcaaagtagactaccttccacgtcgacccggcgattatgccgaggtgtatagtgacccttctaagatcaacagggaactgaattggaccgcacaatacactgaccttgagaagagtttgcaggttgcatggaaatggcaaaaagctcatcgtaacggttacggtatttcatctgcaatctgagtttctagccattcagccaagcagttggccatcaactgctcttttacatggtgctcaggattttttttttctttttctttttggtcgtccttagggagtttggtagttgattcgttatacttacatgtgtattcaacatacaatgagtcaataataataaataatataatgcccaaaaaaaaaaaaaaaa

SEQ ID NO: 3178 - protein, 1696 aa, Glycine max
  misc_feature: PFam Name: Epimerase; PFam Description: NAD dependent
  misc_feature: GI Number: 51978946; NR Description: PREDICTED P0495H05.61 gene product [Oryza sativa (japonica cultivar-group)] >gi|51963258|ref|XP_506159.1| PREDICTED P0495H05.61 gene product
  misc_feature: GI Number: 51964664; NR Description: PREDICTED P0582D05.120 gene product [Oryza sativa (japonica cultivar-group)] >gi|27529690|dbj|BAC53786.1| UDP-galactose 4-epimerase-like protein
  misc_feature: GI Number: 28395529; NR Description: UDP-D-xylose 4-epimerase [Arabidopsis thaliana] >gi|27363222|gb|AAO11530.1| At1g30620/T5I8_7 [Arabidopsis thaliana] >gi|18086329|gb|AAL57628.1| At1g30620/T5I8_7 [Arabidopsis
  misc_feature: GI Number: 25553524; NR Description: UDP-galactose
  misc_feature: GI Number: 50934141; NR Description: putative UDP-glucose 4-epimerase [Oryza sativa (japonica cultivar-group)] >gi|27260937|dbj|BAC45055.1| putative UDP-glucose 4-epimerase [Oryza sativa (japonica cultivar-group)]
TCTCTCTCTCTCTCTCTCTCTCTCACAAGCCACAATTTCAACGCCACACCAAAAATTCCACTGCACCACCACCCTCCCCATTTGTACTTTTCTTCTCATTCTCTTTCCACTCCCCTGCATTCTGCACACAATCTAGCTTTACGTGCTTCTGGGCAACCGCATAAGGTTAAACTGTTAAGCATATCATTGAAATCCTTTTGGGATTGGAACTTGATATGATCATTTGTATTGGGGAGTAAGACCTTGTTACTTTTGCAAATGCTAAATTTTAATAGGATCAGAAGTCAGCCCAGGACAACCAGATCTATGTCTTTGGGAGGCATGGATTACGTGGATCCAAAAAGGAAAGGCAATTTTGTTGGAAAAGTTTTTCTTGCTGCAGCATTAACGGCATTATGCATTATCATGATCAAGAGATCTCCATCTTTGAATCCCCCGAGTCCGTTTTCCATCCATGAACCAGGTGTCACTCATGTTTTAGTGACAGGAGGTGCAGGCTATATCGGCTCACATGCTACCCTACGACTTCTGAGGGAAAATTATCGTGTCACCATAGTGGATAACCTGTCACGAGGAAATTTGGGTGCTGTCAGGGTTCTTCAAGACTTATTTCCAGAACCTGGAAGGCTTCAATTTATATATGCTGACTTGGGAGATAAAGAATCTGTAAATAAAATATTTTCAGAGAATAAATTTGATGCCGTGATGCACTTTGCTGCCGTTGCATACGTGGGAGAGAGCACACTTGACCCTCTTAAGTATTATCACAATATTACATCGAATACCTTGTTGGTATTGGAGTCTATGGCTTAATATGGTGTGAAGACATTAATATATTCTAGTACGTGTGCAACATATGGGGAACCTGAAAAGATGCCTATTATAGAAACAACAGAACAGAAACCAATTAATCCATACGGAAAAGCCAAGAAGATGGCAGAAGATATCATCCTTGATTTTTCCAAAAATTCTAAGATGGCAGTAATGATTCTGAGATACTTCAATGTGATTGGATCAGACCCAGAGGGCAGATTGGGTGAGGCTCCAAGACCTGAACTTCGTGAACATGGCCGAATTTCTGGTGCCTGCTTTGATGCAGCTCGTGGTATTACAACTGGCTTAAAGGTTAGAGGAACTGACTACAAGACACCGGATGGAACATGCATACGAGACTACATTGATGTAACTGATTTGGTTGATGCTCACGTGAAGGCTCTTGAGAAGGCACAACCTGCTAAAGTAGGGATCTACAATGTTGGAACTGGAAAGGGTAGATCAGTGAAGGAGTTTGTGAATGCTTGCAAAAAGGCCACAGGGGTGGACATCAAAGTAGACTACCTTCCACGTCGACCCGGCGATTATGCCGAGGTGTATAGTGACCCTTCTAAGATCAACAGGGAACTGAATTGGACCGCACAATACACTGACCTTGAGAAGAGTTTGCAGGTTGCATGGAAATGGCAAAAAGCTCATCGTAACGGTTACGGTATTTCATCTGCAATCTGAGTTTCTAGCCATTCAGCCAAGCAGTTGGCCATCAACTGCTCTTTTACATGGTGCTCAGGATTTTTTTTTTCTTTTTCTTTTTGGTCGTCCTTAGGGAGTTTGGTAGTTGATTCGTTATACTTACATGTGTATTCAACATACAATGAGTCAATAATAATAAATAATATAATGCCCAAAAAAAAAAAAAAAA

SEQ ID NO: 3179 - DNA, 1274 bp, Glycine max
  misc_feature (1)..(1274): Ceres cDNA ID no. 21572746
  misc_feature (1)..(1274): Ceres CLONE  ID no. 710227
  misc_feature (1)..(1274): Also known as  Ceres CDNA ID no. 23706541
atttttcacctctccccaaaaccctcgcgccgcatttttatttttctctttcattatttttttaccatttttttatggacctcttcgccggcgaccacttccctgtccccgaccacgtcgctccgttccccgattccggcgacctcgtcttcgccgccgacctcctctcccaccgccccaacccccagaagctccgccctatcaggtccgtccccgccgcccccattgcccaccctcctccgccccctctctcgcacgatccgattccctccgggtcgggtcacgccccatgccacgaatccagctcgtctttagatgctgaggatgaagacgatgacgacaattcatcagcaagtacggaaggacatggccctataaagaagaggagaaagacggtgaggaagctcgaagattttttgaaggatttgatggcgaaggtgatggaaaagcaagagcagatgcacgaacagttattggaaatcatagaaaataaggaaagggaaaggataaagagagaagaagcttggaagaacgaggagatggagagaatcagaaaagatgaagaggctagagcccaagtaaattctcgaaatttggccctcatatccttcattcagaacctgttgggccatgaaattcaaatcccccaacaaccagtagaaccatgcagcaaaagagaagaggatgaagttgaggtgagtgctagaaaggatttgaacaatgatccaagtgacaataatagatggcctgatgttgaagtgcaggcactgatcactgtgagaacttcattggagcacaagtttcgtttcatgggatcaaaagggtcaatatgggaggagatatctgaagcaatgaatggcatggggtacaaccgctcttcaaagaagtgtaaggagaagtgggaaaacattaacaagtactataaaaggacaatagggagtggcaagaaaaggcgtcaaaacagtaaaacttgcccttactttgatgagttggacattttgtatagaaatggtcttctaagtattggaaatgccttgagcaataccagcgatgttccccagattgaagtaaaggagttgactgaaacttgaatattagtaattgatagtcatagatacagcttatgtaaaagttccttcgtttcagcatttatttagccattcttcctttcaattttctcactgatgactttagtgtacaataccatcctctaactctgcatttaaaattttaaatattaagttcattgggttgatataaaaaaaaaaaaaaaa

SEQ ID NO: 3180 - protein, 338 aa, Glycine max
  misc_feature: PFam Name: Myb_DNA-binding; PFam Description: Myb-like
  misc_feature: GI Number: 2664198; NR Description: GTL1 [Arabidopsis thaliana]
  misc_feature: GI Number: 15217472; NR Description: trihelix DNA-binding
  misc_feature: GI Number: 9665169; NR Description: Putative GTL1
  misc_feature: GI Number: 13646986; NR Description: DNA-binding protein DF1
  misc_feature: GI Number: 50904639; NR Description: putative GT-2 factor [Oryza sativa (japonica cultivar-group)] >gi|40363766|dbj|BAD06276.1| putative GT-2 factor [Oryza sativa (japonica cultivar-group)] >gi|41052544|dbj|BAD07536.1| putative
MDLFAGDHFPVPDHVAPFPDSGDLVFAADLLSHRPNPQKLRPIRSVPAAPIAHPPPPPLSHDPIPSGSGHAPCHESSSSLDAEDEDDDDNSSASTEGHGPIKKRRKTVRKLEDFLKDLMAKVMEKQEQMHEQLLEIIENKERERIKREEAWKNEEMERIRKDEEARAQVNSRNLALISFIQNLLGHEIQIPQQPVEPCSKREEDEVEVSARKDLNNDPSDNNRWPDVEVQALITVRTSLEHKFRFMGSKGSIWEEISEAMNGMGYNRSSKKCKEKWENINKYYKRTIGSGKKRRQNSKTCPYFDELDILYRNGLLSIGNALSNTSDVPQIEVKELTET

SEQ ID NO: 3181 - DNA, 1500 bp, Glycine max
  misc_feature (1)..(1500): Ceres cDNA ID no. 21572747
  misc_feature (1)..(1500): Ceres CLONE  ID no. 710449
  misc_feature (1)..(1500): Also known as  Ceres CDNA ID no. 24356341
ctatcttcgagcttgcctctgccaactacatttgaattttgcgcaacctcattcttatttgttatattaaattaaattgatccaggggaaatcagaaatactctgattgacttatatatggatcttattaattgaaacgaaattgagttgtctgtagcgacgatgagttgcttttcgtgctttgtttctcgtgggaaagatgtgagaagggttgaaattgacaatggctctcgatctgctacttcttcttctgaggggaaggggaagaagagtgtgagtaacaaaggaactagtacggcagcggctagttttggttttcgcgaactcgcagaggcaacgaggggtttcaaggaagtgaacttacttggggaaggtggttttggaagggtttacaagggtcgtctttcaacgggagagtatgttgccgttaaacaattgattcatgatggtaggcaaggttttcatgagtttgtgacggaggttcttatgttgagcctgctgcacgattctaatcttgtcaagttaattggctactgcactgatggagatcaaaggcttttggtttacgagtacatgcccatgggttcactcgaagaccatctttttgatcctcacccagacaaagaacccctaagttggagtactcgaatgaagattgctgttggagctgctcgtggccttgaatatctccattgtaaagcagatccacctgttatctacagggacttgaaatctgcgaacatcttgttagataatgaattcaacccaaaactgtcagattttgggcttgctaaacttggacctgttggagacaatacccatgtttcaaccagagtgatgggaacatatggttactgtgcaccagagtatgccatgagcggcaaattaactcttaaatctgatatatatagctttggtgtgcttttgttggagttgatcactggacgtagggcaatagatactaatagaagaccaggagagcaaaacttggtttcatggtctcgtcaatttttcagtgaccggaaaaagtttgtacaaatgattgaccctctattacaagaaaacttccccttgcgctgtttgaatcaggcaatggctataactgctatgtgtatccaggagcaaccgaaattccgtccacttattggtgatattgttgttgcactggaatacctagcttctcatagtaatccctgaagtccatagacatggtggtgcagctcaccacaacaacctccttttgaaatggacataaattaatatttacaggtatctgattctagcttgagctcccatttctgtatgattctgggtaatgatttccttaccggtttggtcagtgtaagctaccaacttggctatttaaagtgtcatatgttattgctttaattaacttattgccacagcagtagtgaagataaacttcttgatatagcactagtaaacatgtggattgatttaattgcaatggatgagtttatgccaaaaaaaaaaaaaaaa

SEQ ID NO: 3182 - protein, 344 aa, Glycine max
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15217992; NR Description: protein kinase family
  misc_feature: GI Number: 10445209; NR Description: protein serine/threonine
  misc_feature: GI Number: 15238886; NR Description: protein kinase family
  misc_feature: GI Number: 30679773; NR Description: protein kinase family
  misc_feature: GI Number: 7413555; NR Description: protein kinase-like [Arabidopsis thaliana] >gi|11259782|pir||T48301 protein kinase-like
MSCFSCFVSRGKDVRRVEIDNGSRSATSSSEGKGKKSVSNKGTSTAAASFGFRELAEATRGFKEVNLLGEGGFGRVYKGRLSTGEYVAVKQLIHDGRQGFHEFVTEVLMLSLLHDSNLVKLIGYCTDGDQRLLVYEYMPMGSLEDHLFDPHPDKEPLSWSTRMKIAVGAARGLEYLHCKADPPVIYRDLKSANILLDNEFNPKLSDFGLAKLGPVGDNTHVSTRVMGTYGYCAPEYAMSGKLTLKSDIYSFGVLLLELITGRRAIDTNRRPGEQNLVSWSRQFFSDRKKFVQMIDPLLQENFPLRCLNQAMAITAMCIQEQPKFRPLIGDIVVALEYLASHSNP

SEQ ID NO: 3183 - DNA, 1659 bp, Glycine max
  misc_feature (1)..(1659): Ceres cDNA ID no. 21572748
  misc_feature (1)..(1659): Ceres CLONE  ID no. 710520
  misc_feature (1)..(1659): Also known as  Ceres CDNA ID no. 23378862
ataacaaaattgaagtaagcctcacatcacagatttcccagtaaacaacgaacccatcatctcaatctgcttcttcactctaatcgaatcgaaccacccttcaaatcgcagatcaaaatcgaagcttatacatatacatacaccacgcgtgaatccaacggtgatgatgaccgggaagcaaggtttcttctctctgcgaggctcactcctcttcctcgcagtcctcacacttttatctttcacctacctttccctcaaatactccaccccaacaccccaggttaccaacctctcggtcgagaaactcaacgacgcgccgggaaccgagaaggaagaggagggaggaggagaagaagaagaggttccggacacgttccactcgccgcgcgtattcaagctgaactatgaggaaatggagaagaagttcaaggtttatatatacccagatggggatcccaacacgttctaccagacgccgaggaagctcaccggaaagtatgccagtgaaggctatttcttccagaatatcagagacagtcgcttccgcaccgaaaatcccgatgaggcacacctcttcttcattcccatctcgtgtcacaagatgcgtggcaagggcacgagttatgagaatatgacaataattgtgcaaaattatgtggagagcttgatatccaaatatccttattggaatagaaccttgggtgctgatcacttctttgtcacttgtcatgatgttggtgtgagggcaacagaaggacttgagtttcttgtgaagaattccattcgagcggtgtgctcccccagctatgatgttggattcattccacataaagatgtcgctctccctcaagtgctacagccatttgctcttcctgctggtgggaatgatatagaaaacaggactactcttggattctgggctggtcatcggaactctaaaatcagagttattcttgcacgtgtgtgggaaaatgacacagaacttgatatttcaaacaatagaattagtagggctactgggcatctagtgtaccagaaaagattttacaggagtaagttttgtatatgtcctggtggatcacaggttaatagtgctcggatagcagactctatccattatgggtgtattcctgtgatattgtcaaattactatgaccttcctttcaatgatattcttgactggaacaaatttgccgttgtactcaaggagagtgatgtttaccagcttaaacaaatcctcaaaaatatatcagatgctgagtttgttacacttcataataatttggtaaaggttcagaaacacttccaatggaattcgccctcaatcagatttgatgctttccatttggttatgtatgacctctggttacgccatcacacgatcaaatactgatatttagactcactctatgagacccttattttgtatacaacttacagttttagcaactgagagcactgtaaatatagccaattacagcttttttatacagcagctggtttttctatattcttgcaccctgaacgtttctgttaatttgtttgttatttgtttgtggtaaggttctttgttaggttgaaactactacatgaccaagctattgaattaaggcaggtgcaattgttagaattgttcaaaatccaaaaaaaaaaaaaaaa

SEQ ID NO: 3184 - protein, 1659 aa, Glycine max
  misc_feature: PFam Name: Exostosin; PFam Description: Exostosin family
  misc_feature: GI Number: 51535578; NR Description: pectin-glucuronyltransferase-like [Oryza sativa (japonica
  misc_feature: GI Number: 50905787; NR Description: putative pectin-glucuronyltransferase [Oryza sativa (japonica cultivar-group)] >gi|46390046|dbj|BAD15422.1| putative pectin-glucuronyltransferase [Oryza sativa (japonica
  misc_feature: GI Number: 15237526; NR Description: exostosin family protein / pentatricopeptide (PPR) repeat-containing protein [Arabidopsis
  misc_feature: GI Number: 34911614; NR Description: limonene cyclase-like protein [Oryza sativa (japonica cultivar-group)] >gi|20805119|dbj|BAB92790.1| limonene cyclase-like protein [Oryza
  misc_feature: GI Number: 55297176; NR Description: pectin-glucuronyltransferase-like [Oryza sativa (japonica
ATAACAAAATTGAAGTAAGCCTCACATCACAGATTTCCCAGTAAACAACGAACCCATCATCTCAATCTGCTTCTTCACTCTAATCGAATCGAACCACCCTTCAAATCGCAGATCAAAATCGAAGCTTATACATATACATACACCACGCGTGAATCCAACGGTGATGATGACCGGGAAGCAAGGTTTCTTCTCTCTGCGAGGCTCACTCCTCTTCCTCGCAGTCCTCACACTTTTATCTTTCACCTACCTTTCCCTCAAATACTCCACCCCAACACCCCAGGTTACCAACCTCTCGGTCGAGAAACTCAACGACGCGCCGGGAACCGAGAAGGAAGAGGAGGGAGGAGGAGAAGAAGAAGAGGTTCCGGACACGTTCCACTCGCCGCGCGTATTCAAGCTGAACTATGAGGAAATGGAGAAGAAGTTCAAGGTTTATATATACCCAGATGGGGATCCCAACACGTTCTACCAGACGCCGAGGAAGCTCACCGGAAAGTATGCCAGTGAAGGCTATTTCTTCCAGAATATCAGAGACAGTCGCTTCCGCACCGAAAATCCCGATGAGGCACACCTCTTCTTCATTCCCATCTCGTGTCACAAGATGCGTGGCAAGGGCACGAGTTATGAGAATATGACAATAATTGTGCAAAATTATGTGGAGAGCTTGATATCCAAATATCCTTATTGGAATAGAACCTTGGGTGCTGATCACTTCTTTGTCACTTGTCATGATGTTGGTGTGAGGGCAACAGAAGGACTTGAGTTTCTTGTGAAGAATTCCATTCGAGCGGTGTGCTCCCCCAGCTATGATGTTGGATTCATTCCACATAAAGATGTCGCTCTCCCTCAAGTGCTACAGCCATTTGCTCTTCCTGCTGGTGGGAATGATATAGAAAACAGGACTACTCTTGGATTCTGGGCTGGTCATCGGAACTCTAAAATCAGAGTTATTCTTGCACGTGTGTGGGAAAATGACACAGAACTTGATATTTCAAACAATAGAATTAGTAGGGCTACTGGGCATCTAGTGTACCAGAAAAGATTTTACAGGAGTAAGTTTTGTATATGTCCTGGTGGATCACAGGTTAATAGTGCTCGGATAGCAGACTCTATCCATTATGGGTGTATTCCTGTGATATTGTCAAATTACTATGACCTTCCTTTCAATGATATTCTTGACTGGAACAAATTTGCCGTTGTACTCAAGGAGAGTGATGTTTACCAGCTTAAACAAATCCTCAAAAATATATCAGATGCTGAGTTTGTTACACTTCATAATAATTTGGTAAAGGTTCAGAAACACTTCCAATGGAATTCGCCCTCAATCAGATTTGATGCTTTCCATTTGGTTATGTATGACCTCTGGTTACGCCATCACACGATCAAATACTGATATTTAGACTCACTCTATGAGACCCTTATTTTGTATACAACTTACAGTTTTAGCAACTGAGAGCACTGTAAATATAGCCAATTACAGCTTTTTTATACAGCAGCTGGTTTTTCTATATTCTTGCACCCTGAACGTTTCTGTTAATTTGTTTGTTATTTGTTTGTGGTAAGGTTCTTTGTTAGGTTGAAACTACTACATGACCAAGCTATTGAATTAAGGCAGGTGCAATTGTTAGAATTGTTCAAAATCCAAAAAAAAAAAAAAAA

SEQ ID NO: 3185 - DNA, 1390 bp, Glycine max
  misc_feature (1)..(1390): Ceres cDNA ID no. 21572750
  misc_feature (1)..(1390): Ceres CLONE  ID no. 712340
  misc_feature (1)..(1390): Also known as  Ceres CDNA ID no. 24360079
aatctatttctattttgtaagacatcagatctcctcacgaatgctggtgcccaaagccaaaacgcacccacaaagcagataacggcgtcgtatgcaaccctcaaatgaagtgcaagaaacatacctcagaccttagcagcaccgtcggcgtctgcgcctcctgtctaagggaacgcctcatatccctcgccgccgcccaggcccaagcccaagcccatcacccgcaggcccaattaacgcgagtcatctcacgcgcctccgacgattattccagaaactcagaccctaaccctcccccaccgttaatcttccctcgctctgtttcgccctacgtctctcgccggaagtctgactaccccgccgactggctcgacgaccgccgcgagaggctgttctacagcactccgcagctcggtcccaccttctgcgccggcgattccgaataccacgccgacgcgaagtcgttcaagaaacgcttcaacaagttccgcatattcgcgaagattttcaggacaagatcggagaagttccagtcggatccgtcgtgcgagcaggcctcgcacgcatcgccgtcgtggttctcggctttttttcccacacgccggaggaacaaggatcggagtggaacgacgaaggaatattcctccgccgccgcgcgccggcggtaccgcccgtcggatcgcggaatgtcgcccgtgacgaccgaggatttcggcgacgagtgtgatcagtcgccgtcggggagcggatacgtctcggaggcgtctccgtggtggcggagaacgccagcggtggcgccgtcggcgcggcggtcgaggctagggcacacgaagagcgcgtcgggttcgggcatggcgctttgcctgagtcccctagttcgggcgagtccaaaccggaggtggaaccacaagggattgccgccggagatggcggaggttagggccgcagcggcgaagcctcatctctcggccgcggcgtcgttttgcgcgaaccgttccaggaagcttgcggattttggacgagtcaaccataaccgttgattttgtttagctttcaaatgagcggacccgacccgatccggtgaattttcattctcattccatatgttatcggttttgtgcacattcttcatttcatttcttcatcataaaggaaaaaaagaaaaaagagaaacattttttttttaattttctttgtacacaaattgttcactacatgaaacacaaagtctagtgttattttaattttagtttttgctgatatactagttgacattggtgtgattttgcaattacatgtgatttgtgatgttacattgacttgaattgtttggcaaatgtgtatgggattaatgttcttgggaatctacactctaaaaaaaaaaaaaaaa

SEQ ID NO: 3186 - protein, 311 aa, Glycine max
MKCKKHTSDLSSTVGVCASCLRERLISLAAAQAQAQAHHPQAQLTRVISRASDDYSRNSDPNPPPPLIFPRSVSPYVSRRKSDYPADWLDDRRERLFYSTPQLGPTFCAGDSEYHADAKSFKKRFNKFRIFAKIFRTRSEKFQSDPSCEQASHASPSWFSAFFPTRRRNKDRSGTTKEYSSAAARRRYRPSDRGMSPVTTEDFGDECDQSPSGSGYVSEASPWWRRTPAVAPSARRSRLGHTKSASGSGMALCLSPLVRASPNRRWNHKGLPPEMAEVRAAAAKPHLSAAASFCANRSRKLADFGRVNHNR

SEQ ID NO: 3187 - DNA, 1467 bp, Glycine max
  misc_feature (1)..(1467): Ceres cDNA ID no. 21572751
  misc_feature (1)..(1467): Ceres CLONE  ID no. 713019
  misc_feature (1)..(1467): Also known as  Ceres CDNA ID no. 24356300
aactcactttccattccattcccaacgcaatggacccatggctcgacgatctaacctacgacctccagagtcttagcttcgcctccaccgccaccgcggacatcaagcggagcaccagcttcggctccgaaaccaccactctcaccgcctcctcctccgcccacctccccgccaacagcaagccccacgctccctcctccgacccacgctgggccgccatccaccggatccgatcggagtcccccagccgccgcatcctcccctccgacctccgcttctcccgccgtctcggctccggcgacatcagctccgtctacctcgccgaactcaacgacgggtccctctccgtgatgttcgccgccaaggtgatggacaagaaggagctggccagccgcagcaaggaaggaagagccaagaccgagagggaaatcctcgaatccctcgaccaccccttcctccccaccctctacgccaccatcgacgccgccaaatggctctgcctcctcaccgagttctgccccggcggcgacctccacatcctccgccaacgccagccccacaaacgcttccctgaacccgccgtcaggttctatgcgtcagaggtgctagtggcacttgaatacctccacatgatggggatagtgtaccgtgatctgaagccggagaacgtgttagttcgatcagacggccacatcatgctcactgattttgacctctcgttaaaatgtgatgattccacatcaacgccccagatcatcttggatcagaaaaacaccccacacaaggacccccgcgtggatccctcgcagtctcagttcacctcgtcttcctgcatactacccagctgtatagtccccgccgtgtcgtgtttccacccaaaacgcaagcgcaagaagaagcaggcccaacataatgggcctgagtttgtggccgagcccattgatgttcgctccatgtccttcgttgggacccacgagtacctggctccggaaatcgtgtccggggagggccacggtagtgccgtggactggtggactttgggcatattcatatttgaattgttctatggtgtcacgccctttaggggaatggacaacgagctaaccctagcaaacattgtggctcgagccttggagttccctaaggaaccctccgtgccacccacggcaaaggacctcatctctcagctattggttaaggacccttcgaggaggctaggctcaacaatgggtgcttcctctatcaagcaccacccctttttccaaggtgttaattgggcattgctaaggtgtactcctccaccctttgtgcccccacattatattaaagaagctgtatcatctcatcatgaaattgaaacttgtccgcagactcccattgattattattgatggtcatagggaggagattcatgatgtacagttaataagatagttccaccagatttaatcaaaaaaaaaaaaaaaa

SEQ ID NO: 3188 - protein, 453 aa, Glycine max
  misc_feature: PFam Name: Pkinase; PFam Description: Protein kinase domain
  misc_feature: GI Number: 30692190; NR Description: protein kinase family
  misc_feature: GI Number: 6967109; NR Description: protein kinase-like protein [Arabidopsis thaliana] >gi|11260282|pir||T47436 protein
  misc_feature: GI Number: 62701689; NR Description: second messenger-dependent protein kinase, putative [Oryza sativa
  misc_feature: GI Number: 30689844; NR Description: protein kinase, putative
  misc_feature: GI Number: 34365765; NR Description: At3g27580 [Arabidopsis thaliana] >gi|11994185|dbj|BAB01288.1| serine/threonine-protein kinase [Arabidopsis thaliana] >gi|303500|dbj|BAA01716.1| serine/threonine protein kinase [Arabidopsis thaliana]
MDPWLDDLTYDLQSLSFASTATADIKRSTSFGSETTTLTASSSAHLPANSKPHAPSSDPRWAAIHRIRSESPSRRILPSDLRFSRRLGSGDISSVYLAELNDGSLSVMFAAKVMDKKELASRSKEGRAKTEREILESLDHPFLPTLYATIDAAKWLCLLTEFCPGGDLHILRQRQPHKRFPEPAVRFYASEVLVALEYLHMMGIVYRDLKPENVLVRSDGHIMLTDFDLSLKCDDSTSTPQIILDQKNTPHKDPRVDPSQSQFTSSSCILPSCIVPAVSCFHPKRKRKKKQAQHNGPEFVAEPIDVRSMSFVGTHEYLAPEIVSGEGHGSAVDWWTLGIFIFELFYGVTPFRGMDNELTLANIVARALEFPKEPSVPPTAKDLISQLLVKDPSRRLGSTMGASSIKHHPFFQGVNWALLRCTPPPFVPPHYIKEAVSSHHEIETCPQTPIDYY

SEQ ID NO: 3189 - DNA, 1277 bp, Glycine max
  misc_feature (1)..(1277): Ceres cDNA ID no. 21572752
  misc_feature (1)..(1277): Ceres CLONE  ID no. 716187
  misc_feature (1)..(1277): Also known as  Ceres CDNA ID no. 24356276
gtgaaacaaacaaaaacacctaaatggggagagttatgtgtgtgggttttccactggtagctctcgtagtggtgagcatgtgttatggattggcagatgcagaggtgaaaacaccaaatttgcggtggcattattataaggtgacgaatagatgtcacgacgcagaggagtatgtccggcaccaagtgaacctgttttggaagaatgacagaagcattacagcaaagcttctccgcttggtttatgctgactgttttgtcactggatgtgatgcatcaattctgcttgacgaaggagcaaatccagagaaaaaagcagcacaaaaccgggggcttggaggatttgcggtcattgacaagataaaagctgttctggaatcacgatgccctggaactgtgtcttgtgctgatatactccacctcgccaccagggatgctgttaaactggcaggtggagcaggttacccagttttaacaggtagaaaggatggcatgaaatcagatgctgcatcagtagacctgccatcaccatccgtctcgctgcagaaagtcctggaatatttcaaatccaggaacttgaatgaactagacatgaccacacttttaggagcacacacaatgggcagaacacattgtagctttattgttgatcggctctacaactacaatggttccggaaaacccgacccaagcatgagtgttacttcactagagtcgttgagaaaactttgcccgccaagaaagaagggacaagcagaccctctggtacacctaaacccagaatcagggtcaagttacaacttcacagaatcatactacagaagggtcctatcccacgaagctgtccttggagttgatcaacaattactatatagtgatgacactaaacagatctccgaggagttcgctgttggatttgaagattttcggaaatcttttgctacatcaatgtacaagatggggaattacagggttttaacaggcaaccaaggagagatacgccgatattgccgatacacaaataagggcaacccaaataagtaggaggcgaaatcagatgttttgagtggactccgatatccccagtttaaacagatttgttttgtgtttttaaggtaaagaataattacatgaataataccttctttgtcctttgtaatttctgagtttcagcaattcaagtcactaaaaaatcttcttgttgtagtatgtatgtataaaacataaatcctatcctctgtcaattaaaaccaccacaaaaaaaaaaaaaaaaaaaaa

SEQ ID NO: 3190 - protein, 339 aa, Glycine max
  misc_feature: PFam Name: peroxidase; PFam Description: Peroxidase
  misc_feature: GI Number: 9758231; NR Description: peroxidase-like protein [Arabidopsis thaliana] >gi|26397805|sp|Q9FLV5|PE61_ARATH Probable peroxidase 61 precursor (Atperox P61) >gi|15237884|ref|NP_197795.1|
  misc_feature: GI Number: 25453188; NR Description: Probable peroxidase 26 precursor (Atperox P26) (ATP50) >gi|30689391|ref|NP_181876.2|
  misc_feature: GI Number: 2288998; NR Description: putative peroxidase [Arabidopsis thaliana] >gi|25285613|pir||F84866 probable peroxidase
  misc_feature: GI Number: 19310389; NR Description: At2g43480/T1O24.22
  misc_feature: GI Number: 1232069; NR Description: cationic peroxidase
MGRVMCVGFPLVALVVVSMCYGLADAEVKTPNLRWHYYKVTNRCHDAEEYVRHQVNLFWKNDRSITAKLLRLVYADCFVTGCDASILLDEGANPEKKAAQNRGLGGFAVIDKIKAVLESRCPGTVSCADILHLATRDAVKLAGGAGYPVLTGRKDGMKSDAASVDLPSPSVSLQKVLEYFKSRNLNELDMTTLLGAHTMGRTHCSFIVDRLYNYNGSGKPDPSMSVTSLESLRKLCPPRKKGQADPLVHLNPESGSSYNFTESYYRRVLSHEAVLGVDQQLLYSDDTKQISEEFAVGFEDFRKSFATSMYKMGNYRVLTGNQGEIRRYCRYTNKGNPNK

SEQ ID NO: 3191 - DNA, 1636 bp, Glycine max
  misc_feature (1)..(1636): Ceres cDNA ID no. 21572753
  misc_feature (1)..(1636): Ceres CLONE  ID no. 717186
  misc_feature (1)..(1636): Also known as  Ceres CDNA ID no. 24356280
aaactttgatcacgcgtctggtttctctcccaacattctcatctgggtcttcccaatttcttgatttgatctttctccctctcagaaactggcctcagccaagagtttctcctttttccttttcacctgttcagcattgatatttggttatacattgcattaggttgaatatcagtgttttcaatttgataaaagatattgattctgtaagtccatttgctaagaatcaaatcaaaaaagtatcttctaaatttgatagaataggatcaaaatttcgccatgagtttctctgaccatattccatcctttatgatgtcaccgccgtcgttttccacagacacggatgccattgaagtgaggcttcaattcccaacgaacaacgaatcattggagccacattcaccacaggatcaacccccttcgttcaagagggcaaggacctgtgatagcagcctctccaatgcaatggcatgccctccaaggatgattcagcaccctgcacttaacaaaggaacgagccacattttcttcaagacccgtatttgtgcaaagttcagagctggcgcttgtaggaacggcgagaactgcaattttgcacatgggcttgaagacatgaggcagccgccaccaaattggcaagagcttgttgggttgcgcaatgaggagcggccacccacgatgggggattgggacgatgaccagaaaatcatacacaagatgaagctgtgcaagaagtattacaatggggaggaatgcccctatggtgataagtgtagttttcttcatgaagaccctgccaggttcagggatgattcggtgaggtacagggagagcacagctataagcattggtactaatggatcccccaagtcctatggtgatgcctctaataatttagaaagtaatagggctgtgaatactggcttaaatgttttccgggggaatgttaaatctacctattggaagactaaactctgcatcaaatttgagacaacaggccactgcccctttggggatgactgtcactttgctcatgggcaagcagagttacaagttcctggtggacgcaccgaggcagaaattccaggtgccattccaatttcaaccaaagctaccattccaaccttaccaagagctacatcagtttcttctaatgatgcacctcctagtcacagagcaagtgtacttccagcaaatgaagaggatcaggatgagaagtgtttactgaagtggaaaggacacaggaagatcaaccgaatttatggtgactggcttgacgatttaccactcgttcacgacttgccagttgccaggtagagtggggacctgacttgaagtatgtgatcttgaaaagtctcaccaattggatggattaggaaattgcattcttccctgaagacaaaattttgaaaaatgtggtcactgattgatggtgatcagttcataggtttatttgttcttattttttctgttaattgttatagttttctttttctaattagagatgtgcaattattattgtacatcgggattttgatggatttaagaattaagccacattggtgacaaagatccaaattctgaattgtgtgggatcctgattcgggttcaaccattgccaaaaaaaaaaaaaaaa

SEQ ID NO: 3192 - protein, 345 aa, Glycine max
  misc_feature: PFam Name: zf-CCCH; PFam Description: Zinc finger
  misc_feature: GI Number: 14018368; NR Description: zinc finger protein
  misc_feature: GI Number: 50941347; NR Description: putative zinc finger protein [Oryza sativa (japonica cultivar-group)] >gi|29467558|dbj|BAC66728.1| putative zinc finger protein [Oryza sativa (japonica cultivar-group)] >gi|37806157|dbj|BAC99662.1|
  misc_feature: GI Number: 19547999; NR Description: At1g32359/F27G20.10 [Arabidopsis thaliana] >gi|15912259|gb|AAL08263.1|
  misc_feature: GI Number: 56121890; NR Description: At2g35430 [Arabidopsis thaliana] gi|42569638|ref|NP_181086.2| zinc finger (CCCH-type) family protein [Arabidopsis thaliana] gi|58331803|gb|AAW70399.1|
  misc_feature: GI Number: 50905911; NR Description: KH domain-containing protein-like [Oryza sativa (japonica cultivar-group)] >gi|46389843|dbj|BAD15406.1| KH domain-containing protein-like
MSFSDHIPSFMMSPPSFSTDTDAIEVRLQFPTNNESLEPHSPQDQPPSFKRARTCDSSLSNAMACPPRMIQHPALNKGTSHIFFKTRICAKFRAGACRNGENCNFAHGLEDMRQPPPNWQELVGLRNEERPPTMGDWDDDQKIIHKMKLCKKYYNGEECPYGDKCSFLHEDPARFRDDSVRYRESTAISIGTNGSPKSYGDASNNLESNRAVNTGLNVFRGNVKSTYWKTKLCIKFETTGHCPFGDDCHFAHGQAELQVPGGRTEAEIPGAIPISTKATIPTLPRATSVSSNDAPPSHRASVLPANEEDQDEKCLLKWKGHRKINRIYGDWLDDLPLVHDLPVAR

SEQ ID NO: 3193 - DNA, 1055 bp, Glycine max
  misc_feature (1)..(1055): Ceres cDNA ID no. 21572754
  misc_feature (1)..(1055): Ceres CLONE  ID no. 718471
  misc_feature (1)..(1055): Also known as  Ceres CDNA ID no. 25088306
accattagccagcatgctagaaaacaactgtttagacaaggaagcccctggcaagacaacaagatgagcatcatctcctccttccacaacatcaacccccatccccaaatccttaacctgatactccgcaaaaccccctggtcgaaaatccctctcaatcatcctctccccgaacaattcaagcgccttcgaacccgcagcaccgtcttttatggcttccacgaactccctcaggtccagccccgcacgcttggcgaacaccagcccctcgctcagcccgatcaagttcgcgccaatcgtgatctggttcgcgatcttgcagctctgcccgcaccccgcggggcccatgtaagtggctctcccgaggatcgagaacagagggctcagccattcgactacggctttttctccggcggctaggatggcgagcttgccgtcgcgcgcgccgatgtcgccgccggagacgggggcgtcgacggaccaggcgccgagggagcgtgctgcggagaagatctggcgggcgaggtcggggtgggagctggtggtgtcgacgacgacggagttggggcggagggaggagaggacgggggagtcgaggaggagggagcgaacgtcggaggggtggcccaccatggtgaagaggacgtcggagagttgggccagttgggccggggattgggccagggtggcgccttgggattggagagagagggcgttagggttggaagggttgcgggcgtagaaagagagggtgtagccagcagaaaggaggcgagaggccatggcgaagcccattacgccgatgccgatccagccgattcgggtttcggagggtgagatcggagttgggtacggcgttcccatggtaatgttgctgcctgagacagacactcagtgaattattagtttcctttttttattccatgcctctttctaaccaaaagaatctgctttttgagctagagaataataattcataattttatcctccaattattatttttttctatatttttttagaaaaaaaatattcagacccaaaaaaaaaaaaaaaa

SEQ ID NO: 3194 - protein, 1055 aa, Glycine max
  misc_feature: GI Number: 61658799; NR Description: RPGR [Felis catus]
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 50363141; NR Description: major ampullate spidroin
  misc_feature: Utility: Useful for making plants with enhanced tolerance to
ACCATTAGCCAGCATGCTAGAAAACAACTGTTTAGACAAGGAAGCCCCTGGCAAGACAACAAGATGAGCATCATCTCCTCCTTCCACAACATCAACCCCCATCCCCAAATCCTTAACCTGATACTCCGCAAAACCCCCTGGTCGAAAATCCCTCTCAATCATCCTCTCCCCGAACAATTCAAGCGCCTTCGAACCCGCAGCACCGTCTTTTATGGCTTCCACGAACTCCCTCAGGTCCAGCCCCGCACGCTTGGCGAACACCAGCCCCTCGCTCAGCCCGATCAAGTTCGCGCCAATCGTGATCTGGTTCGCGATCTTGCAGCTCTGCCCGCACCCCGCGGGGCCCATGTAAGTGGCTCTCCCGAGGATCGAGAACAGAGGGCTCAGCCATTCGACTACGGCTTTTTCTCCGGCGGCTAGGATGGCGAGCTTGCCGTCGCGCGCGCCGATGTCGCCGCCGGAGACGGGGGCGTCGACGGACCAGGCGCCGAGGGAGCGTGCTGCGGAGAAGATCTGGCGGGCGAGGTCGGGGTGGGAGCTGGTGGTGTCGACGACGACGGAGTTGGGGCGGAGGGAGGAGAGGACGGGGGAGTCGAGGAGGAGGGAGCGAACGTCGGAGGGGTGGCCCACCATGGTGAAGAGGACGTCGGAGAGTTGGGCCAGTTGGGCCGGGGATTGGGCCAGGGTGGCGCCTTGGGATTGGAGAGAGAGGGCGTTAGGGTTGGAAGGGTTGCGGGCGTAGAAAGAGAGGGTGTAGCCAGCAGAAAGGAGGCGAGAGGCCATGGCGAAGCCCATTACGCCGATGCCGATCCAGCCGATTCGGGTTTCGGAGGGTGAGATCGGAGTTGGGTACGGCGTTCCCATGGTAATGTTGCTGCCTGAGACAGACACTCAGTGAATTATTAGTTTCCTTTTTTTATTCCATGCCTCTTTCTAACCAAAAGAATCTGCTTTTTGAGCTAGAGAATAATAATTCATAATTTTATCCTCCAATTATTATTTTTTTCTATATTTTTTTAGAAAAAAAATATTCAGACCCAAAAAAAAAAAAAAAA

SEQ ID NO: 3195 - DNA, 1459 bp, Glycine max
  misc_feature (1)..(1459): Ceres cDNA ID no. 21572755
  misc_feature (1)..(1459): Ceres CLONE  ID no. 718983
  misc_feature (1)..(1459): Also known as  Ceres CDNA ID no. 24356288
aataatagggcatgacatgatgacaagccacgaagaggatctggatctcctcctttcccttgacgagagagttgctgaaacccctccatcttctcccacaatctcagacgatgatgatgatgaacttgaacttcccaaccaaagggaaagggataaacccgacatgtccgttttcaaaagcgcccttcaggattgccttccttacgatccccccaaaccaactaacaaacccgttattaatgttgattcccaccttgaaaagttttcgggccttcgaataaggaaccaattgttaactcctgccgagcttaaggaacatttttcagacattcgttttgttcggctgtcggttatcaagaattccttagttggggatactgtttctggaagttgggccactgttggagtattgaccgagaaggggactcagaagacaagttcaacagggaagagctattgtatatggaaaattggctgtttagatgaaactactgtttctcttttcttgtttggagatgcttatcagatgaacatgcaagagcaggctggaaccgtctttgcactctttaattctaccgtccgcaaggataatgcgggtaatggtttttctttgagtatatactccaccagacaaattatgaagatgggcacctctgttgattatggagtttgcaaagggaaacgaacagatgggatggcttgtaccctagtcataaataaacgtcatggcacatattgtaaatatcataaatcaaaagcatcagagaagtattcctcaatgcgaactgaactcaagggaggaaacttaagaacagcgtttaggcctatgggttacctcaaatcagaaggaatttacttagttgaccctcttgctgacaaaacaaacttgaagaagtctcagcctgtgaaattattgtccgtggatggtatcagaaaggcattgagcaatgcaggaaaagtaacaacagcttctcattcgcaagggattaggtttctttctgaggttgcagccaagtcggatccaaaaatgaagaataaaggatcaaaatttccaaatgttcaaaacaaatggacagagaagaggaaatcatcttttccgaatgtgggatcctctccagtcataggaaaccgacagtcgggtgaaaagagaataaaaccagacgggcaggttttggctgataaaaccctaaagagaatagaaaagatgattgaaattgatcttgttagttcggatgaagacttctgaactctgcgttgctacatggatggattaagtggttattacgttttcctatttttgtggaagtcattatttttttaaaaataatttgtacggaagaaaaaaatggcccgctttggatatacctttggattcatccctgattatgagaactctagaaggaagaccaaaaactttcttataagaataagattatattaggcaaaaaaaaaaaaaaaa

SEQ ID NO: 3196 - protein, 1459 aa, Glycine max
  misc_feature: GI Number: 52076055; NR Description: minichromosome maintenance protein 10 isoform 1 -like [Oryza sativa (japonica
  misc_feature: GI Number: 58701913; NR Description: Unknown (protein for
  misc_feature: GI Number: 47125104; NR Description: LOC398196 protein [Xenopus laevis] >gi|11276023|gb|AAG33858.1| Mcm10p [Xenopus
  misc_feature: GI Number: 33383237; NR Description: minichromosome maintenance protein 10 isoform 1; homolog of yeast MCM10 [Homo
  misc_feature: GI Number: 33383235; NR Description: minichromosome maintenance protein 10 isoform 2; homolog of yeast MCM10 [Homo
AATAATAGGGCATGACATGATGACAAGCCACGAAGAGGATCTGGATCTCCTCCTTTCCCTTGACGAGAGAGTTGCTGAAACCCCTCCATCTTCTCCCACAATCTCAGACGATGATGATGATGAACTTGAACTTCCCAACCAAAGGGAAAGGGATAAACCCGACATGTCCGTTTTCAAAAGCGCCCTTCAGGATTGCCTTCCTTACGATCCCCCCAAACCAACTAACAAACCCGTTATTAATGTTGATTCCCACCTTGAAAAGTTTTCGGGCCTTCGAATAAGGAACCAATTGTTAACTCCTGCCGAGCTTAAGGAACATTTTTCAGACATTCGTTTTGTTCGGCTGTCGGTTATCAAGAATTCCTTAGTTGGGGATACTGTTTCTGGAAGTTGGGCCACTGTTGGAGTATTGACCGAGAAGGGGACTCAGAAGACAAGTTCAACAGGGAAGAGCTATTGTATATGGAAAATTGGCTGTTTAGATGAAACTACTGTTTCTCTTTTCTTGTTTGGAGATGCTTATCAGATGAACATGCAAGAGCAGGCTGGAACCGTCTTTGCACTCTTTAATTCTACCGTCCGCAAGGATAATGCGGGTAATGGTTTTTCTTTGAGTATATACTCCACCAGACAAATTATGAAGATGGGCACCTCTGTTGATTATGGAGTTTGCAAAGGGAAACGAACAGATGGGATGGCTTGTACCCTAGTCATAAATAAACGTCATGGCACATATTGTAAATATCATAAATCAAAAGCATCAGAGAAGTATTCCTCAATGCGAACTGAACTCAAGGGAGGAAACTTAAGAACAGCGTTTAGGCCTATGGGTTACCTCAAATCAGAAGGAATTTACTTAGTTGACCCTCTTGCTGACAAAACAAACTTGAAGAAGTCTCAGCCTGTGAAATTATTGTCCGTGGATGGTATCAGAAAGGCATTGAGCAATGCAGGAAAAGTAACAACAGCTTCTCATTCGCAAGGGATTAGGTTTCTTTCTGAGGTTGCAGCCAAGTCGGATCCAAAAATGAAGAATAAAGGATCAAAATTTCCAAATGTTCAAAACAAATGGACAGAGAAGAGGAAATCATCTTTTCCGAATGTGGGATCCTCTCCAGTCATAGGAAACCGACAGTCGGGTGAAAAGAGAATAAAACCAGACGGGCAGGTTTTGGCTGATAAAACCCTAAAGAGAATAGAAAAGATGATTGAAATTGATCTTGTTAGTTCGGATGAAGACTTCTGAACTCTGCGTTGCTACATGGATGGATTAAGTGGTTATTACGTTTTCCTATTTTTGTGGAAGTCATTATTTTTTTAAAAATAATTTGTACGGAAGAAAAAAATGGCCCGCTTTGGATATACCTTTGGATTCATCCCTGATTATGAGAACTCTAGAAGGAAGACCAAAAACTTTCTTATAAGAATAAGATTATATTAGGCAAAAAAAAAAAAAAAA

SEQ ID NO: 3197 - DNA, 1373 bp, Glycine max
  misc_feature (1)..(1373): Ceres cDNA ID no. 21572756
  misc_feature (1)..(1373): Ceres CLONE  ID no. 722430
  misc_feature (1)..(1373): Also known as  Ceres CDNA ID no. 24423931
aaatttgtcctcttgagtaacattatcattatgtttagcattttgcacatgatacccactcaacttcatctcatatatccgaccacctccccttgcacctcgtacccaatcacttccacaaccaagaccaatgcaagcagtggagggatcgatggtcatggagtataggagtcaccatattttttacagtagtcaccaattaaaaaatgccaaaacataattgtagacattaagcatgccacaattgttgagtgtcaagttaagcaaaagcaaggattaataatggtgtttgtataattttgttttacttgtttgtctcctgaaagtaccatacaatcttcgaagatgatcgggaaggacgagttcgtctcttactcgccccttccctccaaccctaaccctaaccctaaccctaaccccaaccccaaccccaacccttatcccaatcctaatccttattacgaccctaaccctcatccttacccccaaaacgtcgtcgttttgctcccctcctaccgtccccatttccagcgtcgtcgccgccgctgcatcatctactccgcggcactcttcctcttcctcctcgtcgctggcgccgccttcctcctctacccctccgacccggagattcgtctcgctcggatccgactcgaccgcatcgggatccgaaccaacccgaggcccattctcgacctctcattctccctcacagttaaagttcgcaacagagactttttctccctttcctatgactccctcaccgtctccgtcggctaccgcggccgccagctcggcttcgtaaccggcggcggcggcggcagcatcagggcgcgcggctcctcctacgttgacgccacgctcaccatcgacggatttgaggttatctacgatgcgttctacttgctcgaagatatcgctaagggtgtgattccgtttgacactgacacgcgagttgaagggaaattaggccttttcttcttcactgttcctttgaaggcaacagtgtcgtgcgaagtggatgtgaatataaaccagcagacaattgtacgacaagactgctatcctaagtcactaggtgatccgctggatgagagcgcatatattgaagctggagatacatgatgtggtatcaaccttttgtatcctttgtctatacagcgctgctgctggtgtttacattacatttagcgtgctgtaaaattgtatatggatcacacacccttgtaaattatggttgactacagaccacttgcattttgtatttaacgcttgtatgaggtaaattcaatttaaatggtacctgggagtttgtcagttatatagttgagaaataaaagtatattttacttatccttttaaaaaaaaaaaaaaaa

SEQ ID NO: 3198 - protein, 258 aa, Glycine max
  misc_feature: PFam Name: Hin1; PFam Description: Harpin-induced protein 1 (Hin1)
  misc_feature: PFam Name: Trypan_PARP; PFam Description: Procyclic acidic
  misc_feature: PFam Name: Pyr_redox_2; PFam Description: Pyridine
  misc_feature: GI Number: 188874; NR Description: intestinal mucin
  misc_feature: GI Number: 7493929; NR Description: chitinase (EC 3.2.1.14) A
  misc_feature: GI Number: 2135765; NR Description: mucin 2 precursor,
  misc_feature: GI Number: 28385951; NR Description: 4833412E22Rik protein [Mus musculus] >gi|27503129|gb|AAH42775.1| 4833412E22Rik protein
  misc_feature: GI Number: 111978; NR Description: mucin - rat
MIGKDEFVSYSPLPSNPNPNPNPNPNPNPNPYPNPNPYYDPNPHPYPQNVVVLLPSYRPHFQRRRRRCIIYSAALFLFLLVAGAAFLLYPSDPEIRLARIRLDRIGIRTNPRPILDLSFSLTVKVRNRDFFSLSYDSLTVSVGYRGRQLGFVTGGGGGSIRARGSSYVDATLTIDGFEVIYDAFYLLEDIAKGVIPFDTDTRVEGKLGLFFFTVPLKATVSCEVDVNINQQTIVRQDCYPKSLGDPLDESAYIEAGDT

SEQ ID NO: 3199 - DNA, 1574 bp, Glycine max
  misc_feature (1)..(1574): Ceres cDNA ID no. 21572757
  misc_feature (1)..(1574): Ceres CLONE  ID no. 724469
  misc_feature (1)..(1574): Also known as  Ceres CDNA ID no. 0
aacatatttttccttatgcagagaaaagaaccaatggatcactcagtttcagtttcatccaataagcctcttcatgttgtaatgttcccatggctagccatgggtcacgtatacccctgcttcgaggtttccaagatccttgcacaaaagggtcactatgtcactcttgtttccacccctaagataatagatcgcttgcccaaactccctcaaaccttatcaccatttgttaaactaaccaaattactcttatcgccccacatcgacaagaaccatctcccacaagatgctgactccacaatggacattccctccaacaaactctattacctcaaattggcctatgatgctctccaagaacctgtctttgaggttctcaaaacttcaaatcctgattgggttttctatgattttgcagcaagctggattccacagctagccaagaccctcaaaattcacagtgcctatttcagtccctgccctgcatggaccatatgcttctttgacacaccaaaacaacaacttggtgatgctgctgctgccaatagatcaaaccctgaagactactatggccctcccaagtgggttcctttccctacaaagattggtctaagaccctatgaggtgaggaagctcttagaagatatcaaggtcaacgagacaggtgcctcacctgtttttgatctcaacacagcaaattcaggttgtgacatgtttgtcatcagaagctccagagaccttgaacaagagtggttggattatcttgctgagttttaccacaagcctgtggttcctgtggggttgcttccaccgttaagaggctctgatgaggaggacaatagccccgattggcttcagatcaaggcatggctagatacacagaaagggtcatcagtggtgtacattgcatttgggagtgaggtgaaactgagccaagagaacctcaatgagttggctcttggaattgagctttcagggttgtctttcttctgggtcttgaggaagggctcggttgagtttttgcgagaagggtttgaggatcggaccaaagatcgaggtgttgtttggaaaacttgggcaccccagcctaagatattggctcatgcatcggttggtgggtgcttgactcattgtggttctggttcaatgatcgaaaatctcatctttggacacgttcttgtgatgttgcccttcttgctagaccaagctttatattcaagagtgatggaagagaagaaagtgggaattgagattccaaggaatgagcaagatgggtcgttcacaagaagctcagtggccaaggcattgagattggcaatggtggaagaggagggaagtgcttataggaacaatgctaaagagttgggcaagaaatttagcaacaaggagctcgatgaccaatacattgaagatttcattgcttcccttcacaatcacaagcatacataggagggattaggtggatatgagtatttgattatttgagttagtacaggtctttttacttttctaaaatttcacctgtttttttaaaataaattaagtatggttcaagttcaaaaaaaaaaaaaaaa

SEQ ID NO: 3200 - protein, 1574 aa, Glycine max
AACATATTTTTCCTTATGCAGAGAAAAGAACCAATGGATCACTCAGTTTCAGTTTCATCCAATAAGCCTCTTCATGTTGTAATGTTCCCATGGCTAGCCATGGGTCACGTATACCCCTGCTTCGAGGTTTCCAAGATCCTTGCACAAAAGGGTCACTATGTCACTCTTGTTTCCACCCCTAAGATAATAGATCGCTTGCCCAAACTCCCTCAAACCTTATCACCATTTGTTAAACTAACCAAATTACTCTTATCGCCCCACATCGACAAGAACCATCTCCCACAAGATGCTGACTCCACAATGGACATTCCCTCCAACAAACTCTATTACCTCAAATTGGCCTATGATGCTCTCCAAGAACCTGTCTTTGAGGTTCTCAAAACTTCAAATCCTGATTGGGTTTTCTATGATTTTGCAGCAAGCTGGATTCCACAGCTAGCCAAGACCCTCAAAATTCACAGTGCCTATTTCAGTCCCTGCCCTGCATGGACCATATGCTTCTTTGACACACCAAAACAACAACTTGGTGATGCTGCTGCTGCCAATAGATCAAACCCTGAAGACTACTATGGCCCTCCCAAGTGGGTTCCTTTCCCTACAAAGATTGGTCTAAGACCCTATGAGGTGAGGAAGCTCTTAGAAGATATCAAGGTCAACGAGACAGGTGCCTCACCTGTTTTTGATCTCAACACAGCAAATTCAGGTTGTGACATGTTTGTCATCAGAAGCTCCAGAGACCTTGAACAAGAGTGGTTGGATTATCTTGCTGAGTTTTACCACAAGCCTGTGGTTCCTGTGGGGTTGCTTCCACCGTTAAGAGGCTCTGATGAGGAGGACAATAGCCCCGATTGGCTTCAGATCAAGGCATGGCTAGATACACAGAAAGGGTCATCAGTGGTGTACATTGCATTTGGGAGTGAGGTGAAACTGAGCCAAGAGAACCTCAATGAGTTGGCTCTTGGAATTGAGCTTTCAGGGTTGTCTTTCTTCTGGGTCTTGAGGAAGGGCTCGGTTGAGTTTTTGCGAGAAGGGTTTGAGGATCGGACCAAAGATCGAGGTGTTGTTTGGAAAACTTGGGCACCCCAGCCTAAGATATTGGCTCATGCATCGGTTGGTGGGTGCTTGACTCATTGTGGTTCTGGTTCAATGATCGAAAATCTCATCTTTGGACACGTTCTTGTGATGTTGCCCTTCTTGCTAGACCAAGCTTTATATTCAAGAGTGATGGAAGAGAAGAAAGTGGGAATTGAGATTCCAAGGAATGAGCAAGATGGGTCGTTCACAAGAAGCTCAGTGGCCAAGGCATTGAGATTGGCAATGGTGGAAGAGGAGGGAAGTGCTTATAGGAACAATGCTAAAGAGTTGGGCAAGAAATTTAGCAACAAGGAGCTCGATGACCAATACATTGAAGATTTCATTGCTTCCCTTCACAATCACAAGCATACATAGGAGGGATTAGGTGGATATGAGTATTTGATTATTTGAGTTAGTACAGGTCTTTTTACTTTTCTAAAATTTCACCTGTTTTTTTAAAATAAATTAAGTATGGTTCAAGTTCAAAAAAAAAAAAAAAA

SEQ ID NO: 3201 - DNA, 1778 bp, Triticum aestivum
  misc_feature (1)..(1778): Ceres cDNA ID no. 21572758
  misc_feature (1)..(1778): Ceres CLONE  ID no. 726059
  misc_feature (1)..(1778): Also known as  Ceres CDNA ID no. 24356772
gcgcccgccgccatcgcctgcgacctcctgctcgagttccccccgccggcgccgaactccctgccctaggcagcagaatctctttgctacaatctgacaaagtggagggcttggaagtccaagtttctttcatgtctggacaacactcgctgtacttcgaatcagttggattgccgggagagtgttctcgtacaacaagaaaaagggataagcttctttcccctcacttgccactgttcaaggtcagctcaaaggcggctcttgcttctgaatttggacgaggctgataggatcagaaagcttgagccaagatggcgctgcagaacattggcgctttgaacaaggatgacgccttctacaggtacaagatgcccaaaatgttaacaaaaatagaaggccatggtaatggcatcaagacaaacatcgtgaacatggttggcatagcaaaagcgcttgccaggccagcttcctacacaacaaagtactttggctgtgcgcttggggcacagtctacatttgatgacaagacaggggtttgcatagtcaatggtgcccatgacactgcaaaactggctggccttcttgagaacttcatcaacaagtatgttcagtgttataagtgtggcaaccctgaaacagaggttgtcatctccaagaaacagacgctatctctgaaatgtgctgcatgtggcttcatctcggatgttaacatgagtgacaagcttgctaaattcattgtgaacaacccgccagaactgaagaagggaggcaaggacaagaaagccatgcgaagagctgagaaggagcggctcaaggaaggtcaggctgctgatgaggagatgaagaaactcaagaaggatgggaagaagaaaggtgcttcatccaaggacagcactgcaaaaggtgttgctgcaaagaaaaatgctactgctggtggttctgatgaagaacatgcaacctcgtcaacttacagtcaagctgtggactttccagctgctgcagatgacgactatgacgacgacgatgatgacggtgtggagtggcagactgacacgtcagcagaggctgcgagaaagcgcatggaggagcagctgaatgcggcgactgccgagatggtcatgcttgccaccgaagagacagaaaagaagaagcaacatgccaaaatgtctccatatgatgaactggtcgaggagatcaaggccaacgtgggcaatgctgccactccagctcagatcaaggctgtgctgtcctcctcgaccctccccgccaaggacgtgacggacgccctctttgaggcgctcttccacggtgcgggcaaggggtttgcaaaggacgtcaagaagaacaatgactaccttgctgctgccgtgcccgatgaaggagcccagatgctgctgctccaggccatcgaggcgttctgcggcaagtgcagcgccgaggccctgaaggaggtgccggtggtcctgaaatgcctgtatgatggcgacgtcctcgaggaagaagccattgtccagtggtacgatgaagctgttgctgccggcaaggcctcccaggttgtgaagaatgccaggccgtttgtggtctggctccaggtcgccgaaccggacgaggagtgaagaggccgtgctgcttgatcccgtttatacgctctatctttttaccgcctacttgctttaggtatcttttcatagtgtttgaagtgtccattttttggatcagtattttaagtttcagacgttaaacacttgagttgttatggtcgaaaaaaaaaaaaaaaa

SEQ ID NO: 3202 - protein, 434 aa, Triticum aestivum
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: GI Number: 1806575; NR Description: Eukaryotic initiation factor-5 [Zea mays] >gi|2494320|sp|P55876|IF5_MAIZE Eukaryotic translation initiation factor 5 (eIF-5) >gi|7489730|pir||JC5595
  misc_feature: GI Number: 4160402; NR Description: eukaryotic translation
  misc_feature: GI Number: 53792080; NR Description: putative eukaryotic translation initiation factor 5 [Oryza sativa (japonica
  misc_feature: GI Number: 15810339; NR Description: putative eukaryotic
  misc_feature: GI Number: 20465815; NR Description: putative eukaryotic translation initiation factor 5 protein [Arabidopsis thaliana] >gi|17381210|gb|AAL36417.1| putative Eukaryotic translation initiation factor 5 [Arabidopsis thaliana] factor 5, putative
MALQNIGALNKDDAFYRYKMPKMLTKIEGHGNGIKTNIVNMVGIAKALARPASYTTKYFGCALGAQSTFDDKTGVCIVNGAHDTAKLAGLLENFINKYVQCYKCGNPETEVVISKKQTLSLKCAACGFISDVNMSDKLAKFIVNNPPELKKGGKDKKAMRRAEKERLKEGQAADEEMKKLKKDGKKKGASSKDSTAKGVAAKKNATAGGSDEEHATSSTYSQAVDFPAAADDDYDDDDDDGVEWQTDTSAEAARKRMEEQLNAATAEMVMLATEETEKKKQHAKMSPYDELVEEIKANVGNAATPAQIKAVLSSSTLPAKDVTDALFEALFHGAGKGFAKDVKKNNDYLAAAVPDEGAQMLLLQAIEAFCGKCSAEALKEVPVVLKCLYDGDVLEEEAIVQWYDEAVAAGKASQVVKNARPFVVWLQVAEPDEE

SEQ ID NO: 3203 - DNA, 1568 bp, Triticum aestivum
  misc_feature (1)..(1568): Ceres cDNA ID no. 21572759
  misc_feature (1)..(1568): Ceres CLONE  ID no. 734299
  misc_feature (1)..(1568): Also known as  Ceres CDNA ID no. 24356700
acagcagcccaaaaatccccaaatccgttctcgcacccgcaggtcacatcccgcggccacgcgcgcacctcgccgccgggagacaccccgcctccgccgccgcgcccccaacccggctgcgcgcccccatcaatcgccaggccacgcagtgagcgttccatatcgttggattgctgggcggcgacggagtcgatgtccggaggccaagaaggcggcgaggactcagatcacatcatggacctaggcgaagatcagaattcctttaaaaccaaaagatcacgagccacaaattggccctcagtaatgtcaaagtttctacttaattggtaccttgagaaaaagaaggcgatgccacctaagaccaaattcaagaagacacaccaccattattgccaagctgcactaaatgctagatttgagtctgcttacactgttgatcaggtccatcgccatttgaggcgtctcaaggaggtttggaatattgtggcgcgttatatgaacgagaacgggagcaggtttgacaagaaaaacaaaatgttaatactaccttctgcaaccatggctgctctacccttagcagaacgtgctattctcgttaaacccattccattcttcgaccatttgcaagctctcttcagcgattgcccagttgatggtgcctctataacagacctgctgacagatgctgacttaaatgatgatcagatggaaacccaggatccgttgaacatgatggttgttcatgcagacacaggggacccacacgaggcaggcttggacaaagttgttttggggggtgaagatgagtgtcatgaggttgcagttattagcgccgttggtacagtaccatgtgaagttatgtcaggcactagtgcaccatctgctgaaccatcaggatcggctgagagcacaatagctgctctcaaacccagcttgaagcagtgcaagatagtcagcaaagcaaaagcaaatccaaagccacaggctgttgcgctacatgatagcaggaaaccagacgcgttcaacaggaacttaatggggatccatgacagactcgctaaaccaacacggacagcaccaccactgtcagacccaaatgctcctctgtggaacatgctaaaggaaattccattgacacctgctgataggctgtcagttgggatttatctttgtaagccagagtctgaagtgcatcgaagttttttcatgagtatgggtaaggagtacctagaggcatgggcccacaagttcttgagtggaggggagcctggagccttatagtttgattgcttaatcacggctcattgctttaaattcaacccatgctgtccgtggatgaattgttcttcagacttcagagggccttgtttgtgctgctacatattggtgcacctcttgtgctataagcattggtaaatatgattagttttttcgcgggaaaactattagttagttattatcatgtaacttgccttaacaccttacctgatagtccagtgtagtttgcggacaatttgtgagcatcttatgctcatggcttattctatgtatcaaaaaaaaaaaaaaaa

SEQ ID NO: 3204 - protein, 362 aa, Triticum aestivum
MSGGQEGGEDSDHIMDLGEDQNSFKTKRSRATNWPSVMSKFLLNWYLEKKKAMPPKTKFKKTHHHYCQAALNARFESAYTVDQVHRHLRRLKEVWNIVARYMNENGSRFDKKNKMLILPSATMAALPLAERAILVKPIPFFDHLQALFSDCPVDGASITDLLTDADLNDDQMETQDPLNMMVVHADTGDPHEAGLDKVVLGGEDECHEVAVISAVGTVPCEVMSGTSAPSAEPSGSAESTIAALKPSLKQCKIVSKAKANPKPQAVALHDSRKPDAFNRNLMGIHDRLAKPTRTAPPLSDPNAPLWNMLKEIPLTPADRLSVGIYLCKPESEVHRSFFMSMGKEYLEAWAHKFLSGGEPGAL

SEQ ID NO: 3205 - DNA, 2383 bp, Triticum aestivum
  misc_feature (1)..(2383): Ceres cDNA ID no. 21572760
  misc_feature (1)..(2383): Ceres CLONE  ID no. 735701
  misc_feature (1)..(2383): Also known as  Ceres CDNA ID no. 0
atcagtgatggaccatcagttcattattaatccaacaaaaattcgcgacaaatctctggagtaaagctccgagctttccttcagtttttccaatccctcgatgtctctaccgccggaagcaagtgactagccatgcttaggcggcggctgctccgagagctccaagcttgcgcggagtcgctcccccaatcgagcaatcagattgcgtttgcaagaatctgtggatgcccgttgaatctgactaaagattcgcgtaagtattgtaatcctcctatcagtttccgcttgcctctagtttttagaagaggagttgttgctggttcttgtggcgtgagatcttttcagaactctgatgtccagccgccggctcggtgcttttccggcgacgcctgcgcggcgcctctggccaagatcccggattcgccggtgcgcgtgctccggcatggtctcgtccgtgcgagcgcgcaggcctcgctgctcgagtatctccattctacgcggggaatagagttcatgctcgccgagcacatgagcaagaactctccggcgttcctcgcccgcctccttgccaacgtggacaccggcggcggcgccgatgtgagattgtcagtctccaggttcctgcaataccaccccatcaatgagttcgagccgttcttcgagagcattgggctcaggccgtcagagttggggaagttcttgccaagtgatttgatatacctgaaggatgctgtcgaattgctggagaattaccaagtactctgtgattatggcgtgccacggaccaagattggtaaggtgtacaaggaggccaatgaggtgtttggttatggacacagtgtgttattctcgaaattgcaagaatatgagctgcttggattgagcaaatcaacaatcaccaagcttgtagtgtgttgccccaaactccttattggtgaagccaaccttgagtttctgcatgttttggataagctgaaagcctctggtattatgctcggatggtttagagggggtttgtcagatgagagcacacacaactggagacgaactcttaaaatgcttgaatttcttgatatgatgggttccaacaacaagactctgttggtaaggctgatcaaagaacatccaagatttgtgtttggcgaatctggtaagaagttgtatcttcttgtcagcatgctgtgtaaatttggcattcagatagatagcatgctacagctattcgtgcagtgcccatgggttctaaacatgaaatttccaaagaatctgcagaaatcagtggattttttgactcagataggaatggaggcattcgacattgctcgggttgtctcatcatgccctgaaattcttggtgctagttcttgtcagagtgttgctattgtgttgtctaccatgaacctgtctgctgcgaggttatgcaatatcataaaagaggaccctatgcagtttggtactttggtatcaaagaaaaaaattgctgctgtgacaaagatagacagtttttatcttggagagaaggctgaatttttgctgaagatcggcttcattgagaactctgacgacatggtgaaggcaatgtcccattttcgtggccgcggtgaccagcttcaagagaggctagattgcttggtcgatgctggattggactatgaggatgcctgcagcatgatcaaagtggccccatttatactgaacatgtcagtgagtatgatcaagaaaaagatcagctacattctgaatgacatcggatacactcttgaatctattgttgcttttcctgcgattttcgggtacagtttggagaagatgaagctgagattcatgatgtacaagtggctcaccgaaaatggtgtcaagatcaaaccaacaaacaagaacaaggtaaacaagtccatggtagccttgagcaccatcatggcatgctcagatgtcaggtttgtgaagcaatttgtgaatcttcaccctggtggactggatcaatggcaacggttgaagaactgttcaactattcagtaagaattacaagacaaatattcaattttatttggaaaaatatattccgacgcacaagctttatttcttcagctgcctccttgcaatgcagggctacaatacaaatcttgacacatcttcacaaatgccatgtctgaaaactcaagttttcatatttagaggtttatactttagatcttgactgaaaaactgctaggacctacttggagaggaatatctcttggaaagctttggtatttagttattagtatgttgtaggatatatcagttcatcacaattgtataaatgtataaacctgatattaacatcccatgtgaggttgaccagtggaataaggctaattgccagccaaaaaaaaaaaaaaaa

SEQ ID NO: 3206 - protein, 628 aa, Triticum aestivum
MLRRRLLRELQACAESLPQSSNQIAFARICGCPLNLTKDSRKYCNPPISFRLPLVFRRGVVAGSCGVRSFQNSDVQPPARCFSGDACAAPLAKIPDSPVRVLRHGLVRASAQASLLEYLHSTRGIEFMLAEHMSKNSPAFLARLLANVDTGGGADVRLSVSRFLQYHPINEFEPFFESIGLRPSELGKFLPSDLIYLKDAVELLENYQVLCDYGVPRTKIGKVYKEANEVFGYGHSVLFSKLQEYELLGLSKSTITKLVVCCPKLLIGEANLEFLHVLDKLKASGIMLGWFRGGLSDESTHNWRRTLKMLEFLDMMGSNNKTLLVRLIKEHPRFVFGESGKKLYLLVSMLCKFGIQIDSMLQLFVQCPWVLNMKFPKNLQKSVDFLTQIGMEAFDIARVVSSCPEILGASSCQSVAIVLSTMNLSAARLCNIIKEDPMQFGTLVSKKKIAAVTKIDSFYLGEKAEFLLKIGFIENSDDMVKAMSHFRGRGDQLQERLDCLVDAGLDYEDACSMIKVAPFILNMSVSMIKKKISYILNDIGYTLESIVAFPAIFGYSLEKMKLRFMMYKWLTENGVKIKPTNKNKVNKSMVALSTIMACSDVRFVKQFVNLHPGGLDQWQRLKNCSTIQ

SEQ ID NO: 3207 - DNA, 1634 bp, Triticum aestivum
  misc_feature (1)..(1634): Ceres cDNA ID no. 21572761
  misc_feature (1)..(1634): Ceres CLONE  ID no. 736347
  misc_feature (1)..(1634): Also known as  Ceres CDNA ID no. 24356780
atcagcactatccgcgcaccaccgccaccacaccaaggcaccagaggtagctagctagtggagtggtggacgccccgccgcgcgcacgggcggcaagcatgggccctgcggcggtcgccgtgctggtcatcctctgcgccgccggcgccgaggcccgcgtcccggccggtcacctcgcgacgaggcggcgcgacagtgttcccgcgggcgtgggtgcgtgcgcgctggccgtggcgcccttcggctacccctgcgaggagcacacgatgacgacggtggacgggtacatcctgagcctgcaacggatcccgagggggcggcgccccagcggcggcggcggcgcggggcagccggtgctcctgcagcacggcgttctcacggacggcatgacatggctgctgagctcgccggaggaatcgttggcgtacatcctcgcggacagcggcttcgacgtctgggtcgccaacaacaggggcaccaggtggagcagccgccacgtctccctcgactcctcctcccggaggtactgggactggtcgtgggacgacctggtggtgaacgacatgccgagcatagttgactatatctgcagccacacggcgcagaagccgcacttcctcggccactccatggggacgctggtggcgctggcggccttctcggagggcagaacggtggacaagctcaagtcggcggcgctgctgaccccggtcgcctatctgtcccacatgaccacccccctcggcatactgctagccaaggcattcgtcggaaagctcatcaccatcctcggtgtggcggagttcaacccagtaacgccggcggtggcgagcctcttcaaggaactgtgccgccatcctggaaccaactgctacgacctcctcacagacttcacagggaagaactactgcctcaacagctcggccgtggacgtcttcctccagtacgagccgcagccgacgtccaccaagaccatggtgcacctcgcccagacgttccgcgacggcgtgctgtccaagtacgactacgtgtggccgggcgtgaacgtggagaagtacggccagccggacccgccggcgtacaacatgtccaacataccgccgggcttcccgctcttcctcagctacggcggccgggacgagctggccgaccccgtcgacgtcggccgcctcctcggcgacctccggggccacgaccccggcaggctcacggtgcagtacctggagcagttcgcgcacgccgacttcgtcatcggcacctgcgccaaggactacgtctacaaagacgtcgtctccttcttcaaccgcttcaactagcaacaagctctcgtctccaacaaacacgggagatttggaggatgaacagctacagttgctgcaagattacggaggggaaattacgcttacatatagtagctgtgaatatgtcaatgggatggaaatatcataattacaccagaggtgatcgctatggctacatggtccggctacatgcacacgtttatgcacatgctgatgattaccaggcgatccctgaactgaaagtatggccactcgtataactgtactgcggtgccaaagtttacaaaaaatatatacgtagattggtggtgttatttaaaaaaaaaaaaaaaa

SEQ ID NO: 3208 - protein, 405 aa, Triticum aestivum
  misc_feature: PFam Name: Abhydrolase_1; PFam Description: alpha/beta
  misc_feature: PFam Name: Abhydro_lipase; PFam Description: ab-hydrolase
  misc_feature: PFam Name: Mucin; PFam Description: Mucin-like glycoprotein
  misc_feature: GI Number: 50947883; NR Description: putative gastric lipase precursor [Oryza sativa (japonica cultivar-group)] >gi|42407876|dbj|BAD09017.1| putative gastric lipase precursor [Oryza sativa (japonica cultivar-group)]
  misc_feature: GI Number: 39636476; NR Description: triacylglycerol/steryl
  misc_feature: GI Number: 38344633; NR Description: OSJNBa0094P09.4 [Oryza
  misc_feature: GI Number: 35395931; NR Description: lysosomal acid
  misc_feature: GI Number: 4585908; NR Description: putative lysosomal acid lipase [Arabidopsis thaliana] >gi|25411617|pir||E84526 probable
MGPAAVAVLVILCAAGAEARVPAGHLATRRRDSVPAGVGACALAVAPFGYPCEEHTMTTVDGYILSLQRIPRGRRPSGGGGAGQPVLLQHGVLTDGMTWLLSSPEESLAYILADSGFDVWVANNRGTRWSSRHVSLDSSSRRYWDWSWDDLVVNDMPSIVDYICSHTAQKPHFLGHSMGTLVALAAFSEGRTVDKLKSAALLTPVAYLSHMTTPLGILLAKAFVGKLITILGVAEFNPVTPAVASLFKELCRHPGTNCYDLLTDFTGKNYCLNSSAVDVFLQYEPQPTSTKTMVHLAQTFRDGVLSKYDYVWPGVNVEKYGQPDPPAYNMSNIPPGFPLFLSYGGRDELADPVDVGRLLGDLRGHDPGRLTVQYLEQFAHADFVIGTCAKDYVYKDVVSFFNRFN

SEQ ID NO: 3209 - DNA, 1709 bp, Triticum aestivum
  misc_feature (1)..(1709): Ceres cDNA ID no. 21572762
  misc_feature (1)..(1709): Ceres CLONE  ID no. 738541
  misc_feature (1)..(1709): Also known as  Ceres CDNA ID no. 24356728
attccattcaaaatccatttgagcttcacaacagctagtgtgtccgtgagcttctctcttccatgattgtgcgcggttccttaagcggcggcggcggtgtgatctaagcggcggcggccggcggcgtcagagactggctcactggcagactgtacagggttctgcgacaaccagctagcgggtcatgaccatgttgattctagctaggcgaattttatgttgagttgatgccgaaaatccatgcccgccggccggcgccatcgttgtctccaaagcgccgtgcgcactagcttccaaaaatggagtcctagacaagcgccctccagctaccgttcccagcactcagacacgcgcaggcgcaccctcgcaacgtaggcatggacgtggaggcgcccaaggacgacgaccagcgccccgcgccgccggcgcacggcaaggcgatgcagcggttcctggtggcgctcaactgcgggatgctcacgctgggcaccacgggcgggccgctcctcagccgcctctacttcagcaagggcgggcaccgaaagtggctgtccgcgtggctcgagaccggcggctggccgctgctgctgctccccgtggcggcctcctacctcagccggcgcgcgcacgaccccagcgcgccggtggtgctgaccccgccgaggatactgcttgccgccgcggggctcggtctggccaccggcgccgacgacttcctgtacgcgtacgggctgtcgttcgtgcccgtgtccacctccgcgatcctcatctccacgcagctggccttcaccgtcttcttcgcgttcctgatcgtgcggcagcggctgacggcgctgtcggtgaacgcggtggcgctgctcaccgtgggcgccgtggtgctggggctgcacgtctcctccgaccgccccgccggggtgaccaaggggcagtactggctggggttcctgctgaccctggccgcggcggcgctgtacgggctggtgctgccgctgatcgagctgacctacaagcgggccgcgggcggcgggcgcgtggtgacctacgcgctggtgatggagatgcagctggtgatgggcttcttcgccaccgccttctgcaccgtcggcatgatcttcaacaacgacttccaggcgatctcaagggaagcgcagacattcgagctaggggaggcccggtactacacggtgctggtgtggagcgccatcctgtggcagttcttcttcctgggcgccgtgggcgtcatcttctgcgtccacaccctgttcgccgggatcctcatcgccgtcttcatcccggtcacagaggtgctggccgtcatcttcctgcacgagaagttcaccagcgagaagggcgtggcgctcgcgctctcgctctggggcctcgcctcctactcctacggcgagtacagcgaggccaaggcggccaagaagaaagcggccttggatgcccaagcctctgactaatagtacacttcgattccaagaattgtgatttggattgttgtgcttgtctgctcgtaaggcatacataacctgccaccagttgtaaatggcacggttattgtcatgacccaaaatttcagaacctggtaaaaaaatactgatttttgtcctattagcttatgtaatgttatttacaaagttattccaaagtgcctagtcaataggcttaggccagttctggatgatattagaaaaaaaaaaaaaaaa

SEQ ID NO: 3210 - protein, 1709 aa, Triticum aestivum
  misc_feature: PFam Name: RVT_1; PFam Description: Reverse transcriptase
  misc_feature: PFam Name: Nuc_sug_transp; PFam Description:
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 50900306; NR Description: putative purine permease [Oryza sativa (japonica cultivar-group)] >gi|46806332|dbj|BAD17524.1| putative purine permease [Oryza sativa (japonica cultivar-group)] >gi|47497668|dbj|BAD19735.1|
  misc_feature: GI Number: 7620007; NR Description: purine permease
  misc_feature: GI Number: 9795614; NR Description: purine permease [Arabidopsis thaliana] >gi|26450405|dbj|BAC42317.1| putative purine permease [Arabidopsis thaliana] >gi|28973199|gb|AAO63924.1| putative purine permease [Arabidopsis thaliana]
ATTCCATTCAAAATCCATTTGAGCTTCACAACAGCTAGTGTGTCCGTGAGCTTCTCTCTTCCATGATTGTGCGCGGTTCCTTAAGCGGCGGCGGCGGTGTGATCTAAGCGGCGGCGGCCGGCGGCGTCAGAGACTGGCTCACTGGCAGACTGTACAGGGTTCTGCGACAACCAGCTAGCGGGTCATGACCATGTTGATTCTAGCTAGGCGAATTTTATGTTGAGTTGATGCCGAAAATCCATGCCCGCCGGCCGGCGCCATCGTTGTCTCCAAAGCGCCGTGCGCACTAGCTTCCAAAAATGGAGTCCTAGACAAGCGCCCTCCAGCTACCGTTCCCAGCACTCAGACACGCGCAGGCGCACCCTCGCAACGTAGGCATGGACGTGGAGGCGCCCAAGGACGACGACCAGCGCCCCGCGCCGCCGGCGCACGGCAAGGCGATGCAGCGGTTCCTGGTGGCGCTCAACTGCGGGATGCTCACGCTGGGCACCACGGGCGGGCCGCTCCTCAGCCGCCTCTACTTCAGCAAGGGCGGGCACCGAAAGTGGCTGTCCGCGTGGCTCGAGACCGGCGGCTGGCCGCTGCTGCTGCTCCCCGTGGCGGCCTCCTACCTCAGCCGGCGCGCGCACGACCCCAGCGCGCCGGTGGTGCTGACCCCGCCGAGGATACTGCTTGCCGCCGCGGGGCTCGGTCTGGCCACCGGCGCCGACGACTTCCTGTACGCGTACGGGCTGTCGTTCGTGCCCGTGTCCACCTCCGCGATCCTCATCTCCACGCAGCTGGCCTTCACCGTCTTCTTCGCGTTCCTGATCGTGCGGCAGCGGCTGACGGCGCTGTCGGTGAACGCGGTGGCGCTGCTCACCGTGGGCGCCGTGGTGCTGGGGCTGCACGTCTCCTCCGACCGCCCCGCCGGGGTGACCAAGGGGCAGTACTGGCTGGGGTTCCTGCTGACCCTGGCCGCGGCGGCGCTGTACGGGCTGGTGCTGCCGCTGATCGAGCTGACCTACAAGCGGGCCGCGGGCGGCGGGCGCGTGGTGACCTACGCGCTGGTGATGGAGATGCAGCTGGTGATGGGCTTCTTCGCCACCGCCTTCTGCACCGTCGGCATGATCTTCAACAACGACTTCCAGGCGATCTCAAGGGAAGCGCAGACATTCGAGCTAGGGGAGGCCCGGTACTACACGGTGCTGGTGTGGAGCGCCATCCTGTGGCAGTTCTTCTTCCTGGGCGCCGTGGGCGTCATCTTCTGCGTCCACACCCTGTTCGCCGGGATCCTCATCGCCGTCTTCATCCCGGTCACAGAGGTGCTGGCCGTCATCTTCCTGCACGAGAAGTTCACCAGCGAGAAGGGCGTGGCGCTCGCGCTCTCGCTCTGGGGCCTCGCCTCCTACTCCTACGGCGAGTACAGCGAGGCCAAGGCGGCCAAGAAGAAAGCGGCCTTGGATGCCCAAGCCTCTGACTAATAGTACACTTCGATTCCAAGAATTGTGATTTGGATTGTTGTGCTTGTCTGCTCGTAAGGCATACATAACCTGCCACCAGTTGTAAATGGCACGGTTATTGTCATGACCCAAAATTTCAGAACCTGGTAAAAAAATACTGATTTTTGTCCTATTAGCTTATGTAATGTTATTTACAAAGTTATTCCAAAGTGCCTAGTCAATAGGCTTAGGCCAGTTCTGGATGATATTAGAAAAAAAAAAAAAAAA

SEQ ID NO: 3211 - DNA, 1952 bp, Triticum aestivum
  misc_feature (1)..(1952): Ceres cDNA ID no. 21572763
  misc_feature (1)..(1952): Ceres CLONE  ID no. 738949
  misc_feature (1)..(1952): Also known as  Ceres CDNA ID no. 0
aaaaggaagctagctctccactccagtgaatgcagtgcagtaaaggagtatcatcgactagctagtccgccgctggcctcccctccctcgtcccgttcctccagtccccctcccctcccctagcgtaggcacgcgcgcagcttggcgcggcggccgacggccgacggccagcgcaaggaaggaacaaggccggaagggcaggaggtggtggaacttctttcttggatctgttaaagcaatgggattgtcaagtaactgtgctaagacaatcaagatccagcagtgtgtgaaattgcctgattccaaatatcttcacatcaacgatgagctcgctgggtgctttggtaccgaagatcatggcgatgggcgggcggctcttgttctcagcccgttcggcaagaatgtctggcctgtcaaggttgaccgagacgccaaaggggcattcctgggtgatgggtggccacagtttgttgccgcgcacggtatcggcgttggctggtacttggtgatccggcatgaagggtgcggcgtgctcactctaaaggcgttcaacgccagctttgtcattaaagagttcggcctaacgatcactgttttgagcccagccgagattgagaacgcctttgctcgtaagccacagttcatcgtgccacttcagagaagtttcatggaaaagatgcctattcctcccgagtttctgcaacgaggatacatctcggaagaagacctgaacagaccgagaccgatagccacttttttaacatcctggcatatcgagctcaagaaggatggcccgaatgtcttcttcactggttccgaatggccaaagtttctggcctactttgaaattgctgaaaccgatgtcctgctgatcaagtatcaggggtgcatgaacttctcattcgagaccttccaaaatgggaataatgagaacatcgaggaaaaaataagctcgtctcagcaaagcgagcaatcacctgcagcacaatgccaagaggacgaacatgtttccactcgaagaaggacacaaagcaatggcataacacctggagcacaaagccaagaggaagaacatgtttccactcagacaaggaaacaaagcaatggcaaaacacctggagcacaaagcgaagaagaagaacctgtctccactcagaaaaggaaacaaagcaatggcaaaacacctggagcacaaagccaagaggaagaacatgtttgcacccggaaaaggaaacaaagcgaagtcaaaagcatgctagacggatccacaacttcacaacaccgaaagaaggctctctgtgagcttgggtcgacggggtcgcaggcttggttaaggaaggagatcaacgaactcgcgcttaaaagatatcttcattttccagcgcgcttcggattcctggagcgttgcaagatcacgctcaagtccgtggagaggaacaagtcttgggaggtggaaggtgtcaactaccatccaggcacccgcaggtcttataattgtcttacgagaggctggaaggccttctgtaaggagaacgagctcaaggcaggagacatctgcaccttcaaagtcgtcaacagcacgctgtggcatgttgtcatcgaccgctgctagaaatacggttcatagatgatcttggctgatggcggacctgctggttttgcgaacctaagtagtatcatgatgaatattgtggtgacatgataatcaacctgctaggcgtttgtgttccatgacttgtgattaggtggctggcttgggaaggcatgatatttacttggttcgtaacctgctaggtgttttggttcatgacttgtgattaggtggctggcttgtcaaggcatgatatttaacctgctaggtgttgattttatcgatgtaatgcagcagtgcactatatttattgtttagcctcagtgctactattactctatcacaaaaaaaaaaaaaaaaa

SEQ ID NO: 3212 - protein, 457 aa, Triticum aestivum
MGLSSNCAKTIKIQQCVKLPDSKYLHINDELAGCFGTEDHGDGRAALVLSPFGKNVWPVKVDRDAKGAFLGDGWPQFVAAHGIGVGWYLVIRHEGCGVLTLKAFNASFVIKEFGLTITVLSPAEIENAFARKPQFIVPLQRSFMEKMPIPPEFLQRGYISEEDLNRPRPIATFLTSWHIELKKDGPNVFFTGSEWPKFLAYFEIAETDVLLIKYQGCMNFSFETFQNGNNENIEEKISSSQQSEQSPAAQCQEDEHVSTRRRTQSNGITPGAQSQEEEHVSTQTRKQSNGKTPGAQSEEEEPVSTQKRKQSNGKTPGAQSQEEEHVCTRKRKQSEVKSMLDGSTTSQHRKKALCELGSTGSQAWLRKEINELALKRYLHFPARFGFLERCKITLKSVERNKSWEVEGVNYHPGTRRSYNCLTRGWKAFCKENELKAGDICTFKVVNSTLWHVVIDRC

SEQ ID NO: 3213 - DNA, 2149 bp, Triticum aestivum
  misc_feature (1)..(2149): Ceres cDNA ID no. 21572764
  misc_feature (1)..(2149): Ceres CLONE  ID no. 741133
  misc_feature (1)..(2149): Also known as  Ceres CDNA ID no. 24356610
aacagaacagaaaaccctctcttcatcttcatcgaatggccccgcctccgcgccatcttctactactgcccgttctcctcctcgcctccctgctccgcgcagcgcagatggagcccgcccacgccgccgccgccggcgacggcgatcgcgacgagggcgcccgcgcgctgctcgcgctgctgcagcgcgtgcagtcggaggcgctgcgcgcgctggggccgcgcgacttcgaccccaagctctacgtcgacctgccgctcgcgcccggcgccgaccgggccgccgcggaggccgcgctcgcgacggtgaccacgcgcggggagatgaaggcgttcctggcccggtacttcgcgacggcggggtccgacctggtggaggccgacccgccggacttcgaggccgagccgcgcgggttcctgccgagggtcgcgagcggcgaggcgcgggcgtgggcgctgaaggtgcacgcgctgtggaaggacctggcgcggcgggtggcgccgtccgtcgcggcgcggcccgaccggcacaccctgctgccgctgcccggcagggtcgtcgtgccgggctccaggttccgggaggtctactactgggactcgtactgggtcgtcaggggcttgctggtgagcaaaatgtacgacacggcaaaggacatcgtgctcaatcttgtgtacctcgtggaggaatatgggttcgttctcaacggtgccagatcctactacactaatcgaagccaaccaccacttttgagctcgatggttttggaattatacacggcaacaggtgatttgggccttgtgaggagagcattcccctctttgctgaaagagcatagcttctgggtatcagagcttcacaacgtggaaataatggacaatcatggacggctgcataatttgagtcgttaccaggccatgtggaacaaacctagaccagaaagtgcaacaattgatgaggaactggcctcaaagcttaattctacggctgccaaggaaaaattgtaccaccagattgcttcagcggctgaatcaggatgggattttagctctcgatggatgagcaattcaactgacatgacaaccttggtaacaacatttgttatacctgtggacttgaacacattcatatgcaagatggaacgggacatagcggtctttgccaaactcattggagagaaggcaactgcagaacttttctcacaggcttcaaaagcacgccatacggcaatcgagtctcttttgtggaattctgagatggaacagtggcttgactactggcttcccactgatggaaattgccagggaccctacaagtgggaattgaagtcacaaaaccgcaacatctttgcttctaacttcgtacccttgtggttaaatgcacataattcaggtttggggccatttctggatgaagcaaaatcagtgagagtcatgagaagcctccaagcatcagggttggtctgtcctgcaggaatagcaacttcagtatccaatacagggcaacaatgggattttccaaatggatgggcaccattgcagcatctgatagctgagggattgctgaactctggttcaacagaagcaaaagaatttgctgaggacatcgccacgaggtgggtgagaacaaactatgcagcctacaaatcaagcggcgcaatgcatgagaagtacgacgtcgaggcctgtggaaaatccggaggaggcggtgaatacaaaccacagactggttttggttggtcaaatggcgtattattagcatttttggaagagttgggatggtcccatgacaaggaaataggctgcccatcctgatgagatcaagcaagccgcctcatcagaagaaaaatgtgcacacgccaaaaatctatggaagagccctacatgccaaaaatctatggaagagccattctgctgaactttcttaagcaactaattgactgagcacttgattgattgtgtgtgtctagtctattctttttgttacaaaatgacagcatgctgttgctccttgctgtaactaacgttatagccggcgaactgtaccccgacagtcgcccgacattcttctgctgtttacgctctaagcaaccttgtacgaggtatcactatcagaagtacagtacatctgtttaaaaaaaaaaaaaaaa

SEQ ID NO: 3214 - protein, 2149 aa, Triticum aestivum
  misc_feature: PFam Name: Trehalase; PFam Description: Trehalase
  misc_feature: PFam Name: HlyD; PFam Description: HlyD family secretion protein
  misc_feature: GI Number: 38564246; NR Description: At4g24040 [Arabidopsis thaliana] >gi|26451847|dbj|BAC43016.1| putative trehalase [Arabidopsis thaliana] >gi|7269253|emb|CAB81322.1| trehalase-like protein [Arabidopsis thaliana] >gi|5668632|emb|CAB51647.1|
  misc_feature: GI Number: 37536152; NR Description: putative trehalase [Oryza sativa (japonica cultivar-group)] >gi|10122053|gb|AAG13442.1| putative trehalase [Oryza sativa (japonica cultivar-group)] >gi|31433112|gb|AAP54665.1| putative
  misc_feature: GI Number: 4559292; NR Description: trehalase 1 GMTRE1
  misc_feature: GI Number: 2262112; NR Description: trehalase precusor isolog
  misc_feature: GI Number: 6651011; NR Description: trehalase; Tre
AACAGAACAGAAAACCCTCTCTTCATCTTCATCGAATGGCCCCGCCTCCGCGCCATCTTCTACTACTGCCCGTTCTCCTCCTCGCCTCCCTGCTCCGCGCAGCGCAGATGGAGCCCGCCCACGCCGCCGCCGCCGGCGACGGCGATCGCGACGAGGGCGCCCGCGCGCTGCTCGCGCTGCTGCAGCGCGTGCAGTCGGAGGCGCTGCGCGCGCTGGGGCCGCGCGACTTCGACCCCAAGCTCTACGTCGACCTGCCGCTCGCGCCCGGCGCCGACCGGGCCGCCGCGGAGGCCGCGCTCGCGACGGTGACCACGCGCGGGGAGATGAAGGCGTTCCTGGCCCGGTACTTCGCGACGGCGGGGTCCGACCTGGTGGAGGCCGACCCGCCGGACTTCGAGGCCGAGCCGCGCGGGTTCCTGCCGAGGGTCGCGAGCGGCGAGGCGCGGGCGTGGGCGCTGAAGGTGCACGCGCTGTGGAAGGACCTGGCGCGGCGGGTGGCGCCGTCCGTCGCGGCGCGGCCCGACCGGCACACCCTGCTGCCGCTGCCCGGCAGGGTCGTCGTGCCGGGCTCCAGGTTCCGGGAGGTCTACTACTGGGACTCGTACTGGGTCGTCAGGGGCTTGCTGGTGAGCAAAATGTACGACACGGCAAAGGACATCGTGCTCAATCTTGTGTACCTCGTGGAGGAATATGGGTTCGTTCTCAACGGTGCCAGATCCTACTACACTAATCGAAGCCAACCACCACTTTTGAGCTCGATGGTTTTGGAATTATACACGGCAACAGGTGATTTGGGCCTTGTGAGGAGAGCATTCCCCTCTTTGCTGAAAGAGCATAGCTTCTGGGTATCAGAGCTTCACAACGTGGAAATAATGGACAATCATGGACGGCTGCATAATTTGAGTCGTTACCAGGCCATGTGGAACAAACCTAGACCAGAAAGTGCAACAATTGATGAGGAACTGGCCTCAAAGCTTAATTCTACGGCTGCCAAGGAAAAATTGTACCACCAGATTGCTTCAGCGGCTGAATCAGGATGGGATTTTAGCTCTCGATGGATGAGCAATTCAACTGACATGACAACCTTGGTAACAACATTTGTTATACCTGTGGACTTGAACACATTCATATGCAAGATGGAACGGGACATAGCGGTCTTTGCCAAACTCATTGGAGAGAAGGCAACTGCAGAACTTTTCTCACAGGCTTCAAAAGCACGCCATACGGCAATCGAGTCTCTTTTGTGGAATTCTGAGATGGAACAGTGGCTTGACTACTGGCTTCCCACTGATGGAAATTGCCAGGGACCCTACAAGTGGGAATTGAAGTCACAAAACCGCAACATCTTTGCTTCTAACTTCGTACCCTTGTGGTTAAATGCACATAATTCAGGTTTGGGGCCATTTCTGGATGAAGCAAAATCAGTGAGAGTCATGAGAAGCCTCCAAGCATCAGGGTTGGTCTGTCCTGCAGGAATAGCAACTTCAGTATCCAATACAGGGCAACAATGGGATTTTCCAAATGGATGGGCACCATTGCAGCATCTGATAGCTGAGGGATTGCTGAACTCTGGTTCAACAGAAGCAAAAGAATTTGCTGAGGACATCGCCACGAGGTGGGTGAGAACAAACTATGCAGCCTACAAATCAAGCGGCGCAATGCATGAGAAGTACGACGTCGAGGCCTGTGGAAAATCCGGAGGAGGCGGTGAATACAAACCACAGACTGGTTTTGGTTGGTCAAATGGCGTATTATTAGCATTTTTGGAAGAGTTGGGATGGTCCCATGACAAGGAAATAGGCTGCCCATCCTGATGAGATCAAGCAAGCCGCCTCATCAGAAGAAAAATGTGCACACGCCAAAAATCTATGGAAGAGCCCTACATGCCAAAAATCTATGGAAGAGCCATTCTGCTGAACTTTCTTAAGCAACTAATTGACTGAGCACTTGATTGATTGTGTGTGTCTAGTCTATTCTTTTTGTTACAAAATGACAGCATGCTGTTGCTCCTTGCTGTAACTAACGTTATAGCCGGCGAACTGTACCCCGACAGTCGCCCGACATTCTTCTGCTGTTTACGCTCTAAGCAACCTTGTACGAGGTATCACTATCAGAAGTACAGTACATCTGTTTAAAAAAAAAAAAAAAA

SEQ ID NO: 3215 - DNA, 1372 bp, Triticum aestivum
  misc_feature (1)..(1372): Ceres cDNA ID no. 21572765
  misc_feature (1)..(1372): Ceres CLONE  ID no. 741193
  misc_feature (1)..(1372): Also known as  Ceres CDNA ID no. 24356784
attttaaactccgacgccgccgcaaacccttcctccatccatccatccacacgccgcagcgcaagccctcccccaaatctctcctccctccgaatctctgcgtctccatccatcagcaagcaagcgatcccgtcccacccatggccctccgcgcgctggacaacacgctgccggccgccgtggcggaccagcggcccaagaaggccgccaagctgctccccacggcgcccgccgtcacccgctcccccaccggcagcggcggcaacggcaagaagcagcgcaacgacgagaactctgcgccgcagaccaagcccgcgtcgcccgtggcggccgcggctgagccggccgtggagtacgtccggtccgaggacctgcagcccgtgcccgcgcccaaggcccgcgccgccggcctcgtggcggggctcgactccaaggactgggtcaaggtctgcgaggccctcaacgacgcccgccgcctcgccatccaccacccggccctcctcgcccccatcctggagaaggtggtgctgggggtcgtgaagacgatgaagaacccgcgcagcgcggtgctcaagacctccgtgatggcctgcacggacgtcttcgcggccttcggcaacctcatctcctcggcctcggccgacgcgttcgacaagctgctgctgcagctgctgctcaaggcgtcgcaggacaagcggttcgtgtgcgaggaggccgagaaggcgatgcgcgccatggccacatccatgccgcccctgcccctgttgaagaagctcagggcctacgtccaccacgccaacctcagggtccgggccaaggccgccgttgccatggcgcactgcgccgccaggatggacgtggagacgatgaaggagttcgggctgccggcgctgctgcaggtggccgcggagctgctgaacgaccggctgccggaggcgcgcgaggccgcccgcagcatcgtcggctccacgcacgccgccttcttcttcaaggaggctgccgaaaaagagcaggagaagaaggagaatgagctaaaggagcaggagaaggggaagaaggagcaaaaggagcaggaggaggggaagaaggagaaggaggaagaggaggagaaggagaaggagaagaaggcagagccgtcgggcgtggcggcggcgtgggagagcctgtgcgcgctgagcctgtcgcccatctcggcgcaggccgtggccaagatcgtctcgcagttgcaggcacaataatcaactgttcgaatgatcgtcgcgattctgtctgcgattcgtagtgatgcatgctatctcgcatgatctgcccatgttccagtaggctcaaattattggtgtttccagtccccccgataaaaaaaaaaaaaaaa

SEQ ID NO: 3216 - protein, 365 aa, Triticum aestivum
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: GI Number: 21593517; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 66779191; NR Description: LigA [Anaeromyxobacter dehalogenans 2CP-C] >gi|66855208|ref|ZP_00399285.1| LigA
MALRALDNTLPAAVADQRPKKAAKLLPTAPAVTRSPTGSGGNGKKQRNDENSAPQTKPASPVAAAAEPAVEYVRSEDLQPVPAPKARAAGLVAGLDSKDWVKVCEALNDARRLAIHHPALLAPILEKVVLGVVKTMKNPRSAVLKTSVMACTDVFAAFGNLISSASADAFDKLLLQLLLKASQDKRFVCEEAEKAMRAMATSMPPLPLLKKLRAYVHHANLRVRAKAAVAMAHCAARMDVETMKEFGLPALLQVAAELLNDRLPEAREAARSIVGSTHAAFFFKEAAEKEQEKKENELKEQEKGKKEQKEQEEGKKEKEEEEEKEKEKKAEPSGVAAAWESLCALSLSPISAQAVAKIVSQLQAQ

SEQ ID NO: 3217 - DNA, 1813 bp, Triticum aestivum
  misc_feature (1)..(1813): Ceres cDNA ID no. 21572766
  misc_feature (1)..(1813): Ceres CLONE  ID no. 747367
  misc_feature (1)..(1813): Also known as  Ceres CDNA ID no. 24356606
aattaccatggcctgcaccaagcatttcttgatctccgccgcgcctccctgagcacgttcggtcagcttcagttccctcctcgcgcggatcatggcgtcggtgagatcctgcgtgtccgtcaagccggccgctggccccgccaggtacagatccgccagggtcggggcggccagtttggagccgacaagcctgcgaatatccgcttcttcttcttcttcttcattgggcccaggcgcggatggctgcggcagaggtgtcggctgtgccgccagtatcagcggcaggggcgttgccgttgctcgtttggttggcgatggctggagggcgaggcggaggggcgggcgggaggtcgtcgccgagtgcagcgccagcctggagggggtccgccacggcgcggcggccgccgccgtgcccagcgtgcctgcgctgcccgagcgggccaaggtggtggctctcgtggcggccgtcatgctgctttgcaacgccgaccgggtcgtcatgtccgtcgccgtcgtgccgctggccgcgcagcacggctggtccagctccttcgtcggcatcgtccagtcatcatttctatgggggtatgttttctcatccatggttggaggagctttggcggaccgatacggggggaagaaggtgatggcaggtgctgctgcactctggtccttggccactttcctcactccatgggccgcctctcaatccgccactatgttgcttgctgtacgtgtgctttttggcgttgcagaaggtgttgcatttccgacaatgagcactttcttaccaaagtggttcccaacacatgaacgtgccactgctgttggcctttccatgggaggattccatcttggaaacgtcgtaagcttcctagcaacaccgatcatcatgtcacatataggccttgccggaacatttgccttcttcgcatcacttggttacttgtggctctctgtatggctgttgaatgtagaaagtgaccctattgacagccgtactataagcaaatctgagctgcaactaattctagctggacgaagtaaatcaaaagtcaaaggcagcaaatcaccatccttaagagaagtgttctcaaagatggaaatgtgggccataattgtagctaatgtgataaacaactggggctattttgtcctactatcatggatgccggtgtacttcaaaacggtatataatgtcaatttgaaacaagctgcatggttcagtgccataccttggggcgtcatggctctatcaggatatgtcgcgggagcttctgcagatttcatgatcaaatccggcttatctattgtgcgagtccggaaaattatgcagtcaattggttttattgggccaggtgtgtcattgctatgtctaagatttgcccaaacaccatcggctgcagcagttatcatgaccgccgccttgggtttgagttcctgcagtcaagctgggtacttctgtaatgtacaggacattgcccctaaatacgctggatccctacacggaatgacgaacggcattgggacagtggccgccatagttagcacagtaggggcaggatacttcgtccagtggctgggatccttccaggccttcctcaccctaacggcagtgctctatttcagcgccaccatcttctacaacatctacgcgacaggagacctggtttttgactgagctgaaaaatactgttaatgtcaaatgtacaattacagcttgtaaaatgtctgtctgcgcccaccgcgcagagcaaagaaacaaatagaattaagattgattggctggctcattcataaaaaaaaaaaaaaa

SEQ ID NO: 3218 - protein, 529 aa, Triticum aestivum
  misc_feature: PFam Name: MFS_1; PFam Description: Major Facilitator Superfamily
  misc_feature: PFam Name: Sugar_tr; PFam Description: Sugar (and other)
  misc_feature: GI Number: 42569720; NR Description: transporter-related
  misc_feature: GI Number: 34908356; NR Description: P0529H11.31 [Oryza sativa (japonica cultivar-group)] >gi|18461191|dbj|BAB84388.1| P0529E05.3 [Oryza sativa (japonica cultivar-group)] >gi|20805189|dbj|BAB92858.1| P0529H11.31 [Oryza sativa (japonica
  misc_feature: GI Number: 51536596; NR Description: At3g46980 [Arabidopsis thaliana] >gi|22331630|ref|NP_190282.2| transporter-related
  misc_feature: GI Number: 42572593; NR Description: transporter-related
  misc_feature: GI Number: 56784504; NR Description: putative membrane glycoprotein HP59 [Oryza sativa (japonica cultivar-group)] gi|56784255|dbj|BAD81937.1| putative membrane glycoprotein HP59
MASVRSCVSVKPAAGPARYRSARVGAASLEPTSLRISASSSSSSLGPGADGCGRGVGCAASISGRGVAVARLVGDGWRARRRGGREVVAECSASLEGVRHGAAAAAVPSVPALPERAKVVALVAAVMLLCNADRVVMSVAVVPLAAQHGWSSSFVGIVQSSFLWGYVFSSMVGGALADRYGGKKVMAGAAALWSLATFLTPWAASQSATMLLAVRVLFGVAEGVAFPTMSTFLPKWFPTHERATAVGLSMGGFHLGNVVSFLATPIIMSHIGLAGTFAFFASLGYLWLSVWLLNVESDPIDSRTISKSELQLILAGRSKSKVKGSKSPSLREVFSKMEMWAIIVANVINNWGYFVLLSWMPVYFKTVYNVNLKQAAWFSAIPWGVMALSGYVAGASADFMIKSGLSIVRVRKIMQSIGFIGPGVSLLCLRFAQTPSAAAVIMTAALGLSSCSQAGYFCNVQDIAPKYAGSLHGMTNGIGTVAAIVSTVGAGYFVQWLGSFQAFLTLTAVLYFSATIFYNIYATGDLVFD

SEQ ID NO: 3219 - DNA, 1702 bp, Triticum aestivum
  misc_feature (1)..(1702): Ceres cDNA ID no. 21572767
  misc_feature (1)..(1702): Ceres CLONE  ID no. 749015
  misc_feature (1)..(1702): Also known as  Ceres CDNA ID no. 0
acccaaagcgtgtccctccctcctcccctttttaagcccccagaggaggcaccgccgccgctcgccaccatccccgtgctctccgtcgtcgtgttgccgggtcgcctccctcctgaatctatcaatccctccccatggcgttctggggcgtggaggtgaagcccgggaagccgtacacccacagctacaacctttcccatggccgtctccgcatttgccaggccacattgggaagctgcgatgctgctacaaggacagtggtgcaatgcattgtgggcaacaagaaacccatcatactttgtagtttgaatcctaaattggctgagatgtgccatctcgagattgagttggaggaggtcgatgaggttctgttttcagtacttggccagagttctgtgcatctctcaggatattacctccggccaggcagaaggggcaatgcaggggaggaagactcagaatcttatggagaggatgttggagagtctgatacagaccaagactatgaagggagtgaggacagttacgaatctgacttcattgatgatggtgacaatgaagtacccgaggacaatgatgtttctgattctatggatgatggtgatgtatgctcaacccccgatcactgcaagcaagattctgaaaagcatgctcgtaaggttaaaagacagcggcgcttaaagaagaagcaacaagttgacagctccgctgacaagattgctgattctccatcaaagcctgctgccaggtgcaaacgtggctcaatatttgatagtgccagtgaagatgaggactttttggcccagagtgaagaagaaaacttgcctacgcctgtttccttggctaagaaaactaatggtaaagtttcagaggaaatcaaacctggaaatgttacgtcaaatgacgaagccaaaaaacggagtaacagtgataagaaaagaaaaagtgatgccatcaatgaggatcctgcatctccaatggatgtaacagaggtcaatggattatcggttccaaaacaggaagctgagataaaaaagaaatccaagaaaaagaagaaaactctagaggcagaagatggaaagcattcgaacaacataagaacattggaagatgggctggtcatagaagatctgtcagcaggaaaccaagatgccaaagtggcttcagagggcaataaggtttatatcaattatgttggcaagctgcaggatggaaaaactgttcattctaatggcgaggaaaagccctacaagtttaagcttggttctgagaaagtgatgcgtggatggaaccttggtattactggtatgcgcgttggagagaagaggaggctaaccattcccccatccatgtgcgacaatggtggtaaatcggctgtagaattgcccaaagattcaacaatcatctatgaagtggagttggtgaaagtccggtgaaatgtgctgagcttctcgttcctgttttatgccaaagaccggaccatggatttttgtcgagctacagatggagattgtgtggtttgttccgcataggctatgtgttttgttctgtagacctgttgtgtgggcgacgagtattatagatttgataggcattcgagttagcaaaaagagacgctttatatatcctgtgtactgaactagacgagacggtggtatgtgagtttaaggtctgtggtcgagaccaaaaaaaaaaaaaaaaa

SEQ ID NO: 3220 - protein, 433 aa, Triticum aestivum
MAFWGVEVKPGKPYTHSYNLSHGRLRICQATLGSCDAATRTVVQCIVGNKKPIILCSLNPKLAEMCHLEIELEEVDEVLFSVLGQSSVHLSGYYLRPGRRGNAGEEDSESYGEDVGESDTDQDYEGSEDSYESDFIDDGDNEVPEDNDVSDSMDDGDVCSTPDHCKQDSEKHARKVKRQRRLKKKQQVDSSADKIADSPSKPAARCKRGSIFDSASEDEDFLAQSEEENLPTPVSLAKKTNGKVSEEIKPGNVTSNDEAKKRSNSDKKRKSDAINEDPASPMDVTEVNGLSVPKQEAEIKKKSKKKKKTLEAEDGKHSNNIRTLEDGLVIEDLSAGNQDAKVASEGNKVYINYVGKLQDGKTVHSNGEEKPYKFKLGSEKVMRGWNLGITGMRVGEKRRLTIPPSMCDNGGKSAVELPKDSTIIYEVELVKVR

SEQ ID NO: 3221 - DNA, 1403 bp, Triticum aestivum
  misc_feature (1)..(1403): Ceres cDNA ID no. 21572768
  misc_feature (1)..(1403): Ceres CLONE  ID no. 749796
  misc_feature (1)..(1403): Also known as  Ceres CDNA ID no. 24356815
gcgatctcccaaccccccctttacctcttctgtctcttcttccctccgccgcggcgccgctcgccacgccacccgcgtatccatccaccaccgttcccgcgatggccgccggcgtactcaacacccagccccgcctcaactaaccacggatgatacacatagctcctgttaacttcctgccactcgtcccgtcccccctgagggagaggagatggacgccggcgtgggtctccggccaaggccccgtgcagcatgggccggacgacggaagccgcagggattccccccggcgacggtgccggcggtgaggctcgaccagaatccggcgcggcggccgctggttctgcgctccgacgcggggagccggagcaccgatcccatccgtggcgccagcctcaagggcctgtgctgccacaaatcggcaggtaccgagaaagtccactattctgctgatgaggccctcgtactgaagcaaaaagcagaggatgtgctcccttacctgaatgaccgctgtgtttatctagttggaatgatgggttctggcaaaactacagttgggaagataatagctgaagtactaggctattcattctttgacagtgataagctggttgagcagtctgttggcataccgtcggtggctgagatttttcaggtccacagtgaagcattcttcagagataacgagagtgaggtactaagggatttgtcgtcaatgcaccgattaattgttgcaacgggaggtggtgcggtgatacgaccaatcaattggagttatatgaagaaaggactcactatttggttagatgttccattggatgccctcgcaagaaggattgctgcggtgggtactgcgtcacgacccctcctgcatcaggaatctggtgatccttatgcaaaggcctatgccaaacttacagcactttttgaacaaagaatggattcatatgctaatgctgatgcccgagtttcccttgaaaatattgcactcaaacaaggacataatgatgtgaatgtacttacaccaagtaccatcgctattgaggcattgctaaagatggagagctttcttactgagaaggccatggtcagaaactgaccagatctcggtggttaaaaagaaagatgacaaccaatggttcttggttgccgtgatgtacatacctttgcataagacattcttcttgatatagccagagctatgacagaggataacttgggtttttacttgagtgaactatatgtgaatagctctaaattaagacaatgtttgtcttgtctttatcttgctgcaatttgatatatgggatttgggagtaaatattaagtgatatcccttgtacattttgaagcaaccagaatttacatcaatatattattttgagacaaaaaaaaaaaaaaaa

SEQ ID NO: 3222 - protein, 295 aa, Triticum aestivum
  misc_feature: PFam Name: SKI; PFam Description: Shikimate kinase
  misc_feature: GI Number: 56805579; NR Description: shikimate kinase 2
  misc_feature: GI Number: 56805577; NR Description: shikimate kinase 1
  misc_feature: GI Number: 32488697; NR Description: OSJNBb0003B01.26 [Oryza
  misc_feature: GI Number: 19349; NR Description: shikimate kinase precursor [Lycopersicon esculentum] >gi|114200|sp|Q00497|AROK_LYCES Shikimate kinase, chloroplast precursor >gi|100253|pir||S21584 shikimate
  misc_feature: GI Number: 42570867; NR Description: shikimate kinase,
MDAGVGLRPRPRAAWAGRRKPQGFPPATVPAVRLDQNPARRPLVLRSDAGSRSTDPIRGASLKGLCCHKSAGTEKVHYSADEALVLKQKAEDVLPYLNDRCVYLVGMMGSGKTTVGKIIAEVLGYSFFDSDKLVEQSVGIPSVAEIFQVHSEAFFRDNESEVLRDLSSMHRLIVATGGGAVIRPINWSYMKKGLTIWLDVPLDALARRIAAVGTASRPLLHQESGDPYAKAYAKLTALFEQRMDSYANADARVSLENIALKQGHNDVNVLTPSTIAIEALLKMESFLTEKAMVRN

SEQ ID NO: 3223 - DNA, 2029 bp, Triticum aestivum
  misc_feature (1)..(2029): Ceres cDNA ID no. 21572769
  misc_feature (1)..(2029): Ceres CLONE  ID no. 752080
  misc_feature (1)..(2029): Also known as  Ceres CDNA ID no. 24357130
ggttattcagttgctcattttctccgtgatccgtagccgcctcctctctctctctccgtcctccattgctcttggctgccgactgcgccttcttcctgtcgccaacatccaagaaagcttctgctcttctctcagtaagcttctgcggacaaggcggccggaggaagccgagccacacgcggagcgcagccttgattgcttcacccatggacggctgaccctacaacagctcgaggtttctcgccgacgcacgcggccggccatggagagggcctggagatcgggggcgctgtcggagacggcgtcctgcgccgacacgcccaggtccgcccactcctcctgcaatctccagcatcgacactcacagagcatgctgaggacacgtgaggctgcagtggacatgtcgccgcgattctcctactgcaagcctaccatcaatcgagacagcaagatgctccacagaaggcactcgcttaacttgccagagcagtcgttgcctggccgtcactccaggaaaacaacggaaaggactcaaaaggccacttcaaagtccatcgcagatttagctggggagattgcggccctcgagcaggaagtcatccgcaaggaactgcatctgctgaccctctacagaagggcatttgatcagcatctatccgattcctgcagttttgcgagcgaggtggatcaagaagcaattaaaagtattgatgagggcgcgcttcgtttaagagatatcaagcaatctgcagccttcaacttgccaactgtctcagattctatgagtgaggtattgtcaagaccggcttcgaagcattctagcctagtcaacttcttgaatgcttctatttcagactacgtacccaagatctcttgcaaactatcggaggacatcctcggctgcattgcttcggtctactgcaaacttgcaagcacgccatctcaagatgccgagtccgtgacttcaccgagtcattctgtttcatcttcaaataccttctcgccgaggcgtcgtaatgacagctggagccctcggtacacctttgatgccaccacaagccctcgccaatatccatccggaaaagagaatagtgagcaaaacataggcatgatcattgttccaaggatacatatagatgctggcaagtttgaatatgcgtcaaaaatgctggagactatcaggtccctgatacagcggctcgaaaaagttgatccaacaaagatgacacatgaggagcagctctgcttttggatcaacatccacaacgctttagtcatgcatgcttttctggcctatgggatacaagataaacgactgaagagcactgacatgattctaaaggctgcgtacaatgtgggtggtgaatcagtaaatgcccaaactattcagaactcgatcctcggatgccaatcccaccgtccatcattgtgggttcgcgcgctgttcacgccagcaaaaagatccctggaagggtcgacgccgaggcacccttacgcccttcaccattccgagccggtcgcgcatttcgcgctctccacaggaacattttcagacccgcccgtgcggctgtacacggccaagaagatccaccaccagctggagcaagcccggaccgagttcatccaggccaacgtcacggtgaagaagcaggccctcctgctgcccaaggtgctccactactatgccaaggacgcggcgctcgagctgcgccacctcgtggagctggtgtgcgagagcacgtcggagacccagcggaaggagatggcacagctccagcaccgactcaggagacggatcgacaagtgtgtggagtggctgccttacaagtccaacttcagatacgttgtacatagggatctggccgagtaggcaggcaccggttttcggtttcggttttgggttttgggttttgtttttatggtgtaagtagttaccgggttttagatgaacctaacccatggtgtggtgtgtaagtgtgtaaatacagctgaagtgtgaattgtgttggtttcaaaaaaaaaaaaaaaa

SEQ ID NO: 3224 - protein, 535 aa, Triticum aestivum
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 21618245; NR Description: unknown [Arabidopsis thaliana]
  misc_feature: GI Number: 51535341; NR Description: ternary complex factor
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
MERAWRSGALSETASCADTPRSAHSSCNLQHRHSQSMLRTREAAVDMSPRFSYCKPTINRDSKMLHRRHSLNLPEQSLPGRHSRKTTERTQKATSKSIADLAGEIAALEQEVIRKELHLLTLYRRAFDQHLSDSCSFASEVDQEAIKSIDEGALRLRDIKQSAAFNLPTVSDSMSEVLSRPASKHSSLVNFLNASISDYVPKISCKLSEDILGCIASVYCKLASTPSQDAESVTSPSHSVSSSNTFSPRRRNDSWSPRYTFDATTSPRQYPSGKENSEQNIGMIIVPRIHIDAGKFEYASKMLETIRSLIQRLEKVDPTKMTHEEQLCFWINIHNALVMHAFLAYGIQDKRLKSTDMILKAAYNVGGESVNAQTIQNSILGCQSHRPSLWVRALFTPAKRSLEGSTPRHPYALHHSEPVAHFALSTGTFSDPPVRLYTAKKIHHQLEQARTEFIQANVTVKKQALLLPKVLHYYAKDAALELRHLVELVCESTSETQRKEMAQLQHRLRRRIDKCVEWLPYKSNFRYVVHRDLAE

SEQ ID NO: 3225 - DNA, 1168 bp, Triticum aestivum
  misc_feature (1)..(1168): Ceres cDNA ID no. 21572770
  misc_feature (1)..(1168): Ceres CLONE  ID no. 752355
  misc_feature (1)..(1168): Also known as  Ceres CDNA ID no. 24357134
aaatcaacccctcgctcactcccacacgcgcacagtcgctgctctgcctgcgctcgcgagagagacagccgagccaggccagccagcgggcgacgcaggcaggcatggccacctccagcggcgaccagtcgtcgccccgcgcggcctccgacctcgccgtcctcccctcctaccccgagatgatcgtggaggccatcgcgtcgctccgggagcccaacggctccagccaggccgccatcgcgcgccgcatcgaggcggcccgcggcgccggcgtcgacctcccgccgtcccaccccgcgctcgtcgccgcgcacctctcccgcatgtccgccgccgccgagctcgtcgccgtcgccgggggcaagtacgcgctcccccctccaccgccgccctcgaggtcccccgtcgaggaggacgacatggagccggagggggaggaggaggacgacgacgaatcctctgacgacgcgccgctgccgctgccgctgccgcccccgcctcccgccaagcgcggccgcggccggcccccgaaggtgcgcccgccaggctactaccccggggggcctcccgccgccatcggcgcccctcctagcgacggactagccgtcgtcgctgtcgccaccgcgccccgccggcggggccgcccgcccaagccgcgggacccagacgcgccgcccaagatcccgcgcccgcgcggccggccgcgcaagaacccgctcccggacggcatggcgccggtcccgcggcccggccccaccacggccaagccgcgcccgcagttcgccgaggtgggcttcgtgtgagcgaggccgggccggagcgagcgagctaacatttccacttgtgcctggtgtccgttctgttaggtgtgggggtcatttctccgttcgtgttgttctaattcgaggtggaagacaagacgatgctgcagcagcagcgtttgtccggtgagtgtgggtggtgtttcagtccgtggcgtggtgttggtcgccggaggggcgtcgtctcccccggcgacggtgtatccctcttgtatctctgtcagcgcacacttggtcgatcatttccctccaccaggaggataccacgagctgaggcgcctgcgtctgctccagcgtgtattgatgctcttcgcagttcatttcaagcgtgaaaaaaaaaaaaaaaa

SEQ ID NO: 3226 - protein, 1168 aa, Triticum aestivum
  misc_feature: PFam Name: Pyr_redox_2; PFam Description: Pyridine
  misc_feature: PFam Name: GATase_2; PFam Description: Glutamine
  misc_feature: PFam Name: LMBR1; PFam Description: LMBR1-like membrane protein
  misc_feature: PFam Name: FH2; PFam Description: Formin Homology 2 Domain
  misc_feature: PFam Name: Linker_histone; PFam Description: linker histone
  misc_feature: GI Number: 50918237; NR Description: putative DNA-binding protein [Oryza sativa] >gi|13324788|gb|AAK18836.1| putative
  misc_feature: GI Number: 871498; NR Description: DNA binding protein [Oryza sativa (indica cultivar-group)] >gi|1362170|pir||S57448 DNA binding
  misc_feature: GI Number: 51091572; NR Description: DNA binding protein PF1 [Oryza sativa (japonica cultivar-group)] >gi|7439646|pir||T03931 DNA binding protein PF1 - rice >gi|453692|gb|AAA33914.1| AT hook 1
  misc_feature: GI Number: 6523547; NR Description: hydroxyproline-rich
  misc_feature: GI Number: 629769; NR Description: histone-like DNA-binding protein PF 1 - oat (strain Gary) >gi|454279|gb|AAA32718.1|
AAATCAACCCCTCGCTCACTCCCACACGCGCACAGTCGCTGCTCTGCCTGCGCTCGCGAGAGAGACAGCCGAGCCAGGCCAGCCAGCGGGCGACGCAGGCAGGCATGGCCACCTCCAGCGGCGACCAGTCGTCGCCCCGCGCGGCCTCCGACCTCGCCGTCCTCCCCTCCTACCCCGAGATGATCGTGGAGGCCATCGCGTCGCTCCGGGAGCCCAACGGCTCCAGCCAGGCCGCCATCGCGCGCCGCATCGAGGCGGCCCGCGGCGCCGGCGTCGACCTCCCGCCGTCCCACCCCGCGCTCGTCGCCGCGCACCTCTCCCGCATGTCCGCCGCCGCCGAGCTCGTCGCCGTCGCCGGGGGCAAGTACGCGCTCCCCCCTCCACCGCCGCCCTCGAGGTCCCCCGTCGAGGAGGACGACATGGAGCCGGAGGGGGAGGAGGAGGACGACGACGAATCCTCTGACGACGCGCCGCTGCCGCTGCCGCTGCCGCCCCCGCCTCCCGCCAAGCGCGGCCGCGGCCGGCCCCCGAAGGTGCGCCCGCCAGGCTACTACCCCGGGGGGCCTCCCGCCGCCATCGGCGCCCCTCCTAGCGACGGACTAGCCGTCGTCGCTGTCGCCACCGCGCCCCGCCGGCGGGGCCGCCCGCCCAAGCCGCGGGACCCAGACGCGCCGCCCAAGATCCCGCGCCCGCGCGGCCGGCCGCGCAAGAACCCGCTCCCGGACGGCATGGCGCCGGTCCCGCGGCCCGGCCCCACCACGGCCAAGCCGCGCCCGCAGTTCGCCGAGGTGGGCTTCGTGTGAGCGAGGCCGGGCCGGAGCGAGCGAGCTAACATTTCCACTTGTGCCTGGTGTCCGTTCTGTTAGGTGTGGGGGTCATTTCTCCGTTCGTGTTGTTCTAATTCGAGGTGGAAGACAAGACGATGCTGCAGCAGCAGCGTTTGTCCGGTGAGTGTGGGTGGTGTTTCAGTCCGTGGCGTGGTGTTGGTCGCCGGAGGGGCGTCGTCTCCCCCGGCGACGGTGTATCCCTCTTGTATCTCTGTCAGCGCACACTTGGTCGATCATTTCCCTCCACCAGGAGGATACCACGAGCTGAGGCGCCTGCGTCTGCTCCAGCGTGTATTGATGCTCTTCGCAGTTCATTTCAAGCGTGAAAAAAAAAAAAAAAA

SEQ ID NO: 3227 - DNA, 1386 bp, Triticum aestivum
  misc_feature (1)..(1386): Ceres cDNA ID no. 21572771
  misc_feature (1)..(1386): Ceres CLONE  ID no. 752847
  misc_feature (1)..(1386): Also known as  Ceres CDNA ID no. 24357163
ataataaatcaggaagctaccaaaccagatcggccttccccctcctgcgagaaaatatcagatccgctttggcctccatcgaatcaaattcccaaatccctccgccgcacgccatggcttcttttccgctgctctttttaccgccaccggttgtcggccacgaatcgggcttgttcaaccctcgcgttgtcgtgggcggagaagctctgtccaccgcggcggccgcctacaccaccacaagcaacgactgccgagtccgcgtctccgtgcggctcgaactcccccccgcggagtcctacctgcacatgcaaaccgacgacacgctcctcaaagatcccttggtgctggctgcctgcggcgacctcctcctcgtccacatggtcgtccacgacgctgccgatgatctgtcgtgcaagcagaacctcttcgtatacaaggcccaccccactcgcccgtcgctcagtcgtctccccaatcccgacaccttcaccggctgggcccaatcttgtggcatcgtcccctgtgacgacgggggtttcgttgtggcttcttttcggacaatcaagactgacttagatctgcaaacaggattggcgatggagcgtgtcgagttcttgcactattctcctgccaccggacactgggatttgaagagtccaacaatgccctacgatggcgaggccctcaagccgtgcctatgggagacagatcaggtattctcctatccagatggtacaatatactgggtggattaccaccgcggcttattgtcctgcaacgtgctttctgctggtgaaaatctagagctccgtttcatccagcttccagggatagaaatttggactgagctcgatgatctctcttatggtcgtgtataccctgaggcatatagaactgttggtgtatgcaaaggtattgttaagtttgttgacatcgataatggcttttttggaagcatgaagaaatctggtttcacagtcacagtttggactttgaaaatgccggagttggaatggcatcagacaagcatgttccaagtcgatgatttatgggctcttgcaaacttccgagagtcttcccttccacgatgggtgccacaattccctattgtgaacacacatgataatcatggtttatacttcatattgcaagagtgtgacagttttggtgaggactggatcatcacagtggatatgcacaacaaagtgttgcagtcatatgagcggcgcatttactcaatcttggaatgattgttaagctagtgctatcttaatagcatgaagttgtaagattgcaaggaagattttctttgaaacatctttgagaatattgttgtccttgatgaaaaaattatgtattgttatgtcgtcaaaaaaaaaaaaaaaa

SEQ ID NO: 3228 - protein, 378 aa, Triticum aestivum
MASFPLLFLPPPVVGHESGLFNPRVVVGGEALSTAAAAYTTTSNDCRVRVSVRLELPPAESYLHMQTDDTLLKDPLVLAACGDLLLVHMVVHDAADDLSCKQNLFVYKAHPTRPSLSRLPNPDTFTGWAQSCGIVPCDDGGFVVASFRTIKTDLDLQTGLAMERVEFLHYSPATGHWDLKSPTMPYDGEALKPCLWETDQVFSYPDGTIYWVDYHRGLLSCNVLSAGENLELRFIQLPGIEIWTELDDLSYGRVYPEAYRTVGVCKGIVKFVDIDNGFFGSMKKSGFTVTVWTLKMPELEWHQTSMFQVDDLWALANFRESSLPRWVPQFPIVNTHDNHGLYFILQECDSFGEDWIITVDMHNKVLQSYERRIYSILE

SEQ ID NO: 3229 - DNA, 1677 bp, Triticum aestivum
  misc_feature (1)..(1677): Ceres cDNA ID no. 21572772
  misc_feature (1)..(1677): Ceres CLONE  ID no. 753737
  misc_feature (1)..(1677): Also known as  Ceres CDNA ID no. 24357033
aggcattggtcactgcacacgacagaaagaacagctagcctagccatggctccccttgtgccattgttgctgatgtttctcctctctagctcctctactacatcatcatccctcgacatttcccatgcagtagcagcaagcgtcggcgacgagctcaaccactacgtcgtggtggaaactagctcgctcgagccaagcaccgtctgccaaggccacaaggtgagcccgccggctagcggcaaccttgctggcggcgcctgggtgccgctgagccatcctcatggtccgtgctcctcggcggggcacaatgtggcgccaccgtcatccgtggcggacacgctccggtgggatcagcaccgcgccggctacatccagaggaagctctccgtcgagaaccccctggcggacgcgcccgcccagaccccccagtcatctgaggtcaatagcgagcctgccgggacgttcgcagtgggaaatgaggcgccttcatcgtcatccgacgttgctccggcggccgccggcggtggtaaactgcctggagtgacccaacacatggtgatcgacacggcgagcgacgtgccgtgggtgcagtgcgcgccctgcccaaagccgcagtgccaccctcagacggacgccacctacgacccaagcaagtccggcacctatgctcccttcccctgcagctcccccatctgccgccagctcggcccgtacgccaacggctgcaccggcgccggcaacaccggccagtgccagtaccgcgtccagtaccccgacgggtcagccacctccggcacctacatctccgacgtgctaacaatcacccccacccccgccggcacggtcagcagcttccgcttcggctgcagccacgccctgcagcgccctgagctcttcagcaacacgaccgccgggatcatgtcgctcggccggggcgcgcagtcactctcgtcccagacaaagggaacctatggacacgtcttctcctattgcgtcccgccgacggcgagccaacgcggctttttcaccctcggcgtaccgaggatagccgcctccaggtacgtggtgactcccatgctcaagagcaagatggccccgtccatgtacctcgtgcgcctgcaggctatcaccgtcgccgggcagcgggtcgctgttccgccgatggtctttgcccccggcgcggtcatggactcccgcaccgtcatcacgcgcctccagcccacggcgtaccgcgcgctgcgcgacgccttcagggcccagatgagcgcgtaccgcgtcgccgcgcccaagggccagctagacacctgctacgacttcaccggcatccgcaccctaaggctgcccaagatctcgctggtgttcgacagccggagcaacggcggtgctgcagtggagcttgactcgtcaggggtgctgttcaacagctgcctcgccttcgcatccactggcggcggcgacggatccaccgggatcatcggctacgttcagcagcgtacgatcgaggtgctcttcaacgtcggcggcagcgccgtcgggttccgccgtggcgcgtgctaagctacctatcggacttgtttgctcgatccatgggctggctgcttcagcctccatttatctatatattggcctttgacctatggccgacaaaataagcccatttcaaaaaaaaaaaaaaaa

SEQ ID NO: 3230 - protein, 503 aa, Triticum aestivum
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Lipoprotein_5; PFam Description: Transferrin
  misc_feature: PFam Name: FAP; PFam Description: Fibronectin-attachment
  misc_feature: GI Number: 50912211; NR Description: putative 41 kD chloroplast nucleoid DNA binding protein (CND41) [Oryza sativa (japonica cultivar-group)] gi|51964318|ref|XP_506944.1| PREDICTED
  misc_feature: GI Number: 34912520; NR Description: chloroplast nucleoid DNA-binding protein cnd41-like [Oryza sativa (japonica
  misc_feature: GI Number: 53792202; NR Description: nucleoid DNA-binding
  misc_feature: GI Number: 50912209; NR Description: putative chloroplast nucleoid DNA-binding protein cnd41 [Oryza sativa (japonica cultivar-group)] >gi|45735840|dbj|BAD12875.1| putative chloroplast nucleoid DNA-binding protein cnd41 [Oryza sativa
  misc_feature: GI Number: 55296941; NR Description: putative nucleoid DNA-binding protein cnd41, chloroplast [Oryza sativa (japonica cultivar-group)] gi|55296886|dbj|BAD68338.1| putative nucleoid DNA-binding protein cnd41, chloroplast [Oryza sativa (japonica
MAPLVPLLLMFLLSSSSTTSSSLDISHAVAASVGDELNHYVVVETSSLEPSTVCQGHKVSPPASGNLAGGAWVPLSHPHGPCSSAGHNVAPPSSVADTLRWDQHRAGYIQRKLSVENPLADAPAQTPQSSEVNSEPAGTFAVGNEAPSSSSDVAPAAAGGGKLPGVTQHMVIDTASDVPWVQCAPCPKPQCHPQTDATYDPSKSGTYAPFPCSSPICRQLGPYANGCTGAGNTGQCQYRVQYPDGSATSGTYISDVLTITPTPAGTVSSFRFGCSHALQRPELFSNTTAGIMSLGRGAQSLSSQTKGTYGHVFSYCVPPTASQRGFFTLGVPRIAASRYVVTPMLKSKMAPSMYLVRLQAITVAGQRVAVPPMVFAPGAVMDSRTVITRLQPTAYRALRDAFRAQMSAYRVAAPKGQLDTCYDFTGIRTLRLPKISLVFDSRSNGGAAVELDSSGVLFNSCLAFASTGGGDGSTGIIGYVQQRTIEVLFNVGGSAVGFRRGAC

SEQ ID NO: 3231 - DNA, 1689 bp, Triticum aestivum
  misc_feature (1)..(1689): Ceres cDNA ID no. 21572773
  misc_feature (1)..(1689): Ceres CLONE  ID no. 754321
  misc_feature (1)..(1689): Also known as  Ceres CDNA ID no. 0
atcgttcgccataaaaccgcaccccaccccacccatcccacgcgcgcgaccacaaacgcaaccaataccccctcaccccccacctgttccgccacggaaaaatacccgaaagaaaggctcccaagcaagaaaaggcagacgaggagggtcggcctaatccgatctgcggtctcgtcaaaccgccggtttctgttgtgtcaatattatcacggctctttactttgaagcgtgcagaacctacgcctgctgcctattcgtcacagttgatttcaagatgacaagtaagaaaagtaacagacctacagtcacatcatgcactgctctgcatatggaatgggacaggatttcttgccctatttgtatggagcaaccacacaatgctattttacttatatgcagttcgtacaagaatggctgcagaagttatatttgtaacacaagccatcgacactctaattgcctagatcggttcagagaaatgaatggagatagtaaggtccgtgattcacactcaacctcttcggtgctttcaaactccaataacagaacagtccaaccaagatctcactatagtacgatttccagacatttgttgagcccaagcctcagaagacacattgacaatgctaataaccaagaatctgctaattcaacaccattcgtaggagaaagtagcattataatgcaagaatgtcatgatgctgtgcaaatttcagttgacatgaagtgtcctctctgtagaggatcagtatcaggctggattcctgctggagaagtcagaaggtatctggacgagaagtcgaggtgtttctcccatgatcgctgcaaatttgttggtagctatgagcagctgcgtgagcatgctagaacagctcacttgcttgcaaagcctgcccttgtagatatctcaaggaaaaggtcttgggatcgccttgaacgtgagcaggagtttggtgatgtcattagtgcaatcaggtcacagaatcctggtgcagtaatagttggtgactatgttatggagactagagatgcaatgtctcctgatgaagattctggggaagaaagtggtgatgattggtggtctcctgcccaagaccaagtagaatcaccggataaccgacatcgtgcccctaggccctggctgaatggaagactaggatcacctaccatttggccagatggaaggcatgccttccctaggtttctgccgcagcccaggccattcagtgataggcgcaactcacgtgaagattggcagggcatccgacggtcaagcgcgcaaagctggctgcgccagggtttctcgaatcggcactcgaggcacaccagcagttaccgcggatatcgccatggcatctttgatcgacgttacgctggaaacaatcgtgcaggtattgataggaggcaggatggcccagcacttccgccgggaagacggcagcgtttgagatacacgcaaagaagccagcatgatccatgatcggccgaagcaacactacctgtgcagtatttagttattacaaacagccaagctatccttgtaaaatagttagtggtggttaagaataaatatcttggcctatttactattcgtgtattatatctgtcagaaacgttttagtgcagctgcagaacttcccttctaaatgtctattcaatgccttgttcttggcaaaaaaaaaaaaaaaa

SEQ ID NO: 3232 - protein, 401 aa, Triticum aestivum
MTSKKSNRPTVTSCTALHMEWDRISCPICMEQPHNAILLICSSYKNGCRSYICNTSHRHSNCLDRFREMNGDSKVRDSHSTSSVLSNSNNRTVQPRSHYSTISRHLLSPSLRRHIDNANNQESANSTPFVGESSIIMQECHDAVQISVDMKCPLCRGSVSGWIPAGEVRRYLDEKSRCFSHDRCKFVGSYEQLREHARTAHLLAKPALVDISRKRSWDRLEREQEFGDVISAIRSQNPGAVIVGDYVMETRDAMSPDEDSGEESGDDWWSPAQDQVESPDNRHRAPRPWLNGRLGSPTIWPDGRHAFPRFLPQPRPFSDRRNSREDWQGIRRSSAQSWLRQGFSNRHSRHTSSYRGYRHGIFDRRYAGNNRAGIDRRQDGPALPPGRRQRLRYTQRSQHDP

SEQ ID NO: 3233 - DNA, 1920 bp, Triticum aestivum
  misc_feature (1)..(1920): Ceres cDNA ID no. 21572774
  misc_feature (1)..(1920): Ceres CLONE  ID no. 755412
  misc_feature (1)..(1920): Also known as  Ceres CDNA ID no. 24356629
aaagcagagtactagcaagaaaaccccaaggtgactcatctgcttctcctccggccgggcaaggacaccgtcgtcgtcgaggcggaagccaccaagcagggcaccaagtgcagaagcggagcgcgatggcttcctcctcctcgtcctccgtcgtcctcatcagcgacaccgacaacgacagcaacgacgacgacgccgcctcggacgcgctctccgggccgggcgccgaccgcatcgcctcgaccctgcgcacgcaggccgccgtcgacgccctctgcaggaagcacggcgtcccgagggagttcctcgcgcaccccgccggcgatctgcgcgcgtgcagcacgccgcctccgggggccgtctgcgtgtacgcccacgcgctggagaccggggtgcgcttcccgttgcacgccttcttctgcgacacgctcaaccacttgggcctcgcgccgggccagctcttgctgaacgggtggcgcgttatggtgggcttcgtcgcgctctgccacgaggccggcgtgcggccgtcgctggtgctgttcaggcacttcttcaagctctacaacaggaacggctggtgctacatccgctgcagggttgccgccggagtgctcttcactggcctcaactacaccatatccgagagagagtggaaagggggtttcttcttcctgacgtcgccgggacaatggccgtgccccgtgcgttggggcgagccgccgtccaggaggtcgtccgcaaatctggcgctgacgagcaagcagaggcagcgggcggaaaagctgctaggcgcacgcggcgccgcggttgatatccgggcttacctccgcgtgacaaatcttgatgcggccttgtccggcaacctcgccggcgcaccgccgccaccaccacctcagccttctccccgttctactcttgccaaaggggttgatccgcccgtccgcaacatgactgacactatgcccgtggagaagacggcggcgccggcagcatggacggagcaggtgaaaggcgaggcgtacggcgacacgctgctgtccgggaagaagaggaaacgggaggaggccaccgcaacagacgggcttggctgcgccgccccggtgtccgacacgcgtgccccgtcgggctttgacccggggtcaccgcactcgcccgtgcccgacgcacacgacggcgacacagccgactggaaggccgcacggaaggtgctagagtgcatcgtcacgccgtcgcgggaggacaagttcgcggcgtcgaagccctccgacgtcgtcgcgtcgagctacgtggcgatgctccaggtattcttgcaagcaaatcgttcgtccgtcggtgtatgtccggatcggacccggatcacattgtttgtgtgtgccgtgcggcggcaacgatggcgtgcgcaggccgtgaactacgtgcccttctcctcgggctacgcgctggacctggacgagaagctggtggcgcgggagcgcgacaacgtggcgctgtgggagcagatggacaaggagaagatggcgaggcaggccgcggaggcggagctggaggcggtgaaggccgagctcgcggcggcgaagcgggcgacagactcggagctggagagcgccaagacggcggcggtgcagcagttcctggcgtccgaggagcacacgcggcggctcgcggagcatgcgctggcggggtacgagcgcggtgccgaggagatgaagggcgtcgtgctccggcactacccgcgcctcgacgccgccaagcttgtcctgccacttgattagctcgggctgattgattcatgatttggagtactgctgggccatgatctaggcatatgcctatcgtaatttgttgttggtggaaggtttgttcaccaaaatcaagcctgttatctactcgatgatgttgcatgcaaaaaaaaaaaaaaaa

SEQ ID NO: 3234 - protein, 548 aa, Triticum aestivum
  misc_feature: PFam Name: GRP; PFam Description: Glycine rich protein family
  misc_feature: PFam Name: FH2; PFam Description: Formin Homology 2 Domain
  misc_feature: GI Number: 34898444; NR Description: Similar to Arabidopsis thaliana chromosome II BAC F13B15 genomic sequence, putative non-LTR retroelement reverse transcriptase. (AC006300) [Oryza
  misc_feature: GI Number: 34898446; NR Description: Similar to Zea mays putative AC9 transposase. (P03010) [Oryza sativa (japonica
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66777231; NR Description: Ferric-uptake regulator [Anaeromyxobacter dehalogenans 2CP-C] >gi|66857054|ref|ZP_00401112.1| Ferric-uptake regulator
MASSSSSSVVLISDTDNDSNDDDAASDALSGPGADRIASTLRTQAAVDALCRKHGVPREFLAHPAGDLRACSTPPPGAVCVYAHALETGVRFPLHAFFCDTLNHLGLAPGQLLLNGWRVMVGFVALCHEAGVRPSLVLFRHFFKLYNRNGWCYIRCRVAAGVLFTGLNYTISEREWKGGFFFLTSPGQWPCPVRWGEPPSRRSSANLALTSKQRQRAEKLLGARGAAVDIRAYLRVTNLDAALSGNLAGAPPPPPPQPSPRSTLAKGVDPPVRNMTDTMPVEKTAAPAAWTEQVKGEAYGDTLLSGKKRKREEATATDGLGCAAPVSDTRAPSGFDPGSPHSPVPDAHDGDTADWKAARKVLECIVTPSREDKFAASKPSDVVASSYVAMLQVFLQANRSSVGVCPDRTRITLFVCAVRRQRWRAQAVNYVPFSSGYALDLDEKLVARERDNVALWEQMDKEKMARQAAEAELEAVKAELAAAKRATDSELESAKTAAVQQFLASEEHTRRLAEHALAGYERGAEEMKGVVLRHYPRLDAAKLVLPLD

SEQ ID NO: 3235 - DNA, 1452 bp, Triticum aestivum
  misc_feature (1)..(1452): Ceres cDNA ID no. 21572775
  misc_feature (1)..(1452): Ceres CLONE  ID no. 755603
  misc_feature (1)..(1452): Also known as  Ceres CDNA ID no. 24356648
atcccatctcacacaccactactcatcttgcctcacacacttcactgctagctactagtaattcacttccttgggttctcgtgccaccgagctctctcccgccaagatgtcgacggtgacccctgcctacctcgaccagaggctcgccgccgccaagcgctcctccagagaggccgccatggcgggagccaaggccgcggccgtcgccaccgtcgccgccgcaatccccaccctggcgagcgtgaggatgctgccgtgggcgagggcgcacctcaacccaaccgggcaggcgctcatcatctccaccgtcgccgggatggcctacttcatcgtcgccaacgccctcttctcgctgcccgccaccgagggccgcgacggccccctcgtccgcctcccgccgcccgccaaccgcctgccccgcgagaagcacttaccaaggccaaagcctcctaccaagtgggagcagttcgcaaagtcgaaagggattatcaagcacaagaagaacaagcgtgcatgggatgagcaaactaattcctggaagcggacttatggctatgatcgtgttaatgatgacagggacgttcccattattgaagccaaattgacagacgagcctggtgttgatccttttgctcaaagaagggaagagaagaagggcagggtcgataaacaagaaaagaacagacttgggaatttgaagaatgctgcaaaagttggtgctctgccaagtcatatacagctcgctgccacgtccgtgcccatcacaggaactaaagctgatctgccaagaaaaggtaagaaggaagacctcgagaatgtcgctggtatggcttctgcagcaacggctagcggtgggaagttcgacaaaaagttgcctggcgagaaacctctcaagaaggctggcaaaaacagaaagttcctccctgttgttgaagggaaaggaatgggcaacctggagaaacagcaaaacgacaagatcctgaacagtctactggccaagaacttcgaggaaccgttggatgtcagcaaggcaatcaccatgtacaaggtgaagaaggacaacaagaggaggaaagacaagcaatcatcgtcgtcgtccggatcaaataagttgaagccccagaagaaaatccacaagaaatcctcaaagaaaagcgcttaggtgcacatcatcgttgagacatgccgtgctgtaggcggcgagcgcggtttccaagcatcaaggagtgccttggcaaattttgtatggtcattgacctgtttaagtcccaagggagaaatattgttattccggttgctactggttatgacgaagaagctgaatgccatgatgacatagctgtacacgtattatattttcggaagtttgggaaatgtttctggaaagctttgttggcaatatagaaatcaacctaacaccaaagatatttgatgtcaaaaaaaaaaaaaaaa

SEQ ID NO: 3236 - protein, 351 aa, Triticum aestivum
  misc_feature: PFam Name: RRS1; PFam Description: Ribosome biogenesis
  misc_feature: PFam Name: ENOD93; PFam Description: Early nodulin 93 ENOD93
  misc_feature: PFam Name: Extensin_2; PFam Description: Extensin-like region
  misc_feature: PFam Name: Pyr_redox_2; PFam Description: Pyridine
  misc_feature: PFam Name: Pkinase; PFam Description: Protein kinase domain
  misc_feature: GI Number: 18404610; NR Description: ribosome biogenesis
  misc_feature: GI Number: 21593609; NR Description: unknown [Arabidopsis thaliana]
  misc_feature: GI Number: 45709905; NR Description: Unknown (protein for
  misc_feature: GI Number: 47940235; NR Description: MGC78981 protein
  misc_feature: GI Number: 41056045; NR Description: Ribosome biogenesis regulatory protein homolog; wu:fj66c04 [Danio rerio] >gi|33585885|gb|AAH55615.1| Ribosome biogenesis regulatory protein
MSTVTPAYLDQRLAAAKRSSREAAMAGAKAAAVATVAAAIPTLASVRMLPWARAHLNPTGQALIISTVAGMAYFIVANALFSLPATEGRDGPLVRLPPPANRLPREKHLPRPKPPTKWEQFAKSKGIIKHKKNKRAWDEQTNSWKRTYGYDRVNDDRDVPIIEAKLTDEPGVDPFAQRREEKKGRVDKQEKNRLGNLKNAAKVGALPSHIQLAATSVPITGTKADLPRKGKKEDLENVAGMASAATASGGKFDKKLPGEKPLKKAGKNRKFLPVVEGKGMGNLEKQQNDKILNSLLAKNFEEPLDVSKAITMYKVKKDNKRRKDKQSSSSSGSNKLKPQKKIHKKSSKKSA

SEQ ID NO: 3237 - DNA, 1264 bp, Triticum aestivum
  misc_feature (1)..(1264): Ceres cDNA ID no. 21572776
  misc_feature (1)..(1264): Ceres CLONE  ID no. 907043
  misc_feature (1)..(1264): Also known as  Ceres CDNA ID no. 23730578
ccccaccactcttccctcctcccgtctcctcgcccgcacgccctcagccaccgccggtaacttctccacacccagatcgcttcttgatccactccgatttcgattcaatagacattacccccagacggatcgacgccagattccacctcggtaacaaagacagcaatggggatctccaaagtgacgggcatcgccgcgacggcgctcctcgtctcgtccctcgccctgcggcaggccggcgtgagggccgccgccacggcccccatcctcgccaccagctgcgtcgcctacgtcgtcaccgtcgcgtcccacaccgccgtcaacgtgccgtggatcctgggcaagaccccgtcgggccggttccccctctggtcgtccgtactcttcggccccttcctgatgctggcacgcacgtacgccaaggtgaagaggttcctcaggaaggagaacgtgtacgacgagatcgcccaggggctctacctcgggggctggccgttcatggcaaagcacctgcctcccggggatccgtccgtcgtggattgcacgtgtgagctgccgaggagctcgtttgtgaaggtggatgagtatgtctgtcttgctacttgggataccagggccccgttaccgtcccaaatcgaattcgcggcgcggtgggcctgcgagaagagagcccaggggaagcccgtctatgtccactgcgcatttggtcatggaagaagtgcctgtgtcatgtgcgcaattctagtggcgacgggcgttgctgaaaactggaaagacgctgaaaacgtcatccgaggaaggaggaagatcaaaatgaacgctcttcaccgcaaaactttggaagattggtccaaaagtcgagttgtccagaaaaaggataattagctgtgagctgatttcttttttacatcatatacttcttctgtgaggttagaaccaaaacagagtaaagccatattgtataggaataccatgccattctttatttgaaatattcctccacatgtcaatcatgtgtgacacaaggaaatcctccatttcccccctgaagatgcaggaaagtcctttttctacgtgtttgttcaatgtatgtgtggtagttgctcctctaagcaactcttttcacagcaaaatcagtcttgtgtagtgtacactttggtttacaatggaagaaacttgaacttatcctcaagctggtttctattatctgtgttgcaaaattgtagcaaggtttaacttcaaatgacgaaaaaaaaaaaaaaaa

SEQ ID NO: 3238 - protein, 239 aa, Triticum aestivum
  misc_feature: PFam Name: DSPc; PFam Description: Dual specificity
  misc_feature: PFam Name: Pyr_redox_2; PFam Description: Pyridine
  misc_feature: GI Number: 34908470; NR Description: P0489B03.9 [Oryza sativa (japonica cultivar-group)] >gi|20161641|dbj|BAB90560.1| P0489B03.9 [Oryza sativa (japonica cultivar-group)] >gi|20521237|dbj|BAB91753.1| P0679C12.2 [Oryza sativa (japonica
MGISKVTGIAATALLVSSLALRQAGVRAAATAPILATSCVAYVVTVASHTAVNVPWILGKTPSGRFPLWSSVLFGPFLMLARTYAKVKRFLRKENVYDEIAQGLYLGGWPFMAKHLPPGDPSVVDCTCELPRSSFVKVDEYVCLATWDTRAPLPSQIEFAARWACEKRAQGKPVYVHCAFGHGRSACVMCAILVATGVAENWKDAENVIRGRRKIKMNALHRKTLEDWSKSRVVQKKDN

SEQ ID NO: 3239 - DNA, 1810 bp, Triticum aestivum
  misc_feature (1)..(1810): Ceres cDNA ID no. 21572778
  misc_feature (1)..(1810): Ceres CLONE  ID no. 909517
  misc_feature (1)..(1810): Also known as  Ceres CDNA ID no. 24357587
aaacctcgccttcctcgtgctagcctagccggttggttggtttggtaccaaaccctcttcctctccgggtctttcttcagcacagcgcgctagtactaactacttctagcacggaacagaacagcgcagtatcgaggatcgacattaatggcgtccaagggcgagagggatgtggagatccacgtctcttccccgccgcccgacgaccgcgacgccgccaggcccttgctgcccgccgcctgcgaggcctactccgtctccgccgcaatcctccccttcttcttcccagctctgggtgggcttctctatggctatgacatcggggcaacatctggtgccaccatatcgctcaagtcccccacatccagtggtacagcatggtacctgtcatcagtgcaaactggcctcgtggtcagcggctcactctacggtgctttgatcggatccgccacggcattcaccattgcggattttctaggaaggcgcagagagcttgttgtttcttctatcatgtatttgattggagctcttctcacagcagtggctcctaacttccttatcatggtggttggtcgctttttatatggcataggaattggattggctatgcacgctgctcccatgtatattgctgagactgctccaagtcagattagaggcatgctcatttctctcaaggagttctttattgttcttgggatgcttcttggttatatagtaggcaatctctttgttgaagtgatttctggttggcgctacatgtattccgccagtgctccgatatgtgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggttaatttgattctggaagaactgtcatacgttggtgaagagaaaaaagcaggattcagtgagatctttcaaggaaagtgtctcaaagcaatgataattggatgtggtttggtgttctttcagcaggtcactggtcaaccaagtgtgctatattatgctgcgacaatttttcagagtgctggattctctggagcatctgatgccactcgtgtatcaattcttcttggcgtgctgaagctgattatgactggagttgccgttcttgtggttgacaaacttggtagaagaccattactaattggtggtgttagtggaattgctgtctccctattcttattgtcttcatactataccttgtttacgggtgctccttatgtggctgtaatagcacttctactgtatgttggctgctaccagttatcatttggtccgattggctggcttatgatttcagaggttttcccgctgaagctgcgtggccgtggattgagtgttgctgttcttgtgaactttgcctccaacgcgcttgtcacttttgctttctccccactagaggacttgattggcactggggttctctttgcttcgttcggggtgattgcggtggcgtctctcacattcatattctgcattgtgcccgaaacaaaagggctcaccctggaagaaatcgaagccaaactgtagatccaactatctgtagtctcatcttagttagcatcttctttactgctcttattactcagctattttgtaagcgtagtattacattgagaaactacttatttttctctgaataagatatatatctaaatagaaggtgtccaagtggaagcgtcttcatgagggaaaaaaaaaaaaaaaa

SEQ ID NO: 3240 - protein, 494 aa, Triticum aestivum
  misc_feature: PFam Name: Sugar_tr; PFam Description: Sugar (and other)
  misc_feature: GI Number: 50897170; NR Description: At5g17010 [Arabidopsis thaliana] >gi|42570524|ref|NP_850835.2| sugar transporter family
  misc_feature: GI Number: 37537174; NR Description: putative sugar transporter protein [Oryza sativa (japonica cultivar-group)] >gi|12039393|gb|AAG46179.1| putative sugar transporter protein [Oryza sativa] >gi|31433692|gb|AAP55176.1| putative sugar
  misc_feature: GI Number: 34897404; NR Description: putative sugar transporter protein [Oryza sativa (japonica cultivar-group)] >gi|27545039|gb|AAO18445.1| putative sugar transporter protein
  misc_feature: GI Number: 9755702; NR Description: sugar transporter-like protein [Arabidopsis thaliana] >gi|11358865|pir||T51556 sugar transporter-like protein - Arabidopsis thaliana >gi|30686158|ref|NP_850836.1| sugar transporter family protein
  misc_feature: GI Number: 41400463; NR Description: facilitative glucose transporter [Bos taurus] gi|58652149|ref|NP_001011683.1| solute carrier family 2 (facilitated glucose transporter), member 12 [Bos
MASKGERDVEIHVSSPPPDDRDAARPLLPAACEAYSVSAAILPFFFPALGGLLYGYDIGATSGATISLKSPTSSGTAWYLSSVQTGLVVSGSLYGALIGSATAFTIADFLGRRRELVVSSIMYLIGALLTAVAPNFLIMVVGRFLYGIGIGLAMHAAPMYIAETAPSQIRGMLISLKEFFIVLGMLLGYIVGNLFVEVISGWRYMYSASAPICVIMGIGMCWLPCSPRWLLLCATQGKGDLRETKENATRCLCRLRGQASPDLVSEQVNLILEELSYVGEEKKAGFSEIFQGKCLKAMIIGCGLVFFQQVTGQPSVLYYAATIFQSAGFSGASDATRVSILLGVLKLIMTGVAVLVVDKLGRRPLLIGGVSGIAVSLFLLSSYYTLFTGAPYVAVIALLLYVGCYQLSFGPIGWLMISEVFPLKLRGRGLSVAVLVNFASNALVTFAFSPLEDLIGTGVLFASFGVIAVASLTFIFCIVPETKGLTLEEIEAKL

SEQ ID NO: 3241 - DNA, 1462 bp, Triticum aestivum
  misc_feature (1)..(1462): Ceres cDNA ID no. 21572779
  misc_feature (1)..(1462): Ceres CLONE  ID no. 910116
  misc_feature (1)..(1462): Also known as  Ceres CDNA ID no. 24357404
atatgtgctcatctcgtcttctcttgagtccagaaaaatcgccagcggcaatgcctactcatatcacctcactgttggtcaccttcggtttccttgcagaaatcctgctactagtgcattgctcacacgccctttcagcaaacagcagtgcctcgcagcaggtccctgcacgctgccgtagggaccaggcggccgcgcttctcaccgtgaagcgttccttctccttcaccgacaaagacgactacttcatgccagccaccaccacgacattgtcttcgtggacagagggcacagactgctgccgctgggagggcgttggctgcgacaatgttaccgggagggtaaccgcactcgacctcccggagcggaacctgtatatcagcggacttcacccttctctcttcaggcttacctctctccaatacctcaaccttgccttcaacaagtttaccagctcccagcttcaggtttctggtttccagagcttgacacaactgacctatctcaacctgtcaggttgcaactttgattttcaggtcccagtcgatatctttcggctcaccaacctggtcaccctcgaccttggatacaacagatgggagctccgtccgtcgaccatagtagccagcgaccttggcaagctgaaggagctccatctagagcaagttaatatcaccggcacagcaccggagttcttcaaggcacttgccaaccacttcccccttcttcagatccttcgcttaaacgaatgtcccctttctggtccactccacccatccttatcaagactcaactccctatcagtgattgatcttggttataactctttaaccggtcctctgcctgatttgttcactccttccaatttcccttttctacgagaacttgtgctcggtggtaactacttcgagcctggaacattccctcttgggatcactgggctaaagaatctcatgattctcgaccttggaaccacaaacctcgttggggccatccctacctccatcgggagcctcatgtcactcactgaattacgcatcggtgggaacagcttctccggcaggctaccttcggccctcagcaatctgacaaacttgatcatactggactgtcggtgctctggtttgtctgggaagattccatggcttacaagcttgacacgacttgaaatcgtatggctcgccggcaacaacttcacaggtaagttggtacttctgaaaagattgcagcttgctacatcatctgctcctctgtaaacaaatataagacgtttctaaaacgagttatatttgtttacaaagggagtacctatcaaatctgttacatctttttttggatagttgaatcctcccatgttcttaggcacatcacattgctatcaaatattatacgatgacagctgtaaataaaatatatggggtttatatccaaaaaagtgacaggttaacaaaaaaaaaaaaaa

SEQ ID NO: 3242 - protein, 1462 aa, Triticum aestivum
  misc_feature: GI Number: 47933817; NR Description: cf2-like protein [Zea mays]
  misc_feature: GI Number: 32489922; NR Description: OSJNBa0038P21.7 [Oryza
  misc_feature: GI Number: 47933818; NR Description: cf2-like protein [Zea mays]
  misc_feature: GI Number: 34896064; NR Description: B1189A09.17 [Oryza sativa (japonica cultivar-group)] >gi|21327974|dbj|BAC00563.1|
  misc_feature: GI Number: 2792187; NR Description: Hcr9-9D [Lycopersicon
ATATGTGCTCATCTCGTCTTCTCTTGAGTCCAGAAAAATCGCCAGCGGCAATGCCTACTCATATCACCTCACTGTTGGTCACCTTCGGTTTCCTTGCAGAAATCCTGCTACTAGTGCATTGCTCACACGCCCTTTCAGCAAACAGCAGTGCCTCGCAGCAGGTCCCTGCACGCTGCCGTAGGGACCAGGCGGCCGCGCTTCTCACCGTGAAGCGTTCCTTCTCCTTCACCGACAAAGACGACTACTTCATGCCAGCCACCACCACGACATTGTCTTCGTGGACAGAGGGCACAGACTGCTGCCGCTGGGAGGGCGTTGGCTGCGACAATGTTACCGGGAGGGTAACCGCACTCGACCTCCCGGAGCGGAACCTGTATATCAGCGGACTTCACCCTTCTCTCTTCAGGCTTACCTCTCTCCAATACCTCAACCTTGCCTTCAACAAGTTTACCAGCTCCCAGCTTCAGGTTTCTGGTTTCCAGAGCTTGACACAACTGACCTATCTCAACCTGTCAGGTTGCAACTTTGATTTTCAGGTCCCAGTCGATATCTTTCGGCTCACCAACCTGGTCACCCTCGACCTTGGATACAACAGATGGGAGCTCCGTCCGTCGACCATAGTAGCCAGCGACCTTGGCAAGCTGAAGGAGCTCCATCTAGAGCAAGTTAATATCACCGGCACAGCACCGGAGTTCTTCAAGGCACTTGCCAACCACTTCCCCCTTCTTCAGATCCTTCGCTTAAACGAATGTCCCCTTTCTGGTCCACTCCACCCATCCTTATCAAGACTCAACTCCCTATCAGTGATTGATCTTGGTTATAACTCTTTAACCGGTCCTCTGCCTGATTTGTTCACTCCTTCCAATTTCCCTTTTCTACGAGAACTTGTGCTCGGTGGTAACTACTTCGAGCCTGGAACATTCCCTCTTGGGATCACTGGGCTAAAGAATCTCATGATTCTCGACCTTGGAACCACAAACCTCGTTGGGGCCATCCCTACCTCCATCGGGAGCCTCATGTCACTCACTGAATTACGCATCGGTGGGAACAGCTTCTCCGGCAGGCTACCTTCGGCCCTCAGCAATCTGACAAACTTGATCATACTGGACTGTCGGTGCTCTGGTTTGTCTGGGAAGATTCCATGGCTTACAAGCTTGACACGACTTGAAATCGTATGGCTCGCCGGCAACAACTTCACAGGTAAGTTGGTACTTCTGAAAAGATTGCAGCTTGCTACATCATCTGCTCCTCTGTAAACAAATATAAGACGTTTCTAAAACGAGTTATATTTGTTTACAAAGGGAGTACCTATCAAATCTGTTACATCTTTTTTTGGATAGTTGAATCCTCCCATGTTCTTAGGCACATCACATTGCTATCAAATATTATACGATGACAGCTGTAAATAAAATATATGGGGTTTATATCCAAAAAAGTGACAGGTTAACAAAAAAAAAAAAAA

SEQ ID NO: 3243 - DNA, 1462 bp, Triticum aestivum
  misc_feature (1)..(1462): Ceres cDNA ID no. 21572780
  misc_feature (1)..(1462): Ceres CLONE  ID no. 911642
  misc_feature (1)..(1462): Also known as  Ceres CDNA ID no. 24357444
acgtcgattgatttcgagttgccggctctggctgcggtccaccgagtacgatgcgcatctctttgccttgggacgtcgatgtcgatggtctacaatcacaagtctatccatttgcagtgggacgtcgtcgtctcagcgaggctgatggctgctgctccggcagcatcctggagatccccaatgagatgctacaggaaatcctgatgaagctgccgaccaaggacgtggcccggtcctgctgcatctcccggcagtggcgcagcgtcgtcagggacccctccttccgcaagctccacgcagcgagtcatgccgcgctctctgcagaggccgagttcttgctcctatccggtgtactatgcgagctcagccagagcatgaagacgggcgtcttcagcttatcctcggacaaacccatgtgcttcatcgccaagccccacagcgacggcctcgtcaacatctgcaacggcctcctctgcttcgtgctagaggaccgaaagggtcaggcgccggcggtggtgtgcaaccccgtcaccggcgagacgctggcgcttcccacggcccctccgctcagcaacaagaaccatgtgtatttctttgtctttgggttcagtccgcccaccaacgagtacaagctgttccgcttctcttttccgccatactcgtactcctccgaagagcgggtggacgtggacgtctacaccttgggtgacgcccgcgggtggcgcaaagactcgttcctctcaccctctcgcccaccaaacagaagaaacagcatttcgaagccagtgatgatcgatggtaaacttcacgtggtcaccaaaggctggaatgcacccatgggagaggaggctgccggagtactggtagtggacgtgcctgccgagacgtgccgcgtttaccctctcccgaacgatctcgtgacatatcgatatgataatccactggcctttgagctgaaggggcgtctgtgcctcgccgcacacatgctcagcggtggtcgccccaaggccatccgcttctgggtcatgagcatggagaacaaggaatcggacagcgagaaggagccgcactgggatttgcgctacagcttcttcgtggaagtggaacatcccttcaacacccgaaggccgtggagcagggtaccgtggagtgcgtggtttcaatataagacactctgctacacgcgcagcgacaccttgcacaggtatgacacgaggtcgtccattcctgaccacggtcgattgctacagtggaacaaacagctccagacggctacaatatcatacgaatggcgatggatgatccatcggggttaccgtcccactctgctctcgccacgcgtctttgaattgccgccgtcccaagacgagacgatgatggacatatgctcctaaggaattgtggtttatcctaagttttttgtctgggttttctaattaaaaaaaaaaaaaaaaaaaaaaaa

SEQ ID NO: 3244 - protein, 447 aa, Triticum aestivum
  misc_feature: PFam Name: F-box; PFam Description: F-box domain
  misc_feature: GI Number: 51038137; NR Description: putative polyprotein
MRISLPWDVDVDGLQSQVYPFAVGRRRLSEADGCCSGSILEIPNEMLQEILMKLPTKDVARSCCISRQWRSVVRDPSFRKLHAASHAALSAEAEFLLLSGVLCELSQSMKTGVFSLSSDKPMCFIAKPHSDGLVNICNGLLCFVLEDRKGQAPAVVCNPVTGETLALPTAPPLSNKNHVYFFVFGFSPPTNEYKLFRFSFPPYSYSSEERVDVDVYTLGDARGWRKDSFLSPSRPPNRRNSISKPVMIDGKLHVVTKGWNAPMGEEAAGVLVVDVPAETCRVYPLPNDLVTYRYDNPLAFELKGRLCLAAHMLSGGRPKAIRFWVMSMENKESDSEKEPHWDLRYSFFVEVEHPFNTRRPWSRVPWSAWFQYKTLCYTRSDTLHRYDTRSSIPDHGRLLQWNKQLQTATISYEWRWMIHRGYRPTLLSPRVFELPPSQDETMMDICS

SEQ ID NO: 3245 - DNA, 1358 bp, Triticum aestivum
  misc_feature (1)..(1358): Ceres cDNA ID no. 21572781
  misc_feature (1)..(1358): Ceres CLONE  ID no. 912568
  misc_feature (1)..(1358): Also known as  Ceres CDNA ID no. 23731995
attattcgatcttttttccttttgcccttgtcttcttcctcgccgctcgtccccttaaaccctcccatggcggcccgcccatgctcccgcggctgccccaagctccggcgcctcctctcctccgccgccgccgcgaacctccccctcctgtgatcctagaggcgcacggccaagggctccctggcggatttggatgaatgccaccggccggccgccccatctcctctccccagcgagatctaggctgcagccccaaagagaactaaatattctccctctccaactcgcgcgagcttcgatccggtgccctgcggccggcgtccccgagaccggccccggccccaaacgcggttcccaacccgacgcccccctcccgcacgcttgcggcctccgggagcatcgcgcggtcctacatttcgttgcgggtgactcctttccgctcagtgtttatggtgccgcctgtgtaccaggagcctagtatcatgccgatcaatacaagaacggagaaggagttggaagaaaaggaggtgttatgcacgcacaaaaagcccaaagctacagggtgtgttgcccaaccgcagcaggaaactgaactcgccattgagagtgagaataaagggcatggtgatccttcaccaaaagagtctgcttgtgttgtgctgagcaatggtgaagcaaatggttgcagtgaggggcatgttcttggcaaatgtcatgtccaaattccgaagacatgactcgggtagaaaggatcattacagttcaaatattccatacaggcggtgcaaatgaagaaccagaagcaaggtcgagactggctcaactctgcagtgcaattggctggaagagtccaacatatgagtttcaagaacatggacatggccatacaaaactgttcacatgcaaggtgagtgttcttgtggagacgttcacagacactgttgtggagtgcatcagtgagcccaaaccccagaagagagctgcccaggaacaaggtgctgaaggtgtgttatggaccctcaagcgccttggtcatgtgaaatagctctagacgtcctccatcaggcgtggcgcgacgtctgtgtaccctcttgttaccatccgatccatcataagagcggtatctgatctttcttgaatccatgactcaacctgcgatcatgttgtcagctgatgcttatgcacggttaaacttgttgctctgtcggtcgtgttctaattttatattgctttagatctctatacaaacgagtgaagtgaacccatctccaatagtccaataattcttatctttagaccattctgagccatttacgaacattacagcgaatatgatcaagacaaaaaaaaaaaaaaaa

SEQ ID NO: 3246 - protein, 95 aa, Triticum aestivum
  misc_feature: PFam Name: dsrm; PFam Description: Double-stranded RNA
  misc_feature: GI Number: 30678641; NR Description: double-stranded RNA-binding domain (DsRBD)-containing protein [Arabidopsis
MVPPVYQEPSIMPINTRTEKELEEKEVLCTHKKPKATGCVAQPQQETELAIESENKGHGDPSPKESACVVLSNGEANGCSEGHVLGKCHVQIPKT

SEQ ID NO: 3247 - DNA, 1292 bp, Triticum aestivum
  misc_feature (1)..(1292): Ceres cDNA ID no. 21572782
  misc_feature (1)..(1292): Ceres CLONE  ID no. 915372
  misc_feature (1)..(1292): Also known as  Ceres CDNA ID no. 24357314
aaaagcaacttcacactttccagtccaccgctagtctctgccactgccaccaaccactgaacaaactataccttcagatctgtgcgcggctacggccatggagtccggcgccgacgaagtagtgttcgactgcgatgactaccgcatataccggagcggccagatggaccgcctctgtcgcccggctcgtgtgcccaccggcctcgacccggccaccggcgtcacgtccaaagacgtggtccttgactacgacaccggcctgtccgtccgcctcttcctccccaccagccgagacccctccaagaggctcccgatcctcgtcttcttccatggcggcggcttcctcgtcgagtcggccgtctccccgcagtaccacaactacgtggcgtccctcgctgccgtggccggcgtcgtcgccgtctccgtcgagtaccgcctcgcgcccgagcatccggtgcccgacgcctacgacgacacctgggccgcgctatcgtgggccgcctcgagccaggacgagtggctcgccgagcacggcgacagcgcgcgcctcttcctggccggcgacagcgccggcggcaacatagtgcacaacgtcctcatcagagcgtcgttccagccggcgccgagagtagaaggcgcgattcttctgcatccttggttcggagggaacacgttcctcgaaggtgaggtcgaggcgacggccaaggacatggccatgatctgggagttcgcgtgccccggcgcggtgggcggcgcggacgacccgaggatgaacccgatggcgccgggcgccccggggatggagaatctccggtgcgagcggatgctcgtgtgcgccggcgagaaggactggctggcggccagggaccgagcgtactacgcggcggtgaccaccagcgcgtggcgcgggagcgtatggcgtggaggcgtggcgtggttcgagtcggaaggcgaggggcacgtcttcttcctgaagaagccggactgtgccaaggccaaggagctcatggctcgcgtcgtggcgttcatcgccggcacctgagccctgatcggtgcgcgcacgccggcgcggccgcggtgtgctgtcgtttcgtcacaaacgaactgtaagagtggcttcgattcacaacgtagatctaatgttacaatccgatggactggtgcatgtaacgcgcttgatgaaggacacaacaatggccatctccttcgccgccttctccggcacgacggagttggatctcgcggctttggagaaataatacatgtgaccctcgccaaaaaaaaaaaaaaaa

SEQ ID NO: 3248 - protein, 314 aa, Triticum aestivum
  misc_feature: PFam Name: Abhydrolase_3; PFam Description: alpha/beta
  misc_feature: PFam Name: COesterase; PFam Description: Carboxylesterase
  misc_feature: GI Number: 51535274; NR Description: putative PrMC3 [Oryza
  misc_feature: GI Number: 51535269; NR Description: putative PrMC3 [Oryza
  misc_feature: GI Number: 51535268; NR Description: putative PrMC3 [Oryza
  misc_feature: GI Number: 51535273; NR Description: putative PrMC3 [Oryza
  misc_feature: GI Number: 51535271; NR Description: putative PrMC3 [Oryza
MESGADEVVFDCDDYRIYRSGQMDRLCRPARVPTGLDPATGVTSKDVVLDYDTGLSVRLFLPTSRDPSKRLPILVFFHGGGFLVESAVSPQYHNYVASLAAVAGVVAVSVEYRLAPEHPVPDAYDDTWAALSWAASSQDEWLAEHGDSARLFLAGDSAGGNIVHNVLIRASFQPAPRVEGAILLHPWFGGNTFLEGEVEATAKDMAMIWEFACPGAVGGADDPRMNPMAPGAPGMENLRCERMLVCAGEKDWLAARDRAYYAAVTTSAWRGSVWRGGVAWFESEGEGHVFFLKKPDCAKAKELMARVVAFIAGT

SEQ ID NO: 3249 - DNA, 1576 bp, Triticum aestivum
  misc_feature (1)..(1576): Ceres cDNA ID no. 21572783
  misc_feature (1)..(1576): Ceres CLONE  ID no. 915622
  misc_feature (1)..(1576): Also known as  Ceres CDNA ID no. 25088340
acacgagccagcctaccatcaccaccaccagcggcagagtgctcccctcttcctcagcttacttgcgtcccattaattaaaggtggtaagatggatcctggcttctgcaacgacatgatcctaagcgagagcgcgtggaacagcggcggtggagacggtggcgcggccggtgatgtcgttaatgttgtggacgggagcggcatgtcggtgctggagaggctggtgctggacgaggcgctcgcggccgcgatcatggagctgcagggcatccaggtgccatgcggaggtggcaagccgatggccggcggcatcgaggcggccagcctcgcattcggcgctacgggaacgggacccgtcacgcctgcctacgctgaggttgacggggttgtcctgcagcgacagcagcatcaacatcgccatcagggcgtgatggggatgcctgtcgactacgacctcgtaccagcagcacgagcagtcacgttggctactgtacctgcggcaccttccttcccaaaaggcgcggctgccgccgttgaccgcgccggcgtcgccgatgcggcggtctttgactccggcaataacgcgccggcatcggcggtaatagcagggatgacgaggcagtgggacgaagccaacggttgtgccaaaaggcaacgccggtcaagtagaaagaggagggccgccgatgcaccatgcccggccgccgacgggcactcgcaggagaaccctctctgcagcctcctcgcgtccaccaacaccggggatcgcggcattcagattgcgttcagcagcggcggcggtgctgcgccgtcctccaagcgcaccaagccgtcgctgagcagcacctcgtccagcatcagctttgacggcagaagctccgtcaacaacggctgcgacgacgtcccccagtacgaaccggacacggaggccctggcgcaggtgaaggagatgatctaccgcgcggcggcgatgcggccgttgagcctcggcgccgaggaggaagacaccggcgagcggccaagcaggcgcaacgtgcgcatctcgtccgacccgcagacggtggcggcgcgccagcggcgggagcgcatcagcgagcggctgcgcgtgctgcagaagctcgtcccgggaggcgccaagatggacacggcctccatgctggacgaggccgccaactacctccgcttcctcaagtcacagatcagggagctgcaaaccctggaccgccggaattacggcgcaaatgccatatcgaacacaggcatggcgccaatgatgagctacaacaatatgccggccttcgccttcccggcgacaggagccggcgaaaccctaggaagaggaggagaggaggctttcataagcagccggtttagatagattattgatgagggacatgcacgtacgcaagtgttttcatgtgttgtgcccaatgtaagaccatgcatcgatcagaagatagatcgatccatcatcattagctactgattagggatgatcatgtcggtcgatgaaattaatcataatgtcgtcgtcttcaccttttttaaaaaaaaaaaaaagaaaaaaaaaaaaaaaa

SEQ ID NO: 3250 - protein, 428 aa, Triticum aestivum
  misc_feature: PFam Name: HLH; PFam Description: Helix-loop-helix
  misc_feature: GI Number: 34914234; NR Description: P0697C12.24 [Oryza
  misc_feature: GI Number: 52076301; NR Description: bHLH transcription-like [Oryza sativa (japonica cultivar-group)] >gi|52076245|dbj|BAD45013.1| bHLH transcription-like [Oryza sativa
  misc_feature: GI Number: 34910410; NR Description: P0692C11.28 [Oryza sativa (japonica cultivar-group)] >gi|19571105|dbj|BAB86530.1| P0692C11.28 [Oryza sativa (japonica cultivar-group)] >gi|20804650|dbj|BAB92339.1| P0510F09.13 [Oryza sativa (japonica
  misc_feature: GI Number: 20127095; NR Description: putative bHLH transcription factor [Arabidopsis thaliana] >gi|15232534|ref|NP_188770.1| basic helix-loop-helix (bHLH) family
  misc_feature: GI Number: 51536285; NR Description: basic helix-loop-helix (bHLH)-like protein [Oryza sativa (japonica cultivar-group)] >gi|51535231|dbj|BAD38280.1| basic helix-loop-helix (bHLH)-like
MDPGFCNDMILSESAWNSGGGDGGAAGDVVNVVDGSGMSVLERLVLDEALAAAIMELQGIQVPCGGGKPMAGGIEAASLAFGATGTGPVTPAYAEVDGVVLQRQQHQHRHQGVMGMPVDYDLVPAARAVTLATVPAAPSFPKGAAAAVDRAGVADAAVFDSGNNAPASAVIAGMTRQWDEANGCAKRQRRSSRKRRAADAPCPAADGHSQENPLCSLLASTNTGDRGIQIAFSSGGGAAPSSKRTKPSLSSTSSSISFDGRSSVNNGCDDVPQYEPDTEALAQVKEMIYRAAAMRPLSLGAEEEDTGERPSRRNVRISSDPQTVAARQRRERISERLRVLQKLVPGGAKMDTASMLDEAANYLRFLKSQIRELQTLDRRNYGANAISNTGMAPMMSYNNMPAFAFPATGAGETLGRGGEEAFISSRFR

SEQ ID NO: 3251 - DNA, 1248 bp, Triticum aestivum
  misc_feature (1)..(1248): Ceres cDNA ID no. 21572784
  misc_feature (1)..(1248): Ceres CLONE  ID no. 917382
  misc_feature (1)..(1248): Also known as  Ceres CDNA ID no. 24357595
ccccagccaacatccatcgaggtgcgtgtgacgtcgtgacgacgagttcattctctgttggcaaggtaatgcatttttcagtatggtgagcagttccatcagtgtggtcgtccagcacgcgggcgtgggtttgtaatgtggtgcccatctacgtgcagcccacgaggaggcgactggtactaaagatgctacatccatgatagtggtaaatccctttgcaatttcagaatctgtttgattgctatgaaaactgttgtagtgcctaattttttagtgtcgtgcaatctttagtgatgttcactttgttagttcttccctctaattctacggacgagctgcacagaactgcagtcatcccgagcctaccgccgaggagccggcgagcgcgcccgcggcgccaccgcctacctcaacctcgaaccgggcgactactacggggacagcaccgccgtctcctccctcgtgcaggcaagaagaggatgaagatctccacacctgcccccatgcagttcactcgacgcgcccgtgtggtgcggagcgcatctgcgtgcagtacgcctgccaaccaactccaccacgcccacagtccactccgtggtccaatgcaatccgacgactcgatgcatgcagctcgcatggtgcgtgtgtgcagttttcaggctcgcaggtgtgtggttctaccaacaaccaactccaccgcggcccagcactcacgccggggagctcctggacttcagcgtcgaggtgttcaacaactgacgcagagattggaacggacacggccgcctttcctcatcgtcttcattggaaagcacacctagtggctgctcgcgggcgtgctacgtgccgttcggcatcagcagcaatgcggttcagaatcgcggtttgcttctgggtggccaaaggcagcgacaatccatgacttcggcctttcccagcccgctgccatgagctcccaggggaaggaagacatgatgtgcttgcatccgcctgcgagatgccaccgcttggcgtacacattttttctcttcattggaattgttttcacgggaatgctagatcctagcaggcatgcagtatagctggtgctagcggtccatatctttgtttttgtagctcactgtctctcttttgttgtatcttcttttttagtgtagtgatgtgggggttggacttgcagtgcactggcgaccggcttgcatttcatggaaaaattgtggatttatactcgtaaaaaaaaaaaaaaaa

SEQ ID NO: 3252 - protein, 175 aa, Triticum aestivum
  misc_feature: PFam Name: dCMP_cyt_deam; PFam Description: Cytidine and
MFTLLVLPSNSTDELHRTAVIPSLPPRSRRARPRRHRLPQPRTGRLLRGQHRRLLPRAGKKRMKISTPAPMQFTRRARVVRSASACSTPANQLHHAHSPLRGPMQSDDSMHAARMVRVCSFQARRCVVLPTTNSTAAQHSRRGAPGLQRRGVQQLTQRLERTRPPFLIVFIGKHT

SEQ ID NO: 3253 - DNA, 1819 bp, Triticum aestivum
  misc_feature (1)..(1819): Ceres cDNA ID no. 21572785
  misc_feature (1)..(1819): Ceres CLONE  ID no. 917431
  misc_feature (1)..(1819): Also known as  Ceres CDNA ID no. 24357504
actcctcactcctcactgaggacaggccagaccttgtttttccagctctgctttcgggcttaaagacacgccacacccgcgcggccctcgagggaactgcgacggaccatggcgtcggagaccgcgccgttctgcgtcacgggggcggcgggcaagggcgccgcgtccgcggcgcaccggccgcacggccacgtcgtgctcgccgcgcgcatccacgacgcgctcgtcttcgccgcgggcgccgtggcggccgtgctcctcctcctctgcttctcctccctgctcgcgcccgcgcccgtgcccaacctcgtcgccggcccctccctccccttccccacctccttcccgcagcagccgcaggaggccgactcctccgacgacggcctgtacgccagggtcgccgcggcgccgcgcacgttctatgacgacccgaagctgtcctacgccgtggaccggcgggtggccggctgggacgcgaagcgggccgagtggctgcgcctgcactaccctttcggcctccgcgcgcgccgcggccccggggagcgcgtcgtcatgctctccggctcccagtcccacccgtgcgccggcgacggcggcgaccacatgctgctgcgcttcctcaagaacaaggtggactacgcgcggctccacggcatcgagctgctctacaacacggcgctgctgcagccccggatggtggcatactgggccaagatccccgtggtgcgctccgccatgctcgcccacccggaggccgagtgggtctggtggctcgacgccgacgccgtcatcaccgacatggacttcgcgcccccgctcgccaccaggtataaggagtacaacctggtcgtccacggctgggacagggaggtgtacgaggcccggtcctgggtcggcctcaacgccggcgtcttcctcatccggaactgccagtggtcgctcgacttcatggacgcatgggccagcatgggcccggcctcgccggagtacgcgcgctggggcaagaccctcaaggccacgctcagcgacaagcccgacgccgagtccgacgaccagtccgcgctcgcttacctcctcctcaagaacccgaaaaaatggggcgccaggacgtacctggagcacgagtactacttccagggctactgggcggagatcgtggacaggctcgacggcgtcgcggcgcggtaccgggcggcggagcggcgcttcggcccggcgctccggcggcggcacgcggagggggagcacgcgctgtacgcggcggcgaggaacgcggccctgaggaagaaggccggcggcgtcccggggcccgacgggggcgggcagaaggcgtcctactggcgccggcccttcgtgacgcacttcaccggctgcaacccctgcggcggcaggcccaacgagatctactccaacgagagctgcgccgaggggatgcgccgcgcgctcaacctcgccgacgaccaggtgctccgcgcctacggcttccgccacgccgggccgctcaaggacgacgtgcgcgcgctcctagtctagtctagtcaaaccaagcgtgcagtttcgttcttacagacagcaaaatcagatcaccattttgtactgttttattggtggtgaaatgaaaagatgatgacatgacagtgtacgttgcttgctctgcatccgggtcactgtcactggatgtggcggtgcatccttttagcttgattgtgggtccttgcttgaccccctctttctttttcttgcttttttttttcaaacttcatccaagtttatattcagggagcaccaataaatcagttgttcaaaaaaaaaaaaaaaa

SEQ ID NO: 3254 - protein, 474 aa, Triticum aestivum
  misc_feature: PFam Name: Glyco_transf_34; PFam Description: galactosyl
  misc_feature: PFam Name: Pyr_redox_2; PFam Description: Pyridine
  misc_feature: PFam Name: Podocalyxin; PFam Description: Podocalyxin
  misc_feature: PFam Name: Atrophin-1; PFam Description: Atrophin-1 family
  misc_feature: PFam Name: MAGE; PFam Description: MAGE family
  misc_feature: GI Number: 55956982; NR Description:
  misc_feature: GI Number: 50912265; NR Description: putative alpha galactosyltransferase [Oryza sativa (japonica cultivar-group)] >gi|45735998|dbj|BAD13026.1| putative alpha galactosyltransferase
  misc_feature: GI Number: 62700759; NR Description: galactomannan
  misc_feature: GI Number: 32127690; NR Description: galactomannan
  misc_feature: GI Number: 55956976; NR Description:
MASETAPFCVTGAAGKGAASAAHRPHGHVVLAARIHDALVFAAGAVAAVLLLLCFSSLLAPAPVPNLVAGPSLPFPTSFPQQPQEADSSDDGLYARVAAAPRTFYDDPKLSYAVDRRVAGWDAKRAEWLRLHYPFGLRARRGPGERVVMLSGSQSHPCAGDGGDHMLLRFLKNKVDYARLHGIELLYNTALLQPRMVAYWAKIPVVRSAMLAHPEAEWVWWLDADAVITDMDFAPPLATRYKEYNLVVHGWDREVYEARSWVGLNAGVFLIRNCQWSLDFMDAWASMGPASPEYARWGKTLKATLSDKPDAESDDQSALAYLLLKNPKKWGARTYLEHEYYFQGYWAEIVDRLDGVAARYRAAERRFGPALRRRHAEGEHALYAAARNAALRKKAGGVPGPDGGGQKASYWRRPFVTHFTGCNPCGGRPNEIYSNESCAEGMRRALNLADDQVLRAYGFRHAGPLKDDVRALLV

SEQ ID NO: 3255 - DNA, 1829 bp, Triticum aestivum
  misc_feature (1)..(1829): Ceres cDNA ID no. 21572786
  misc_feature (1)..(1829): Ceres CLONE  ID no. 918890
  misc_feature (1)..(1829): Also known as  Ceres CDNA ID no. 24357665
atgccatgttctccgcgagccgcttcacgtggccactcgcgcgcacctcgccgcggttgactgctacgttggagtagctcggcggtggtggttggccgccgctgcgtgctcggaatctgttagagcagcaaaggtcggttgataaggagcgatggggaaggcggggaggtggctcaggaacttcttggccggcggcaggaaggatgggaagagggacaggccgcacgccgaggccacgccgggaccggggcctggggcgacgcccaaggaaaagaggtggagcttccggcggccggtggtgctgacgccggagcagactggacgcgtcgtgctgccggctgaggccgacagctttggtgcgtctcggtcgtccgcgacatcgcaggttgggtacgacgagaagaagcacgccgtggcggtggctgtggcgagcgcgaccgccgcagacgtggcgggcgccgcggcgcaggcggcggccactgtggcacgtctgtcttcccgcaaggcgccgcacctgacgccgccggcgagcctcctcgccgaggcggcggcggctgtgaggattcaggcatccttcagaggctatctggcgagagcggcgctgtgcgcgctgaggggcatcgtgaagctgcaggcgctggtgcgcggtcagctggtgaggaagcaggccaaggccacgctccggtgcatgcaggccctgctcgcggcgcagtcccagctgcgcgcgcagcgcatgcgcttccttcaagtccaagaccaccacgcccaccacacaacgccgcctagaccacgaccgtcgtcgcagcactcgaggcaccgcagatcgtcctacgagatggaccggtcgagcgaggagaatatgaagatcgtcgagatggacagcggcgagcagccagcgcggcgcggcggggcgaagggcggcgacaggcagttctcctccgtcgagtaccaccacggcggcaggtgctcgccggcgccgtcggccatgacggagctgagcccgagggcgagcagctggcacgtggaggaccacctgtccttcgggacggcgcacagcagcccgcactcccactcccacaacgcgacggcggccatggcggagccagcggcgtcggacttgccgttcccgagctacatgagcaacaccgagtcgtcgagggccaaggcgcggtcccagagcgcgccgaggcagcgcgcggccgcggaggcgctggagcggcaaccgagcaggaggaagggggcggagcacaggagcgtgccgcggggcgccaggatgcagcggtcgtcgtcgcagcagcaggccgggtcggcgccgcgccagtcgcccttcttccaccggccgtggtcgtcgtcgacgtcggtgaggctggacacgtcgacggcgtcgctcaaggacagcgagtgcgggtccaccaccagctccgtggtcaccgcggccaccaccgtgtccaccgtctacagccggacccgctcgctcgtcggattcgaggtgcgcaggagcctgtattgatgagttgcaacataagaagccacatcgggagcttcatgaaatgctcatgagaaaattgcttgatactgtggtctcgttcgtgtgtgtgttgatgagagatcagagcctagtagagtgttgtacatacgtccgagtcaagtactcctttttttttggctcttcgagtcaagtaccaagtgtacattctttttatacacagggcatatctgggacatgatgacgaggtactcagtgtaattagaaatgtagtggtaaaaaaaatgtactggtttatctcgcaaagaaaaaaaactggcacagtggaaaaaaaaaaaaaaaa

SEQ ID NO: 3256 - protein, 452 aa, Triticum aestivum
  misc_feature: GI Number: 34906398; NR Description: P0710E05.11 [Oryza sativa (japonica cultivar-group)] >gi|9049461|dbj|BAA99426.1|
  misc_feature: GI Number: 30682982; NR Description: calmodulin-binding
  misc_feature: GI Number: 21594016; NR Description: unknown [Arabidopsis thaliana]
  misc_feature: GI Number: 42566208; NR Description: calmodulin-binding
  misc_feature: GI Number: 50940489; NR Description: calmodulin-binding protein family-like [Oryza sativa (japonica cultivar-group)] >gi|42409298|dbj|BAD10560.1| calmodulin-binding protein family-like
MGKAGRWLRNFLAGGRKDGKRDRPHAEATPGPGPGATPKEKRWSFRRPVVLTPEQTGRVVLPAEADSFGASRSSATSQVGYDEKKHAVAVAVASATAADVAGAAAQAAATVARLSSRKAPHLTPPASLLAEAAAAVRIQASFRGYLARAALCALRGIVKLQALVRGQLVRKQAKATLRCMQALLAAQSQLRAQRMRFLQVQDHHAHHTTPPRPRPSSQHSRHRRSSYEMDRSSEENMKIVEMDSGEQPARRGGAKGGDRQFSSVEYHHGGRCSPAPSAMTELSPRASSWHVEDHLSFGTAHSSPHSHSHNATAAMAEPAASDLPFPSYMSNTESSRAKARSQSAPRQRAAAEALERQPSRRKGAEHRSVPRGARMQRSSSQQQAGSAPRQSPFFHRPWSSSTSVRLDTSTASLKDSECGSTTSSVVTAATTVSTVYSRTRSLVGFEVRRSLY

SEQ ID NO: 3257 - DNA, 1542 bp, Triticum aestivum
  misc_feature (1)..(1542): Ceres cDNA ID no. 21572787
  misc_feature (1)..(1542): Ceres CLONE  ID no. 918997
  misc_feature (1)..(1542): Also known as  Ceres CDNA ID no. 24357488
tttttctccttttagcctcctcgctttctcccccatcacggaaggaacgaggcaggggaggggaaccccaaggccgcggaccgagccgagcgcgcgcgccacccatcccgtcccatgccgccgctggaggccctcctcggcgccgccgagctctggcgccccgcggcgcgcggggccggcggctgggccaccgccgccgcgctcctcctgctcctcgtcgcccacctctccgtcctcctcgtccgccgccgccgccgggggcgggcacgcctcgcccggcagcaggaggacgcccccgcggcgcccgcccccgcctcaccctccccctcctccggttccgggtccagcacaggggtggagggcctcgtgacggaggacgatctgaggcggctggttggcagcctgggggtcggcgcccgccagccggagctcgagggctgggaccccgtcatcgccaaggggaacgacgccgtctcctacaaggcgtggtgcgagaggaccaaggatggcccgcctagatatcttagtgtgacaacttatgagggatgctcaacagagcttttgagggacttttacatggataatgagtacagaatggagtgggataacaccgtgataaagcatgagcagctgcagtgtgatgaagatagcggaatcgagatagggcgtacagttaagaagttccctcttttaacaccaagagagtacatattggcatggcgagtttgggcatcagatgagaactctttctattgcttggtcaaggaatgtgaacactctcttgcgccaatacaaagaaaatttgttcgagtacgacttctgagatcggggtggtgtattaggaaagtccctggaagagacgcatgtgaaatcacagtgctgcaccatgaagacaatggcatgaacatcgagatggcaaagctggccttttccaagggcatctggaattatatttgtaaaatgaacaatgctttacgccggtatcctcagcaccgtggtccgtcgatatcaattttgaccatgcgaagacttaccaagaagtttccccaggacttgcagatcaacgtggatgaaagtaatcgatctccggtgaatacagctgcagctgttgctcctcctacaccttcatccggaacttctccctgcaagcagctagggaagaagtcatcacgggaaacgattgcaagtggacttttgctaattggaagcattgtttgtctgtcgaaaggtcggtctaacctcggcgcacagcttgccatggcattcttcctgaagaaggcctttaagcaggacaaagaatcaggctcttcgccaaggggaagaactgatgcgacggtgcccatgcagtagtactaggtccggcttaagctgttgatgctaccgttttatccttacaaactgagtacttactacttacttgaaattgaaaaaggcatgattttgtacagtgttcttggccgcaaattatgtaaatgataagttttgaaataacttttgttctccatttagcacatgggtgacattcgaaaaaaaaaaaaaaaa

SEQ ID NO: 3258 - protein, 411 aa, Triticum aestivum
  misc_feature: PFam Name: START; PFam Description: START domain
  misc_feature: PFam Name: FH2; PFam Description: Formin Homology 2 Domain
  misc_feature: PFam Name: MCPVI; PFam Description: Minor capsid protein VI
  misc_feature: GI Number: 50908121; NR Description: putative membrane related protein [Oryza sativa (japonica cultivar-group)] >gi|47497322|dbj|BAD19363.1| putative membrane related protein
  misc_feature: GI Number: 8778323; NR Description: F14J16.24 [Arabidopsis thaliana] >gi|25406013|pir||G96600 protein F14J16.24 [imported] -
  misc_feature: GI Number: 10178166; NR Description: membrane related
  misc_feature: GI Number: 23197608; NR Description: membrane related protein CP5, putative [Arabidopsis thaliana] >gi|22135902|gb|AAM91533.1|
  misc_feature: GI Number: 21593272; NR Description: membrane related
MPPLEALLGAAELWRPAARGAGGWATAAALLLLLVAHLSVLLVRRRRRGRARLARQQEDAPAAPAPASPSPSSGSGSSTGVEGLVTEDDLRRLVGSLGVGARQPELEGWDPVIAKGNDAVSYKAWCERTKDGPPRYLSVTTYEGCSTELLRDFYMDNEYRMEWDNTVIKHEQLQCDEDSGIEIGRTVKKFPLLTPREYILAWRVWASDENSFYCLVKECEHSLAPIQRKFVRVRLLRSGWCIRKVPGRDACEITVLHHEDNGMNIEMAKLAFSKGIWNYICKMNNALRRYPQHRGPSISILTMRRLTKKFPQDLQINVDESNRSPVNTAAAVAPPTPSSGTSPCKQLGKKSSRETIASGLLLIGSIVCLSKGRSNLGAQLAMAFFLKKAFKQDKESGSSPRGRTDATVPMQ

SEQ ID NO: 3259 - DNA, 1524 bp, Triticum aestivum
  misc_feature (1)..(1524): Ceres cDNA ID no. 21572788
  misc_feature (1)..(1524): Ceres CLONE  ID no. 919281
  misc_feature (1)..(1524): Also known as  Ceres CDNA ID no. 24357424
attagcgaggagcacgagcgccaggcaccgcatcgcatcgcatcgcacgcgaaccttcccacctcccccccgaagtgcggactacagagccaccagacatggcctccgcctcgcctctgtagaatcccaccaaccagtcttccctgtccgcgcccccgcgattcgagttcgaccagggctggaggcctcgccgtcggcgtctggtggtgcgtcgagtgtcgaggcgaccgcgcggatggcggcggtggcggagggcgcgcccgcggcttccgcgcaggcggcggcttccgcggcggccaaggaggcggagtaccgcaaggacgtgcagaagctggtggacctgctctccaagctgaacccggccgccaaggagttcgtcccgtcctccgcggccgccacgcccaggaagggcctgtcggcggacgcgccggtgttctactacggcccgatcggaggccggagcgccgggatcggcgggtaccccggcagcgccgacgccgggtacattgggtaccagcagcgcatgagaaggaattttgtagataatgagaggaggaatgtatacatcaaccatgggaggaggaggacaaatgagagggcgaggcgtgcagacagggaagagagcatccgacgaaccgtttatgtctctgaactcgaccatactgtgacagaggaaagacttgctgaaacctttgctaactgcgggcaagttgtcgattgcagaatctgtggtgatccacattctgttatgaggtttgcattcattgagttttctggtgaagagggggctagagctgcacttaaccttggtggcacaatgcttgggttctaccccgttagagtcttgccttcaaagacagctatcttacctgtgaatccaaaatttcttccagcgacggaggatgagaaggaaatggtcatacggacggtttattgtacaaatatagataagaaggttactcaattagatgtaaagagtttctttgaagaactttgtggtgaggtctctcgtttgagacttttaggcgacaatgtacattcaacaaggattgcttttgttgagtttgtcaatgctgagggtgccatccaggctctgaactgcagtgggatgattttgggcacactgccagtcagggtgagcccttccaagaccccggtgaagccccgtctaaatcgggtggtgtcaaactgactgcttcggctacacactggattgttgacgggaaggctgcctgaccatcacctatagcttccgcgatccagtgaaactatgatgtttctgcttagatccttgcaacggaagagcgttttcttcctttaattatcccttctgagaaactgttggaaagggactggctgaatcagacccttgagagtcttgagagtcccgcatctcgcagacaaatctgtgatggatggagcaaccagtagaaaaacctgccattcagagtaatttctgtggctaaaacattgtttccttgttatctcattggctgttattcccttcaaaaaaaaaaaaaaaaa

SEQ ID NO: 3260 - protein, 318 aa, Triticum aestivum
  misc_feature: PFam Name: RRM_1; PFam Description: RNA recognition motif.
  misc_feature: GI Number: 50252270; NR Description: putative RNA-binding
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
  misc_feature: GI Number: 48427656; NR Description: At1g53650 [Arabidopsis thaliana] >gi|25405657|pir||F96576 probable RNA-binding protein, 40942-42923 [imported] - Arabidopsis thaliana
  misc_feature: GI Number: 51970080; NR Description: putative RNA-binding protein [Arabidopsis thaliana] >gi|51969708|dbj|BAD43546.1|
MAAVAEGAPAASAQAAASAAAKEAEYRKDVQKLVDLLSKLNPAAKEFVPSSAAATPRKGLSADAPVFYYGPIGGRSAGIGGYPGSADAGYIGYQQRMRRNFVDNERRNVYINHGRRRTNERARRADREESIRRTVYVSELDHTVTEERLAETFANCGQVVDCRICGDPHSVMRFAFIEFSGEEGARAALNLGGTMLGFYPVRVLPSKTAILPVNPKFLPATEDEKEMVIRTVYCTNIDKKVTQLDVKSFFEELCGEVSRLRLLGDNVHSTRIAFVEFVNAEGAIQALNCSGMILGTLPVRVSPSKTPVKPRLNRVVSN

SEQ ID NO: 3261 - DNA, 1416 bp, Triticum aestivum
  misc_feature (1)..(1416): Ceres cDNA ID no. 21572789
  misc_feature (1)..(1416): Ceres CLONE  ID no. 920163
  misc_feature (1)..(1416): Also known as  Ceres CDNA ID no. 24357515
ctctctctctcacccgcacctcgccgcccttcctccggatctcggctctgctcggcggcgccagcagagcggggtcggaggcatacgagcgaatcccccagacaacgttgctcacagctcgagaggccgacaaagcattggttcctctgtgctcgccacgtcatggcggcggcgctcatggacggcgagctcgggagcctactgaaggccacggcggcggtttgggcggccatgtactacgcccgcatggccgccgcgctcattcgcccaggcgccgctcgcctcgccgcgcttctgcccgctgtcgcgctcttctgcgcgatccccttcgccttctccaccaccacgttccgcggcagctccgccttcttcctctgctggctcggcaccttcaagctcctcctcctcgccgccggccgcgggcccctggacccgtccctctccctgccccacttcgtcttctccgcctccctgcccgtcaagttccggcagcccgcccccgccaaatcaaaggaccaagatcccgcttcggcttcggcccgtggacacggcccggccaagatcctcgtcgccggcgccgtcatccccttcatcatctacgcgtaccagttcaaggacgcgatgcgccggtggcagctcgtcctcctgtacaccgtgcacatctacctctccctggagctcctgctgggctcggtgcgcgccctgatccacggcgtgctgggcatggagatggagccgcaggtggaccggccgtacctggcgtcgtcgctgcgggacttctggggcaggcggtggaacctcatggtgcccaccatcctccggccgtcggtgcacggccccgtgcgcgcgcgcttcggcgacgcggcgggcgtcatggcgtccttcctcgtctccgggctcatgcacgaggtgatgttctactacatcatgtggcagccgcccagcggcgacgtgaccgcgttcttcgtcctgcacggcgcgtgcaccgcggcggaggggtggtgggcgcggcacgccgggtggtggcgcccgccgcgggcggccgcggtgccgctcacgctggcgttcgtgggcgggacggggatctggctcttcttcccggccatggtcaggggcggcctggacgagcttgtgctgcaggagtgccagggcttggtggcggccatggagcaggccggccgttggctcgccggcggcgccgccgccggtcccattctttccacgcgctgaccaggagaaaacatgcgctgtgacgaggggccgaacgtgtgccgtacgattaggatccaaagggcgataggagtatactacttgtgatgtggactgtggtagacttcagatcttggaaggtcgtgattgaacattcattgatcgataataattaaaatatattgatattcaaaaaaaaaaaaaaaa

SEQ ID NO: 3262 - protein, 1416 aa, Triticum aestivum
  misc_feature: PFam Name: MBOAT; PFam Description: MBOAT family
  misc_feature: PFam Name: FH2; PFam Description: Formin Homology 2 Domain
  misc_feature: PFam Name: Extensin_2; PFam Description: Extensin-like region
  misc_feature: PFam Name: Pyr_redox_2; PFam Description: Pyridine
  misc_feature: PFam Name: Cation_efflux; PFam Description: Cation efflux family
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
  misc_feature: GI Number: 38347115; NR Description: OSJNBa0009K15.12 [Oryza
  misc_feature: GI Number: 58532043; NR Description: OSJNBa0009K15.16 [Oryza
  misc_feature: GI Number: 9758167; NR Description: wax synthase-like protein [Arabidopsis thaliana] >gi|15240497|ref|NP_200346.1| membrane bound O-acyl transferase (MBOAT) family protein / wax synthase-related
CTCTCTCTCTCACCCGCACCTCGCCGCCCTTCCTCCGGATCTCGGCTCTGCTCGGCGGCGCCAGCAGAGCGGGGTCGGAGGCATACGAGCGAATCCCCCAGACAACGTTGCTCACAGCTCGAGAGGCCGACAAAGCATTGGTTCCTCTGTGCTCGCCACGTCATGGCGGCGGCGCTCATGGACGGCGAGCTCGGGAGCCTACTGAAGGCCACGGCGGCGGTTTGGGCGGCCATGTACTACGCCCGCATGGCCGCCGCGCTCATTCGCCCAGGCGCCGCTCGCCTCGCCGCGCTTCTGCCCGCTGTCGCGCTCTTCTGCGCGATCCCCTTCGCCTTCTCCACCACCACGTTCCGCGGCAGCTCCGCCTTCTTCCTCTGCTGGCTCGGCACCTTCAAGCTCCTCCTCCTCGCCGCCGGCCGCGGGCCCCTGGACCCGTCCCTCTCCCTGCCCCACTTCGTCTTCTCCGCCTCCCTGCCCGTCAAGTTCCGGCAGCCCGCCCCCGCCAAATCAAAGGACCAAGATCCCGCTTCGGCTTCGGCCCGTGGACACGGCCCGGCCAAGATCCTCGTCGCCGGCGCCGTCATCCCCTTCATCATCTACGCGTACCAGTTCAAGGACGCGATGCGCCGGTGGCAGCTCGTCCTCCTGTACACCGTGCACATCTACCTCTCCCTGGAGCTCCTGCTGGGCTCGGTGCGCGCCCTGATCCACGGCGTGCTGGGCATGGAGATGGAGCCGCAGGTGGACCGGCCGTACCTGGCGTCGTCGCTGCGGGACTTCTGGGGCAGGCGGTGGAACCTCATGGTGCCCACCATCCTCCGGCCGTCGGTGCACGGCCCCGTGCGCGCGCGCTTCGGCGACGCGGCGGGCGTCATGGCGTCCTTCCTCGTCTCCGGGCTCATGCACGAGGTGATGTTCTACTACATCATGTGGCAGCCGCCCAGCGGCGACGTGACCGCGTTCTTCGTCCTGCACGGCGCGTGCACCGCGGCGGAGGGGTGGTGGGCGCGGCACGCCGGGTGGTGGCGCCCGCCGCGGGCGGCCGCGGTGCCGCTCACGCTGGCGTTCGTGGGCGGGACGGGGATCTGGCTCTTCTTCCCGGCCATGGTCAGGGGCGGCCTGGACGAGCTTGTGCTGCAGGAGTGCCAGGGCTTGGTGGCGGCCATGGAGCAGGCCGGCCGTTGGCTCGCCGGCGGCGCCGCCGCCGGTCCCATTCTTTCCACGCGCTGACCAGGAGAAAACATGCGCTGTGACGAGGGGCCGAACGTGTGCCGTACGATTAGGATCCAAAGGGCGATAGGAGTATACTACTTGTGATGTGGACTGTGGTAGACTTCAGATCTTGGAAGGTCGTGATTGAACATTCATTGATCGATAATAATTAAAATATATTGATATTCAAAAAAAAAAAAAAAA

SEQ ID NO: 3263 - DNA, 692 bp, Triticum aestivum
  misc_feature (1)..(692): Ceres cDNA ID no. 21572790
  misc_feature (1)..(692): Ceres CLONE  ID no. 922589
  misc_feature (1)..(692): Also known as  Ceres CDNA ID no. 24357549
acaaaatcttttttctgtgatggtagtcttttacatggagcaaactctcccatgtttgtatattcctaggctaacatcgcagactaacccttttgatgtttctccttccgaaggttgtctcatctcccatcacccttggtagcagcgttgctgcattgaaactttgggacttgccatgaggcaaaaatcagctttatgttccattcattaatctgaatgtcagttgtttgtttgtgtctgatccctttttctttctttgtgtggattttgattatgcctttggatgtagacatctttgcctaacttcaaggactatttgatgtttaatgaatgtcattttaaactcaactgaacaatggctgtgggtttgttttgcagacaatgctggagtgatcgtgaaccccaagggtgagatgaaaggatctgccatcaccggacctgtgggaaaggagtgtgctgacctttggcccaggatcgccagcaacgccaatgccatcgtttgagagcctgtttcaagttgtgagactgcttatataatgccagtgtgggttgcagctgttttgcctgggaaatagtggaactctgcgttgctctgttttgtttggcatctcagtttcttagtgaacagaagcctgcctgtctgcttagtttaacaactgtaacttcgttgccagagaaaaaaaaaaaaaaaa

SEQ ID NO: 3264 - protein, 58 aa, Triticum aestivum
  misc_feature: PFam Name: Ribosomal_L14; PFam Description: Ribosomal
  misc_feature: GI Number: 2982289; NR Description: 60S ribosomal protein L17
  misc_feature: GI Number: 32400871; NR Description: ribosomal Pr 117
  misc_feature: GI Number: 13430182; NR Description: ribosomal protein L17
  misc_feature: GI Number: 7547099; NR Description: ribosomal protein L17, putative [Arabidopsis thaliana] >gi|21593801|gb|AAM65768.1| putative 60S ribosomal protein L17 [Arabidopsis thaliana] >gi|21555625|gb|AAM63901.1| putative 60S ribosomal protein L17
  misc_feature: GI Number: 57471720; NR Description: ribosomal protein L17
MNVILNSTEQWLWVCFADNAGVIVNPKGEMKGSAITGPVGKECADLWPRIASNANAIV

SEQ ID NO: 3265 - DNA, 2179 bp, Triticum aestivum
  misc_feature (1)..(2179): Ceres cDNA ID no. 21572792
  misc_feature (1)..(2179): Ceres CLONE  ID no. 923907
  misc_feature (1)..(2179): Also known as  Ceres CDNA ID no. 24357614
aaccactagtctccttcctcggttcctcctcctgtccccctttttttccccatggcccaatcctgggcctccttcctcctccttgctctcttctcctccaccctcctcgtctgcggcagcaatggggagcgagtcttcctctacccgcagtcccagaaggtctcatccatcgtcagccagaggtaccggaccgcctaccacttccagccccccaagaactggatcaacgatccaaatgggccaatgtactacaatggcatctaccatgagttctaccagtacaaccccaatggctccgtctggggtaacatagtttggggccactcggtttcgacagacctcatcaactggatcccacttgaagccgcaatagagcgggacaccccgagcgacataaacggttgctggaccggctcagccacaattctccccggtaaccgactggtcatcatatacaccggtgctgacccggagaagcgtcaggtccaaaacattgtggttccgaaaaacctgtctgacccgtacctgagagaatggaccaaagccggaaataacccggtgatccaaccggtcggaccgggcttgaactcgggccagttcagggacccgacaaccggttggatcggacctgatggactgtggaggatagcagttggtgctgagctcaacggggacagtgctgcacttttgtacaagagcaaagactttctgaactggactagagttgaccacccactgtattcatccaattcctcctctatgtgggagtgcccggatttcttcgcggtattgccgggcaatagcggtggactggacctgtctgcagcgatcccgaatggtgccaagcatgtcctcaagatgagcctggattcctgtgacaagtacatgattggggtttatgatctgaaaagtgacacctttattccagatactgtcctagatgaccgccggctatggtcgaggatcgattatggtaatttctatgcctcaaagtcatttttcgactcgaagaagggcaggaggatcatatggggttggactaacgagacagacagttcttcggacgatgttgcaaaaggttgggctggaatccatgcaattcccaggacaatttggttagacagccatggcaagcagttgctgcaatggccagttgaagaggttgagtcccttcgaggaaatgaaatcaaccatcaaggactagagctgaagaagggaggtctgtttgagatcaagggagctgacagtttccaggctgatgtggagatagactttgagctgacgtccatcgataaagccgatcctttcgacccctcctggcttttggacgtcgagaagcattgccgggaagcgggtgcatcagtcaatggtggcataggtccatttggacttgttgtcctggcctctgacaacatggaggagcacactgctgtgcacttccgggtgtacaagtcagagcagaagtacatgatactcatgtgctctgatctaagaagttcttcgttgaggccaggactgtacacaccagcctatggaggcttctttgaatacgacctggaaaaagaaaagaagatatctctgagaactctgattgatcggtcggcggtggagagcttcggcggtggcggcagggtctgcatcatggccagagtgtaccccgtggcggttgtcgacggcgtggcccacatgtatgccttcaacaacggcagtaccacggtcagggtgccacagctcagggcctggagcatgaggagagcacaagtgaatgtgaaagggatggagtgatggttaacaaagcagagcaattctaattgacctgtgattggaggaccggatcaatcaatctgatcacttgtttagcgcacttcactattttgaaaacacaaattactcccattcatgagcacttctaggtaggaataaaaggaaattcaacagggaaaaaaaatagctgctcatttccttgacctctaggattcatgtattatagtttaccggtacttggtcagaaagaaggacaaattattactgtttgaaactagtagtatagttggcaattggtaaagaaacatgatgcctgttgtcagcatcggcattactgctgtgaaacgattcagagttacaaaaggtaataaatagtaccacgagcttgtgcatgtcaagaaaaaaaaaaaaaaaa

SEQ ID NO: 3266 - protein, 577 aa, Triticum aestivum
  misc_feature: PFam Name: Glyco_hydro_32; PFam Description: Glycosyl
  misc_feature: GI Number: 551259; NR Description: beta-fructofuranosidase; beta-fructosidase [Nicotiana tabacum] >gi|1076619|pir||S49308
  misc_feature: GI Number: 16225878; NR Description: cell wall invertase
  misc_feature: GI Number: 27802647; NR Description: cell wall invertase
  misc_feature: GI Number: 40217607; NR Description: cell wall invertase
  misc_feature: GI Number: 3342242; NR Description: cell wall invertase; beta-fructofuranosidase; fructosidase [Triticum aestivum] >gi|7435481|pir||T06167 beta-fructofuranosidase (EC 3.2.1.26), cell
MAQSWASFLLLALFSSTLLVCGSNGERVFLYPQSQKVSSIVSQRYRTAYHFQPPKNWINDPNGPMYYNGIYHEFYQYNPNGSVWGNIVWGHSVSTDLINWIPLEAAIERDTPSDINGCWTGSATILPGNRLVIIYTGADPEKRQVQNIVVPKNLSDPYLREWTKAGNNPVIQPVGPGLNSGQFRDPTTGWIGPDGLWRIAVGAELNGDSAALLYKSKDFLNWTRVDHPLYSSNSSSMWECPDFFAVLPGNSGGLDLSAAIPNGAKHVLKMSLDSCDKYMIGVYDLKSDTFIPDTVLDDRRLWSRIDYGNFYASKSFFDSKKGRRIIWGWTNETDSSSDDVAKGWAGIHAIPRTIWLDSHGKQLLQWPVEEVESLRGNEINHQGLELKKGGLFEIKGADSFQADVEIDFELTSIDKADPFDPSWLLDVEKHCREAGASVNGGIGPFGLVVLASDNMEEHTAVHFRVYKSEQKYMILMCSDLRSSSLRPGLYTPAYGGFFEYDLEKEKKISLRTLIDRSAVESFGGGGRVCIMARVYPVAVVDGVAHMYAFNNGSTTVRVPQLRAWSMRRAQVNVKGME

SEQ ID NO: 3267 - DNA, 1596 bp, Triticum aestivum
  misc_feature (1)..(1596): Ceres cDNA ID no. 21572793
  misc_feature (1)..(1596): Ceres CLONE  ID no. 924278
  misc_feature (1)..(1596): Also known as  Ceres CDNA ID no. 24357603
tggctaaagttcacatttttgtcctcctccgattctctcccatgcatatacatcgtaccctcccttccccttgtgtctcttccgtcgcatttcccccacactccaagaaagcaagcaggccaagcactgcggcggctcaccaccggcggcggcggcatggacgtggccatggcgctggccacggtcttcttctgcctcctgctgctcgcctcggccgccatctcgctcctcctcctccgcctctgcctcgccgcgctccgccgggcccccgcacccgccgcgcgcgccccctacgccgcggtcgaccccgaggccgccgcgcgggcggcggcaccgccagcagtgccgcagcaggagccgccccttccggcggcgtgggcgaagcccaaggcgccggagccccggcggctggcgtggcgggaggtggaggcgctgacgggcgggttcgacgaggcggccgtggtgggccgcggcggctccggcggcgccgtgtacctgtccaggatccccgtgttggccggcgggcccccggccgccgtgaaggtgcaccgctggtgcggcggcggcgagcgccggctcggcgcgttccggcgcgagctcgacctgctccgccgcgtcggccgccacccgcgcctcgtcgccctcctcgcctactccgacgaccacgaggagggaggcgcgctggtgctggagtacatgccgggcggcacgctggcggaccgtctccaccacgccgccacgccgccgctcacctggcgccaccgcatgcgggtcctccacgacgtggccgccgcgctggagcacctccacgacgccgtctccatcgtgcacggcgacgtgtcggcctccaacgtgctcctcgacgccggcggccgcgcgcggctctgcgacctggggtcggcctgcgagggcaccttctcggcggccgtggcccccgcccggggcgcggcggccgtcggctcgccgggctacgccgaccccttcttcctccgcaccggcatcgtgtccaagaagtccgacgtgtacggcttcggcgtgctgctcctcgaggccctcaccggctcgccggccgccggcgcgccgggcccggacggcgtcggcggccagtacctcgcggccagggtgctgccgcgcgtgagggccgccggggtggcggggctcgtggacggcaggctgggcgacggctatgatgctgtggaggccggcgacgtcgcgcggatcgccgtggagtgcgtggcgccgcagccggggctccggccgaccatggcgcaggtgcgggccgccgtcgcggagaaggcggcgaggtccatcgcggcgacggacggcggcgagagcgacctcaagttgctcgacttgttccgcatggccagctagctgactggagcactggaccccatttttcagaagctccattagcctcatcttcttctactccttctcctcgtgtgtgtgtgtgttttagacatttagcggtagaaaatggattggtttagtgtctagtgctagaactgagtgggatgtaaatatgatccgacttcacttacttccataaacgggtgcaataaaaatcctgtccatgcaaaaaaaaaaaaaaaa

SEQ ID NO: 3268 - protein, 405 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50252107; NR Description: serine/threonine-specific receptor protein kinase-like protein [Oryza sativa (japonica cultivar-group)] >gi|50251992|dbj|BAD27925.1| serine/threonine-specific receptor protein kinase-like protein
  misc_feature: GI Number: 37536060; NR Description: putative receptor protein kinase [Oryza sativa (japonica cultivar-group)] >gi|13786470|gb|AAK39595.1| putative receptor protein kinase [Oryza
  misc_feature: GI Number: 50911268; NR Description: putative serine/threonine-specific protein kinase [Oryza sativa (japonica cultivar-group)] >gi|49388396|dbj|BAD25532.1| putative serine/threonine-specific protein kinase [Oryza sativa (japonica
  misc_feature: GI Number: 42562481; NR Description: protein kinase family
  misc_feature: GI Number: 42571731; NR Description: protein kinase family
MDVAMALATVFFCLLLLASAAISLLLLRLCLAALRRAPAPAARAPYAAVDPEAAARAAAPPAVPQQEPPLPAAWAKPKAPEPRRLAWREVEALTGGFDEAAVVGRGGSGGAVYLSRIPVLAGGPPAAVKVHRWCGGGERRLGAFRRELDLLRRVGRHPRLVALLAYSDDHEEGGALVLEYMPGGTLADRLHHAATPPLTWRHRMRVLHDVAAALEHLHDAVSIVHGDVSASNVLLDAGGRARLCDLGSACEGTFSAAVAPARGAAAVGSPGYADPFFLRTGIVSKKSDVYGFGVLLLEALTGSPAAGAPGPDGVGGQYLAARVLPRVRAAGVAGLVDGRLGDGYDAVEAGDVARIAVECVAPQPGLRPTMAQVRAAVAEKAARSIAATDGGESDLKLLDLFRMAS

SEQ ID NO: 3269 - DNA, 1628 bp, Triticum aestivum
  misc_feature (1)..(1628): Ceres cDNA ID no. 21572794
  misc_feature (1)..(1628): Ceres CLONE  ID no. 926577
  misc_feature (1)..(1628): Also known as  Ceres CDNA ID no. 24357464
gtgtctacgtatatatcaccgccgtaaccactagcgacagccgagctccaggccatggcgcctgccgcgttcgacgccgaggccggcggcccggcgatcgtggccgcggcaggcaacgacgcgcacaagcccgcccccggagccgacgccgatgccggcgccgccttcgtgctcgagtccaaagggacgtggtggcacgcgggtttccacctgacgacggcgatcgtggggccgacggtgttgacgctgccgtacgcgctgcgggggatgggctgggctctcggcatcaccacgctctccctcatcgccgccgtcaccttctacgagtactccctcatgtcccgcgtgctcgaccactgcgaggcgcgcggccgcaggcacatccgcttccgcgagctcgccaccgacgtcctcggctccgggtggatgttttacttcgtggtgattgtgcagacggccatcaacacaggcgttagcatcggttccatcttgctggcggccgattgcatcgagataatgtactcgagccttgctcccaatggtcccctaaaactgtaccacttcatcatcatcgtggctgtggtgctggccttcctctcccaactaccatcgttccactcgctgcggcacatcaacttggtctcactactcctaagcttgggctacaccatccttgtgtctgctgcttgtattcgtgcaggtttgtcgaaaaacgctccagccaaggactactctctaagctcatccaagtcagagcagaccttcaatgccttcctctccatttccatcctggcatctgttttcggcaatggcattctgcctgaaatccaggctaccttggcgccgccggccgccgggaagatgatgaaggctctggtgatgtgctactccgtcataggcttcaccttctatctcccgtccatcaccggctactgggcgttcggcagccaggtccagtccaacgtcctcaagagcctcatgccggactcagggccggccctcgcgccgacctggctgctgggcctcgctgttctcttcgtcctcctccagctcctagccattgggctcgtgtactctcaggtggcatacgagatcatggagaagaactcagcggacgtgacacagggcaagttctcgcgccggaacctggtgccgcggctgctgctgcggacgctctacctggccttctgcgcgctcatggccgcgatgctgcccttctttggcgacattgtcggcgtggtcggcgccgtggggttcatcccgctcgactttgtcctccccgtcatcatgtacaacatcgcgcttgcgccgccgaggaggtccacgctgtacatcgccaacacggtcatcatggtcgtcttcacaggcgtcggggccatcggtgccttcgcctctatacggaagctcgtgctagacgccggccagtttaaactcttcagcaacaacgtagtcgactgaagaacgcacatctatgtagagtctagtttgttaggtgcttagtagtcccctgatttcttgaggcataggcgtatagctaagtaattaagctttgtacctccccttttacatagctattaatttacacgtaagcacgcatgcatccgtcgagtataaaaaaaaaaaaaaaa

SEQ ID NO: 3270 - protein, 467 aa, Triticum aestivum
  misc_feature: PFam Name: Aa_trans; PFam Description: Transmembrane amino
  misc_feature: GI Number: 34912776; NR Description: P0407B12.25 [Oryza sativa (japonica cultivar-group)] >gi|11034686|dbj|BAB17188.1|
  misc_feature: GI Number: 21554158; NR Description: amino acid permease-like
  misc_feature: GI Number: 22136372; NR Description: amino acid permease-like protein [Arabidopsis thaliana] >gi|20466438|gb|AAM20536.1| amino acid permease-like protein [Arabidopsis thaliana] >gi|18422139|ref|NP_568597.1| amino acid transporter family
  misc_feature: GI Number: 10177364; NR Description: amino acid permease-like
  misc_feature: GI Number: 50932903; NR Description: putative amino acid transporter family II [Oryza sativa (japonica cultivar-group)] >gi|48475084|gb|AAT44153.1| putative amino acid transporter family
MAPAAFDAEAGGPAIVAAAGNDAHKPAPGADADAGAAFVLESKGTWWHAGFHLTTAIVGPTVLTLPYALRGMGWALGITTLSLIAAVTFYEYSLMSRVLDHCEARGRRHIRFRELATDVLGSGWMFYFVVIVQTAINTGVSIGSILLAADCIEIMYSSLAPNGPLKLYHFIIIVAVVLAFLSQLPSFHSLRHINLVSLLLSLGYTILVSAACIRAGLSKNAPAKDYSLSSSKSEQTFNAFLSISILASVFGNGILPEIQATLAPPAAGKMMKALVMCYSVIGFTFYLPSITGYWAFGSQVQSNVLKSLMPDSGPALAPTWLLGLAVLFVLLQLLAIGLVYSQVAYEIMEKNSADVTQGKFSRRNLVPRLLLRTLYLAFCALMAAMLPFFGDIVGVVGAVGFIPLDFVLPVIMYNIALAPPRRSTLYIANTVIMVVFTGVGAIGAFASIRKLVLDAGQFKLFSNNVVD

SEQ ID NO: 3271 - DNA, 1875 bp, Triticum aestivum
  misc_feature (1)..(1875): Ceres cDNA ID no. 21572795
  misc_feature (1)..(1875): Ceres CLONE  ID no. 929855
  misc_feature (1)..(1875): Also known as  Ceres CDNA ID no. 24357627
acatcgatcctcacatgcgaggacaaggctagacctccaagaaaaacaaaatgccgatcccccagatccactggcagctcctcccacaggtccagctgccccaacaatggcggcagctcctcctcggcctcggcctcctgctgcctgtcctggttctgatagtgaggcgcaggaaagggttcaagctgccgccgggaccggcgcggctgccggtgctaggcaacctgcaccagctgggctcgctcccgcaccggagcctgcgggagctggcgcggcggcacggtcccgtgatgctgctgcgcctgggcgccacgcacatgctggtggtgtcgtcggcgtcggcggcgcgtgaggtgctcaaggagcacgacgccgactgctgcagccggccggcgtgccccggcccgaagcggctctcctacgggttcaagaacatggcgttcgctccctacggcgagcactggcgcgagatgcgcaagatcttcatcgtggagctcctcagcatgcgccgcgtcaaggccgcctggggcgcgcgccaggagcaggtggacaagctcatggccgccctcgccccagacgagccggtggcgctcggcgagcacatcttcgccttcaccgacggcatcatcggcaccgtggcgctcgggaacgtctacggcgcggacatgctggcgcgcaagaagcacttccagcacgtgctcgacgaggccatggacatgctcgccaccttctccgccgaggacttcttccccaacgccgccggccgcctcgtcgaccgcctcaccggcctcgtcgcgcgccgtgaccggctcttcagcagcctcgacgacttcttcgagacggtcatcgagcagcacctggaccccgcgaggcccaagccggagaacggcggcgacctcgtcgacgtcctcatcgacctctggaagcaggagcaccgtggcttcaccaaggaccacgtcaaggccatcatcatggacactttcgtgggtggcatcgacacgagctcggtgacgatcctgtgggccatgtcggagctgatccggaacccgcgggtgatgaagaaggcgcaggaggagatcagggcggcggtgggcgagcagcgcgcccgggtgcagccggacgacctgcccaagctcaactacctcaagatggtcctcaaggagacgctgaggctgtacccgccggcgacgctgctgctgccgcgcgagacgatgcggcacgtcaggatcggcggctacgacgtgccggcggggacgagggtcgccgtcaacgcgtgggccctcgggagggacccggcgagctggggcgaggacgccgacgagttcaacccggacaggttcgaggccggagcgaggcacggcgaggtggacctccacggcgcgcacttcgagctggtgccgttcggcgccgggcggcggatctgcccgggcatggctatggcgctgatgaacgtggagttcgcgctggccaacctgctgtgcggcttcgactgggcgctgccggaggggaccaaggcggaggacctgtgcatggaggaggccggcgggctcaccttccaccgcaagacgccgctcgtgctcgtgcccaccccgtacgtgccgccctccgccgcttaattaattccgcgtcaactccgtcagctgcgtcgtgatcgaaagttttaaaccggccaatcagtttgtcgctacccaggtttggccatatgctgaatatcccagcgtcggctcagtttcagcataaatttgttgctttatcctgctgcaagtcagtattttgtttgtttgtttgtactacttgtctcgacctctggggcaaaatgtattcaaggaataaaattggcagctatgttatctggacctaaaaaaaaaaaaaaaa

SEQ ID NO: 3272 - protein, 521 aa, Triticum aestivum
  misc_feature: PFam Name: p450; PFam Description: Cytochrome P450
  misc_feature: GI Number: 5915841; NR Description: Cytochrome P450 71E1 (4-hydroxyphenylacetaldehyde oxime monooxygenase) >gi|7430623|pir||T14640 cytochrome P450 CYP71E1 - sorghum >gi|2766452|gb|AAC39318.1| cytochrome P450 CYP71E1 [Sorghum
  misc_feature: GI Number: 34897434; NR Description: putative cytochrome P450 [Oryza sativa (japonica cultivar-group)] >gi|27573338|gb|AAO20056.1| putative cytochrome P450 protein [Oryza sativa (japonica cultivar-group)]
  misc_feature: GI Number: 37788136; NR Description: cytochrome P450 protein
  misc_feature: GI Number: 28392854; NR Description: putative cytochrome P450 monooxygenase [Arabidopsis thaliana] >gi|38503391|sp|O65788|C722_ARATH Cytochrome P450 71B2 >gi|4850391|gb|AAD31061.1| Identical to gb|D78605 cytochrome P450
  misc_feature: GI Number: 50897236; NR Description: At3g26210 [Arabidopsis thaliana] >gi|11994440|dbj|BAB02442.1| cytochrome P450 [Arabidopsis thaliana] >gi|13878383|sp|Q9LTM0|C72N_ARATH Cytochrome P450 71B23
MPIPQIHWQLLPQVQLPQQWRQLLLGLGLLLPVLVLIVRRRKGFKLPPGPARLPVLGNLHQLGSLPHRSLRELARRHGPVMLLRLGATHMLVVSSASAAREVLKEHDADCCSRPACPGPKRLSYGFKNMAFAPYGEHWREMRKIFIVELLSMRRVKAAWGARQEQVDKLMAALAPDEPVALGEHIFAFTDGIIGTVALGNVYGADMLARKKHFQHVLDEAMDMLATFSAEDFFPNAAGRLVDRLTGLVARRDRLFSSLDDFFETVIEQHLDPARPKPENGGDLVDVLIDLWKQEHRGFTKDHVKAIIMDTFVGGIDTSSVTILWAMSELIRNPRVMKKAQEEIRAAVGEQRARVQPDDLPKLNYLKMVLKETLRLYPPATLLLPRETMRHVRIGGYDVPAGTRVAVNAWALGRDPASWGEDADEFNPDRFEAGARHGEVDLHGAHFELVPFGAGRRICPGMAMALMNVEFALANLLCGFDWALPEGTKAEDLCMEEAGGLTFHRKTPLVLVPTPYVPPSAA

SEQ ID NO: 3273 - DNA, 1550 bp, Triticum aestivum
  misc_feature (1)..(1550): Ceres cDNA ID no. 21572796
  misc_feature (1)..(1550): Ceres CLONE  ID no. 929905
  misc_feature (1)..(1550): Also known as  Ceres CDNA ID no. 24357685
tccccaaatcagtccaatccctagctcctctaacgcaagccgccgccggtcgcctcttccacgccgccgccggacgctcccccctttctcctccgctgctcaacctccacggctccacggccacgggcacggctgcacggccgcctcctccttcacacaaagcttgctctagagcatgtgcgtgagcagggcatgtggtgtgaagaggccaagttgaggccgagaggagccagccgtgttcttgtgctctttttcgagtattacaccggagatgggtcgcaagaggaagagcacaatgggtggaaagactccaccgtcaaagggccggccttgctgcaagtcggtggcggtgcccagtctagttgccgtagaggcgccggagccggtggcagcgtccaacgcaatggtgccacatcatcagccaaaaggaggaccagggctactcaaacaagcctgcagtgcagtcgcggtatctgcggcgaaggaaaaggtggtgaagctcgacttagatgttccgatgagggtgctaaactgcgacgtgtgctatggcctcctgaaggctcccatcttccagtgctcccttctgcggcacgtcgcgtgcaggtcctgcagtgagttccacggcggcaagtgccgtccttgtgcagacttggccgcctccgctgtctacgtccagagctcctacctggacaccctattcggctacatcaaggaggcctgcccgtacaaaaagtacggctgcacaagcactattgtcataggtgacctggcggcggcgcacagagccacatgcgagttcgagccctgttggtgcacgaggtgctctttcaagggctcgccggcggacctcgtgagccacttcacgctcacgcacgcctggtccgcccacaagttcacatacggccaagactacatatacaacaccgacgagatggattcgtcgtttgtgtacaccgacaagatggattcgtggatggtgcgctatgaactctttctcggggaggacggtggcgtgttcctattggtcgtggaccttgctccgttcttccaggagttccctttccccttggtgacccttgtgtgtgtcaggaatagcgctgctgctgccgctgggccggtgtacacctactcggtcagggcggatgcccctcctgctcagaggcgcaagctgaagctggaaattaaggaggtggcgagctgcccggactggaggatggagcgtgactgtttcactgcttccggggatgctgcgtgaggaaaaaaccagcaagagtgtccttgtgcgcatctgcgttagcaagagcgagagcagcagcgcgtcatgctcaagttagaggggcatcagaaatgcagttatctttgcgtgaatccgagaagaatgtgtagtttcgtagtactactagttaagccgtttcaagtcattgagatgtgtctttttgtattcttgattgatgaaagacttgaatttcctcctgttcggctgctcgatggaggatggctaaaatgtgtaagagtggcagggtgttgccttgaaaaaaaaaaaaaaaaaa

SEQ ID NO: 3274 - protein, 327 aa, Triticum aestivum
  misc_feature: PFam Name: Sina; PFam Description: Seven in absentia protein
  misc_feature: GI Number: 34895400; NR Description: P0445D12.7 [Oryza sativa
  misc_feature: GI Number: 34895408; NR Description: P0445D12.12 [Oryza
MGRKRKSTMGGKTPPSKGRPCCKSVAVPSLVAVEAPEPVAASNAMVPHHQPKGGPGLLKQACSAVAVSAAKEKVVKLDLDVPMRVLNCDVCYGLLKAPIFQCSLLRHVACRSCSEFHGGKCRPCADLAASAVYVQSSYLDTLFGYIKEACPYKKYGCTSTIVIGDLAAAHRATCEFEPCWCTRCSFKGSPADLVSHFTLTHAWSAHKFTYGQDYIYNTDEMDSSFVYTDKMDSWMVRYELFLGEDGGVFLLVVDLAPFFQEFPFPLVTLVCVRNSAAAAAGPVYTYSVRADAPPAQRRKLKLEIKEVASCPDWRMERDCFTASGDAA

SEQ ID NO: 3275 - DNA, 1261 bp, Triticum aestivum
  misc_feature (1)..(1261): Ceres cDNA ID no. 21572797
  misc_feature (1)..(1261): Ceres CLONE  ID no. 933722
  misc_feature (1)..(1261): Also known as  Ceres CDNA ID no. 24412250
acttagttttctcgtgtcttcctgggcagatgttgccgtccctctgacttcgtttctggtcttatccttcctccctgctgctgctcctccaagcccatcctttcatctccgtcgcaatgccgtcttcaccaccatactcgtgtcgcggctcgatctgctgctcccgagcgcagccacctcgtccccgaccccgagctcccctgccttcttttccccgtcatctccgtgttcccttcttctctatttcacccgtttactcacatctccctctatctctcttgctttctattacagggaggccgccatggacgcctaggtcctccactccaagcctccgacccacaccccggcggccctgccgacgtcgacgcctaggtgagcagctggtgcaccctgacgttgccccgcctcctctctccctctctatctctcccctgtctctctctcaaccctctctcttttcttcaacaggaagactaccatgctcgctgcaggagcttcgagccgaccccgcagcatgtagacctccgccgcccgtccgtcgtggggaatcaccagatccggccggtatccgacctgcctcgccatccttcgcccgttcccggcgtatccccgacgccaggagctcaggcgagcgccgccacaagactctgcctcctctgctccggagcccgccatggaggtcgtcgcctctccgcctcgatctgtccactgccagatccatgctgctgtcctcctgggatcctcatatggaggttaccgcccctcccgtctcgatccttccgccgtcggatccacggcggagcagccgagatctgccgcccgttcggcgacgcctcggcccgccaaggccagcgccgaggctgacaaggcgcgcaggaaggccaagggcctcgccaagcagcgggaggacttgcgggctaggctcgccagccgcaagcgcgcgggcgcgagctcgcccccgtgccggccaaggccaccttcggcgaattcctgtccgccgtgctctcgaacgcctgccacgatgccagggtcttttttgcaaaaacgaaacgttatcttaggaacacacttagaataggactgcggtttaaattctcaggaataggaggacttttctgcaaatcgctagcgacgacctcttcctaagtgctagctttttttttttttttttgaggaaatcctaagtgctagctatggtagccaaataggcaacgcgcccgaatgtgtttttttttttgaggaaaaaaaaaaaaaaaaa

SEQ ID NO: 3276 - protein, 315 aa, Triticum aestivum
MPSSPPYSCRGSICCSRAQPPRPRPRAPLPSFPRHLRVPFFSISPVYSHLPLSLLLSITGRPPWTPRSSTPSLRPTPRRPCRRRRLGEQLVHPDVAPPPLSLSISPLSLSQPSLFSSTGRLPCSLQELRADPAACRPPPPVRRGESPDPAGIRPASPSFARSRRIPDARSSGERRHKTLPPLLRSPPWRSSPLRLDLSTARSMLLSSWDPHMEVTAPPVSILPPSDPRRSSRDLPPVRRRLGPPRPAPRLTRRAGRPRASPSSGRTCGLGSPAASARARARPRAGQGHLRRIPVRRALERLPRCQGLFCKNETLS

SEQ ID NO: 3277 - DNA, 1417 bp, Triticum aestivum
  misc_feature (1)..(1417): Ceres cDNA ID no. 21572798
  misc_feature (1)..(1417): Ceres CLONE  ID no. 933725
  misc_feature (1)..(1417): Also known as  Ceres CDNA ID no. 24357468
ttttccaaagcaacacatagcaaccacacactcatcaagagaacggaacagagaaggagagggtccgggagagcgatggcggctcaggcagacaccattgaagttccgacggacgctgagttgctgcaggcgcaggctgacctgtggcgccacagcctctattacctctcgtccatggggctccggtgcgccgtccagcttgggatcccgaccaccatccaccgcctcggcgggttcgcttcgctgcccgacctgatggctgagctgtcccttccatcagtaaagatgccgtttctcagccggctcatgcgcgtgctcgtcgcgtcgggggtcttcgcagccgacaaagactccgagtccggcggggagctctaccgcctcaccccgctgtcccgcatcctggtggacggcgtcgacgcggatgagcaccacatccaaaagtatttcgtgcttggagtgacctcgccgcattgcgcggaggctgcgttggggctggccgactggttcaagaaggaccttgagccaccagtgccgtctcctttcgaggacttgcatggcgccccaatctttgatgagagaacacccctcatggatgaagagtttgacgccgttgccaaccaaggcttggctgcccacgacaacctggggattgcaaccatacttcgcgagtgcggtgacatcttcaagggacttgagtctctgattgactgctgtggtggcgatggtacgacggcgagggctctcgtcaaggcttacccgcacatcaagtgcaccgtgctggaccttccgaaggtgatcgacaaagccccaactgatggcgtcgtttactatgttgcgggtgacctgttccacaccgtcccatcttctcaagccgtgatgctcaagcttgtgctacacttttggagcgacgaggattgtgtaaaaattttaacccagtgcaagaaggccattcctccacgcgacgagggaggaaaggtgattatcatagacaccgtgattggaccttccttagcaccaataatgtttgaagcccaactcttgatggatatgctcatgatggtgaacacaagaggagcccaacggagtgaaaatgactggcgcaagctattcgtggaagcagggttcaaagactataaaattgtgaagaagctgggggctcgatgcgttatcgaggtctacccctaagatgttgcgctctaaggatatgaataaaagtggtgcttgtttttctaaatgatagcttcatggttcttataaagtagctcaagtgtttgaatcagatgccttaagatcaatgtaaagttcatttagagaagtactaaacactctctctctctctctcttgtgtgtgtgtgtgtgtgtgtgttcagtttttaccatgtcggtgtgtttcaagcctccaaaaaaaaaaaaaaaa

SEQ ID NO: 3278 - protein, 369 aa, Triticum aestivum
  misc_feature: PFam Name: Methyltransf_2; PFam Description: O-methyltransferase
  misc_feature: PFam Name: Dimerisation; PFam Description: Dimerisation domain
  misc_feature: GI Number: 62734415; NR Description: O-methyltransferase
  misc_feature: GI Number: 62734422; NR Description: O-methyltransferase
  misc_feature: GI Number: 62733074; NR Description: O-methyltransferase [Oryza sativa (japonica cultivar-group)] >gi|62734545|gb|AAX96654.1| O-methyltransferase [Oryza sativa
  misc_feature: GI Number: 27777630; NR Description: O-methyltransferase
  misc_feature: GI Number: 62732812; NR Description: O-methyltransferase
MAAQADTIEVPTDAELLQAQADLWRHSLYYLSSMGLRCAVQLGIPTTIHRLGGFASLPDLMAELSLPSVKMPFLSRLMRVLVASGVFAADKDSESGGELYRLTPLSRILVDGVDADEHHIQKYFVLGVTSPHCAEAALGLADWFKKDLEPPVPSPFEDLHGAPIFDERTPLMDEEFDAVANQGLAAHDNLGIATILRECGDIFKGLESLIDCCGGDGTTARALVKAYPHIKCTVLDLPKVIDKAPTDGVVYYVAGDLFHTVPSSQAVMLKLVLHFWSDEDCVKILTQCKKAIPPRDEGGKVIIIDTVIGPSLAPIMFEAQLLMDMLMMVNTRGAQRSENDWRKLFVEAGFKDYKIVKKLGARCVIEVYP

SEQ ID NO: 3279 - DNA, 1354 bp, Triticum aestivum
  misc_feature (1)..(1354): Ceres cDNA ID no. 21572799
  misc_feature (1)..(1354): Ceres CLONE  ID no. 934534
  misc_feature (1)..(1354): Also known as  Ceres CDNA ID no. 24360430
gagtcagtgactcagtgagtgacgcgacgcgcttgcccgtacgctgccagtccgcctgagatatttctctctctctctctctctctctctctctctctctctggggtgagggtgagggactgagggtagaccgcgggtgcccgtgatgctgctgcggagcgcgtcctcgccgctgctcaacgcggcgcgcgtgccggcggccgcggcggtggagcatgtactgggccacgggcacctcgcggtggcgtcgccggcggggcatcacgggccgaggcagcagggggcgctgtgccgcgcattgtccgaggccgatctgctggcgccggtgcagctcccggccgcctccgccttcctcgaggagttggacgaggaggaggcgcagcaggaggacgaggacgtggtcgcggtcggggtggcggccgtgccgctgcgccggctgctgacgagcacggggctggacgccgcgggggaggaacaggaggccggcgccggcggagccctggcgctcctcgagggcgtcgggggaggcggcgggcgcgggagggtgtgcggcggctggcagggcggccgcggaggagacggggacggcgacggcgacggaggtgaccgcggcgccaccgacgcgcactaccggcggatgatcagggccaacccgggcaactcgctgccgctggggaactacgccaggttcctcaaggaggtgcagggggacgcggcgagggcgcaggagtactgcgagcgcgccatcgtcgccaaccccggcgacggcgacgccctggcgatgtacgcgggcctcgtctgggagaccagccgcgacgctgagcgcgccgacgcttactacagccgcgccgtccaggccgcgcccgacgactgctatgtcctgggatcctacgccgggttcctgtgggacgccgaggaggaagacggtctcaacgacgggcagcctccggcggggtcgccgccgttctatggggcagcgcagccatcctccatcagagcggcttcttagacgaagaatcaatctcactaccagtaaacaaactacatctggaactctgcaaggaagagcgacatgccacgatcacagcggcctctgagggaggccgccaccgccgtcgccggccgggacgcggcagcttgtaaactgaataaaccaagtccggctacctgtgtgagcagtacgcttctaaggttggtaggatctgcagcactgcaggataaatatgtagcctaataaggttttgctgtgcctgtacatgtagaatgttcctgataacatggtgtacgtggtgtatgtaccacttgtgaattacagtaaatgccagaaccgattgccccaaaaaaaaaaaaaaaa

SEQ ID NO: 3280 - protein, 287 aa, Triticum aestivum
  misc_feature: PFam Name: HlyD; PFam Description: HlyD family secretion protein
  misc_feature: PFam Name: GRP; PFam Description: Glycine rich protein family
  misc_feature: PFam Name: Peptidase_S8; PFam Description: Subtilase family
  misc_feature: PFam Name: eIF-4B; PFam Description: Plant specific
  misc_feature: PFam Name: Bindin; PFam Description: Bindin
  misc_feature: GI Number: 21592868; NR Description: unknown [Arabidopsis thaliana]
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66776103; NR Description: LigA [Anaeromyxobacter dehalogenans 2CP-C] >gi|66858140|ref|ZP_00402169.1| LigA
  misc_feature: GI Number: 21555875; NR Description: unknown [Arabidopsis thaliana]
MLLRSASSPLLNAARVPAAAAVEHVLGHGHLAVASPAGHHGPRQQGALCRALSEADLLAPVQLPAASAFLEELDEEEAQQEDEDVVAVGVAAVPLRRLLTSTGLDAAGEEQEAGAGGALALLEGVGGGGGRGRVCGGWQGGRGGDGDGDGDGGDRGATDAHYRRMIRANPGNSLPLGNYARFLKEVQGDAARAQEYCERAIVANPGDGDALAMYAGLVWETSRDAERADAYYSRAVQAAPDDCYVLGSYAGFLWDAEEEDGLNDGQPPAGSPPFYGAAQPSSIRAAS

SEQ ID NO: 3281 - DNA, 1372 bp, Triticum aestivum
  misc_feature (1)..(1372): Ceres cDNA ID no. 21572800
  misc_feature (1)..(1372): Ceres CLONE  ID no. 935509
  misc_feature (1)..(1372): Also known as  Ceres CDNA ID no. 24357606
taacccatgcctaagatgaggccacgcaccttccaccacatgacgcacacgatctgaaaccgccaaaaataaaaaacgcctttttcgctctcgagctcttcttctctactgctctccccctttcccccattccccgccgctacccgcgtccgcgcgagcaaacgccggctcaacaggcctctccaatcagtgggcgctgctacgtgggctcgtcaaagtttttgttgccgcgaggggcaggaaggcgctgctttggaacccatcttacacctggtggaagtggtggtggtggtggccggtggacaccatgagctttgtgttccggggcagcagggccgacatcgaggccggtggcttcccagggttcgccacggagcgccgtgccatgcggattcatgccggggggcggccggtgaacagcaattccttagcttttcttgtaactgttcttgttctgttcatggtactgagctcgcaccagatgtctccgaactttttgctttggatggtcttaggtgtgttcctattggccaccagccttaggatgtacgctacatgccagcagctccaagcgcagtctcaagctcatgctgcagacggcaacggcttccttggacgcacagagttgcgggtgcatgtcccgccaaccatagcccttgcttcgaggggccggttgcaaagccttagactccaacttgctctgcttgaccgcgagtttgatgatttagattatgatgctctcagagcgctagataccgacaatagcccacatgctccttctatgactgaagaagaaataaatactctgcctgttttcagatacaaacttcaggcgcagcagaggagcaccccttatcgaaatagtgacgggccatctgaaccattggtttcttctcctgaatccggcaaggagaaaaagcaagacgcagatgcaacaagcaaaatgacagaggatgagttgacgtgcagtgtttgcttagagcaagttgtggcgggtgatctattgagaagcctgccatgcttgcatcggtttcatgtgaactgcattgatccatggttgcgccaacaaggaacatgcccgatctgcaagcaccaggtcagcgacgtgtggcgtggcgccggcagcggtggtgaaatggatgccatggtgtaacatgacatgagcttcagttcttaacctaatattactaggcggtagtactaaaggaaaacccatggaatcggggacgagctgtttagtcctgccgagagtttctgtacatgatgtgttcccagttccttcctctgtgatgtttatgcatccaaaggttgttgctattttcttgttgagttttatttaccctgccgatcaagatcaaaaaaaaaaaaaaaa

SEQ ID NO: 3282 - protein, 281 aa, Triticum aestivum
  misc_feature: PFam Name: zf-C3HC4; PFam Description: Zinc finger, C3HC4
  misc_feature: GI Number: 50915420; NR Description: RING zinc finger protein-like [Oryza sativa (japonica cultivar-group)] >gi|47497169|dbj|BAD19217.1| RING zinc finger protein-like [Oryza sativa (japonica cultivar-group)] >gi|47497754|dbj|BAD19854.1|
  misc_feature: GI Number: 61827115; NR Description: PREDICTED: similar to
  misc_feature: GI Number: 61882623; NR Description: PREDICTED: similar to
  misc_feature: GI Number: 50355735; NR Description: putative C3HC4 type RING
  misc_feature: GI Number: 61885839; NR Description: PREDICTED: similar to Ubiquitin ligase protein DZIP3 (DAZ-interacting protein 3) (RNA-binding ubiquitin ligase of 138 kDa) (hRUL138), partial [Bos
MSFVFRGSRADIEAGGFPGFATERRAMRIHAGGRPVNSNSLAFLVTVLVLFMVLSSHQMSPNFLLWMVLGVFLLATSLRMYATCQQLQAQSQAHAADGNGFLGRTELRVHVPPTIALASRGRLQSLRLQLALLDREFDDLDYDALRALDTDNSPHAPSMTEEEINTLPVFRYKLQAQQRSTPYRNSDGPSEPLVSSPESGKEKKQDADATSKMTEDELTCSVCLEQVVAGDLLRSLPCLHRFHVNCIDPWLRQQGTCPICKHQVSDVWRGAGSGGEMDAMV

SEQ ID NO: 3283 - DNA, 1701 bp, Triticum aestivum
  misc_feature (1)..(1701): Ceres cDNA ID no. 21572801
  misc_feature (1)..(1701): Ceres CLONE  ID no. 935972
  misc_feature (1)..(1701): Also known as  Ceres CDNA ID no. 25892747
cgatgagctgagggtgaaagaagagaccagcgctgccacatggtgcttcctattcgaccagttgaggatggatcgattagttcatgggttgaaagggagggcgaaagaacagaatactccaggccacaacttctggaggacatctggtgtcatatacattccctactaccaatgcgagatgctgcccgagctgcttgcgtgtctcgtgcctttctaagtttatggagatgccatccaaatcttacattcagtatggaagcactgggcatgaatatgaatccgtgtggagaggatgaaataggaaatttcaccaaaaaagttgaccacatcttaaaaaaccgctcacgcattggtgtgaagacactcaggattgttttccgttattccaatgccatggtcagcaatgttgataggtggcttcagacagctgttacacctgagattgaagaactcactgttcagcttacacctgggattgaagaactcactgttcagcttacacctgggattgaagtactcactgttcagctatcttcagcatcgggaacatactacaacttcccatggtctcttttagctaatgggaatggaaactcgatgcagcatctacgcctttcccattgtgttttctctcccagcgttgaacttggcttaaaaaagatgacaaggattgatttgtgttatgtctgtatcacagaggagcagctggggtgccttcttcacaattgctttgttctccaatggatgcgactctcacaatgcagtccgctaacttgccttaagattccgttccatctgcaacagctcagatacctgaaggtgtttgaatgcaggtctctacaggtgatagggatagaagctccaaacctcgtcagttttaattttcatgattcccaccaggtacagatatcatttgaagtagcattgcaattgaagaagctcggcatgtcccatcctggtgctgtatgttatgctcgtgctgatctcccattgagcttgccaaatgttgaagatctttccctgagttcatgtagtgagatggtcgatacaccaatgctgcctagcaaattcttacacctcaagtacttgagtgtcagtctttgtacagtgacattttcgccggcctatgactattgttctctcatatccttctttgatgctgctccttccttggagactttcttcgtgaatgtgttgcagaaagacatgaagcatgagtcaatcgtgggagaccattcaaatttgaggcaggtaccaggacaccgccatgataaccttaagacagtgaagatcatcggtttctcctcggcgaagagcttggttgagctgacatgccatatcattgagaatgcgacgtcactcgaatgccttacattggacacgacacgagggcatccttgggccagctgctcatccaacagtactggcaagtgcttgctgttgcacttggactttttggcggaagctcgtaaggggctctcggctatcaggacatatgttgagccaaaggttccctccagagtcaagctaaatgccgtggagccttgccgccgatgccatgacctcgagccgacgccatgatctcaaactctagatgcgacatgttgctatgtatggtcagaagcaaaccgttgccaatgttcagaaagactagtgtgttgttccaagagctgtatttttccttgaaaaaaaaaaaaaaaa

SEQ ID NO: 3284 - protein, 513 aa, Triticum aestivum
MVLPIRPVEDGSISSWVEREGERTEYSRPQLLEDIWCHIHSLLPMRDAARAACVSRAFLSLWRCHPNLTFSMEALGMNMNPCGEDEIGNFTKKVDHILKNRSRIGVKTLRIVFRYSNAMVSNVDRWLQTAVTPEIEELTVQLTPGIEELTVQLTPGIEVLTVQLSSASGTYYNFPWSLLANGNGNSMQHLRLSHCVFSPSVELGLKKMTRIDLCYVCITEEQLGCLLHNCFVLQWMRLSQCSPLTCLKIPFHLQQLRYLKVFECRSLQVIGIEAPNLVSFNFHDSHQVQISFEVALQLKKLGMSHPGAVCYARADLPLSLPNVEDLSLSSCSEMVDTPMLPSKFLHLKYLSVSLCTVTFSPAYDYCSLISFFDAAPSLETFFVNVLQKDMKHESIVGDHSNLRQVPGHRHDNLKTVKIIGFSSAKSLVELTCHIIENATSLECLTLDTTRGHPWASCSSNSTGKCLLLHLDFLAEARKGLSAIRTYVEPKVPSRVKLNAVEPCRRCHDLEPTP

SEQ ID NO: 3285 - DNA, 1669 bp, Triticum aestivum
  misc_feature (1)..(1669): Ceres cDNA ID no. 21572802
  misc_feature (1)..(1669): Ceres CLONE  ID no. 937096
  misc_feature (1)..(1669): Also known as  Ceres CDNA ID no. 25088346
attcatcccggacaaacacttcccaaccccgaccaaccgcatccaccacgcacgcaagctagccggcccactgtgctacgtacgtacgccaccatgagcgccgccgcccaagaaaccacggccggcggcggcggcgatggcaagcgtcagggaccttgccgcccgggacacctcaagcttggctaccacatcgtcgtgtccgtcgccacggccctcgcgacggtctacctcgcgcggcggccgcgcgcggtgtacctgctagacttcgcgtgctacaagcccgggcccgaccacgtggtcacccgggagaccttcatgaagcagtccagcaaggccggggtgttcaccgacgacaacctggcgttccagcggaagatcctggagcggtcggggctcgggcaggggacctacttcccggcggcggtgctcaactcgccccctaacccgtgcatggcggaggcgcggcgggaggcggaggctgttatgttcggcgccatcgacagcctgctcgccaagacaggggtgcgggccagggacatcggcgtcgtggtcgtcaactgcagcctcttcaacccgacgccgtcgctctccgccatggtcgtcaaccactataagctccgcggtaacgtcgccagctacaacctcggcggcatgggatgcagcgccgggctcatctccatcgagctcgccaagcagctgctccaggtccaccggaactcgtacgcgctggtggtgagcatggagaacatcacgctgaactggtactggggcaacgaccgctccatgctcatgtccaactgcctcttccgcatgggcggcgcggcgatcctcctcagcaaccgcgccgccgacaagcgccgctcaaagtaccagctcgtgcacaccgtgcggacgcaccacggcgccgacgaccgcgcctaccgctgcgtgttccaggaggaggacaaggccggccgggtcggcgtcgcgctctccaaggacctcatggccgtcgccggcgaggccctcaagaccaacatcaccacgctcgggcccctcgttctccccatgtccgagcagatccttttcctcacctctctcatcggcaagaagatctttggcctcaagatgaagccctacattccggacttcaagatggcgttcgagcacttctgcatccatgccggcggcagggcggtgctggacaccatcgagaagaacctggagctcagtgactggcacatggagccttcaaggatgacgttgaaccggtgggggaacacgtccagcagctcgctctggtacgagcttgcgtacacggaggccaagggacgcgtccggcgcgggcaccgtgcgtggcagatcgccttcgggtcagggttcaagtgtaacagcgcggtgtggcgcgcgctcaaagacattcacccgtcaaaggaagcgggcagcaacccgtggattgaggagatccaccggttcccggtcgaggtgcccaaggtggagagcgtcgtttcatcgccatgatagactcgtcaaggtcgagtaccaatggttttctagaaaagaatctttcttttcaagttgaaaggtatctgttgaattatttgtatcattgtgatgtagcatcaagttaattgatggtttgtagctcaattgatatggaacttcaattggtgcaaaaaaaaaaaaaaaa

SEQ ID NO: 3286 - protein, 468 aa, Triticum aestivum
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: PFam Name: Glutenin_hmw; PFam Description: High molecular
  misc_feature: GI Number: 53850553; NR Description: At1g04220 [Arabidopsis
  misc_feature: GI Number: 20334738; NR Description: At1g68530/T26J14_10 [Arabidopsis thaliana] >gi|17979464|gb|AAL50069.1|
  misc_feature: GI Number: 23506207; NR Description: At2g26250/T1D16.11 [Arabidopsis thaliana] >gi|12597467|gb|AAG60062.1| putative beta-ketoacyl-CoA synthase FIDDLEHEAD [Arabidopsis thaliana] >gi|3559809|emb|CAA09311.1| fiddlehead protein [Arabidopsis
  misc_feature: GI Number: 32172502; NR Description: FAE1 [Marchantia polymorpha]
  misc_feature: GI Number: 32172500; NR Description: FAE3 [Marchantia polymorpha]
MSAAAQETTAGGGGDGKRQGPCRPGHLKLGYHIVVSVATALATVYLARRPRAVYLLDFACYKPGPDHVVTRETFMKQSSKAGVFTDDNLAFQRKILERSGLGQGTYFPAAVLNSPPNPCMAEARREAEAVMFGAIDSLLAKTGVRARDIGVVVVNCSLFNPTPSLSAMVVNHYKLRGNVASYNLGGMGCSAGLISIELAKQLLQVHRNSYALVVSMENITLNWYWGNDRSMLMSNCLFRMGGAAILLSNRAADKRRSKYQLVHTVRTHHGADDRAYRCVFQEEDKAGRVGVALSKDLMAVAGEALKTNITTLGPLVLPMSEQILFLTSLIGKKIFGLKMKPYIPDFKMAFEHFCIHAGGRAVLDTIEKNLELSDWHMEPSRMTLNRWGNTSSSSLWYELAYTEAKGRVRRGHRAWQIAFGSGFKCNSAVWRALKDIHPSKEAGSNPWIEEIHRFPVEVPKVESVVSSP

SEQ ID NO: 3287 - DNA, 1175 bp, Triticum aestivum
  misc_feature (1)..(1175): Ceres cDNA ID no. 21572804
  misc_feature (1)..(1175): Ceres CLONE  ID no. 1328518
  misc_feature (1)..(1175): Also known as  Ceres CDNA ID no. 23734842
acatccatccacatgcgccaaacacctcaacgatccagctagtgtctgttaactcttaagtggccggccacctccagagtccagcaacagacaccccctagctacgtcctctttggtttggtttggtttcgaccccggtctcgaagctctccctcttcatattaatctccccccgataccagcagctagtagcactagagtagacatcgccttctctgctcgatctattcctgcaagtagctcctactgctagtcaagatgctgcacgaggcggcgccatgcacgtgcgggctgctctacggcagctgcggcggcggctgctccatgctgttcgccgcggcgccgggggaccaccactactacatcaagcaatgcggcgacgacggctcctacgcctcctacggcggctccgtcgactgcacgctctcgctcggcacgccctccaccaggcgcgccgaggccggggtccgcgcgccggcggccgggctgccgtgggaggcagtgcccagctgcaacggcaggcaggatatcggcccggcgcgcgctgatcagagcaatgccggcgccgcgtccgctcgccggtgcgccaactgcgacaccacctccaccccgctctggaggaacgggccacgcggaccaaagtcattgtgcaatgcgtgcggaatccggtacaagaaggaggagaggcgcgcggcggcggccgcggtggcgccgacggcgcttgcatcggacagcggcatcgagtacgcgtacgggtacgcgcggcaccaccaccaccagcagcagcagcagcagcagtgggggtgctacggcccggccgtggcgaaggcggcgtcctacgggctgttcggcgacgcggcggcggaggacgggccgtgcctgccatgggggctcggcgtcatgccctcgtcgccggcgttcgggtccgtccgggagatgacaagcctgttccagtactactagccatagccatagccatagctcgctcgctctctagggactttctttccttccttctccccttttaagtaacaaagaagatgctgtggtacttctttttgagggcaggcaagatgctgtgcttgaccaacgacccggctgcggctgcatgaaagttgaagctgaaatgaaatggatcactccccgatttctttccaacaaaaaaaaaaaaaaaa

SEQ ID NO: 3288 - protein, 1175 aa, Triticum aestivum
  misc_feature: PFam Name: GATA; PFam Description: GATA zinc finger
  misc_feature: GI Number: 34912080; NR Description: P0671D01.19 [Oryza sativa (japonica cultivar-group)] >gi|20521225|dbj|BAB91742.1|
  misc_feature: GI Number: 42766602; NR Description: At4g36620 [Arabidopsis
  misc_feature: GI Number: 4006901; NR Description: transcription factor like protein [Arabidopsis thaliana] >gi|7270610|emb|CAB80328.1| transcription factor like protein [Arabidopsis thaliana] >gi|25407746|pir||D85432 transcription factor like protein
  misc_feature: GI Number: 21555178; NR Description: transcription
  misc_feature: GI Number: 4835238; NR Description: transcription factor-like protein [Arabidopsis thaliana] >gi|7488381|pir||T08408
ACATCCATCCACATGCGCCAAACACCTCAACGATCCAGCTAGTGTCTGTTAACTCTTAAGTGGCCGGCCACCTCCAGAGTCCAGCAACAGACACCCCCTAGCTACGTCCTCTTTGGTTTGGTTTGGTTTCGACCCCGGTCTCGAAGCTCTCCCTCTTCATATTAATCTCCCCCCGATACCAGCAGCTAGTAGCACTAGAGTAGACATCGCCTTCTCTGCTCGATCTATTCCTGCAAGTAGCTCCTACTGCTAGTCAAGATGCTGCACGAGGCGGCGCCATGCACGTGCGGGCTGCTCTACGGCAGCTGCGGCGGCGGCTGCTCCATGCTGTTCGCCGCGGCGCCGGGGGACCACCACTACTACATCAAGCAATGCGGCGACGACGGCTCCTACGCCTCCTACGGCGGCTCCGTCGACTGCACGCTCTCGCTCGGCACGCCCTCCACCAGGCGCGCCGAGGCCGGGGTCCGCGCGCCGGCGGCCGGGCTGCCGTGGGAGGCAGTGCCCAGCTGCAACGGCAGGCAGGATATCGGCCCGGCGCGCGCTGATCAGAGCAATGCCGGCGCCGCGTCCGCTCGCCGGTGCGCCAACTGCGACACCACCTCCACCCCGCTCTGGAGGAACGGGCCACGCGGACCAAAGTCATTGTGCAATGCGTGCGGAATCCGGTACAAGAAGGAGGAGAGGCGCGCGGCGGCGGCCGCGGTGGCGCCGACGGCGCTTGCATCGGACAGCGGCATCGAGTACGCGTACGGGTACGCGCGGCACCACCACCACCAGCAGCAGCAGCAGCAGCAGTGGGGGTGCTACGGCCCGGCCGTGGCGAAGGCGGCGTCCTACGGGCTGTTCGGCGACGCGGCGGCGGAGGACGGGCCGTGCCTGCCATGGGGGCTCGGCGTCATGCCCTCGTCGCCGGCGTTCGGGTCCGTCCGGGAGATGACAAGCCTGTTCCAGTACTACTAGCCATAGCCATAGCCATAGCTCGCTCGCTCTCTAGGGACTTTCTTTCCTTCCTTCTCCCCTTTTAAGTAACAAAGAAGATGCTGTGGTACTTCTTTTTGAGGGCAGGCAAGATGCTGTGCTTGACCAACGACCCGGCTGCGGCTGCATGAAAGTTGAAGCTGAAATGAAATGGATCACTCCCCGATTTCTTTCCAACAAAAAAAAAAAAAAAA

SEQ ID NO: 3289 - DNA, 671 bp, Zea mays
  misc_feature (1)..(671): Ceres cDNA ID no. 21572806
  misc_feature (1)..(671): Ceres CLONE  ID no. 1428643
  misc_feature (1)..(671): Also known as  Ceres CDNA ID no. 0
aaacagtactcttaactatctttagatccgatggagtcatcaccaccagcaaccaaggcagcgagaggtggaagaagaggaggagaccgcaagaagagcgtctccaagtccgtcaaagccggtctccagttccccgtcggccgcatcgctcgttacctaaagaaaggccgttacgcgatcaggtacggctccggcgctccggtctacctcgccgccgttctcgagtacctcgccgccgaggttcttgagctagctgggaacgcggcgagggataacaagaagaacaggataaacccgaggcatctttgtttggcgataaggaacgatgaggagctggggaagctgttgcacggtgtgacgatagcgagtgggggtgtgcttccgaatatcaacccggttctgcttcctaagaggactactggttcgtctcacggtgagaaagagaaagcttcttcgccggctaagaagtctcccaagaagggttgaaaacggtgtcgctttgttttgtttagggtttctctttaatgtttggtttgtgaaacctattgaagatttatgtttttatacatttgtaatgaaggaactaatttctctggttatgtttctgagtttctgtctaatcgaataaaaaaaataaaatatctttctggatcccaaaaaaaaaaaaaaaa

SEQ ID NO: 3290 - protein, 151 aa, Zea mays
MESSPPATKAARGGRRGGDRKKSVSKSVKAGLQFPVGRIARYLKKGRYAIRYGSGAPVYLAAVLEYLAAEVLELAGNAARDNKKNRINPRHLCLAIRNDEELGKLLHGVTIASGGVLPNINPVLLPKRTTGSSHGEKEKASSPAKKSPKKG

SEQ ID NO: 3291 - DNA, 1158 bp, Zea mays
  misc_feature (1)..(1158): Ceres cDNA ID no. 21572807
  misc_feature (1)..(1158): Ceres CLONE  ID no. 1436402
  misc_feature (1)..(1158): Also known as  Ceres CDNA ID no. 0
ctccttcgtctctctctctctctctctgcaaaaaggatcgtgcaaacatttcaaaaaccctagatacccaaaaagagattcggttcctaatcctctccggcgattctcctcgattgaaattgggatcacggtgagcatctcaaacctcgaatcgactcgatcgaagaggtgcaaaggtttttgtaaaactcttgtgttgagagatgagctcacaagagtcgagagcaagccgaggaatccgacggaggaaagctgtgattgatctgaatgaggtgcccagagatcacgaaggtacgacctccgcttctgtgagagaagctcctacggtggtgcctagtggtgcgtctgtaccttctcagcctgttcctacgatgattgatgtcgatgctattgaagatgatgttattgaatcatccgcaagtgcttttgctgaagctaagagcaagtcagcaggtgcacgtcggaggccgttgatggttgatgtagagtcaggtgatacgactagattgcctgccaacgtaagcaacaaacggagaaggattcctcctaatcaacctgtcatcgactgtgagcatgtccctgtagatgtgagagagtctagccctaagcctcctccaccaccaccagaggagccaaagttttcttgtccgatctgtatgtgcccgttcaccgaggagacgtcaaccaaatgcggtcacatcttctgcaagggatgtataaagacggcaatatctcgacaagccaagtgccctacttgtaggaaaagggtgactgttaaagagctgattcgagtattccttccaaccaccagatgagttgtacatcaaacagtcaccagtcaccttgtctaacagctcaacttcaattcgctttggaacattggagggacttcagtgacttggcattttagtttgaatgtttcactttattggaagagaaatgttcattgtttaagaaggccccctttcatttaatggatatcattggtaatatcggatttgtttgtttcctagttgttgttttatgtaatttaggtctctgcaaactgctcagacgatgccttactctctctgatagatgaaaaatatatatatggaagaaacaaaatttgatattgaatctcaactttgttgttgcttcctaaaaaaaaaaaaaaaa

SEQ ID NO: 3292 - protein, 203 aa, Zea mays
MSSQESRASRGIRRRKAVIDLNEVPRDHEGTTSASVREAPTVVPSGASVPSQPVPTMIDVDAIEDDVIESSASAFAEAKSKSAGARRRPLMVDVESGDTTRLPANVSNKRRRIPPNQPVIDCEHVPVDVRESSPKPPPPPPEEPKFSCPICMCPFTEETSTKCGHIFCKGCIKTAISRQAKCPTCRKRVTVKELIRVFLPTTR

SEQ ID NO: 3293 - DNA, 1234 bp, Zea mays
  misc_feature (1)..(1234): Ceres cDNA ID no. 21572809
  misc_feature (1)..(1234): Ceres CLONE  ID no. 1440437
  misc_feature (1)..(1234): Also known as  Ceres CDNA ID no. 0
aaccaaaccaaatctctccgtctcctctcgccagagcaccaccagaaccatcgccctcaaccaactcatcaatggcgtcgccggcgctgggggcggggacgccgccgttcctcaccaagacgtacgcgatggtggacgacccggagaccgacgacaccatctcctggaacgagtccggcacggcgttcgtggtgtggcgccgcgccgagttcgagcgcgacctcctccccaagaacttcaagcacagcaacttcgcctccttcgtccgccagctcaacacctacggattcaggaagataggccttgacaggtgggagttcgccaacgagtgcttcaggaaaggggagaagcgcctgctcggcgcgatacagaggcggaagggatctggcgccggggcgccgccgcccgcgatgatggcgacgccgattgcgacggcgattccgatctcgcccacgccgacgagctccggcggggacgccgcggtctcgtcgtcgccgccgcccgggctggcgctggtggccaccggcgcgatggccgagctggaggaggagaacgcgcggctgcggcgcgagaacgcgaggctggcgcgggagctcgcgcgcgcgcggcgcgtctgcgacagcgtgcggcacctcgtctggcggtatgaccacggcggggatgaagtgggggaggaggacgagaggcacggcgccgcaggcgcgaagccgatgctattcggcgtcgcgatagggaggaagaggtcgcgcgaggatgggcacgggggaggggatgaggaaaatggggcagaggaggacggcgaagacgaggaggaggagcaagaacacgacgacgacgacgagaggcacgccgcccggcgagaacaagggaaggctatgaagacggagcggtcggatctgaatgtgctttcgctgtccgtgcgggcggcggcggcggcgaggcctgacggaggctcgcgtgatcgtagcggaaaccactagtaggatctaaatccacctcgcgtgatcgtagcggaaagcactaggatctaaatggtgtaccactctagctcgcattatgacgtctttgtatcttgacgtgacaagaattgcattgctggtagcacaatgtagaatcagccaaggcgtgtagaacaaccggtagattgtttggtagttagggcctgtttggtttccatgtagacctaggattgggaaaatgagaagagttggatgccagaaaaaaaaaaaaaaaa

SEQ ID NO: 3294 - protein, 302 aa, Zea mays
MASPALGAGTPPFLTKTYAMVDDPETDDTISWNESGTAFVVWRRAEFERDLLPKNFKHSNFASFVRQLNTYGFRKIGLDRWEFANECFRKGEKRLLGAIQRRKGSGAGAPPPAMMATPIATAIPISPTPTSSGGDAAVSSSPPPGLALVATGAMAELEEENARLRRENARLARELARARRVCDSVRHLVWRYDHGGDEVGEEDERHGAAGAKPMLFGVAIGRKRSREDGHGGGDEENGAEEDGEDEEEEQEHDDDDERHAARREQGKAMKTERSDLNVLSLSVRAAAAARPDGGSRDRSGNH

SEQ ID NO: 3295 - DNA, 929 bp, Zea mays
  misc_feature (1)..(929): Ceres cDNA ID no. 21572810
  misc_feature (1)..(929): Ceres CLONE  ID no. 1447548
  misc_feature (1)..(929): Also known as  Ceres CDNA ID no. 23833709
atcaccactttcttcgttaatcgttacatttagctggccctctgtatgtagcatttgcttccccgctaagaaggcatggacctggacatcatggcgatgcccaccacgcccaaagccaccaccagcagccccgccgcgtactacgtcgccaagcctcctcctcctcctcctctgggctacgcggttcacaacaaggcggcggcggcggcctacgattcctacgacggccgacacggcggcatggtcgccaccaccaccaccacccggtcgtcctcctcggcggcgcgccaccaccaccaccaccaccaccaccagcagccggcgggagcgcgggcgctggacggggtcctgctgctgctgcgcgcggccgcgtcggtcatggcgttcgtggccgtcgcgctcgtcgcgtcctgccgccacggcgactggatggagttcgcgcgctacccggagtaccggggcctcctgggggcctccgcgctcgcctgcgcctactccgccgcgcaggccacccgtggcttccgccggatgcgcgcctccgggagagcgggtggcggcctcgcggatttcgccggcgaccaggtggtggcgtacctgctcatcacggcgtcggcggcggctctccccatcaccctccgcatgagatccgccgtactcaacgtcttcacggacgccatgacggccgccatcagcctggctttcatagcctttgcggcgctcgccttgtccgccgtgctctccgccgccgcgcaaccatactagtagcagttcgcagtacacggccacatcctcacactcattatactgctggttacaacgtgagtgatgcatcgtataaacaaccacaatacctaatgcagtcatgtaaaccacttttttttcaatataatactagcccgcaacaattttccccaaaaaaaaaaaaaaaa

SEQ ID NO: 3296 - protein, 929 aa, Zea mays
  misc_feature: PFam Name: FH2; PFam Description: Formin Homology 2 Domain
  misc_feature: PFam Name: Drf_FH1; PFam Description: Formin Homology Region 1
  misc_feature: PFam Name: Pyr_redox_2; PFam Description: Pyridine
  misc_feature: GI Number: 21553786; NR Description: unknown [Arabidopsis thaliana]
  misc_feature: GI Number: 188864; NR Description: mucin
ATCACCACTTTCTTCGTTAATCGTTACATTTAGCTGGCCCTCTGTATGTAGCATTTGCTTCCCCGCTAAGAAGGCATGGACCTGGACATCATGGCGATGCCCACCACGCCCAAAGCCACCACCAGCAGCCCCGCCGCGTACTACGTCGCCAAGCCTCCTCCTCCTCCTCCTCTGGGCTACGCGGTTCACAACAAGGCGGCGGCGGCGGCCTACGATTCCTACGACGGCCGACACGGCGGCATGGTCGCCACCACCACCACCACCCGGTCGTCCTCCTCGGCGGCGCGCCACCACCACCACCACCACCACCACCAGCAGCCGGCGGGAGCGCGGGCGCTGGACGGGGTCCTGCTGCTGCTGCGCGCGGCCGCGTCGGTCATGGCGTTCGTGGCCGTCGCGCTCGTCGCGTCCTGCCGCCACGGCGACTGGATGGAGTTCGCGCGCTACCCGGAGTACCGGGGCCTCCTGGGGGCCTCCGCGCTCGCCTGCGCCTACTCCGCCGCGCAGGCCACCCGTGGCTTCCGCCGGATGCGCGCCTCCGGGAGAGCGGGTGGCGGCCTCGCGGATTTCGCCGGCGACCAGGTGGTGGCGTACCTGCTCATCACGGCGTCGGCGGCGGCTCTCCCCATCACCCTCCGCATGAGATCCGCCGTACTCAACGTCTTCACGGACGCCATGACGGCCGCCATCAGCCTGGCTTTCATAGCCTTTGCGGCGCTCGCCTTGTCCGCCGTGCTCTCCGCCGCCGCGCAACCATACTAGTAGCAGTTCGCAGTACACGGCCACATCCTCACACTCATTATACTGCTGGTTACAACGTGAGTGATGCATCGTATAAACAACCACAATACCTAATGCAGTCATGTAAACCACTTTTTTTTCAATATAATACTAGCCCGCAACAATTTTCCCCAAAAAAAAAAAAAAAA

SEQ ID NO: 3297 - DNA, 1179 bp, Zea mays
  misc_feature (1)..(1179): Ceres cDNA ID no. 21572812
  misc_feature (1)..(1179): Ceres CLONE  ID no. 1454374
  misc_feature (1)..(1179): Also known as  Ceres CDNA ID no. 25088183
attactcacctgttcttgttggtaccaataccaatcaaacggcacccattttcccttctgttattgttgttgttttagtattattagatttccagaatagatcgtctgatgcgagtgcgtgcctctgatgactcgtaggagacggtcgcatgtacaagcttccttcaggaaagagggagtacctcctcccagatggcgagaagcatgattacgactggctcaagactcccccagcgaccccactgttcccttccctcgagatggaagccaactcatcccagatgatctttcagaaggagctgctgcctatgcttcagccactcaggacttcaaggttctcaagcaagcccgactctgcaaccgcatcgacaacgtccgaatcgcctacctccagctcctccatttctgtgactccgacagcgaggcccagctctccaccatcgaagaaaaaactcagcatagaagctcccactccatctaaacagcaggactcagcataccggatagagaagaagtccagctacacagcactggccaacaggcagcacaactcgatccctgcagccccaaccccaacagctactgccaccaaagcgtccaagaaagcagctccgggcagcaaatcccagccaccaaacgcaggcgccaagaataacgcggccagaccgggcaaggcgccgaagaacgttacgacagcgaccacgaccacggcgaagcctcggccgaatggttcttcagctggcgccgccaaggatcggaaggtggacgctggcgccgccgccaggagactgtcgtcgtgcccacgcgctgcgacgacaggcgacgacgcgcaggttacagcaacgatgaaaggaaggagcagcagagctgcggccaccggcgctcctgtggctactgcccgtaagggtgccggtgccggtgccggcgacgctgccaccgatgcggtgctgaaggggcggaggagggctggagagaaggagcagaggccgaagcttggaagccatgcgaagaagtgattgaaacatggcggtttcaggctgacgagtagatgggatgggatgggacgctatcactttttcaggaaggaacctattggtcgagtcattggaatgatcttagtcgccctaatatgtgaaaatacaagtgacttgaaagttctttgcaaaaaaaaaaaaaaaa

SEQ ID NO: 3298 - protein, 288 aa, Zea mays
  misc_feature: GI Number: 54290178; NR Description: putative
  misc_feature: GI Number: 2088658; NR Description: En/Spm-like transposon protein [Arabidopsis thaliana] >gi|25408663|pir||H84824 En/Spm-like
  misc_feature: GI Number: 11359723; NR Description: proteophosphoglycan, membrane-associated [imported] - Leishmania major (fragment)
  misc_feature: GI Number: 13592175; NR Description: ppg3 [Leishmania major]
  misc_feature: GI Number: 15801378; NR Description: putative membrane protein of prophage CP-933X [Escherichia coli O157:H7 EDL933] >gi|25497124|pir||C85693 probable membrane protein of prophage
MYKLPSGKREYLLPDGEKHDYDWLKTPPATPLFPSLEMEANSSQMIFQKELLPMLQPLRTSRFSSKPDSATASTTSESPTSSSSISVTPTARPSSPPSKKKLSIEAPTPSKQQDSAYRIEKKSSYTALANRQHNSIPAAPTPTATATKASKKAAPGSKSQPPNAGAKNNAARPGKAPKNVTTATTTTAKPRPNGSSAGAAKDRKVDAGAAARRLSSCPRAATTGDDAQVTATMKGRSSRAAATGAPVATARKGAGAGAGDAATDAVLKGRRRAGEKEQRPKLGSHAKK

SEQ ID NO: 3299 - DNA, 1220 bp, Glycine max
  misc_feature (1)..(1220): Ceres cDNA ID no. 21572813
  misc_feature (1)..(1220): Ceres CLONE  ID no. 1455626
  misc_feature (1)..(1220): Also known as  Ceres CDNA ID no. 25088184
gctcaagccaaccatccatcgtattcgtaccgcaccatggccggcgacacggcaccgcacgtcgtggaggatctcctccgcctcgtccagatcctgagtgacggctccgtcgtccgcggcgacgagtccgtcctcggcccaaaggagcccttcccggacgtccccggcgtggaatggaaggacgtggtgtaccacgcggcgcacggcctccgcgtccgcgtctacaggccgacttcggtggtggccggcggcgacaagctcccggtgctggtgtacttccacggcggcggctactgcctcggctccttcgcccagccgaccttccacgcgttctgcctccgcgccgccgccgagctcccggccgtcgtgctgtccgtgcagtaccgccgcgcccccgagcaccgcctccccgccgccatcgacgacggcgcggctttcctctcctggctgcgcggccaggccgagctcggcgccggcgccgacccgtggctcgcggagtcggcctgcttcgcccggacgttcctctccggcgtctccgcgggcgccaacttgtcccaccacctcatcgtccaggtcggctcggcgcgcctcgcggtcagccccgtgcgcatcgtcgggtacgtactcctctctgccttcttcaccggcgccgagcgcacggctgcggagacagacccgccggcggacgtgttcctgccgctggagctgtccgaccagctctggcacatgtcgcttccggttggggcgagcagggaccacccggtggcgaatccgttcgggccggagagccccaacctcgcgccggtggagctcccgccggctctcgtcgtggcgccgttgggcgacgtgctccgtgatcgctcgctgggttacgcggcgaggctcaaggacatggggaaggacgtggagcttgtcgagttcgagaggcagcagcatggcttctccgtccttcagccgttcggcgaggcggccgacgagttgatgcgagtcctcaggcggttcgtgtaccccgcccgctgagcgatgatgtgctggtgaacggatggtgatctcatgacgctgctgttcctgatgctgtgatagctgctgtttcgatgttatgaacttctgggtagaggtcagagactgtgtctgtatgttgagtgttgtgtgttggcttgcctttggatcgagcctagaaataaatctagtccatttctgattgaaaaaaaaaaaaaaaa

SEQ ID NO: 3300 - protein, 327 aa, Glycine max
  misc_feature: PFam Name: Abhydrolase_3; PFam Description: alpha/beta
  misc_feature: PFam Name: COesterase; PFam Description: Carboxylesterase
  misc_feature: PFam Name: Peptidase_S8; PFam Description: Subtilase family
  misc_feature: PFam Name: IER; PFam Description: Immediate early response
  misc_feature: PFam Name: MARCKS; PFam Description: MARCKS family
  misc_feature: GI Number: 34895916; NR Description: P0030H07.24 [Oryza sativa (japonica cultivar-group)] >gi|13872954|dbj|BAB44059.1|
  misc_feature: GI Number: 34895936; NR Description: P0030H07.39 [Oryza
  misc_feature: GI Number: 34895938; NR Description: P0030H07.40 [Oryza sativa (japonica cultivar-group)] >gi|15528618|dbj|BAB64639.1| putative PrMC3 [Oryza sativa (japonica cultivar-group)] >gi|13872965|dbj|BAB44070.1| putative PrMC3 [Oryza sativa
  misc_feature: GI Number: 50919067; NR Description: putative esterase [Oryza sativa (japonica cultivar-group)] >gi|27819508|gb|AAO24912.1|
  misc_feature: GI Number: 51963278; NR Description: PREDICTED OJ1714_H10.153 gene product [Oryza sativa (japonica cultivar-group)] >gi|34899930|ref|NP_911311.1| putative pepper esterase [Oryza sativa (japonica cultivar-group)] >gi|22831104|dbj|BAC15966.1|
MAGDTAPHVVEDLLRLVQILSDGSVVRGDESVLGPKEPFPDVPGVEWKDVVYHAAHGLRVRVYRPTSVVAGGDKLPVLVYFHGGGYCLGSFAQPTFHAFCLRAAAELPAVVLSVQYRRAPEHRLPAAIDDGAAFLSWLRGQAELGAGADPWLAESACFARTFLSGVSAGANLSHHLIVQVGSARLAVSPVRIVGYVLLSAFFTGAERTAAETDPPADVFLPLELSDQLWHMSLPVGASRDHPVANPFGPESPNLAPVELPPALVVAPLGDVLRDRSLGYAARLKDMGKDVELVEFERQQHGFSVLQPFGEAADELMRVLRRFVYPAR

SEQ ID NO: 3301 - DNA, 896 bp, Zea mays
  misc_feature (1)..(896): Ceres cDNA ID no. 21572816
  misc_feature (1)..(896): Ceres CLONE  ID no. 1460597
  misc_feature (1)..(896): Also known as  Ceres CDNA ID no. 24359792
acgtgaccctccttatccattagtgacgcggcgccttctcgttcgagggagctgccgtgaccgggaggaagcaaggaggcgaaggagccacagcagccatggctcccgccacttccacctcgccgctatcccgcctcctgctcagcctcccgaagcccaacgcccagccgcccctgtgcgccaagccgccgagcgcggactccggcgcgggcgccaccagcaagaacctcgtcctccgccggcgcgaggccgcggcagccgtcctatccgccgctctcctcacacgcgtcctccccgcagcggccgcggcagatgagtgcgcgctcgaggcgaccccctcgggcctcgccttctgcgaccgcgtcgtcggcaccggcgccgaggccgtcaaaggccagctcatcaaggcgcactaccgggggatgctggaggacggcacggtgttcgacagcagctacggccgcgggaggccgctgaccatcatggtgggcgtgggggaggtgatcaaggggtgggacctgtgcctcgccggcggcgaagggatcccgccgatgagagtcggtgggaaacggagcctgaggctgccgccggagctggcctacggggagaagggggccgggtgcagggggtgggagcccacctcgtgcgtcatcccgcccaactccacgctcctcttcgacgtcgagtacgtcggcagggcatcctcctgatcgacctatccatctatgagtccatgatcatgccttgtatatgccatcagttcgtactagaggattcatcgattgatcgatcgacattatatgtggagcgagcaaagaccgtgaatcctgagatcaatatgtacaacctattctatttctatgatccacgagtttatgccaaaaaaaaaaaaaaaa

SEQ ID NO: 3302 - protein, 203 aa, Zea mays
  misc_feature: PFam Name: FKBP_C; PFam Description: FKBP-type
  misc_feature: GI Number: 21535744; NR Description: FK506 binding protein 1
  misc_feature: GI Number: 52075930; NR Description: putative peptidyl-prolyl
  misc_feature: GI Number: 6686798; NR Description: FKBP like protein [Arabidopsis thaliana] >gi|18420509|ref|NP_568067.1| immunophilin, putative / FKBP-type peptidyl-prolyl cis-trans isomerase, putative
  misc_feature: GI Number: 46130465; NR Description: COG0545: FKBP-type peptidyl-prolyl cis-trans isomerases 1 [Synechococcus elongatus PCC
  misc_feature: GI Number: 53688597; NR Description: COG0545: FKBP-type peptidyl-prolyl cis-trans isomerases 1 [Nostoc punctiforme PCC
MAPATSTSPLSRLLLSLPKPNAQPPLCAKPPSADSGAGATSKNLVLRRREAAAAVLSAALLTRVLPAAAAADECALEATPSGLAFCDRVVGTGAEAVKGQLIKAHYRGMLEDGTVFDSSYGRGRPLTIMVGVGEVIKGWDLCLAGGEGIPPMRVGGKRSLRLPPELAYGEKGAGCRGWEPTSCVIPPNSTLLFDVEYVGRASS

SEQ ID NO: 3303 - DNA, 1145 bp, Zea mays
  misc_feature (1)..(1145): Ceres cDNA ID no. 21572820
  misc_feature (1)..(1145): Ceres CLONE  ID no. 1469970
  misc_feature (1)..(1145): Also known as  Ceres CDNA ID no. 24359258
aattcgttccatcccttcaccacacacaccattcctgggcctgggcgacaaggccacacacgatcgccggcagtttccgaaacgagaaaaggaagaaacaggaggcgagagatcgagatcgatgagcagcggtcagtcgtcgccatgcccacatggcggcgcccggccgggagcgagcccctccaagaagctgtggcgcggggtgcaagccgtctacctcgtcctcgtcaagaagcaccagccgaagctcgccgcgttcggcgtccacatgcaccgcctcctctccagcagcaagcgccgccgccgccgccacctcgccgcgcgggggcgggagcagaacccggcgctgacgtacatgtcgtgccggtccatggaccccgctgccgcggtggtgcacccgtacccgcacagccacggccacggccgccggcgcgcgccgtcgaggtcgaggtcgaggtcgaggctcgcggccccgtcgtccctgtcgtgccggtccttggaccccgccgccgccgtgcgcagcaagtaccagtaccgtccccgcgaggtggagttcagctgcaagagcacgccgatgcacacacgccggcgccgcctgcgcctgcatcagggccgcggccacccgtcggagccggagccggagcggcacgtctcggccgcggcggtgacgaggctgttcgcgctcatggacgacgtcgaggtcgaggaggcggcggacggcgatctggggctgggcctgggcctggacgccccggcgccgcgtcaggtgcggatcacggactcgccgtacctggcgagggaggaggacaataacgaggaattgaggagcgcggtggacaggcgcgccggcgagttcatcatgtggttccacgagcagctgcggacgcagcagcagcacgggcaactgggtcgataaggtaggggcgcagaagagaagcagtgccgttgcctctagtctagtcttatggttttgttgtgattgtgattgtgattagttcatgtatgcatggattacgtattagatcgataagggtacattccttggaggagatgcgaacattttcatacggcagtagtacttttttttctttcatgtatatgaattgcagtgcctgattttttttttgctgaaaaaaaaaaaaaaa

SEQ ID NO: 3304 - protein, 264 aa, Zea mays
  misc_feature: PFam Name: FH2; PFam Description: Formin Homology 2 Domain
  misc_feature: PFam Name: Peptidase_S21; PFam Description: Assemblin
  misc_feature: PFam Name: Pyr_redox_2; PFam Description: Pyridine
  misc_feature: PFam Name: Drf_FH1; PFam Description: Formin Homology Region 1
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778264; NR Description: LigA [Anaeromyxobacter dehalogenans 2CP-C] >gi|66856061|ref|ZP_00400131.1| LigA
  misc_feature: GI Number: 5821145; NR Description: RNA binding protein [Homo
  misc_feature: GI Number: 47124032; NR Description: SRRM2 protein [Homo sapiens]
  misc_feature: GI Number: 15145795; NR Description: basic proline-rich
MSSGQSSPCPHGGARPGASPSKKLWRGVQAVYLVLVKKHQPKLAAFGVHMHRLLSSSKRRRRRHLAARGREQNPALTYMSCRSMDPAAAVVHPYPHSHGHGRRRAPSRSRSRSRLAAPSSLSCRSLDPAAAVRSKYQYRPREVEFSCKSTPMHTRRRRLRLHQGRGHPSEPEPERHVSAAAVTRLFALMDDVEVEEAADGDLGLGLGLDAPAPRQVRITDSPYLAREEDNNEELRSAVDRRAGEFIMWFHEQLRTQQQHGQLGR

SEQ ID NO: 3305 - DNA, 1039 bp, Zea mays
  misc_feature (1)..(1039): Ceres cDNA ID no. 21572821
  misc_feature (1)..(1039): Ceres CLONE  ID no. 1471251
  misc_feature (1)..(1039): Also known as  Ceres CDNA ID no. 24371344
aatcggccagtacagtgcccaggcggttagggtttcgcccaccacatcgacctacggcgacggccaaacagcaggcgcagccatggcctcccccggcggcggcatgggagcggcctaggcacggccatggcggccggaagcacggccccctgagcgagccccccggcggcgcatgctctggcggcgcgcggttccggccaggcgggcgcggcggcccggcagcgtgcggctccggccaggcgggcgcggcggccccggccaggcaggagcgatgggcatggcggccttgggcataggcgcggcggcccccggcgcgcacgggtgcagctcggcacgagcgcgcctcccccgcggtggtgtgggctgcaccggcgtgcggccctcggatcctcggcggctcgccgcaggccggcggacgagggcgggcacagcccctcggcgcaggcgtggccccggcggccctgtggtagcgtgggcgcggcctccggcgcgcgcgggcgtggccccggctggtccatcggcatgcgggctcgcggctctgacgcgcgggcacggcggcactggccccggcgtgggctcgggcgcgcgtcccttccagcggcagcgcaggcagcccaggcgcgcggcccccccggcccctcggcggctcggcgcagaccggcgcacgagggcgggcgcggctgctctgcgcaagtgcgtgcgggcgcgttccctgcggcgcggcccgaccaggcgcgcgcggcgcacggccgctctccggcggcgtggccccggccaggcgcgcggcctccgcggcggggcagccccggccaagcgcgcgggcgcggccactgcacgtgcggccgtggagctctctggcagagcgggacgagcgccggcggtgcgatcgcgtggcccatgcgagcgcagcgatgcgtgctctgacgcgtgctcaagcctggatccatgagaactgctccaacagttcatggaagccgaagtcacactttttcatctcgttgaaatacaagagaaaattgaagcaaaaaaaaaaaaaaaa

SEQ ID NO: 3306 - protein, 258 aa, Zea mays
  misc_feature: GI Number: 66776103; NR Description: LigA [Anaeromyxobacter dehalogenans 2CP-C] >gi|66858140|ref|ZP_00402169.1| LigA
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66779191; NR Description: LigA [Anaeromyxobacter dehalogenans 2CP-C] >gi|66855208|ref|ZP_00399285.1| LigA
  misc_feature: GI Number: 13562004; NR Description: major ampullate spidroin
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
MLWRRAVPARRARRPGSVRLRPGGRGGPGQAGAMGMAALGIGAAAPGAHGCSSARARLPRGGVGCTGVRPSDPRRLAAGRRTRAGTAPRRRRGPGGPVVAWARPPARAGVAPAGPSACGLAALTRGHGGTGPGVGSGARPFQRQRRQPRRAAPPAPRRLGADRRTRAGAAALRKCVRARSLRRGPTRRARRTAALRRRGPGQARGLRGGAAPAKRAGAATARAAVELSGRAGRAPAVRSRGPCERSDACSDACSSLDP

SEQ ID NO: 3307 - DNA, 1480 bp, Zea mays
  misc_feature (1)..(1480): Ceres cDNA ID no. 21572822
  misc_feature (1)..(1480): Ceres CLONE  ID no. 1475247
  misc_feature (1)..(1480): Also known as  Ceres CDNA ID no. 0
agtactgttcctttgccagcttgcctgctgccaccagtggcacctgcaggcgaacctccacgcgagctgcccggccccggctgcccctgtccctgccggccccttccaaaataaagcgggagggggatgcgctgagccggatggcggcccactcgctctcgctctacctccccgtcgtcacgcgctcgcctgtgcccctagcgtttcgccacctcctgctcccgcaccgcctccggctccgcctcgcctccgccgtcaccccatcccgggcgcggcccctcggcctcggcgcccgcccgccccgccaccacgccgcacccctcggctacggagggagaaggccgagtggtggactggaccacagagccatgtcaagttccacaaattcaacagtggccacggagttgtcggtgtctgagaatagcagggaaattgagccgctaccttttgtgaatgacaaacatggaggcgtcatcattgagatgaagactccaatggatcctggagtgttttcagcttacttgaaagcagcgctggcaaaatggagggagcagggaataagaggtgtctggatcaaattacccatcaccctttccaaccttattccaacagttgtagaggaaggtttctggtaccatcatgcagaggaaacttacttgatgcttgcgtactggcttccaaatacaacacatacactaccagtaaacgcaacccaccgtgttggtgttggagcttttataatgaatgacaaaagagaggtcttggttgtacaagaaaagagtggtgtacttcgaggcctaggtgtgtggaaatttccaactggcgtagttgaaccgggggaagatattaacgttggagccataagagaagtaaaagaagagaccgggattgatgcagaatttgttgaagtgctggccttcaggcagagccacaaagctttttttgataaatcagatctatttttcgtgtgcctgctgcgaccactgtcatatgacattacgaagcaagattcggaaatagaagcatgccagtggatgccagtagaggaatttgcagcacaaccatttgtccagaaacatgagcttgtgaagtacatcctcgaagtaggcctggctaaagttgacaagaaatatgcagggttttcgccaatctccataaaatcggcgtttacagacaaattgtcattattttacatgaaccggagggacctggacaaagcctcaggatagagtaatatgtaattaaacacagggaattcaagatagttgaaatttcagttgtggtatgtaaaagcaggccaagtcattcatacttgattattttgttcacaaattggaagtttcgggcatccgaaacttgtgatttttcgaccatatgtcgtctgctacacatctgtgtttcaaaggagtgttgcaatccaaaagtagagataaaactgttgtgcttatggaaaaaaaaaaaaaaaaaaaaaaaaaaaaaa

SEQ ID NO: 3308 - protein, 1480 aa, Zea mays
AGTACTGTTCCTTTGCCAGCTTGCCTGCTGCCACCAGTGGCACCTGCAGGCGAACCTCCACGCGAGCTGCCCGGCCCCGGCTGCCCCTGTCCCTGCCGGCCCCTTCCAAAATAAAGCGGGAGGGGGATGCGCTGAGCCGGATGGCGGCCCACTCGCTCTCGCTCTACCTCCCCGTCGTCACGCGCTCGCCTGTGCCCCTAGCGTTTCGCCACCTCCTGCTCCCGCACCGCCTCCGGCTCCGCCTCGCCTCCGCCGTCACCCCATCCCGGGCGCGGCCCCTCGGCCTCGGCGCCCGCCCGCCCCGCCACCACGCCGCACCCCTCGGCTACGGAGGGAGAAGGCCGAGTGGTGGACTGGACCACAGAGCCATGTCAAGTTCCACAAATTCAACAGTGGCCACGGAGTTGTCGGTGTCTGAGAATAGCAGGGAAATTGAGCCGCTACCTTTTGTGAATGACAAACATGGAGGCGTCATCATTGAGATGAAGACTCCAATGGATCCTGGAGTGTTTTCAGCTTACTTGAAAGCAGCGCTGGCAAAATGGAGGGAGCAGGGAATAAGAGGTGTCTGGATCAAATTACCCATCACCCTTTCCAACCTTATTCCAACAGTTGTAGAGGAAGGTTTCTGGTACCATCATGCAGAGGAAACTTACTTGATGCTTGCGTACTGGCTTCCAAATACAACACATACACTACCAGTAAACGCAACCCACCGTGTTGGTGTTGGAGCTTTTATAATGAATGACAAAAGAGAGGTCTTGGTTGTACAAGAAAAGAGTGGTGTACTTCGAGGCCTAGGTGTGTGGAAATTTCCAACTGGCGTAGTTGAACCGGGGGAAGATATTAACGTTGGAGCCATAAGAGAAGTAAAAGAAGAGACCGGGATTGATGCAGAATTTGTTGAAGTGCTGGCCTTCAGGCAGAGCCACAAAGCTTTTTTTGATAAATCAGATCTATTTTTCGTGTGCCTGCTGCGACCACTGTCATATGACATTACGAAGCAAGATTCGGAAATAGAAGCATGCCAGTGGATGCCAGTAGAGGAATTTGCAGCACAACCATTTGTCCAGAAACATGAGCTTGTGAAGTACATCCTCGAAGTAGGCCTGGCTAAAGTTGACAAGAAATATGCAGGGTTTTCGCCAATCTCCATAAAATCGGCGTTTACAGACAAATTGTCATTATTTTACATGAACCGGAGGGACCTGGACAAAGCCTCAGGATAGAGTAATATGTAATTAAACACAGGGAATTCAAGATAGTTGAAATTTCAGTTGTGGTATGTAAAAGCAGGCCAAGTCATTCATACTTGATTATTTTGTTCACAAATTGGAAGTTTCGGGCATCCGAAACTTGTGATTTTTCGACCATATGTCGTCTGCTACACATCTGTGTTTCAAAGGAGTGTTGCAATCCAAAAGTAGAGATAAAACTGTTGTGCTTATGGAAAAAAAAAAAAAAAAAAAAAAAAAAAAAA

SEQ ID NO: 3309 - DNA, 631 bp, Zea mays
  misc_feature (1)..(631): Ceres cDNA ID no. 21572823
  misc_feature (1)..(631): Ceres CLONE  ID no. 1475339
  misc_feature (1)..(631): Also known as  Ceres CDNA ID no. 24359239
aagctgcctcagctcacaacctagacagagagagataggcaggccagctagcttcttgtagctaggtctcctggattactgtgacaatgtccaagataggcagcttcgtgtccggcctggtcagccaaattcattagcatcgatcgcgcgcgcttgttcatgcatttgacgtgcgtgcctgcatgcacagccggcggagctacggcagcgtccagcacgcgatggcggtgaatgctcaagcctccgctgctgcagcggcggcgacgaaagcgggcgtcgtcgcggcagcggatgcgtcgggggcgaccaacaacaagacgaagcaggacaagttctggatgagggaccccaagacgggctgctggatcccagagaaccggttcgaagaggtggacgtggtcgacctgcggaaccggctgatccacgtccaccaccacaactaaactccttcggaagcagcagcagatcaaacaggcgtatgggctaatgagcaccttgctggaatcagtcgtcagctgaccaccgtcagcatctatcacgtggattatatatgctgtaaaataaacactgcgcatttccatacttactataattaaagtaccagtttcaacgatcaaaaaaaaaaaaaaaa

SEQ ID NO: 3310 - protein, 86 aa, Zea mays
  misc_feature: PFam Name: LEA_3; PFam Description: Late embryogenesis
MHSRRSYGSVQHAMAVNAQASAAAAAATKAGVVAAADASGATNNKTKQDKFWMRDPKTGCWIPENRFEEVDVVDLRNRLIHVHHHN

SEQ ID NO: 3311 - DNA, 580 bp, Zea mays
  misc_feature (1)..(580): Ceres cDNA ID no. 21572824
  misc_feature (1)..(580): Ceres CLONE  ID no. 1483307
  misc_feature (1)..(580): Also known as  Ceres CDNA ID no. 23864681
aaaatacgatggagatagatgtgctgagttcttaacatcaagcagcgcaaagatcattgacaagtaagaacctatagagttaatggggagggcgacgccggtggcggtggcggcagacgacgacggccagaagacgtcgtggccggaggtggtggggtgggtgacgctgaacgcggcgctgcagatcagcagcgacaggcccgacgtgtcgacggacttctacagtgagaccaccccgctgccgaccgactacgaccccaaccgtgtcatcatcgtcgccgacgaccggaacgtcgtcgtccggactccggtcatcggctagatcgtgcccccgccgtatcatcaggctgcagcttttcccgataatagcgacaagaacaactactgctttatgttttgtttctttactgctgggttctcatgtatgggatgggaaagagaaggtcactatatatagtgctgttcatcgttgaacatgcacgtatattcaatcctcgtataagaaatccgtgtgatatatcccttgtttggtgaatggccagcactcgccggtgttaattatgacaaaaaaaaaaaaaaa

SEQ ID NO: 3312 - protein, 79 aa, Zea mays
  misc_feature: PFam Name: potato_inhibit; PFam Description: Potato
MGRATPVAVAADDDGQKTSWPEVVGWVTLNAALQISSDRPDVSTDFYSETTPLPTDYDPNRVIIVADDRNVVVRTPVIG

SEQ ID NO: 3313 - DNA, 790 bp, Zea mays
  misc_feature (1)..(790): Ceres cDNA ID no. 21572826
  misc_feature (1)..(790): Ceres CLONE  ID no. 1490286
  misc_feature (1)..(790): Also known as  Ceres CDNA ID no. 23864733
cttcctgcgagtttcatttcatcctaccttacctttttactcctccagtccagtcagagaacaccataagtggccgctacacctgctcactccattgcaccactggcaagtagcaacaggagcgcaggcagaactagagcggtcttggtatggcttcttccctcgcgcccgcgtcgtgggcactgccgctgcagatgggcggggctggggcggcagcggcgggcccttcctgccgcgcgacgctagccgtcgtcacggagccccgctgggccgcgtcgctgcgccgggcaagggttctcgtggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatggtgtgcgaatacttcctttgttcttaatctctctctctctctcacacacagccgctccagttcgtactatatatgctcaactgctcggtctcaaactctactctgcacgattctggcattgctaattagggtattgaaaaaaatagcagtgcatcgcctctgtaatctgtagtgctactccaaatactcttcatgctaaagttctttctccgaccactgtgattggttgtgctgtggttggtattaacagtaaaattgagccttttgtagttcacttttaaaaaaaaaaaaaaaa

SEQ ID NO: 3314 - protein, 790 aa, Zea mays
CTTCCTGCGAGTTTCATTTCATCCTACCTTACCTTTTTACTCCTCCAGTCCAGTCAGAGAACACCATAAGTGGCCGCTACACCTGCTCACTCCATTGCACCACTGGCAAGTAGCAACAGGAGCGCAGGCAGAACTAGAGCGGTCTTGGTATGGCTTCTTCCCTCGCGCCCGCGTCGTGGGCACTGCCGCTGCAGATGGGCGGGGCTGGGGCGGCAGCGGCGGGCCCTTCCTGCCGCGCGACGCTAGCCGTCGTCACGGAGCCCCGCTGGGCCGCGTCGCTGCGCCGGGCAAGGGTTCTCGTGGCGCCCCGGTGCGTGGCGCTCGACGGGCCCGGCGCCAGCGGCGAGGAGGAGGCGCCCAAGATCGAGGACGAGAGGAAGAAGAGCGGTGAGACGAAGAAGCCGGCGCGCGGCCGGCCGGTGTGGAGCCGGATCCTCTTCGCCTCCAAGAAGACACGAAGTATCATCATCCTCAACGCCCTCACGGTCATCTATGGTGTGCGAATACTTCCTTTGTTCTTAATCTCTCTCTCTCTCTCACACACAGCCGCTCCAGTTCGTACTATATATGCTCAACTGCTCGGTCTCAAACTCTACTCTGCACGATTCTGGCATTGCTAATTAGGGTATTGAAAAAAATAGCAGTGCATCGCCTCTGTAATCTGTAGTGCTACTCCAAATACTCTTCATGCTAAAGTTCTTTCTCCGACCACTGTGATTGGTTGTGCTGTGGTTGGTATTAACAGTAAAATTGAGCCTTTTGTAGTTCACTTTTAAAAAAAAAAAAAAAA

SEQ ID NO: 3315 - DNA, 687 bp, Zea mays
  misc_feature (1)..(687): Ceres cDNA ID no. 21572827
  misc_feature (1)..(687): Ceres CLONE  ID no. 1495565
  misc_feature (1)..(687): Also known as  Ceres CDNA ID no. 23842102
agctagcaatctactagcgtccagcagcaccatccaactggctcatccgcaagcgaacccgatggatccaatcacaaggccggcagctccatcgttccatcggccagcagtcgcgaccgcgaagcatctccatcaggccgccgccaccttggctcggaggaatggagtcagcaggaggtgccttctgacgctgctgatgtccactgcggccatacctggcggcagcgaatcgaggaaggctctactgcaagagtatctgaagaaatcgaaggagaacaaggaaaagaacgacaaggagaggctggatgactacaacaagaggaactacagggactacttcgggctcatcgagggccaggtcagagagaagacggaagaggagcgcacggagtcggagaaacggatcctcgagtggctcgacaagaacaggtagtctaatgagcaggatcgaatggtcgatcatggagggccggccggtcgcacggggtgaaaattctcgcaggattcttcgtgttcccgctctagctatggcacgctttgtgtaaacaagtactccgtatatgattgactgagcgtactacgtcgtgtttgttttcctgttacagcgagagcgagcgaggaaacatgttatctcgttcgcaacataaacaaagattagaaaatttcaaataaaaaaaaaaaaaaaaa

SEQ ID NO: 3316 - protein, 123 aa, Zea mays
  misc_feature: PFam Name: PsaN; PFam Description: Photosystem I reaction
MDPITRPAAPSFHRPAVATAKHLHQAAATLARRNGVSRRCLLTLLMSTAAIPGGSESRKALLQEYLKKSKENKEKNDKERLDDYNKRNYRDYFGLIEGQVREKTEEERTESEKRILEWLDKNR

SEQ ID NO: 3317 - DNA, 1229 bp, Glycine max
  misc_feature (1)..(1229): Ceres cDNA ID no. 21572829
  misc_feature (1)..(1229): Ceres CLONE  ID no. 1504874
  misc_feature (1)..(1229): Also known as  Ceres CDNA ID no. 21572829
cctctagtcttgtcccctcccgcggctagggtttcctccgcttcgctctcgcagaatgcctcgctacgatgagcgtgatcgttacggtggcaacacaaggctgtacgtgggtcgtcttccctcgcgcacccgcacaagggacctcgaagacctcttcggcagatatgggagagtgcgacatgtggatatgaagcacgagtttgcatttgttgagtttagtgatcccagggatgctgatgaagcaaggtacaatcttgatggtcgtgactttgatggaagccgcatgattgttgagtttgctaaaggggttccgcgtggccaaggaggaggaggtgaccgtgaccgtggtggccgtggtggtgaccgtgaatatatgggtcggggacctcctcctggttctgggcgttgctttaactgtgggattgatgggcattgggctcgggactgcaaagctggcgactggaaaaacaggtgctatcgttgtggagatagtggccacatagaaagggattgtcagaacagccctaagaacctcaagcgtggaaagagttactccagatctccatctcctcgccgcggaagggtgcgtgataggagctacagcaggagccgcagtaggagctacagccgctctgtttccccaaggagggatgaaaggcgatcaaggagccctcgcgacagtcgcagcccaaggaggagcccccgtgacagtctcagccccaggaggagcccccgcaacagtcgcagccctatgaagagcccccgtggcagtcgcagccctatgaggagcccccgtgacagtcgcagccctaggaggagtgcttcacctgccaaggggagggcccggagccccacccctcctggcagcaggagccctgcaccaagggataacagcaggagcccaatgaaggctgacagccctaaaaacatgagcccagctgccaatggtcgtagcctgagccccagggacggcgaagacaatggccaccaccgtgcacccagtggaagtgcatcacccggtggtggttagagatggatcgaaatccttcaagctttcacccagtggaactgcatcacctggtgagggtcgagagatcgatcaaattcttcctacggttatgaaactctccaaacatgttgaacaaagacttgcctgtacgagtttgattttatcgtgtactctatttcggtattgatactccagtcagaccataaaaaaaaaaaaaaaa

SEQ ID NO: 3318 - protein, 324 aa, Glycine max
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSLSPRRSPRNSRSPMKSPRGSRSPMRSPRDSRSPRRSASPAKGRARSPTPPGSRSPAPRDNSRSPMKADSPKNMSPAANGRSLSPRDGEDNGHHRAPSGSASPGGG

SEQ ID NO: 3319 - DNA, 891 bp, Zea mays
  misc_feature (1)..(891): Ceres cDNA ID no. 21572831
  misc_feature (1)..(891): Ceres CLONE  ID no. 1509273
  misc_feature (1)..(891): Also known as  Ceres CDNA ID no. 23867340
atatttccgttcccctgtacccgcgtggtcttcgatcttgccaagtttcacgtttgcagatcggcgcagttttggtcgcaaaggcgtggtcgttctcctcgagcatcgatttagggttcttcggctttctatgatcaggaggagttgctggattattttatcagggaacagaatggtgtgattcgttgattggattacagtctggatctctcttgcatcaaatggttgagcaaggcaaaccacgaagcatcccgacgaaggcgaagaaatcgccgttcgtggaggtagaggttgacgagattggccaggctagtggggtggtgtttgcaagggaatcaccgctggcgcctaagagcgaccaaggatgcagcgttagccatagtcatggcgacgacgaaacacatgaatcggatgggtgcgtgcaaagccaggggctagacgagcatgggtgggtggacttcggtcactcactgcagctggtgctgttctcgcgacagtggagcctcgctgaaagtcttgttgacctagcagatcagcagccgatgctggattatggcctgtcgattgcccttgatgccatatggtttttgcggacgaaacaggatcttgaggggctcaacagtctgatatcgaagattgtggcctcaggggcaaaggattttgcaagagcaatcctcaggacatcgctgctcgcgtcatgtgttgcagcgtgccaaagcaaggctatcactgtgggtaacagcaaggagatcgtcgcagagaggtgactttgagcttagatataaatgtatttattcagaatagattgcttattaccgcccgagtttagaatagattgcttaatactgtaatacattattagtgatgttatttctaaaaaaaaaaaaaaaa

SEQ ID NO: 3320 - protein, 181 aa, Zea mays
  misc_feature: GI Number: 15081725; NR Description: At2g44090/F6E13.22
MVEQGKPRSIPTKAKKSPFVEVEVDEIGQASGVVFARESPLAPKSDQGCSVSHSHGDDETHESDGCVQSQGLDEHGWVDFGHSLQLVLFSRQWSLAESLVDLADQQPMLDYGLSIALDAIWFLRTKQDLEGLNSLISKIVASGAKDFARAILRTSLLASCVAACQSKAITVGNSKEIVAER

SEQ ID NO: 3321 - DNA, 1237 bp, Zea mays
  misc_feature (1)..(1237): Ceres cDNA ID no. 21572832
  misc_feature (1)..(1237): Ceres CLONE  ID no. 1509299
  misc_feature (1)..(1237): Also known as  Ceres CDNA ID no. 25088191
atgattcgggaatcagaaggctgggctgagaatgttgaggagggagactctggtgttgacgagggctctgaacaccttctcgccgctgctctccacgtccgcgatgcaccgtcctagattgtccagccgctcaaacgccgccttccgctctcgctcctccgggtccgcggcggcctccatctgggccccacggcagacgtggcggcgtgctgcctcttggccgatcgacgcttcgcacgcgacatccaccgcatgaggtcggcgacccaccagatccatggcatggaggtcgaggaggaggacccggtggtgacgaccacgtgtctgggcgtggcggacggcgcgcttaacctcgcgggggaggacatgcagcacggcgtggcgtcgacctcgacgcgcgccgtggcggcggcgacggagagcgaggagacaccggagaagaccgccgccgaggccgacgcgtcggaggtcggcgggcggggtgggcgggggcctggcggccacggcgcgcgccgaggaggcgacccgcgggaggtcccgcgcggaccagcgcagcgcgcgcggccgacgcgaggcgggccggctcctccttgcgcagcgcgacgcgggcctcaacctggagcgcggcgagcgcgaccagagcgtcgcggaagctgccgtgcgcgtcgacgaggcggaggaagtcgtccgctccgcgaacggggacgggccgaggcggcgcagcgggtcctgcgcctgtggttggtgcaacaggccggagagcgacacgagcacgcggcccagccgtgccacggccttcacggaggccggcgacgctaggcggcccaccagcgcccgcaggtcggcgacgtcgtcgtcgagctggagcaccagcgggtggaaccgtcacggtaggcgacggacttgttgtcggcggcgctgggccacaggtaggaacatcttccagtggaagttggagcttgcgagaccgcgggacggctgcgagatgtgggctggcggcggaaggcagggtgggagaggccgtgtggggttggtgggcaggatcgaacggctaagatcgtagaacggtagaacggacggttgaaattgcaaaacggtaggctatccttgcggtcttaataagtagtatataattgcctttgttttttatatttttatcttttcctaagcgcatggatgttccgcacacaggcgttttcaagttaatcggattttttttgtaaaaaaaaaaaaaaaa

SEQ ID NO: 3322 - protein, 188 aa, Zea mays
  misc_feature: PFam Name: TT_ORF1; PFam Description: TT viral orf 1
  misc_feature: PFam Name: Collagen; PFam Description: Collagen triple helix
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66776103; NR Description: LigA [Anaeromyxobacter dehalogenans 2CP-C] >gi|66858140|ref|ZP_00402169.1| LigA
  misc_feature: GI Number: 53767374; NR Description: COG3832: Uncharacterized
  misc_feature: GI Number: 3242649; NR Description: alpha 1 type I collagen
MRSATHQIHGMEVEEEDPVVTTTCLGVADGALNLAGEDMQHGVASTSTRAVAAATESEETPEKTAAEADASEVGGRGGRGPGGHGARRGGDPREVPRGPAQRARPTRGGPAPPCAARRGPQPGARRARPERRGSCRARRRGGGSRPLRERGRAEAAQRVLRLWLVQQAGERHEHAAQPCHGLHGGRRR

SEQ ID NO: 3323 - DNA, 809 bp, Zea mays
  misc_feature (1)..(809): Ceres cDNA ID no. 21572833
  misc_feature (1)..(809): Ceres CLONE  ID no. 1511227
  misc_feature (1)..(809): Also known as  Ceres CDNA ID no. 21572833
aaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgccgccgggatggcggccccgcccgaagcctccgccgccgtggtgcaggacctcgcggcaatcgccgccgccgcgcccgccgacgacagccgcggcctcctcctgctcatcgtcgtcgcgcccgccatcggctgggtgctcttcaacatcctccagccggcgctcaaccagctcaaccgcatgcggtccgactgaagctagctagctagcgtccgtttccgtatccgcggcgtgcgttgtagacgtgaagcacgtggttggttgatcaacgtacgtggacgtggcctgtctttccatcttcaaaaaaaaaaaaaaaaa

SEQ ID NO: 3324 - protein, 191 aa, Zea mays
MATIATMALLKPAAKAAARSAPSTSSGSVSLRVRTGQAAKKAALSVSASSTLAGAFLAALASSPDAALADVAAADAGGDSRGQLLLVVVAPAIGWVLYNILQPALNQLNRMRSSQAVAAGLGLGAAAAAGMAAPPEASAAVVQDLAAIAAAAPADDSRGLLLLIVVAPAIGWVLFNILQPALNQLNRMRSD

SEQ ID NO: 3325 - DNA, 891 bp, Zea mays
  misc_feature (1)..(891): Ceres cDNA ID no. 21572834
  misc_feature (1)..(891): Ceres CLONE  ID no. 1513374
  misc_feature (1)..(891): Also known as  Ceres CDNA ID no. 24359235
aatatctagattcgggactgtctcagtcaggtggagttacagcagggggtggctgattctcacatccagttctcgcgtaatggaagatattcagccaaaatggcatatgcgggtttttttgttggctcggttccttttgaaccttatgagaagatttgatgttcttggccccttcctaaatataaatgttttctgtggttggtggcgcacaacagatactggatggcaggcaggctggcttgtagaggcctcccggtgccttctgtgtgactacgaagatgaaacagtcagccatctgcttctttcttgtatgtttgcgcgagaattttggttcaaaatcctaaggccttatggcctgcagacccttgcaccataatctgaaggtaggagtttctttctctggtggacgcaggctgaagagagaactaaggggttgacaagaaaaggtttcaactccctcgtcatcctgggagcttgaactctgtggaagatacgaaatggatgtctttgaaggcctccccccatcatatgatttcagcttctgctcactttggtgaagaaatagatttatggatgatggctcacgccaaaggattggtgttcctttcagccgtggctgaggattagtggtagttggtctgctataatctatgcctctgaataatcctttcttgtataagaggttttggccaccatgagctagccatttgagttttgtaaggcctttatacgtttcttcttagtataatgatacgtagttctcctgcgtctttgagaaaaaaaagttctaacgaaattcgctagaatttatttgacgtggcacattatgatatcaggtacttcttgaagattatatatagctcatttaaatgtgaaaaaaaaaaaaaaaaa

SEQ ID NO: 3326 - protein, 98 aa, Zea mays
  misc_feature: GI Number: 18568267; NR Description: putative polyprotein
  misc_feature: GI Number: 34913456; NR Description: P0702H08.17 [Oryza sativa (japonica cultivar-group)] >gi|20521347|dbj|BAB91860.1|
  misc_feature: GI Number: 50931747; NR Description: putative polyprotein [Oryza sativa (japonica cultivar-group)] >gi|49328070|gb|AAT58770.1| putative polyprotein [Oryza sativa
  misc_feature: GI Number: 50902238; NR Description: P0408G07.7 [Oryza sativa (japonica cultivar-group)] >gi|20161234|dbj|BAB90161.1| P0408G07.7
MEDIQPKWHMRVFLLARFLLNLMRRFDVLGPFLNINVFCGWWRTTDTGWQAGWLVEASRCLLCDYEDETVSHLLLSCMFAREFWFKILRPYGLQTLAP

SEQ ID NO: 3327 - DNA, 752 bp, Zea mays
  misc_feature (1)..(752): Ceres cDNA ID no. 21572837
  misc_feature (1)..(752): Ceres CLONE  ID no. 1516852
  misc_feature (1)..(752): Also known as  Ceres CDNA ID no. 0
acttcttctcctcctcgatcggcaagaagctaaggaggcaccattgcttatcgtctgatccccgcggggcgcgtgtcgctgcacaagatgacgacggcaacagccggtggcagcgtcgccgaccgcatcatgccgcacctcctcaacatatatggatcgtccgcgacggcacgggacttcgagatttacgcgccaaatgcgacgtttgaggacccgctcatgcgagctcacggggttaagcagatcaaatcagcgttctacacgctgccaaaggtgtttggggaatccaagatcaccgagtacaccgtacaagagaatcccatggggccgggcaaaaccgaggtggtgatccagaacaagcagcactacaaggtgctgggcaagccggtggatctgacgtcgctcatcaggctgcagctccaggacggcaaggtggtcaagcacgaggactggtggcacgggaagcctctcaagaacagggacacggtgggcgtgccgctggtgggccgactcgcagaggccagccgccggggcgccatgctgctcacccacgcactcatgggcttcggcaaagacccaacccagcctcctcctcctccgacactttgaattcgtcagactcggtagtctgatcaatccaaccaatcatatatgtttgtatatctatctgtctgtctgcttcgcaatgctactctcacgcataacacctgctggacattcttttgttgcgtgcacaaaaaaaaaaaaaaaaa

SEQ ID NO: 3328 - protein, 173 aa, Zea mays
MTTATAGGSVADRIMPHLLNIYGSSATARDFEIYAPNATFEDPLMRAHGVKQIKSAFYTLPKVFGESKITEYTVQENPMGPGKTEVVIQNKQHYKVLGKPVDLTSLIRLQLQDGKVVKHEDWWHGKPLKNRDTVGVPLVGRLAEASRRGAMLLTHALMGFGKDPTQPPPPPTL

SEQ ID NO: 3329 - DNA, 606 bp, Zea mays
  misc_feature (1)..(606): Ceres cDNA ID no. 21572839
  misc_feature (1)..(606): Ceres CLONE  ID no. 1519053
  misc_feature (1)..(606): Also known as  Ceres CDNA ID no. 0
aacattccctagctgctagctccactccccaccagctctatgccgcagtgtgcgcaagcgcaagcaaacccagagccccacctgccgctgtgccgccactccgggtaaccgcgcgtggggatgaggcagctggcgcggcggctcactcgcgtcgcggactcctcagcgtccccggcggaggagcggcggggcgtcgagaaggctccgcaagcggcggcagtgcccgagggccacgtgccggtgcacgtcggggagcggtcggacggcgaggcggagcgcttcctcgtgcgggctgagctgctgggccgcccggcgctggcccacctcctgggccgtgctgcccaagagtacgggtacggccaccagggcccgctcaggatcccgtgctcccccgccgccttccgccgggcgctcgcggccctcgagccttgacagcgccgctgccgcagtgccgcctgccgccgagccgacgggcaagctatttgggctcccttctttctacttgtgttgtatttgtcacctataaaatacgtcctaaacaggaggcgtacgtatgtatgatcaaaacaattcaacgaacctggtacctattaaaaaaaaaaaaaa

SEQ ID NO: 3330 - protein, 103 aa, Zea mays
MRQLARRLTRVADSSASPAEERRGVEKAPQAAAVPEGHVPVHVGERSDGEAERFLVRAELLGRPALAHLLGRAAQEYGYGHQGPLRIPCSPAAFRRALAALEP

SEQ ID NO: 3331 - DNA, 890 bp, Zea mays
  misc_feature (1)..(890): Ceres cDNA ID no. 21572841
  misc_feature (1)..(890): Ceres CLONE  ID no. 1521307
  misc_feature (1)..(890): Also known as  Ceres CDNA ID no. 25088359
aaagtcctctgcctccgcctgccttgccgccgcccaagtctcgtccgtcgtcgtcgctccgctgccagtcagccgcatctccagcctccagcaggcagagcacccccgctctcgtctccggagccttccggatgggctgcatcttctcgtcgccgggctcggcgcgtgcgctgcggccgtgcgccggggtgcgggtgatccacaccaacgggttcgtggaggacttcgagggccccggcgtggtgaccgtggcgcacgtgacgcgctgcctcggcgggcccggcggccccgcctccgccgccaacgccgccgggaaggggtacgtgctgtgctcgtcggcgcacctgctgcagccggggcgcgggccgttccggcccgacgacgcgctgcagccgggaaccgtctacttcctgctcccgcagtcggtgttccaggccgagtcctccgccgtggacctcgcgtgcctcatgaaccgcctcacggcgctcgcccgcaagggcggcgccagcgccgcgcccaagcccagcccgctcgacgcgctcttcgacgccgcagccgccgccgccgcctccgccgggagccaccgccagcacaaccagcagcggatgcccgtggccgcggcggcgagggagaagaagggtcagccctggcgggcggcgccgtggaagccctgcctcgaccgcatcgacgagtccgtcggccgcgcctccatgcgcagcgcgtccagcggctgcagcagcgaggcctgatcattggctccatctagtccccttttcccctctcgtcttctgcagtagtgcatacagatggatggttttgcagaactgtgtgtaaagatctgttgctttgccggtagtgattaattagattcattcaaaaaaaaaaaaaaa

SEQ ID NO: 3332 - protein, 205 aa, Zea mays
  misc_feature: PFam Name: FH2; PFam Description: Formin Homology 2 Domain
  misc_feature: PFam Name: Pyr_redox_2; PFam Description: Pyridine
  misc_feature: PFam Name: Cupin_1; PFam Description: Cupin
  misc_feature: PFam Name: Peptidase_S8; PFam Description: Subtilase family
  misc_feature: GI Number: 55239156; NR Description: ENSANGP00000028192
  misc_feature: GI Number: 66779249; NR Description: similar to ATP-dependent protease [Anaeromyxobacter dehalogenans 2CP-C] >gi|66854938|ref|ZP_00399016.1| similar to ATP-dependent protease
  misc_feature: GI Number: 50902298; NR Description: P0497A05.11 [Oryza sativa (japonica cultivar-group)] >gi|20804886|dbj|BAB92567.1|
  misc_feature: GI Number: 55239256; NR Description: ENSANGP00000027848
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
MGCIFSSPGSARALRPCAGVRVIHTNGFVEDFEGPGVVTVAHVTRCLGGPGGPASAANAAGKGYVLCSSAHLLQPGRGPFRPDDALQPGTVYFLLPQSVFQAESSAVDLACLMNRLTALARKGGASAAPKPSPLDALFDAAAAAAASAGSHRQHNQQRMPVAAAAREKKGQPWRAAPWKPCLDRIDESVGRASMRSASSGCSSEA

SEQ ID NO: 3333 - DNA, 770 bp, Zea mays
  misc_feature (1)..(770): Ceres cDNA ID no. 21572843
  misc_feature (1)..(770): Ceres CLONE  ID no. 1523182
  misc_feature (1)..(770): Also known as  Ceres CDNA ID no. 0
aagctcagcatacacaacatcatcatcatcatcttctcgctagtcgagcgagcccttatagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggctgaaacagctgaagatctaggaggtcaattgaacatataggacgaacgatcgatgatccagaagatgcaaacatgtgtgtatataggattaatgggacagtatcagtatgcatgcaatggtccatgctgcaagtgcatgcaagtggtgtgtgaaagcaagaatcagattagatgcatgcatatgcatgtgttaatttagtagtaataattgtagtatgggatgagtcctatactagccagtcacgcgcgatcgaccgaccgacccatcgatctccaatgcttctgttccctctccctcctacttgtccacttgtgtgtatatataaatattatgtatttttattattatatatactctacctgttctaaagaaaaaaaaaaaaaaaaa

SEQ ID NO: 3334 - protein, 96 aa, Zea mays
MASLSMTTSAAARAQWTPRQNKLFEQALAVYDKDTPDRWHNIACAVGGGKSADDVRRYYELLEEDVGHIESGKVPFPAYRYPAGYGAADRLKQLKI

SEQ ID NO: 3335 - DNA, 853 bp, Zea mays
  misc_feature (1)..(853): Ceres cDNA ID no. 21572845
  misc_feature (1)..(853): Ceres CLONE  ID no. 1524520
  misc_feature (1)..(853): Also known as  Ceres CDNA ID no. 0
aacgcctcggctcgtatcgtactcatcacacatacacaatagttcgcagcttgtagtgctcgtccttgccttgtccctctctctccggggaatcgtagccaagtccacgcggcgcgcgtgcatgaagaagaagggcggcggcggcggcgggtgcctcggcgcgccgatgcgcgcgctgtcgcgggcgtgcgactcggcctgcgacctctacgtgcgcggcatgtccgggtgcgcgcgcggcgtgccgcgggggtcgtccgcgggcatcgtggggcggggcttcggcggcggcggctccggcgccgcgaccctgcgcctccgggtcagctcggacaaggccgacgacgacctcgtccgcgccgcggcagcggccgcggccgccaggcgccagcgccgcgtcgcggccgagccggacacggcgacagcagaggcccgtaaggtgggcagcgccggcggaggactgcccgtcagggcgccgcccgcgcggaagagggccgctgcggccaccatgggcaccatcgccgaggacgcgccgtgcgagttcgtcggactggacggcggcggtggcgcctgcgctgctcctgtcccctcgctcaacccgccgcgccgcgggggtttcgtcgccgtcaaggcggggggcgacgtctttgcgcgctgacccattcggctacgatcgccctgccactgcagaatcagcttcgagtcatcccttatgtcatggcgccacttttctccctccttctctcgtctctctgtctatagcttgacgtgtaaattactctagggataactacgagagcagtgtatctttacgaaatctatgcatgagtgtgatttgatcaaaaaaaaaaaa

SEQ ID NO: 3336 - protein, 178 aa, Zea mays
MKKKGGGGGGCLGAPMRALSRACDSACDLYVRGMSGCARGVPRGSSAGIVGRGFGGGGSGAATLRLRVSSDKADDDLVRAAAAAAAARRQRRVAAEPDTATAEARKVGSAGGGLPVRAPPARKRAAAATMGTIAEDAPCEFVGLDGGGGACAAPVPSLNPPRRGGFVAVKAGGDVFAR

SEQ ID NO: 3337 - DNA, 1569 bp, Zea mays
  misc_feature (1)..(1569): Ceres cDNA ID no. 21572846
  misc_feature (1)..(1569): Ceres CLONE  ID no. 1529084
  misc_feature (1)..(1569): Also known as  Ceres CDNA ID no. 23830647
aaccacttctctcgctttcgctttatcacctgtcgcccccgcccccgagcctggtcgccgcttcacccgccgtcgccgtcgtcggtcgggacgcctccgggcggccgcgccctcgacggaggaatgtcttctgctgctcccgccctcgtccaccaccgtggggtctcaggcagagcaatcttacctttgcatcatggagaatgcagagtccctccaggtgcttgtttcatgggcacatcacctacgttggggccaatgagggtatccttggtatgtaatgcaagccccaaccaccataggccaaggaattcggatatatcgcgacaacaaaaaggggggtcctccagaggaaaaggcaagtcgtaccaggataaagatgactctgagaacattgatgaatttgatagtgatatcatgttctccaagaatgggccaccaatctctttggcaagcaattcccgtcctcaagccacatcggctcctggggaaagagagaaggagatcgtggaactatttaaaagggttcaagcacagctgcgagctagggggaaaagcagggaagacaagaagcctgaacatgcaaaagtgcagggtgaaaggggcagtgttgattcacttcttcagttgctcaggaaacactctgtggaccagagaagaaagaatggtgatgacaaagagcagaattccgatgtattgaggagaggcaacgattctggaaatagacaaggttcaaccgtctttggcacaaaaagtgagatccaggaagagaagaagaagccacctccggcacccttcataaggccagcctcaaatttcaggcgaaggtctcctgttcctggagtgaagttccagcctgttatcaatgcggatctggacacagatgacgatcgcaagtccatcggcagtaatgccgtggatgctgtacagaaagctaagacagctcttgatgagaggactgctacagatgagcctgactccatgtctccatatgaggcggattctgtaatagaaccaggaaacatttctttgaatgacctcgatgacattttagatgacgacgaagaattcgatgcagatgaaccagacgacgagtatccagaaccttctttgggaatatctgatgtcacagatacggatgagtcgcacgagaacaactccacccccacaggaagtgcggatctaagctctctgaaggttgcggagctgagagagctcgcaaagtctcgaggaatcaaagggtactcgaagaagaagaaaaacgagctggttgaagtgttgagcagcagcatggattgatgataaagtgggtgagctggcgctctgtttgaagtttgaacccactttgcttggccccctctagaaaattgtaaatgagcaaggctaactctgttccggtctgtgctgatcttttgctggttcattttgtacgcctagcttggtagccgtttagctgaattctgtggtgagtggagtaaggtagctgagagccttagctgtttgtgtactaaatcaatgcactgcatccgttctagggtgttgttcgtctgttttccgaaaaaaaaaaaaaaa

SEQ ID NO: 3338 - protein, 390 aa, Zea mays
  misc_feature: PFam Name: Rho_N; PFam Description: Rho termination factor,
  misc_feature: GI Number: 21727822; NR Description: SAP-like protein [Oryza sativa] >gi|21727820|emb|CAC86222.1| SAP-like protein [Oryza
  misc_feature: GI Number: 50920397; NR Description: Putative plasma membrane proton ATPase [Oryza sativa] >gi|15217290|gb|AAK92634.1| Putative
  misc_feature: GI Number: 21536878; NR Description: unknown [Arabidopsis thaliana]
  misc_feature: GI Number: 19347613; NR Description: Riaa1 [Oryza sativa]
MSSAAPALVHHRGVSGRAILPLHHGECRVPPGACFMGTSPTLGPMRVSLVCNASPNHHRPRNSDISRQQKGGSSRGKGKSYQDKDDSENIDEFDSDIMFSKNGPPISLASNSRPQATSAPGEREKEIVELFKRVQAQLRARGKSREDKKPEHAKVQGERGSVDSLLQLLRKHSVDQRRKNGDDKEQNSDVLRRGNDSGNRQGSTVFGTKSEIQEEKKKPPPAPFIRPASNFRRRSPVPGVKFQPVINADLDTDDDRKSIGSNAVDAVQKAKTALDERTATDEPDSMSPYEADSVIEPGNISLNDLDDILDDDEEFDADEPDDEYPEPSLGISDVTDTDESHENNSTPTGSADLSSLKVAELRELAKSRGIKGYSKKKKNELVEVLSSSMD

SEQ ID NO: 3339 - DNA, 914 bp, Zea mays
  misc_feature (1)..(914): Ceres cDNA ID no. 21572847
  misc_feature (1)..(914): Ceres CLONE  ID no. 1531817
  misc_feature (1)..(914): Also known as  Ceres CDNA ID no. 24359305
attctcttcctctgcatccatcatcctcagctcctaccatgagtacacggatacacccttcgtcttcggacgctgccggccgtgcccaccatcgtcgtcgggctgctgctgctgaacgggaacgccggccgccggcggtgtacacggtgtggaagaggtccagcatgggcttccagggcaccgacggcttctgcgtctacgacgacgccggcaggctcgcgttccgcgtcgacaactactcccgccgccgcaagctctgcgccggcgacctgctgctcatggacggccaaggcacgcctctcctctccctcaggccacagcttctcagtctgcacgaccgttggaactgctacacagcaacggaagacgccgtcgtggacaagaaggcgcctcccgcgtcttcggcgcagcagcaggtgttcacgatgagcaggtgctcagctctgcgtagcagcagcgacaacgcggaggtgcacatgtcagcctcaagaccgggctctactgccgcgtcgtcctcgtcctcctctctcagtagtctcagctgcaacaagcacaacccgcgggccgccgctcccggctaccgggtcgagggctccttctcgaggcggagctgcaagatccggcgcggcagcgatggcagggaggcggcgcggataacgaggaagagcgccggcgtggcgtccaggccggtggccacgctcggggacgacgacgtgttcagcctcgtggtccggccgggcgtcgacgtggccaccgtcatggccatcgtcgtcgtcatggacaggatctgtcgcaggccgtacacgcccatggtgtgcgtgtgcccttcgcagtgagagtggtaatgagaaacgtgtataagtgttctgattttgacattgcatttgctaattattgctaaaaaaaaaaaaaaa

SEQ ID NO: 3340 - protein, 265 aa, Zea mays
MSTRIHPSSSDAAGRAHHRRRAAAAERERRPPAVYTVWKRSSMGFQGTDGFCVYDDAGRLAFRVDNYSRRRKLCAGDLLLMDGQGTPLLSLRPQLLSLHDRWNCYTATEDAVVDKKAPPASSAQQQVFTMSRCSALRSSSDNAEVHMSASRPGSTAASSSSSSLSSLSCNKHNPRAAAPGYRVEGSFSRRSCKIRRGSDGREAARITRKSAGVASRPVATLGDDDVFSLVVRPGVDVATVMAIVVVMDRICRRPYTPMVCVCPSQ

SEQ ID NO: 3341 - DNA, 1739 bp, Zea mays
  misc_feature (1)..(1739): Ceres cDNA ID no. 21572848
  misc_feature (1)..(1739): Ceres CLONE  ID no. 1532145
  misc_feature (1)..(1739): Also known as  Ceres CDNA ID no. 24359342
aagcaagtagtgtcgaacgagagccacatcccgctctccacccgggcgcgcgtgtcctccgtttcgccatgtccaactccaagcagcacgacgccgccgacgacggcggcatcccagcccccgaggcgccggcaaagcgcccaccgcttaacaagtacgccctcgcctgcgccgtcctcgcttccatgaactccatcctcctcggctacgatgtgtcggtgatgagcggagcgcagctattcatgaagcaggacctcaagatcacggacacgcagatcgagatcctcgccggcatcatcaatatctactcgctcgtcggctcgctcgcggcgggccggacgtccgactggctcggccggcggtacaccatggtgctcgcggcggccatcttcttcgcgggcgcgctcatcatgggcctcgccccgagctacacgatcctcatgcttggccgcttcgtggcgggcgtcggcgtcggatacgcgctcatgatcgcacccgtgtacacggccgaggtctcgcccacgtcggcgcgcggcctgctcacgtccttcccggaggtgttcatcaacacgggggtgctcctcgggtatgtctccaactacgccttccacggcctccccgtgcacctcagctggcgcgtcatgttcctcgtcggcgccgtcccgcctatcttcctcgcactgggggtcctcgccatgccggagtcgccgcggtggctcgtcatgcaggggcgcatcggcgacgcgcgccgcgtgctggccaagacctccaactcccccgccgaggccgaggagcggctcgccgacatcaagaatgccatcggcatcccagacggcgtcggcgacaacgacgacgacgtggtggtggtcgcccgcaggaacaagggcagccatggcgaaggggtgtggagggacctcctcatccgcccgacgccgcccgtccgccgcatactcatcgcctgcctcggcctccagttcttccagcaggcctccggcatcgactccgtggtgctgtacagcccgcgggtgttcgagaaggctgggcttaggtcgaacaacaactctttgggcgccaccatggcggtgggcgcgaccaagacgctgttcatcctggtggccacgttcttcctcgaccgcgtcgggcggagaccgctgctgctcacaagcgcgggcgggatggtggtgtcgctggtgacgctggcctcggcgttgcgcgccatcgaccggctcccagagggacaggcgacgtcgctggcgggcgtgagcatcgcggcggttctcacgttcgtggcgtccttctccatcggcatgggcccgatcgcgtgggtgtacagctcagagatattcccactgcggctccgcgcgcagggctgcgcactcggcacggcgatgaaccgggtcatgagcggcaccatcaccatgtccttcatctcgctctacaaggccatcaccttcgccgggagcttctacttgtatgcaggcattgctgctgccgggtggctgttcatgttcttcttcctgccggagacgaggggcagcaacctagaggacaccgagaagctcttcggcggtggcgaccacgacgaggacaaggaagatggacacgatgcgcagaagtccactgagttgagtagtagccaacagtgaccttatctgtatctgatagtatgtacgctagtaaaaaaaacagactttttttttacttagatcactgcactttaaagcaaaaaaaaaaaaaaa

SEQ ID NO: 3342 - protein, 1739 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 34392081; NR Description: polyol transporter
  misc_feature: GI Number: 30025133; NR Description: putative sorbitol
  misc_feature: GI Number: 4678208; NR Description: putative sugar transporter [Arabidopsis thaliana] >gi|15226682|ref|NP_179209.1| mannitol transporter, putative [Arabidopsis thaliana] >gi|25308957|pir||H84536 probable sugar transporter [imported] -
  misc_feature: GI Number: 4678209; NR Description: putative sugar transporter [Arabidopsis thaliana] >gi|15226696|ref|NP_179210.1| mannitol transporter, putative [Arabidopsis thaliana] >gi|25308959|pir||A84537 probable sugar transporter [imported] -
  misc_feature: GI Number: 16118827; NR Description: putative sugar
AAGCAAGTAGTGTCGAACGAGAGCCACATCCCGCTCTCCACCCGGGCGCGCGTGTCCTCCGTTTCGCCATGTCCAACTCCAAGCAGCACGACGCCGCCGACGACGGCGGCATCCCAGCCCCCGAGGCGCCGGCAAAGCGCCCACCGCTTAACAAGTACGCCCTCGCCTGCGCCGTCCTCGCTTCCATGAACTCCATCCTCCTCGGCTACGATGTGTCGGTGATGAGCGGAGCGCAGCTATTCATGAAGCAGGACCTCAAGATCACGGACACGCAGATCGAGATCCTCGCCGGCATCATCAATATCTACTCGCTCGTCGGCTCGCTCGCGGCGGGCCGGACGTCCGACTGGCTCGGCCGGCGGTACACCATGGTGCTCGCGGCGGCCATCTTCTTCGCGGGCGCGCTCATCATGGGCCTCGCCCCGAGCTACACGATCCTCATGCTTGGCCGCTTCGTGGCGGGCGTCGGCGTCGGATACGCGCTCATGATCGCACCCGTGTACACGGCCGAGGTCTCGCCCACGTCGGCGCGCGGCCTGCTCACGTCCTTCCCGGAGGTGTTCATCAACACGGGGGTGCTCCTCGGGTATGTCTCCAACTACGCCTTCCACGGCCTCCCCGTGCACCTCAGCTGGCGCGTCATGTTCCTCGTCGGCGCCGTCCCGCCTATCTTCCTCGCACTGGGGGTCCTCGCCATGCCGGAGTCGCCGCGGTGGCTCGTCATGCAGGGGCGCATCGGCGACGCGCGCCGCGTGCTGGCCAAGACCTCCAACTCCCCCGCCGAGGCCGAGGAGCGGCTCGCCGACATCAAGAATGCCATCGGCATCCCAGACGGCGTCGGCGACAACGACGACGACGTGGTGGTGGTCGCCCGCAGGAACAAGGGCAGCCATGGCGAAGGGGTGTGGAGGGACCTCCTCATCCGCCCGACGCCGCCCGTCCGCCGCATACTCATCGCCTGCCTCGGCCTCCAGTTCTTCCAGCAGGCCTCCGGCATCGACTCCGTGGTGCTGTACAGCCCGCGGGTGTTCGAGAAGGCTGGGCTTAGGTCGAACAACAACTCTTTGGGCGCCACCATGGCGGTGGGCGCGACCAAGACGCTGTTCATCCTGGTGGCCACGTTCTTCCTCGACCGCGTCGGGCGGAGACCGCTGCTGCTCACAAGCGCGGGCGGGATGGTGGTGTCGCTGGTGACGCTGGCCTCGGCGTTGCGCGCCATCGACCGGCTCCCAGAGGGACAGGCGACGTCGCTGGCGGGCGTGAGCATCGCGGCGGTTCTCACGTTCGTGGCGTCCTTCTCCATCGGCATGGGCCCGATCGCGTGGGTGTACAGCTCAGAGATATTCCCACTGCGGCTCCGCGCGCAGGGCTGCGCACTCGGCACGGCGATGAACCGGGTCATGAGCGGCACCATCACCATGTCCTTCATCTCGCTCTACAAGGCCATCACCTTCGCCGGGAGCTTCTACTTGTATGCAGGCATTGCTGCTGCCGGGTGGCTGTTCATGTTCTTCTTCCTGCCGGAGACGAGGGGCAGCAACCTAGAGGACACCGAGAAGCTCTTCGGCGGTGGCGACCACGACGAGGACAAGGAAGATGGACACGATGCGCAGAAGTCCACTGAGTTGAGTAGTAGCCAACAGTGACCTTATCTGTATCTGATAGTATGTACGCTAGTAAAAAAAACAGACTTTTTTTTTACTTAGATCACTGCACTTTAAAGCAAAAAAAAAAAAAAA

SEQ ID NO: 3343 - DNA, 1776 bp, Zea mays
  misc_feature (1)..(1776): Ceres cDNA ID no. 21572849
  misc_feature (1)..(1776): Ceres CLONE  ID no. 1532292
  misc_feature (1)..(1776): Also known as  Ceres CDNA ID no. 24359325
actctttcctccccccggcggccccgcgccgccgccttgttctcctcttctcgccgccgttcagcggcgcgactagcctcgtgccctttgcccctctagattgttcgtgtcacaatagctttgttactgctcctgtttcggccctcctgttttagaagttcctggccgcctcacacgccatgcacgcagcacgttcgcgcaattgcttgagcgatctgcttcactgccagaggcattggcgatgccgatgcccgtaccagctctctccggcacgaggcatgacgcgtggccgcagtgtgaaggaccggagcaagaagaagcgcgtgcacgcgctcgaggtggccaccgagcgctggaaggttctctccaaagtgctcgccgtcgtcgacgcgctcaagaaggaggatgagcacgtcaccccgctcaagcgcctcgagatcctgcggccgcagctcggcctcgtcaagccgcacaaggtggcccacttcgtgcgtcgctcgccgcacctgttcgaggtctgccgcgacagccgcggcgtcatgtgggcaggcctctcgccgcaggcagaggcgctcgtcgaggaggaagcgcgcctgctggaggatcactcccctgtggccgcgcagtacgtcaccaggatgctcatgatgtccgtggaccggcggctgccagtcgacaagatcgcccacttccggcgcgacatgggacttcctcatgactttcgaacacggtgggtgcacatgtttccggagcatttcaggctggtcagattggaggatggtgagtatttggagctcatctcttgggacccaacctgggcagtcactgagcttgagaagaaggcgtctgtgtcgactggcgatgccattgccagttcgccaggagagctgtcgcttccgtttccaatgaaattcccaccaaattttactacttactacagatttcgaggaaaagctcatcattatgtgaaaatgggcaataccgagcagtttcagaaggtcacctacctgtccccttatgcagaggcaaagggattggctcctggatcgccagagtttgataagagggctgttgcagtgatgcatgagatactgagcttcatgctggaaaagaggctggtgactgatcaccttacacatttccgtcgtgagtttgtaatgccacagaagcttatgaggttactcttgaagcattatggcatcttttatgtttctgagaggggaaagaggttgagtgtgttcttaactgaggcatatgatgggaacgaactgatagagaagtgtccgttggtgcggtggagggaaaaactccttcaacttactggttacagagggagattgaagaatcttggtaaagtcgacgtgtgttctgattcagatgagtacttattaggccatgacgatgatgatgatgtattggatgttgaaagtgaaaatccagatgacatcttagatgactgttctatttcagatgattctgagatggatttaggggatgcagatgcagatgaattttgcagagactgagttggtggcatgtgtgtagcagaaaagaacaaaaaaaaagttgtgttaagtttgttatgaaaacaaagttcagcaataactgtttgtgactttaagctcaggatataattgtgtactatactctagctgctgtcatctatggagttccaagtaacacttaaggcgtactgtattcttctctcgtcagttgtatttggactttcaaatattagtcaaagctcaaacagatcacaataaaaaaaaaaaaaaa

SEQ ID NO: 3344 - protein, 448 aa, Zea mays
  misc_feature: GI Number: 21593983; NR Description: unknown [Arabidopsis thaliana]
  misc_feature: GI Number: 21536812; NR Description: unknown [Arabidopsis thaliana]
  misc_feature: GI Number: 7239512; NR Description: Strong similarity to the higher plant tyrosine-specific protein phosphatases (PTPs) from A. thaliana gi|3413424 expressed during embryogenesis. [Arabidopsis
  misc_feature: GI Number: 34912696; NR Description: P0686E09.18 [Oryza sativa (japonica cultivar-group)] >gi|13365580|dbj|BAB39125.1|
  misc_feature: GI Number: 50908051; NR Description: tyrosine-specific protein phosphatase-like [Oryza sativa (japonica cultivar-group)] >gi|47496868|dbj|BAD19832.1| tyrosine-specific protein
MHAARSRNCLSDLLHCQRHWRCRCPYQLSPARGMTRGRSVKDRSKKKRVHALEVATERWKVLSKVLAVVDALKKEDEHVTPLKRLEILRPQLGLVKPHKVAHFVRRSPHLFEVCRDSRGVMWAGLSPQAEALVEEEARLLEDHSPVAAQYVTRMLMMSVDRRLPVDKIAHFRRDMGLPHDFRTRWVHMFPEHFRLVRLEDGEYLELISWDPTWAVTELEKKASVSTGDAIASSPGELSLPFPMKFPPNFTTYYRFRGKAHHYVKMGNTEQFQKVTYLSPYAEAKGLAPGSPEFDKRAVAVMHEILSFMLEKRLVTDHLTHFRREFVMPQKLMRLLLKHYGIFYVSERGKRLSVFLTEAYDGNELIEKCPLVRWREKLLQLTGYRGRLKNLGKVDVCSDSDEYLLGHDDDDDVLDVESENPDDILDDCSISDDSEMDLGDADADEFCRD

SEQ ID NO: 3345 - DNA, 1345 bp, Zea mays
  misc_feature (1)..(1345): Ceres cDNA ID no. 21572851
  misc_feature (1)..(1345): Ceres CLONE  ID no. 1537388
  misc_feature (1)..(1345): Also known as  Ceres CDNA ID no. 24359293
accgccactggacttgcgctccctccacgctccggcccttctcgcctctccggccatggccaccgccgccgcggccgtcgcggccaccttccgcaccctgatccagcacgcagcggcttgtggcgcccccgtcccgctccccagcgtccggttccagagcctgcagcgccaccgcgtcggcctccgccgcctcgcgccaccgcgtgggcgccccgtcctaaccccgcccttcgccgccgaggacttctcatcctacgtagatgatttctccggggacgacggcgaggagcacttcgatgaggaagagggctctgaaccggaggaggaagccgaggccccgcgcgcgtactcgtcgccacgaagccgcccaccgcgcggcgacgaccccggccgtctcttcgtcggcaaccttccctacacctatacctccgaggagctcgcccaggtgttctctgaggccggcagggtcgacgacgcgcagataatctacgacaaggtcaccaacaggagccggggcttcgccttcgtcaccatggccaccgccgaggaggccgccaaggccatccagatgttcgatggcgccctgctgggagggaggacggctagggtgaactacccggaggtgccgcgtggcggggagaggagaacagtcaccatgagtggccgcaggcgtgacgatggcacttacaagatttatgccggcaacctggggtggggggtgcgtgccgacacgttgaggaacgtgttcgagggtagggccggcttgctcgacgccagggtcatctttgagcgtgagactggtcgctccagagggtttgggttcgtctccttcagcaccgcagaggatgcacaggctgcattggagtctttggatggagtggaactggaagggaggccgcttcgtcttagtctggcagaacagaacccgccacctggttccccgcctagcactgcgcaggcacagcaggaagaaacggattcaggcgcacctgctggtgcgggtacggaagcagccagttcttcagaaccatctgaagcagaggtgggcgagagcaacttgcaaacagctgcaaattattgataagcaggagccacagggttataaatgtgttgcaacgacctctaaatcctgccattcgagtccaaggtgtgctgatagggaagtaaattttgacacgagtgatgctgtagcgaggattcagcatttgagctatatacatatacactagaatggattaagtgttgttaggaacgtatttgtgtaatgaattctgcaaagtatgatctcaactgcagttgtgtagcctttctcttacagtcttactgtaaaaaaaaaaaaaaaaaa

SEQ ID NO: 3346 - protein, 341 aa, Zea mays
  misc_feature: PFam Name: RRM_1; PFam Description: RNA recognition motif.
  misc_feature: PFam Name: Pyr_redox_2; PFam Description: Pyridine
  misc_feature: GI Number: 3550485; NR Description: cp33Hv [Hordeum vulgare subsp. vulgare] >gi|7446339|pir||T05730 probable RNA-binding
  misc_feature: GI Number: 21553418; NR Description: RNA-binding protein cp33 [Arabidopsis thaliana] >gi|681910|dbj|BAA06522.1| cp33 [Arabidopsis thaliana] >gi|4886289|emb|CAB43448.1| RNA-binding protein cp33
  misc_feature: GI Number: 17064758; NR Description: ubiquitin / ribosomal
  misc_feature: GI Number: 681912; NR Description: cp33 [Arabidopsis thaliana]
  misc_feature: GI Number: 311952; NR Description: 33 kd chloroplast ribonucleoprotein [Nicotiana sylvestris] >gi|7446342|pir||S77714
MATAAAAVAATFRTLIQHAAACGAPVPLPSVRFQSLQRHRVGLRRLAPPRGRPVLTPPFAAEDFSSYVDDFSGDDGEEHFDEEEGSEPEEEAEAPRAYSSPRSRPPRGDDPGRLFVGNLPYTYTSEELAQVFSEAGRVDDAQIIYDKVTNRSRGFAFVTMATAEEAAKAIQMFDGALLGGRTARVNYPEVPRGGERRTVTMSGRRRDDGTYKIYAGNLGWGVRADTLRNVFEGRAGLLDARVIFERETGRSRGFGFVSFSTAEDAQAALESLDGVELEGRPLRLSLAEQNPPPGSPPSTAQAQQEETDSGAPAGAGTEAASSSEPSEAEVGESNLQTAANY

SEQ ID NO: 3347 - DNA, 1891 bp, Zea mays
  misc_feature (1)..(1891): Ceres cDNA ID no. 21572853
  misc_feature (1)..(1891): Ceres CLONE  ID no. 1541937
  misc_feature (1)..(1891): Also known as  Ceres CDNA ID no. 0
aatcgaaatcaatcgtgttcctcgcctgcacgacgagaacccgagaccaatccagccgccgcctccgccttcgccttcgccttcgcctcgcctagtattccctccgattcagaggccgatggagtgcatcgccgagatgccccgcgcgccgctggacagcaggctgcgcaagcgtcagcgtctcggctgggacgtcggccctgccgagatgtataaggccgtgcggccgcggcacgggtgggacgtcggccccgccgagatgtatcagattccacaacgttttactcttattaaactccccaacttcgtctaaggaagcaagtgatttcattatgaaagactggtctattttctccaaactcgatcacaatggaggttacctccccaggttcccaatagactctccaatatctcatgatattgggttacgattggtatcgcaagtcggaaacttagttgagtgttcatttcaacatccaaggcatatatgtgctacggggagtggagctgttcaggaagcattcagctgtttcaacaagtttgctggagctttctatttctggttttctagagcatcgaatcctaagttattccaaaggctatcagctgctgcaggctcaagttcaagagcttgtcggtcacacataaagcaagtgacctcttgcttgcagcatttacctggactggagtttggttcacaattaagagaagatcatgctgtacaagtgcttttagcaaggcttgcaagcgcaacttttggacgcctgtggacagaggtggaggagcgacatgcctgcaacatccttatgctggctgctgctactgtaattccaccatttgaaaacatatcaccaaagatgctggctgcgtcaatggcactaagaaaagatcgtggaaacatagagcctactgaacaatcttattcagaggaaaaccgtccaggttgtgtgtgtgttgctgtgccaagagtactcttaccagaagatgcaacggaaccaacaactggcatcaaattccccactgtactcgaagacaattccaatctgactacagaggtccttgttggaatgggttttagaagcatgcgaataatgagggtcaaaaatctgaatctttatgcctttggattatatatacaacctgattctgtctgcaagaagctgggtccaaagtacgcttatattccagatgctgagttaaaggatcacccagatttctatgaagatcttctgagggaaaatattgatatgactgttaggctagtagtaagctacaatggtctcagcattggcacagttcgagatgcatttgagaagtctcttggcttccggttgcaaaagatgaatcctaatactgattatggttgcttgaagacatttggttcttgttttagtgaagacattcgtatacctgctggtacaaagattgacttccggcaaacatctgatggccagctaataactgaaattgatggcaaacaaattggcactgtccagagcaaagatctttgcagagccttcttcgatatgtatattggtgaccccccagtttcagtggagaccaaacaagacattgcgcaaaatgtggctggactcataagaagatgctagggaaacgggaaaactaaatcgaagaacctggaattatttcattcatctatacaaggagaggacatataaacagaaaggaagccaggagaggatcgattgtatttatagtggtagactgtctttgtaagctataaacataaagcatatgcttggcaaaggcctccatgcctttcatatggtttggcattttcgccatttcctggctggctggcgtgctgtatcatgtctacaaatatatgatacagtaaaaagttgtaaaaaaaataaaaaaaaaaaaaaaa

SEQ ID NO: 3348 - protein, 425 aa, Zea mays
MKDWSIFSKLDHNGGYLPRFPIDSPISHDIGLRLVSQVGNLVECSFQHPRHICATGSGAVQEAFSCFNKFAGAFYFWFSRASNPKLFQRLSAAAGSSSRACRSHIKQVTSCLQHLPGLEFGSQLREDHAVQVLLARLASATFGRLWTEVEERHACNILMLAAATVIPPFENISPKMLAASMALRKDRGNIEPTEQSYSEENRPGCVCVAVPRVLLPEDATEPTTGIKFPTVLEDNSNLTTEVLVGMGFRSMRIMRVKNLNLYAFGLYIQPDSVCKKLGPKYAYIPDAELKDHPDFYEDLLRENIDMTVRLVVSYNGLSIGTVRDAFEKSLGFRLQKMNPNTDYGCLKTFGSCFSEDIRIPAGTKIDFRQTSDGQLITEIDGKQIGTVQSKDLCRAFFDMYIGDPPVSVETKQDIAQNVAGLIRRC

SEQ ID NO: 3349 - DNA, 975 bp, Zea mays
  misc_feature (1)..(975): Ceres cDNA ID no. 21572854
  misc_feature (1)..(975): Ceres CLONE  ID no. 1542028
  misc_feature (1)..(975): Also known as  Ceres CDNA ID no. 24371173
gtcagtccagccaccgcacacctccctcccgagtcccggccatgggacgcggcagtgacctgcttctgcgtcgtggtcgtcgtccgagcacggggaccgaacgcgagcagtagcagcatcccggagcgcaggagcatggcgatggacgacggcggcgacgacttcaccttcgccgccgcccagccgcctcctagtctagtatctgcaggaggcggcggtttcataggcccgccgctgctgtacccagtcttcggccggccgagatcccctccgcgggctgctccggagacggccaccgcgcgggtgccgctaggacggttcctgctggtggacagggatccgtcgcagccgccgccgcctgctcccgcggacgacgacgacggcgacctcgactcggtgccggcggagatgttctgcccgtggtcccgtgggtggtcgaccgcagccgcagcggcgtcctcccaggcgcggtgcaagaagagcggctccacggggtccgtgctccggtggcggccccggctcgccgtcgggcgcagccagagcgacggcaaggagaagttcgtcttcctgagcgcctcctccggcgggtccgggcgccggagccagaaggggctagtaggcagcgccgtggacgtggagggtggtgcccaccacgcctggaggcattacgccaacaacactagtgagggcggtggcgcgcggcgccagaggtcgttcctgccgtacaagcaggacctcgtcgggttgttcgccaacgccgccgtgttccgccggagctacctcccgttctgatgcaatccattctcagtacgtggcatgtactacgcgggtacagtgatacactcacgcacgcaagtagagtagcgattcagtgtaccgtgtgctatactgctgtactagcttatatacgcaaaaagaaactaagtaatataaataaataaagctggaatcgttttacaaaaaaaaaaaaaaaaa

SEQ ID NO: 3350 - protein, 218 aa, Zea mays
  misc_feature: GI Number: 34912066; NR Description: P0445H04.35 [Oryza sativa (japonica cultivar-group)] >gi|20521218|dbj|BAB91735.1| P0671D01.12 [Oryza sativa (japonica cultivar-group)] >gi|21952910|dbj|BAC06322.1| P0445H04.35 [Oryza sativa (japonica
  misc_feature: GI Number: 34911600; NR Description: P0004A09.25 [Oryza sativa (japonica cultivar-group)] >gi|15290094|dbj|BAB63787.1|
MAMDDGGDDFTFAAAQPPPSLVSAGGGGFIGPPLLYPVFGRPRSPPRAAPETATARVPLGRFLLVDRDPSQPPPPAPADDDDGDLDSVPAEMFCPWSRGWSTAAAAASSQARCKKSGSTGSVLRWRPRLAVGRSQSDGKEKFVFLSASSGGSGRRSQKGLVGSAVDVEGGAHHAWRHYANNTSEGGGARRQRSFLPYKQDLVGLFANAAVFRRSYLPF

SEQ ID NO: 3351 - DNA, 1041 bp, Zea mays
  misc_feature (1)..(1041): Ceres cDNA ID no. 21572855
  misc_feature (1)..(1041): Ceres CLONE  ID no. 1542605
  misc_feature (1)..(1041): Also known as  Ceres CDNA ID no. 24359285
accctttctttttttccccagcaccaccaccaccaccaccaccagcagtagccaggatggggtgcgtgtcgtccgccttgctcgaggaggacggcgccgaggacgaccgccgccgcatcatctcgcaccaccacatcgtctccctcacctcctccacctacggcatcctcaccagcccgcgagcctactgctcctcctcgtcgtcttccactgcccttggctcagagccgttggctcgttgcgcgcctcctcctccccctcctctgactccccctccaccgacgacggcaagacaacaagcagccccagcaccgaaacccgaatcccagccccaggcggaggtcatcaactcctgggagctcatggcaggcctcgtggacccctcgacgccgggcaagcccacgaagctcgacggcggcggcagggaccagcagcgccgccgccgcatccctctgcgcgccatcgacggcaactcttccgtctccaaggctccgtcctcgtccgcggttgtgctctacaccacctccctccgcggggtccgcgtcaccttcgaggcctgcaacgccgtccgcgcggcgctgcaggcgcacggcgtcgccttccgggagcgcgacgtgtccatggaccgcgggttcagggacgagctgaggagcaggctggggctggggctgggcggcggcagagcagcagcggcgggcatgctccccaggctgttcgtgcggggccgtcacgtgggcggcgcggaggacgtgctgcgcctggacgaggagggcctcctggcgcggctgctggatggcctgcccagggcgcgcggaggggcctactgctgcgacggatgcggcggcatgaggttcctgccctgcttcgactgctcggggagccgcaagctggctgtcgcgcttcccgtggtggcctcctcgcggaagaaagcagggaccgtggtggtgcgatgcggggagtgcaacgagaatggactcgtgctctgcccaatctgctcctgaataaaacgacgacagagtgctacaaaaaaaaaaaaaaaaa

SEQ ID NO: 3352 - protein, 314 aa, Zea mays
  misc_feature: PFam Name: Glutaredoxin; PFam Description: Glutaredoxin
  misc_feature: PFam Name: FH2; PFam Description: Formin Homology 2 Domain
  misc_feature: PFam Name: Pyr_redox_2; PFam Description: Pyridine
  misc_feature: GI Number: 50904589; NR Description: peptide transporter protein-like [Oryza sativa (japonica cultivar-group)] >gi|41052897|dbj|BAD07809.1| peptide transporter protein-like [Oryza sativa (japonica cultivar-group)]
  misc_feature: GI Number: 34899868; NR Description: peptide transporter-like [Oryza sativa (japonica cultivar-group)] >gi|22831078|dbj|BAC15940.1| peptide transporter-like [Oryza sativa (japonica cultivar-group)] >gi|50509619|dbj|BAD31449.1|
  misc_feature: GI Number: 50912785; NR Description: glutaredoxin-like [Oryza sativa (japonica cultivar-group)] >gi|46390946|dbj|BAD16460.1|
  misc_feature: GI Number: 10241626; NR Description: Contains similarity to
  misc_feature: GI Number: 17381052; NR Description: putative peptide
MGCVSSALLEEDGAEDDRRRIISHHHIVSLTSSTYGILTSPRAYCSSSSSSTALGSEPLARCAPPPPPPLTPPPPTTARQQAAPAPKPESQPQAEVINSWELMAGLVDPSTPGKPTKLDGGGRDQQRRRRIPLRAIDGNSSVSKAPSSSAVVLYTTSLRGVRVTFEACNAVRAALQAHGVAFRERDVSMDRGFRDELRSRLGLGLGGGRAAAAGMLPRLFVRGRHVGGAEDVLRLDEEGLLARLLDGLPRARGGAYCCDGCGGMRFLPCFDCSGSRKLAVALPVVASSRKKAGTVVVRCGECNENGLVLCPICS

SEQ ID NO: 3353 - DNA, 877 bp, Zea mays
  misc_feature (1)..(877): Ceres cDNA ID no. 21572856
  misc_feature (1)..(877): Ceres CLONE  ID no. 1543066
  misc_feature (1)..(877): Also known as  Ceres CDNA ID no. 24359545
aaagacagttggagggggtaattcggagcagctagcagacagacagacgaaatggcttccgtcctccaccacctcttcccgctcgtcgtcgtcctcctcctcgcggccgctgccgacgcggccaccttcaccgtgaccaacaactgcccgtacaccgtgtgggcggccgccgtgccgggcggcgggcagcagctggacaacgggcagacgtggagcatcgacgtgccggcgggcacgacgggcgggcgcgtgtgggcgcgcacgggctgctccttcgacggcagcggcaacgggcagtgccagacgggcgactgcggcggcgtgctgcagtgcgcgcagtacgggcaggcgcccaacacgctggccgagttcgggctcaacaagttcgacggcctcgacttcttcgacatctccctggtggacggcttcaacgtgcccatggacttcctgcccgccggcgacggctccgggtgccccaagggcgggccgcgctgcgacgccgacgtcacgtcgcagtgccccgccgcgctgcaggcccccggcggatgcgacaacccctgcaccgtgttcaagacggaccagtactgctgcaccggctcggcgacggacaactgcgggcccaccgactactccaagttcttcaaggggctctgcccggacgcctacagctatcccaaggacgacgccaccagcacctacacttgccccggcggcaccaactacaacgtcgtcttctgcccatgagctccatcgagctgctcaaacatacgtacctatatagttgatccaggagacacgtacgtgagaaacaaataaactaaactagcacacaaatgatgaaatgaataagttattatgaataaaaaaaaaaaaaaaa

SEQ ID NO: 3354 - protein, 230 aa, Zea mays
  misc_feature: PFam Name: Thaumatin; PFam Description: Thaumatin family
  misc_feature: GI Number: 50917505; NR Description: putative antifungal zeamatin-like protein [Oryza sativa (japonica cultivar-group)] >gi|41469595|gb|AAS07338.1| putative antifungal zeamatin-like
  misc_feature: GI Number: 14164983; NR Description: thaumatin-like protein
  misc_feature: GI Number: 50917481; NR Description: putative pathogenesis-related thaumatin-like protein [Oryza sativa (japonica cultivar-group)] >gi|41469190|gb|AAS07119.1| putative pathogenesis-related thaumatin-like protein [Oryza sativa
  misc_feature: GI Number: 2062389; NR Description: pathogenesis-related
  misc_feature: GI Number: 7442171; NR Description: thaumatin-like protein - rice
MASVLHHLFPLVVVLLLAAAADAATFTVTNNCPYTVWAAAVPGGGQQLDNGQTWSIDVPAGTTGGRVWARTGCSFDGSGNGQCQTGDCGGVLQCAQYGQAPNTLAEFGLNKFDGLDFFDISLVDGFNVPMDFLPAGDGSGCPKGGPRCDADVTSQCPAALQAPGGCDNPCTVFKTDQYCCTGSATDNCGPTDYSKFFKGLCPDAYSYPKDDATSTYTCPGGTNYNVVFCP

SEQ ID NO: 3355 - DNA, 1867 bp, Zea mays
  misc_feature (1)..(1867): Ceres cDNA ID no. 21572857
  misc_feature (1)..(1867): Ceres CLONE  ID no. 1543796
  misc_feature (1)..(1867): Also known as  Ceres CDNA ID no. 23836273
aaccacccaccaacccaccatccccgatcgcccttggagatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaggcctacctcgccgcggaggcctacctgggcgccaccttcgccggccgcgccagcaggctccgcgccgagctcccgggcggcagcgaccgcgtcagcctcgccgtcgacgaccacgtcgaggtcaccgacgccttccgcggcgcccggatgcggtggcgcaagacgcggacgctccgccgcggcaacgtgatcgcctggaacccgcgtgaggaggagcgccgcgcctactgcctcaccttccaccgccgccaccgcgcgctcgtcgaggccgcctacctgccgcacgtcctcgccgagggccgcgccgccaccgtccggaaccgccagcgccgcctctacaccaacaacgccagcggggactggggcggcggcgacgacgggccccgcgcctggacgcacgtcaagctggagcacccgtccacgttcgccacgctcgccatggacccggacaggaagcgggaggtcgtcgacgacctcgacatgttccgcgacggcagggactactacgcgtccgtgggcaaggcgtggaagcgcggctacctgctgttcggcccgcccggcaccggcaagtccaccatgatcgccgccatggccaactacctgggctacgacatctacgacctggagctcacggcggtcaagagcaacacggagctcaggaagctcttcatcgagaccaagagcaagtccatcatcgtcatcgaggacatcgactgctccatcgacctcaccggcaagcgaaagaagaagaagaaggacaagaacgatacgaagaagaagaagaagaaggcgccgtgggaagaagaagacaaggacgaaggcagcaaggtgactctttcagggctcctcaacttcatcgacgggctgtggtcggcgtgcggcggcgagcgcatcatcgtgttcaccaccaaccacaaggacaagctggacccggcgctgatccggcgcggcaggatggacatgcacatcgagatgtcctactgctgcttccagggcttcaaggtgctcgccaaaaactacctgggcgtgcaggagcatgacggcggccaccaggagctgttcggcgacatccgtcggctgctggaggaggtggacatgactcccgcggacgtggcagagaacttgatgcccaggtccaagaccaaggacgccgacgcctgtctccggaggctcgtcaaagcgctcgaggaggccaaggaggcggcgttgttggcagccaaagccaaacaactggacgggatcaaggaggaggagggaaccgacgatgaagacgacagcgatgacgatggcagcgttaccagcagaggtcacccctccgacggtgacgaaaagagtgccaaaaaagaggaaatgtaataaaaaaaattaaaaacctatgaaagcctgaaagctaggtgaggatggatacttgacttgaccattcctttccaaagctggtggtacctagaattacttttcttacttgtatgctaactatcttgtcgtttttctgttgtccctccctctgattctaaaaccaaagggggcaactgcgtcatcaaaacaatgcaggcgggcatgcatccgtccaatcagacctaaaaaaaaaaaa

SEQ ID NO: 3356 - protein, 530 aa, Zea mays
  misc_feature: PFam Name: AAA; PFam Description: ATPase family associated
  misc_feature: PFam Name: Pyr_redox_2; PFam Description: Pyridine
  misc_feature: PFam Name: Podocalyxin; PFam Description: Podocalyxin
  misc_feature: PFam Name: MAGE; PFam Description: MAGE family
  misc_feature: PFam Name: Cupin_1; PFam Description: Cupin
  misc_feature: GI Number: 61656787; NR Description: Cell Division Protein
  misc_feature: GI Number: 61656809; NR Description: Cell Division Protein
  misc_feature: GI Number: 61656810; NR Description: Cell Division Protein
  misc_feature: GI Number: 61656812; NR Description: Cell Division Protein
  misc_feature: GI Number: 61656802; NR Description: Cell Division Protein
MEMVGGSADAIPGLLSYGWAGLWSTLASLLFLWSMVQDHLPFQLEEQLSALARRALAAVTPYVTITIDEHDADSFGRSEAYLAAEAYLGATFAGRASRLRAELPGGSDRVSLAVDDHVEVTDAFRGARMRWRKTRTLRRGNVIAWNPREEERRAYCLTFHRRHRALVEAAYLPHVLAEGRAATVRNRQRRLYTNNASGDWGGGDDGPRAWTHVKLEHPSTFATLAMDPDRKREVVDDLDMFRDGRDYYASVGKAWKRGYLLFGPPGTGKSTMIAAMANYLGYDIYDLELTAVKSNTELRKLFIETKSKSIIVIEDIDCSIDLTGKRKKKKKDKNDTKKKKKKAPWEEEDKDEGSKVTLSGLLNFIDGLWSACGGERIIVFTTNHKDKLDPALIRRGRMDMHIEMSYCCFQGFKVLAKNYLGVQEHDGGHQELFGDIRRLLEEVDMTPADVAENLMPRSKTKDADACLRRLVKALEEAKEAALLAAKAKQLDGIKEEEGTDDEDDSDDDGSVTSRGHPSDGDEKSAKKEEM

SEQ ID NO: 3357 - DNA, 1305 bp, Zea mays
  misc_feature (1)..(1305): Ceres cDNA ID no. 21572858
  misc_feature (1)..(1305): Ceres CLONE  ID no. 1543899
  misc_feature (1)..(1305): Also known as  Ceres CDNA ID no. 0
atttagtcgtactcgtacagaagccacagccctctgctagctagctcctgctagaatggaaagtgcaggaggggaagctcggccgccgccgccgccgccggtgcaagagcttgccggcgcagcgaacgacgtgccagctcggtacgtcgcgcgcgcaggcaacgagcccaaggtcacggtaaccgcgccggtccccgtcatcgacctcgcctgcctgtgccagccgggcggcggcggcgccgacgaggcctcgaagctccggctggcgctcgagtcctggggtctcttcctggtgaccaaccacggcatcgaggccactctcatggacgccatgatggactcgtcgagggagttcttcaggcagccgctccaggagaagcggaagcacagcaacatgatcgacggcaagcacttccagctccaagggtacgggaacgaccgggtggcgtcggaggaccaggtcctggactggtgcgaccgcctttacctcttggtggagcctcaggaggacaggagccttgacctatggcccacatgtctaagggacgttctgcacgatttcaccacagagtgcacgagagtgaaggactgcctgcttctacaaatggcgaaggcgctagatgagctcggcgacgacggctacttcatcgaccagttcggcgacagggccgacacccatgccaggttcagctactaccctccgtgcgcgcggccggacctcgtcttcggcctgaggcctcactccgacggcacgttcctctcgcttctcatgctagacgacagcgtcggcgggcttcaggttttccgggacggagtctggtacgacgtgcgcaccagacctcacaccctgctcgtcaatctaggagaccaaatagagataataagcaatgggatcttcaagagcccagtacatcgggttgtaacaaacgcggagaaagagaggctatcagtggttctgttctattctatagatcctgagagagaaatccggcccgctgacaaactgatagatgagaaccatccagcactatacaagaaggtgaaagtcaaagaatatactgctggactctacgaacatttctctcgagggaaattggttaaagagactgcaaagatatagcttgtttgctttagattaaatccagctatttggactaatccctagagacaaaaacactgtataagtagtaaaagccgatacgaattaaagcccaagctagtcgtatctatgtaatgaataagggtgaaacctttgggatcctagatattaaatgaaattaatttttaataaaaaaaaaaaaaaaa

SEQ ID NO: 3358 - protein, 354 aa, Zea mays
MESAGGEARPPPPPPVQELAGAANDVPARYVARAGNEPKVTVTAPVPVIDLACLCQPGGGGADEASKLRLALESWGLFLVTNHGIEATLMDAMMDSSREFFRQPLQEKRKHSNMIDGKHFQLQGYGNDRVASEDQVLDWCDRLYLLVEPQEDRSLDLWPTCLRDVLHDFTTECTRVKDCLLLQMAKALDELGDDGYFIDQFGDRADTHARFSYYPPCARPDLVFGLRPHSDGTFLSLLMLDDSVGGLQVFRDGVWYDVRTRPHTLLVNLGDQIEIISNGIFKSPVHRVVTNAEKERLSVVLFYSIDPEREIRPADKLIDENHPALYKKVKVKEYTAGLYEHFSRGKLVKETAKI

SEQ ID NO: 3359 - DNA, 1585 bp, Zea mays
  misc_feature (1)..(1585): Ceres cDNA ID no. 21572859
  misc_feature (1)..(1585): Ceres CLONE  ID no. 1544937
  misc_feature (1)..(1585): Also known as  Ceres CDNA ID no. 24359329
aagctcactcccggtcctggtgacccacgcccgatcctgctcctcccggacaatgatcgccgccgccgcggcaggcgcggccaccgccttcccgttcgtctccaccgcctaccgccgcccgcgcctccagcagcgctgcccgcgccgcgccgcggccgtcctcccggcccgcgccaccggcggtgcctcgtcctgggaggagcgcgaggaggcgcggtggctccgcgaggagcagcgctggctgcgggaggagcagcggtggctccgcgaggagtcgcgctggcgcgccgagcgcgaggccctcctcgccgaggtggccgcgctgcggctccgcctccgcgcgctcgagggagctcgccctgaccacctcgcggtcgccgtcgacgccgtggcctcgcctgcggcgcgggcggccaaggccgaggcggcggtgagcggcgcaggtgccagcgagagcaggaggacgctgaggacgggggccgagggcgaggacgtgcgcgcgatgcaggaagctttgcagaagctcggtttttactcaggcgaggaagacatggagtactccagtttctcgtctggcaccgagcgagctgtcaagacatggcaggcaacggtaggagcttcagagaacggagtgatgacatcggagctgcttgagtggctattctcggggaagaccggggaagaagtgaaaaccaaagatggcacaaacggagcagcggttcctgctgtaacagggatcgcggaggtacgcaaaactgcggttgcagaaaacggtgtctcgggagttggggtctccgagcacagagtgtttcttctcggtgaaaacaggtgggaagacccaaccagactgacgcagaacaaaaagacagccagcaccggcactagtgcatctactaagacatgcatgtcctgtcgaggcgaaggccgcctcatgtgcttagaatgtgatggaacaggtgagccgaacattgaaccgcagttcttggagtgggtcggtgaagatacgaagtgcccatactgtgaaggaattggttccattttgtgtgatgtttgtgatggaaagaaagtaatggcaagttaagtaaggcttagagcaagaattccctgccttgtctgtgttcggttcccatcccaccctggtaagcacgcctaggccaggcatcaacgccagacagttcgatttggggtcggatgcggctgcctggcgtcgctccccaggcgagggttgcagccagacacgctaataatatcagcatgtgtagatgctagcaaaatattcagttttatcacagaactggagaatgcgttcaaatggcagttcgagtggactgctgtcccgcagaaagcggagacataagcaacagtgtaacacttttatggtacaataggagatggaaacatacgagggaagaagaggaatcctttcccaaatcaggccggtaaaattaacatctctattaacatttcatatgttgcaatctcttcccgagagtatgtgataatctcaaaagctatgttgcggaatggacgaaatgaacagaataatataagtatttggttgaatctccaaaaaaaaaaaaaaaaa

SEQ ID NO: 3360 - protein, 342 aa, Zea mays
  misc_feature: PFam Name: PG_binding_1; PFam Description: Putative
  misc_feature: PFam Name: Extensin_2; PFam Description: Extensin-like region
  misc_feature: PFam Name: FH2; PFam Description: Formin Homology 2 Domain
  misc_feature: GI Number: 30682566; NR Description: peptidoglycan-binding
MIAAAAAGAATAFPFVSTAYRRPRLQQRCPRRAAAVLPARATGGASSWEEREEARWLREEQRWLREEQRWLREESRWRAEREALLAEVAALRLRLRALEGARPDHLAVAVDAVASPAARAAKAEAAVSGAGASESRRTLRTGAEGEDVRAMQEALQKLGFYSGEEDMEYSSFSSGTERAVKTWQATVGASENGVMTSELLEWLFSGKTGEEVKTKDGTNGAAVPAVTGIAEVRKTAVAENGVSGVGVSEHRVFLLGENRWEDPTRLTQNKKTASTGTSASTKTCMSCRGEGRLMCLECDGTGEPNIEPQFLEWVGEDTKCPYCEGIGSILCDVCDGKKVMAS

SEQ ID NO: 3361 - DNA, 980 bp, Zea mays
  misc_feature (1)..(980): Ceres cDNA ID no. 21572860
  misc_feature (1)..(980): Ceres CLONE  ID no. 1545141
  misc_feature (1)..(980): Also known as  Ceres CDNA ID no. 23845138
agcggctccgcctcgccatctaccactccaccaccgtccacacacccacgcacacacagagacacttgcgttggggccgatcgaactcgccggtgattccttcgtctactcgactcgttggtattcggcctctgcagaaagtttgcgcaaacatgcagcccaccaccatcacggagatttggcagtggcagtgtggcacgtgcagagctgactggaagatgatgcgccagctgaccacctgctgcccgcacgtcggccgctgctgtcagggtcagggtgctccgcctccgccgtctgaacggaaccctcctcactgccactgccatcaccatcaccaccacggccatcgccatcaccaggagcagggtaccaccaccgccgccatcaccaccaccggccgggctttggcggcgggtgccgagggttccaacgccgggtctgctgggcgtcacaccaccatcgctacactgaatcctgctgcccctcccgccgtcgcagaggtcttctgggatccggacccctacctgatggtgcagcagctcagggagttcgagaccctgaacgacgggctggtggcgctcagggtgcagctgcaggagtacgcggaggaaatcagcaagagcaaggacaccaacgccgggatggactggctcctcgctctcccggccagcgtcagggacgtcgtcatcatggccagggacgtcatcgagtctttctttgtcatctccactggcgccgcaccgccgtaagcagctccgcagctgtagtcatatatggatattattatatcattatacagtgtgaaagagtcagttcgcctattttctcatgtcatgtaatgtgtgagaagttgatattactgttcagttttcgtgtttgttttctggtattagatttgcgggttattatgtaagtctggtatataaaattataatcaatacattatgaggatactcttgctgcttaaaaaaaaaaaaaaa

SEQ ID NO: 3362 - protein, 198 aa, Zea mays
MQPTTITEIWQWQCGTCRADWKMMRQLTTCCPHVGRCCQGQGAPPPPSERNPPHCHCHHHHHHGHRHHQEQGTTTAAITTTGRALAAGAEGSNAGSAGRHTTIATLNPAAPPAVAEVFWDPDPYLMVQQLREFETLNDGLVALRVQLQEYAEEISKSKDTNAGMDWLLALPASVRDVVIMARDVIESFFVISTGAAPP

SEQ ID NO: 3363 - DNA, 1439 bp, Zea mays
  misc_feature (1)..(1439): Ceres cDNA ID no. 21572861
  misc_feature (1)..(1439): Ceres CLONE  ID no. 1545326
  misc_feature (1)..(1439): Also known as  Ceres CDNA ID no. 24359346
ctagaaaaaacaggagagcaggccgaagcagcagcaaactggaaactggcaagagaaagaaaacttcgccatacacatacacactacccaaaggcaaaattaaacagcagaggccacccacacccaccgatgaagtgtgagtctgacatgcgcgccctacacgtccactccttccacggcctccgtgactgcgacgaagtcgtccatctccttgtgcccggcgccgtcgggcgccaccgacgacggcaagctggtggccttgtactggtgccgcctggcgaagacgacgaagacggcgaagttggcgacgccgagcagggccagcatccagtagaagaggtcgagcctgccgcggtcgaggttgttccggatccacgtgcccgcggtggcggcgtcgacggcgaagacgaggaagctgctgaggaagaagcccatggagagcgtgacgaggaagaggccggtgctcatggacttcatccgctcgggggcctcgcggatgaagaactccagctggcccacgtaggcgaaggcctcgccggcgccgacgaggaagtactgcgggacgagccagaaggcgctgacggcgacgtggtccggcccgttggccgcgtcgcgccgcttcctctcgacgagcgcggagacggccatggcggcgacggagagcgcgagcccggccccgacgcgctgcagcgaggtgagcccctgcgggcggcccgtgaggcgggcggccagcggcacgaggaggcgctcgttgagcgaggtgaagagcaggatggagaggaagaggaagacggagaaggagcccgccgggacggcgaagccgccggcgccggagcccgggcggaggtggcggtccatgcgcgtggcctgctccaccgagaaggtggtcatctgggagtagaccgtccagaagaggatgcacgtggaccagatgggcagcagcttcgccaccatcttcacctcctccacctccgtcaccgtcgacgccgccgccgcgctcgcccgctgcttccccgccggctcggcctccacgatcgccgccttgtcaagccacctgcatgatgatgatgatgcattcacgaccagcgatcaggatcagcacgtactgcaccggtgtacccgtctgtcgtcaactgtagcgcgcgcgagaggcacacacgtactacagtaccgcactactgctcagtctcgttgatcgcgtgacgcatcacgcgcccgtgctgtcagtgtcaccactgggtgactcagcagcgagagcgacagctgaaaggccggcggcacatcggccagttttccggccggatcggaacagtgtaacgagctttcgcggcacgtctacctgtctagatccttttttttttttctttcaagttccgttgtgttagcgactgggttcaataattccctcttttgcgtgttgtgttaaaaaaaaaaaaaaa

SEQ ID NO: 3364 - protein, 1439 aa, Zea mays
  misc_feature: PFam Name: Peptidase_S8; PFam Description: Subtilase family
  misc_feature: PFam Name: TT_ORF1; PFam Description: TT viral orf 1
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 5821145; NR Description: RNA binding protein [Homo
  misc_feature: GI Number: 47124032; NR Description: SRRM2 protein [Homo sapiens]
  misc_feature: GI Number: 5821143; NR Description: RNA binding protein [Homo
  misc_feature: GI Number: 6649242; NR Description: splicing coactivator
CTAGAAAAAACAGGAGAGCAGGCCGAAGCAGCAGCAAACTGGAAACTGGCAAGAGAAAGAAAACTTCGCCATACACATACACACTACCCAAAGGCAAAATTAAACAGCAGAGGCCACCCACACCCACCGATGAAGTGTGAGTCTGACATGCGCGCCCTACACGTCCACTCCTTCCACGGCCTCCGTGACTGCGACGAAGTCGTCCATCTCCTTGTGCCCGGCGCCGTCGGGCGCCACCGACGACGGCAAGCTGGTGGCCTTGTACTGGTGCCGCCTGGCGAAGACGACGAAGACGGCGAAGTTGGCGACGCCGAGCAGGGCCAGCATCCAGTAGAAGAGGTCGAGCCTGCCGCGGTCGAGGTTGTTCCGGATCCACGTGCCCGCGGTGGCGGCGTCGACGGCGAAGACGAGGAAGCTGCTGAGGAAGAAGCCCATGGAGAGCGTGACGAGGAAGAGGCCGGTGCTCATGGACTTCATCCGCTCGGGGGCCTCGCGGATGAAGAACTCCAGCTGGCCCACGTAGGCGAAGGCCTCGCCGGCGCCGACGAGGAAGTACTGCGGGACGAGCCAGAAGGCGCTGACGGCGACGTGGTCCGGCCCGTTGGCCGCGTCGCGCCGCTTCCTCTCGACGAGCGCGGAGACGGCCATGGCGGCGACGGAGAGCGCGAGCCCGGCCCCGACGCGCTGCAGCGAGGTGAGCCCCTGCGGGCGGCCCGTGAGGCGGGCGGCCAGCGGCACGAGGAGGCGCTCGTTGAGCGAGGTGAAGAGCAGGATGGAGAGGAAGAGGAAGACGGAGAAGGAGCCCGCCGGGACGGCGAAGCCGCCGGCGCCGGAGCCCGGGCGGAGGTGGCGGTCCATGCGCGTGGCCTGCTCCACCGAGAAGGTGGTCATCTGGGAGTAGACCGTCCAGAAGAGGATGCACGTGGACCAGATGGGCAGCAGCTTCGCCACCATCTTCACCTCCTCCACCTCCGTCACCGTCGACGCCGCCGCCGCGCTCGCCCGCTGCTTCCCCGCCGGCTCGGCCTCCACGATCGCCGCCTTGTCAAGCCACCTGCATGATGATGATGATGCATTCACGACCAGCGATCAGGATCAGCACGTACTGCACCGGTGTACCCGTCTGTCGTCAACTGTAGCGCGCGCGAGAGGCACACACGTACTACAGTACCGCACTACTGCTCAGTCTCGTTGATCGCGTGACGCATCACGCGCCCGTGCTGTCAGTGTCACCACTGGGTGACTCAGCAGCGAGAGCGACAGCTGAAAGGCCGGCGGCACATCGGCCAGTTTTCCGGCCGGATCGGAACAGTGTAACGAGCTTTCGCGGCACGTCTACCTGTCTAGATCCTTTTTTTTTTTTCTTTCAAGTTCCGTTGTGTTAGCGACTGGGTTCAATAATTCCCTCTTTTGCGTGTTGTGTTAAAAAAAAAAAAAAA

SEQ ID NO: 3365 - DNA, 1863 bp, Zea mays
  misc_feature (1)..(1863): Ceres cDNA ID no. 21572862
  misc_feature (1)..(1863): Ceres CLONE  ID no. 1546337
  misc_feature (1)..(1863): Also known as  Ceres CDNA ID no. 24359541
aatagtctgatttcttctttttctttactatgatagacttgctcaatgtttcttctccttctgaattctaatggcttgctcgatgttttctttaacttcttctaaattctagtttgtttttttcctacatacatatgcaggagtaaggaagccgacaccacttggagttgctgccaactaccgggctcggctgtcaaattctctatctggcagccagcccgtgtccaattccaactccaccggtggtaaaccatcgacagcaggagcagggagggcaggctgcacaagtttcctctttggactgccacaagaaaagagcatcattcctgctgatcggctcggctccactccaccccgaataaaatggcttccttctcgggacatctccaccgccccctgtccgccatggccgtggccgccttcgccgccatctcctcccacgagcttcccgacaagctgtcccaccacaggtttcctgatgccagcacaggcacggacgcgctcgcctcgcttccattgaccaggtcagatgttcccgcagcgccttcggcatctgccctttctggcgcgcagctattgccacgggacctccacagcttgcgtctgctgaaggcgcccttcgcgtctgtgccggtcatgcagacggtttaccagtacgccaactttgccaaaacctcgggacaggccgatgcgatgcctgcaattccttcctcgccgtccgatgtgctgtaccgctggcacctgccagaccccagggtctatgccgacttccctgacaagtctcagacggtcgtggtccttcttgggtggttgggctcgaggcagaagcatctcaagagatatgccgattggtacacctccaggggcttccatgtcgtcactttcaccctcccgatgtctgacattctcagttataaccttggagggaaggctgagaagaacgttgagatgctatctgaacatattgctgactgggtcagggaggagagtgggaagaagattattttccacaccttcagtaatactggttggctttgttatggcgtaattctagagaacttgcaacagcatgatccttcagcagtggacaaaattaaagcttgtgtagtagactcagcacctgttgctgcacctgatcctcaggtttgggctttgggcttctcggctgccctcatgaaaaaacgcagtgtcaccacgaagggactaggttcagatgattcaaggtctgatgtcctagttgtggagtccaacaaggagctcaagctgggggcaacagaggcggttctactgtcagcgttagagagtttctttgacgttgttttgaactatccaaagatcaataggaggttatgtgacgtgatggagctcttgtcctggaagcaacccaagtgcccccaattgtacatatacagctccgccgacagggtgatcccagcgaaatcagtggaggcattcatcgactgccagcggaaagccgggcatgaggtgagggcctgcgacttcgtgtcatcgccccatgtggaccattaccggagcaatcctgggctgtatagctctcagctggccaacttcttggaggaatgtgtgcttgccaagcgctgtgagggtgcttgcacatcatgattgtctcttttatttgttcctggtcttgaattggaatgcaccagggtcactgacatacgtgggttatacatgattttgttctctccttgttttaacggtctttgtgggtgaccttttttccccctcttgtaactcttgtctttgtggttggagtttgggcgcacaattgtaaaaacgtgtgaggagaaataaccaaatgaaaggagaggaatttttttttatccaaaaaaaaaaaaaaaa

SEQ ID NO: 3366 - protein, 419 aa, Zea mays
  misc_feature: GI Number: 21536700; NR Description: unknown [Arabidopsis thaliana]
  misc_feature: GI Number: 25411844; NR Description: probable integral
  misc_feature: GI Number: 50751482; NR Description: PREDICTED: similar to
  misc_feature: GI Number: 50540342; NR Description: zgc:92204 [Danio rerio]
  misc_feature: GI Number: 34870283; NR Description: similar to RIKEN cDNA
MASFSGHLHRPLSAMAVAAFAAISSHELPDKLSHHRFPDASTGTDALASLPLTRSDVPAAPSASALSGAQLLPRDLHSLRLLKAPFASVPVMQTVYQYANFAKTSGQADAMPAIPSSPSDVLYRWHLPDPRVYADFPDKSQTVVVLLGWLGSRQKHLKRYADWYTSRGFHVVTFTLPMSDILSYNLGGKAEKNVEMLSEHIADWVREESGKKIIFHTFSNTGWLCYGVILENLQQHDPSAVDKIKACVVDSAPVAAPDPQVWALGFSAALMKKRSVTTKGLGSDDSRSDVLVVESNKELKLGATEAVLLSALESFFDVVLNYPKINRRLCDVMELLSWKQPKCPQLYIYSSADRVIPAKSVEAFIDCQRKAGHEVRACDFVSSPHVDHYRSNPGLYSSQLANFLEECVLAKRCEGACTS

SEQ ID NO: 3367 - DNA, 1445 bp, Zea mays
  misc_feature (1)..(1445): Ceres cDNA ID no. 21572863
  misc_feature (1)..(1445): Ceres CLONE  ID no. 1547129
  misc_feature (1)..(1445): Also known as  Ceres CDNA ID no. 24359270
aagccagccaaaagttacctacagctcactcccaacggaagcaagaaccaccgctcactcactcgccattcggcagaggcgtgactgactgaaactgagcactagggctttgagagtgcagcagaggagggcgaaccatgggcgaggaggagaaggcgaaggaggcggcgcccccggccgacaaagtaaaggaggcggaggagaagaagggcgaggggggaggaggggaggagaagaagaacgaggccccgtctcttccaccgccgccgccggaggaggtggtcatgcgggtcttcatgcactgcgagggttgtgcgcgcaaggtcaagaagattctcaagggatttgatggtgttgaagatgttattgcagatacgaaggcacacaaggtggtcgttaaggggaaaaaggcagctgctgacccaatgaaggtggtggaacgggtgcagaagaagacaggccgcaaggtagagcttctctcaccaatgccaccaccgaaagaagagaagaaggaagaggagaaaaaggaagaacctgagccaccaaaaaccgagaagaaagaggaggcaacggtgctcgctgtggtgctcaaggtgcatatgcattgtgaggcttgcacacaagtgatcaagaagagaatcctcaagatgaaaggcgtgcaatctgtagaggcagacctcaaggcttctcaagtcactgtgaagggtgtgttcgaggaggccaagctgtctgattatgtgtataggcgcactggtaagcacgctgctatcgtcaagtctgagccggttgcagctgagaatgttgatgatggaaatgccaaggatgacaagaaggcagccgaaggtggggaggagaagaaggatgatggcaaggaggaaaagaaagatgaagacaagaaagaagcggataaacagaaggatgatggcaatgctggtgatgaagggaaagacaaagaccctggcgccgttgctaacatgtatatgcactacccgaggtccaatcatctgagcgaatacggatatgcctaccagtacccacctcagctcttcagcgacgagaacccgaatgcctgttctctgatgtgagaaagccagaaccaagtgaccttaagcgcgaaaataagaggggattgagttatcccctgattttggaggttcaggaagtttagaacttttcttttctatttctaaggttgaactttctgtctggtacaaagtgaactctgggctggtttgtggacatcatattgtgtatgctactggttagtaggattttgtgttgcacctttcacctttggcttttatttttgtacaaagatgtattatatatgctagttttgaaatagcttgctgctagtactctgtagtctgttgtccggaatagacggagctttctcagttaacattgccagtgatgtcggaaaaatccaaaaaaaaaaaaaaaaa

SEQ ID NO: 3368 - protein, 1445 aa, Zea mays
AAGCCAGCCAAAAGTTACCTACAGCTCACTCCCAACGGAAGCAAGAACCACCGCTCACTCACTCGCCATTCGGCAGAGGCGTGACTGACTGAAACTGAGCACTAGGGCTTTGAGAGTGCAGCAGAGGAGGGCGAACCATGGGCGAGGAGGAGAAGGCGAAGGAGGCGGCGCCCCCGGCCGACAAAGTAAAGGAGGCGGAGGAGAAGAAGGGCGAGGGGGGAGGAGGGGAGGAGAAGAAGAACGAGGCCCCGTCTCTTCCACCGCCGCCGCCGGAGGAGGTGGTCATGCGGGTCTTCATGCACTGCGAGGGTTGTGCGCGCAAGGTCAAGAAGATTCTCAAGGGATTTGATGGTGTTGAAGATGTTATTGCAGATACGAAGGCACACAAGGTGGTCGTTAAGGGGAAAAAGGCAGCTGCTGACCCAATGAAGGTGGTGGAACGGGTGCAGAAGAAGACAGGCCGCAAGGTAGAGCTTCTCTCACCAATGCCACCACCGAAAGAAGAGAAGAAGGAAGAGGAGAAAAAGGAAGAACCTGAGCCACCAAAAACCGAGAAGAAAGAGGAGGCAACGGTGCTCGCTGTGGTGCTCAAGGTGCATATGCATTGTGAGGCTTGCACACAAGTGATCAAGAAGAGAATCCTCAAGATGAAAGGCGTGCAATCTGTAGAGGCAGACCTCAAGGCTTCTCAAGTCACTGTGAAGGGTGTGTTCGAGGAGGCCAAGCTGTCTGATTATGTGTATAGGCGCACTGGTAAGCACGCTGCTATCGTCAAGTCTGAGCCGGTTGCAGCTGAGAATGTTGATGATGGAAATGCCAAGGATGACAAGAAGGCAGCCGAAGGTGGGGAGGAGAAGAAGGATGATGGCAAGGAGGAAAAGAAAGATGAAGACAAGAAAGAAGCGGATAAACAGAAGGATGATGGCAATGCTGGTGATGAAGGGAAAGACAAAGACCCTGGCGCCGTTGCTAACATGTATATGCACTACCCGAGGTCCAATCATCTGAGCGAATACGGATATGCCTACCAGTACCCACCTCAGCTCTTCAGCGACGAGAACCCGAATGCCTGTTCTCTGATGTGAGAAAGCCAGAACCAAGTGACCTTAAGCGCGAAAATAAGAGGGGATTGAGTTATCCCCTGATTTTGGAGGTTCAGGAAGTTTAGAACTTTTCTTTTCTATTTCTAAGGTTGAACTTTCTGTCTGGTACAAAGTGAACTCTGGGCTGGTTTGTGGACATCATATTGTGTATGCTACTGGTTAGTAGGATTTTGTGTTGCACCTTTCACCTTTGGCTTTTATTTTTGTACAAAGATGTATTATATATGCTAGTTTTGAAATAGCTTGCTGCTAGTACTCTGTAGTCTGTTGTCCGGAATAGACGGAGCTTTCTCAGTTAACATTGCCAGTGATGTCGGAAAAATCCAAAAAAAAAAAAAAAAA

SEQ ID NO: 3369 - DNA, 1477 bp, Zea mays
  misc_feature (1)..(1477): Ceres cDNA ID no. 21572866
  misc_feature (1)..(1477): Ceres CLONE  ID no. 1548941
  misc_feature (1)..(1477): Also known as  Ceres CDNA ID no. 24359321
actaggactaggagtccagtagcctgctagctatctatcagtgatccctcgcgaacgatgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcgcatcctgccagaggagggggctcacgtcccagctgttctcggcgtccaggcaggccgacaggttcagggacgtcgagcgcaagatcgaaacctgcgtcaccatcatccctgtcatcggctacatcggcataacaagacgcctcgatggttcgcaatcccagtcccagctgtcggcgggaggggctgaggatcgggagttcacgctggcggagatcgccgtggccaccaacaacttcgccgtcgtgctcagcaacgacgccgacactggcaccaaggtatacaagggaaggctcctgcagaacgggcctgaggtggccgtcaagcgcctcaaccgcgcgcggcggggagcggaggacgccttcttcgcggagcagcacatcctctcgccgctccgccacgaccgcatcgtccgcctcctgggcacctgcgccgacgacggcgagcgcatgctgctcacccagtacatgcccaacggctcgctccacgaccacctgcacgggcaccacctgtcgtcctcgtcggcgtcgccggtgacggcgtcctggaggactcgcgtccaggtgctgcttggcacggcgcgcgccgtcgagcacctccactgccacgccgtgccgctcatcatccacggcaacgtcgcctcctccaacgtcctcctggacgccgcctgggcgccgcgcctggccggcttcggcgcatcggtgtggcgcgcggccggcgtggactcccagcccgtggaggtcgccggcgccgcgtcgtgcggcgggtacgccgacccggagtactgcggcacgggccggatcaggccggcgagcgacgtttacggcctcggcgtgctgatgctcgaggtcctgacggggcaaccaccggtggtgagtgtctgggacgcggcgaagcagggcgtggtggccgtgaccttggcgtcgttcgcgctgccgagcatccaggccggccggcttggggacgtgctcgacaggcgtccggcgccgcagcagctccagccgctgcagctggtggccaacatggcggcgcgttgtctgcatatgcaggggggtagtcgcccggccatatcagacgtcgtcgccaacctcgagcaggcactccgcctcatatgaaagcatgtggacatctttgcttgtacacaagtgaacttgcttgtcgttcagctaaaaaaaaaaaaaa

SEQ ID NO: 3370 - protein, 450 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 29367347; NR Description: receptor kinase-like
  misc_feature: GI Number: 50945081; NR Description: serine threonine kinase-like [Oryza sativa (japonica cultivar-group)] >gi|40253346|dbj|BAD05278.1| serine threonine kinase-like [Oryza
  misc_feature: GI Number: 50944507; NR Description: receptor-like kinase CHRK1-like [Oryza sativa (japonica cultivar-group)] >gi|38423996|dbj|BAD01724.1| receptor-like kinase CHRK1-like [Oryza sativa (japonica cultivar-group)]
  misc_feature: GI Number: 51964828; NR Description: PREDICTED OJ1790_D02.36
  misc_feature: GI Number: 50940397; NR Description: putative cytokinin-regulated kinase 1 [Oryza sativa (japonica cultivar-group)] >gi|42408380|dbj|BAD09531.1| putative cytokinin-regulated kinase 1 [Oryza sativa (japonica
MWDGLESAATVAQLVGLDVGGLITMIGQAARKARQNTKDCEHLARRVGMLAELVPHLQDPEARRAVAGLKDALVEAHQLIASCQRRGLTSQLFSASRQADRFRDVERKIETCVTIIPVIGYIGITRRLDGSQSQSQLSAGGAEDREFTLAEIAVATNNFAVVLSNDADTGTKVYKGRLLQNGPEVAVKRLNRARRGAEDAFFAEQHILSPLRHDRIVRLLGTCADDGERMLLTQYMPNGSLHDHLHGHHLSSSSASPVTASWRTRVQVLLGTARAVEHLHCHAVPLIIHGNVASSNVLLDAAWAPRLAGFGASVWRAAGVDSQPVEVAGAASCGGYADPEYCGTGRIRPASDVYGLGVLMLEVLTGQPPVVSVWDAAKQGVVAVTLASFALPSIQAGRLGDVLDRRPAPQQLQPLQLVANMAARCLHMQGGSRPAISDVVANLEQALRLI

SEQ ID NO: 3371 - DNA, 2118 bp, Zea mays
  misc_feature (1)..(2118): Ceres cDNA ID no. 21572867
  misc_feature (1)..(2118): Ceres CLONE  ID no. 1549801
  misc_feature (1)..(2118): Also known as  Ceres CDNA ID no. 24359568
actctctcgtccaaatcaccgaagacaaccagcacattaaaattcttcccaaccttcccaaaatgccccccaaccgccccgcttacctgctctccgccctcctcctcgccgccgccgccgcggccgtcggcgcgcgtcgccacgcgtcgccggccgcgaacgctaccttcgccggagagcccgtctacctctggccgctgcccaagagcgtctcgtccggatcccggacgctgacggtggacccggacctcgcgctcgacccgcagggcctcggcggccgctccccggccgtggccgaggcgttccagcggtaccggggcctcgtgttcgcgccgtgggcgcacgccgcgcgcgcgggccgcgcgcggtacgacgtcaccaggctcaccgtcgtcgttgcctccgccaacgacacgctggcgctgggggtggacgagagctacgccatctacgtggcggcggccgggggcgtcgattccatcgtcggaggagcaatcattgaggcaaacacaatatatggagctattcgaggactggagacattcagtcaactttgtgttttcaactatgacaccaaaaatgttgaagtgcacaatgctccatggcatatccaagatgagccccgctttgcttttcgtgggctgctcctagacacctcaaggcattatcttccagttgatgttattaagcaagtgatcgactctatgtcatttgctaagctgaacgttcttcattggcatatcatcgatgagcaatcctttccattggaggtgccaacatatccaaacctttggaaaggttcatactccaaatgggagcgctacaccgtggaagatgcacatgatattgtcaactacgctaagaaaagaggtatcaatgtgatggcagaaattgacgtgcctggtcatgcagaatcatggggaaatggatacccaaagctctggccttctcccatttgtacagagccattagatgtctctagtgatttcacatttgaagtaatttttggaattttgtctgatatgaggaaaatctttccattcgggctgtttcacttgggtggtgatgaagtatacacagggtgctggaacacaacgcctcacgtgcggcagtggatggacgagcgcaaaatgaccacgaaggacgcttacaaatacttcgttctgaaggcccaggagctggcgatcaagctgaactggactcccgtgaactgggaagaaaccttcaactcgttcgaagaaaacctcaatccactgacggttgtgcacaactggctggggcccggagtctgcccaaaggttgtggccaagggtttcagatgcataatgagcaaccaaggcgtctggtacctggaccacctcgacgtcccctgggaggacgtctacagcggcgagccgctcgccgggatcagcgacagagagcagcagaagctggtgctcggcggggaggtctgcatgtggggcgagacggccgacacgtccgacgtcctgcagacaatctggccccgagccgccgcagcggcagagcgtctgtggagccagctggaggccatatccgcccaggacgtcgagacgaccgtgctgtcacggctacaccgcttcaggtgcctgctgaaccaccgtggggtcgccgcggctcctgtcacgaactactacgctcggaggccgccggtcggcccgggttcgtgcttcgttcagtaaagcaagcagccaagcaggaaggtaccctcctacccacgccacgaggtgctctgccttcgtgtaccatatctgtgtgtaatccacggaaacaatctgtataataatctgtctccgttttcgatttcccaaagtcgaaataaaaccgcaccgttcaaacctccttcgagctcgggcagtactgcatttgttttctggcggcggggtgcgtcgctgtcggggaccggacgccatcttttcctcagtttggccttgacctgaaacccgctggtccaagctgcgcattaatggcgcgtgtaatttgcgaccacctgttgtgcttgggtggtttggagtgacgacaatgggtttggcaccttgttctatacttccaatatagagagagaggtcactgtccttcccaaagaaaaaaaaaaaaaaa

SEQ ID NO: 3372 - protein, 545 aa, Zea mays
  misc_feature: PFam Name: Glyco_hydro_20; PFam Description: Glycosyl
  misc_feature: PFam Name: Glyco_hydro_20b; PFam Description: Glycosyl
  misc_feature: GI Number: 23463073; NR Description: At1g65600/F5I14_13 [Arabidopsis thaliana] >gi|22135811|gb|AAM91092.1| At1g65600/F5I14_13 [Arabidopsis thaliana] >gi|30697215|ref|NP_176737.2| glycosyl hydrolase family 20
  misc_feature: GI Number: 7019659; NR Description: beta-N-acetylhexosaminidase-like protein [Arabidopsis thaliana] >gi|11264425|pir||T47665 beta-N-acetylhexosaminidase-like protein -
  misc_feature: GI Number: 30694211; NR Description: glycosyl hydrolase
  misc_feature: GI Number: 24030299; NR Description: putative beta-N-acetylhexosaminidase [Arabidopsis thaliana] >gi|21537026|gb|AAM61367.1| beta-N-acetylhexosaminidase-like
  misc_feature: GI Number: 50511452; NR Description: putative beta-N-acetylhexosaminidase [Oryza sativa (japonica
MPPNRPAYLLSALLLAAAAAAVGARRHASPAANATFAGEPVYLWPLPKSVSSGSRTLTVDPDLALDPQGLGGRSPAVAEAFQRYRGLVFAPWAHAARAGRARYDVTRLTVVVASANDTLALGVDESYAIYVAAAGGVDSIVGGAIIEANTIYGAIRGLETFSQLCVFNYDTKNVEVHNAPWHIQDEPRFAFRGLLLDTSRHYLPVDVIKQVIDSMSFAKLNVLHWHIIDEQSFPLEVPTYPNLWKGSYSKWERYTVEDAHDIVNYAKKRGINVMAEIDVPGHAESWGNGYPKLWPSPICTEPLDVSSDFTFEVIFGILSDMRKIFPFGLFHLGGDEVYTGCWNTTPHVRQWMDERKMTTKDAYKYFVLKAQELAIKLNWTPVNWEETFNSFEENLNPLTVVHNWLGPGVCPKVVAKGFRCIMSNQGVWYLDHLDVPWEDVYSGEPLAGISDREQQKLVLGGEVCMWGETADTSDVLQTIWPRAAAAAERLWSQLEAISAQDVETTVLSRLHRFRCLLNHRGVAAAPVTNYYARRPPVGPGSCFVQ

SEQ ID NO: 3373 - DNA, 1463 bp, Zea mays
  misc_feature (1)..(1463): Ceres cDNA ID no. 21572868
  misc_feature (1)..(1463): Ceres CLONE  ID no. 1551561
  misc_feature (1)..(1463): Also known as  Ceres CDNA ID no. 24359547
agtagcagcgtagccagtagcccagtacccagtagtacccagtagccatctccatccaggctcaaaccctagggaatctacccagaaatcacatcccaagcagggtcatatcgtatcaagaagccgtcgcgggggccggatcgccgcggctcggagaggagcggagcgaaaatcatctgcggacaggtaaggattcggaggcgggatcaggagctgagggaacctgttcgaggtggcctagactcgtagggatcgcgttgacattgggagaaatcacggagaggcggaaagcgagcaatagccaataggggaagggaagagcccaagaattcgttgcatagatccagcagaagaacaatagaaatctgggcagaacgagagcagagctgactacaagatgcctcaattgagaactgccagcaggccggcgctcgccagcaactctgctggtggtttttttatcaggagaagggtggcatcaccaggaacttcccaggcaaagggcgccgccaagccgctggctcgacgggtccgaacacctgcagcgagggctaaaccaaagaggagaagccccctacctgactggtacccaagggtcccactccgtgacatcacatcaatcgtaaaggctcttgagaaaagaaatcgcctagaggaggatgcggctcggcaacacatccaatcgaatgaagattcttcacagcctgtggatccaacaactgcagaacatagtgatcctgattctcaaagcacgcaaactcaagaaacaccgggtgctgttgcttctggtccaagctcaacttcagctgttgcaaaccgtgtgacttctgtggctgagggcaagcaagaggcaacggactgctccttgcaggtggctccatccaagccaaatgatccatctcccgctgatctggagaagaaactgtcaggttcgatagagcagattgaaaagatggtgaggcgccatatgaaggaaactcatccaaaggctgcccagccttccaaggtagttgtccaaaggcgcatactgatgtccatgcgatgagctcagcaacgatttctcttgtctgctgcgttcttgccttcttggccgctagtcaaggtatgtctagggatggggattcctggttctctgcttgaggacactgtggtaggagtaagagggatttctagcttctctgcttgagagcatggctatctgttggtacaacttgccatggtatgcagtatgcttactgcatacgacttcagttggcttcaccagaaacgaaccactgttgttcacgtctttctgtttgtgaagtataagacttcactgcgtagtagtaaggcgtactagatatctgtggcgtttagttcaccgaaaagatagagcagttacgagttgtagtgacagcttgaattcttgacacttcaattgatacagttagccttacttattgttccaaaaaaaaaaaaaaaaa

SEQ ID NO: 3374 - protein, 215 aa, Zea mays
MPQLRTASRPALASNSAGGFFIRRRVASPGTSQAKGAAKPLARRVRTPAARAKPKRRSPLPDWYPRVPLRDITSIVKALEKRNRLEEDAARQHIQSNEDSSQPVDPTTAEHSDPDSQSTQTQETPGAVASGPSSTSAVANRVTSVAEGKQEATDCSLQVAPSKPNDPSPADLEKKLSGSIEQIEKMVRRHMKETHPKAAQPSKVVVQRRILMSMR

SEQ ID NO: 3375 - DNA, 1984 bp, Zea mays
  misc_feature (1)..(1984): Ceres cDNA ID no. 21665679
  misc_feature (1)..(1984): Ceres CLONE  ID no. 239527
  misc_feature (1)..(1984): Also known as  Ceres CDNA ID no. 24360825
agttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacggcggaggagaagagccccgaaagggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcggccttagacgtcatggaccgctacggcctcaagcacgacgccgtcgcgctcaactcgctgctctcggcgatttgccgcgtcgagggtcgcgcgcaggatgcgcaggacgtcttcgagcgtaccaaggccaccatcccacccgacggcgacacgttcgcgatactgctcgaggcatgggagaaggaggggaacgcggtgcgcgccaagagcgtctttggcgagatggtcgtccgcatcggctgggacgcagccaacgtatccgcgtacgactccttcctctccactctcgttcggggcggcctgttggacgaggccttcaaatttctgcaggtgatgcggagcaagggctgcttgccggggatcaattttttttctacagctgtggatctggtcgtccgcaagggtgactacctcaacgccgtagccatctggcacatgatggtctctgaagccggcctcgttcccaatttctcaatgtacagcgccatgattggtctccactgcaatgctggtagcatagacgatgctcttgggttgcttgatgaaatgcccctcaacggcgtctttgcaaattctgtcacatacaacaccatactggaaggattcatcaagcatcgcaaggctcgtgaggctgaaagtttcctaacggagatgagcaagaatgagcaactgcctactgcatccaattgcgctgctgctatcagcttgttctttaaggagtttaacccatctgcagcaatcgacgtgtggcgctgtattgtggagcacaacattaccccagctgaggactctgccaaagagctaatagcagggctgcttgattttggcaggtttactgaggtgacgaagcgtgctgatgagatgattgacatgagagttgagttgtcacggtccacaatggagaatatgaagcgtgcttttgctaaggctggcaggcaccaatcatatgacaacattgcaagaaggctaaagcgatattagctgcacatgaatgctttaatcagctgaaactttgcggctcacggggtagacgtttaacgcctggactgcttaattgcatgacaaccaagaatttggactagcctggatcctggaatgtaagtctggaaatctggaactgtactctgatcccacaagcagtggtcgggatgttagtgtagctcttgtagattccggaccccatttgttagctggttactcatcgagtgtaataagtggctagtttagtgaggctgcacattatcgctgtttatttttcatatatattttatgaatatgaaattgggttatgtaagtatcagatattcctggcgaaaaaaaaaaaaaaaaaa

SEQ ID NO: 3376 - protein, 467 aa, Zea mays
  misc_feature: PFam Name: PPR; PFam Description: PPR repeat
  misc_feature: PFam Name: 7tm_1; PFam Description: 7 transmembrane receptor
  misc_feature: GI Number: 50912049; NR Description: pentatricopeptide (PPR) repeat-containing protein-like [Oryza sativa (japonica cultivar-group)] >gi|41052650|dbj|BAD07498.1| pentatricopeptide (PPR) repeat-containing protein-like [Oryza sativa (japonica
  misc_feature: GI Number: 42565430; NR Description: pentatricopeptide repeat
  misc_feature: GI Number: 15228788; NR Description: pentatricopeptide (PPR)
  misc_feature: GI Number: 50918647; NR Description: putative reverse transcriptase [Oryza sativa (japonica cultivar-group)] >gi|21686921|gb|AAK71569.2| putative reverse transcriptase [Oryza
  misc_feature: GI Number: 15218325; NR Description: pentatricopeptide (PPR)
MITAEEKSPEREEEEEANPRAEAFLEIICRVPAGEVEAALSACGIGPTAEVEELVLKSRECYKRPKSAVRFFRWAGQSVSHTAYAWNLLVDILGKAAMFEPMWDAIRSMKQEGGGGLVSVATFASVFASYCAAGNIKDAIAALDVMDRYGLKHDAVALNSLLSAICRVEGRAQDAQDVFERTKATIPPDGDTFAILLEAWEKEGNAVRAKSVFGEMVVRIGWDAANVSAYDSFLSTLVRGGLLDEAFKFLQVMRSKGCLPGINFFSTAVDLVVRKGDYLNAVAIWHMMVSEAGLVPNFSMYSAMIGLHCNAGSIDDALGLLDEMPLNGVFANSVTYNTILEGFIKHRKAREAESFLTEMSKNEQLPTASNCAAAISLFFKEFNPSAAIDVWRCIVEHNITPAEDSAKELIAGLLDFGRFTEVTKRADEMIDMRVELSRSTMENMKRAFAKAGRHQSYDNIARRLKRY

SEQ ID NO: 3377 - DNA, 1381 bp, Zea mays
  misc_feature (1)..(1381): Ceres cDNA ID no. 21665680
  misc_feature (1)..(1381): Ceres CLONE  ID no. 244347
  misc_feature (1)..(1381): Also known as  Ceres CDNA ID no. 24360853
actgcagtggagctggagcgcgcacgcacacacgagacagaagccgggaatcgaagcatcaagccctttctctgagcgccgatggcacggtatcttctcgcccccacttccacctcctcctctgccctcctcccaaggatggcgtcaagaactcgccgacgtcacggcccctccgcctccgtgcgctcggctccaggaccagcaaggcgcggcacatcatggcggtggcgtccgagcaggccgcgccgccggccaggtaccccaaggtggctgcccctaccaccggcccgatccccgccgccgagctgctcggagtcatcgaggccgccgcaaaagctggggccgatgttataatggaagctgttaataagccacgcaatatccactataaaggtgttgcagacctggtgacagacacagacaagttgagtgaatcagtcattttggaagttgtcaccaagaacttcaaagaccacctcatacttggggaggaaggcggccttgttggagattccctatcagagtacctctggtgcattgaccctttagatggaacaacgaactttgcacatggttaccccagcttttctgtgtccattagtgttctcttccgtggaaagcctgctgcttccactgtggtggaattttgtggcgggcctatgtgctggagcacccgtacaatttctgcatctgctggcggaggagcttattgtaatgggcaaaagattcatgtcagtcagacagacaaggtggaacaatcacttctcgtcacaggttttggatatgaacacgatgatgcctggacgaccaatatgaatctgttcaaggaatttactgacattagcaggggagtgcgaaggctagggtctgctgctgctgacatgtcccacattggacttggtattacagaagcttactgggaataccgacttaagccatgggatatggctgctggcgtcctgatagtagaggaagctggtggggtggtaactcgcatggacggtggagagtttacggtcttcgatcgctctgttcttgtttccaacggacttgttcatggacagcttttggaccggatcggccctcctactgaagaccttaagaagaaagggatcgacttctcgttgtggttcaagcctgacaagtaccctaccgacttttgagctgcaccaagggcaccaccaccagccatgggccaccataataaagcagccatcatttttttcggtgggggggttccttaaagaagaaacaataatgtttttagttcaatagcattgtacttgtaatggcaatacgatgtacagttcttcgactcgagtttcagaccagagtttcaagagagccaagctcctgaaaaaaaaaaaaaaaaaaaaaaaaa

SEQ ID NO: 3378 - protein, 1381 aa, Zea mays
  misc_feature: PFam Name: Inositol_P; PFam Description: Inositol
  misc_feature: PFam Name: Arv1; PFam Description: Arv1-like family
  misc_feature: PFam Name: Ras; PFam Description: Ras family
  misc_feature: PFam Name: Nsp1_C; PFam Description: Nsp1-like C-terminal region
  misc_feature: GI Number: 18397837; NR Description: inositol monophosphatase
  misc_feature: GI Number: 21537207; NR Description: unknown [Arabidopsis thaliana]
  misc_feature: GI Number: 4512616; NR Description: Contains similarity to gi1653332 extragenic suppressor (SuhB) from Synechocystis sp. gbD90912 and is a member of the Inositol monophophatase family PF00459. EST gbAA597395 comes from this protein F28K20.15
  misc_feature: GI Number: 58760232; NR Description: inositol monophosphatase
  misc_feature: GI Number: 45526844; NR Description: COG0483: Archaeal fructose-1,6-bisphosphatase and related enzymes of inositol
ACTGCAGTGGAGCTGGAGCGCGCACGCACACACGAGACAGAAGCCGGGAATCGAAGCATCAAGCCCTTTCTCTGAGCGCCGATGGCACGGTATCTTCTCGCCCCCACTTCCACCTCCTCCTCTGCCCTCCTCCCAAGGATGGCGTCAAGAACTCGCCGACGTCACGGCCCCTCCGCCTCCGTGCGCTCGGCTCCAGGACCAGCAAGGCGCGGCACATCATGGCGGTGGCGTCCGAGCAGGCCGCGCCGCCGGCCAGGTACCCCAAGGTGGCTGCCCCTACCACCGGCCCGATCCCCGCCGCCGAGCTGCTCGGAGTCATCGAGGCCGCCGCAAAAGCTGGGGCCGATGTTATAATGGAAGCTGTTAATAAGCCACGCAATATCCACTATAAAGGTGTTGCAGACCTGGTGACAGACACAGACAAGTTGAGTGAATCAGTCATTTTGGAAGTTGTCACCAAGAACTTCAAAGACCACCTCATACTTGGGGAGGAAGGCGGCCTTGTTGGAGATTCCCTATCAGAGTACCTCTGGTGCATTGACCCTTTAGATGGAACAACGAACTTTGCACATGGTTACCCCAGCTTTTCTGTGTCCATTAGTGTTCTCTTCCGTGGAAAGCCTGCTGCTTCCACTGTGGTGGAATTTTGTGGCGGGCCTATGTGCTGGAGCACCCGTACAATTTCTGCATCTGCTGGCGGAGGAGCTTATTGTAATGGGCAAAAGATTCATGTCAGTCAGACAGACAAGGTGGAACAATCACTTCTCGTCACAGGTTTTGGATATGAACACGATGATGCCTGGACGACCAATATGAATCTGTTCAAGGAATTTACTGACATTAGCAGGGGAGTGCGAAGGCTAGGGTCTGCTGCTGCTGACATGTCCCACATTGGACTTGGTATTACAGAAGCTTACTGGGAATACCGACTTAAGCCATGGGATATGGCTGCTGGCGTCCTGATAGTAGAGGAAGCTGGTGGGGTGGTAACTCGCATGGACGGTGGAGAGTTTACGGTCTTCGATCGCTCTGTTCTTGTTTCCAACGGACTTGTTCATGGACAGCTTTTGGACCGGATCGGCCCTCCTACTGAAGACCTTAAGAAGAAAGGGATCGACTTCTCGTTGTGGTTCAAGCCTGACAAGTACCCTACCGACTTTTGAGCTGCACCAAGGGCACCACCACCAGCCATGGGCCACCATAATAAAGCAGCCATCATTTTTTTCGGTGGGGGGGTTCCTTAAAGAAGAAACAATAATGTTTTTAGTTCAATAGCATTGTACTTGTAATGGCAATACGATGTACAGTTCTTCGACTCGAGTTTCAGACCAGAGTTTCAAGAGAGCCAAGCTCCTGAAAAAAAAAAAAAAAAAAAAAAAAA

SEQ ID NO: 3379 - DNA, 1211 bp, Zea mays
  misc_feature (1)..(1211): Ceres cDNA ID no. 21665681
  misc_feature (1)..(1211): Ceres CLONE  ID no. 247289
  misc_feature (1)..(1211): Also known as  Ceres CDNA ID no. 24362757
agtagtctatccccaccgcgaaccgccgcaggaatctctgacgatggccccgccggccgctgcggttgccgccgtccgccaccacagcccgcacctgctcctccgccgcgggggcgggggtctcctatcatcgccttcgggccccgccacgctccctttcgcctcgcggggtgcggcctccgcgcccgcgcgcctgcgcctgccgccgccgcagttctctctctcccccgtcccgaagagcctctccgccgcctcctcctcccacgtcattgtacggtccctcttcaccggcattgtcgaggaggtcggccgcgtgcgccgcctcggcccgccgctcgcgccgtctgggggtggcggcggcgaggctcttggccttgacttggaggtcgagaccaaggacctcctcgccggtactcagctcggtgacagtgtggcggtcgacggcgcctgcctcaccgttgcggcgatcgacccggccgcgtccacgctcaccttcggagtggccccggagacgctccgccggacgtccctgggagagcgcgccccaggcgacggcgtcaacctcgagcgcgcactcactccgtcgtcccgcatgggcgggcacttcgtgcagggccacgtcgacgggaccggggagatcgttgcgttccggccggacggggactcgctctgggtcaccgtgcgcgccccgccggagatcctccggctgctcgtgcccaagggcttcgtcgccgttgacggcactagcctcactgttgtcagtgtggacgacgagggcggctggtttgacttcatgctcgtcaggtacacgcaggacaacatcgtgctgccgaccaagaaggtcggagacaaggtgaacctagaggcggatatactgggtaagtacgtcgagaagctcctcgctgggagggttgaggccatggcgaaggttgattcttgatctaccattgctgagctgctggatcaatggtcattctacaggtatttcagcaatgttatgttcatcaataatagcagttcattccattttgttgcaattggcttgttgtttttttatttcagactttcagtgagacagtaataaaacataagtgatcgaggaaatgacttatcatttcttttcatccgttgagataaatgtacaagtatccatactctaatatgcagccaaatttagaagtttgttttgttgccgaaaaaaaaaaaaaaaa

SEQ ID NO: 3380 - protein, 298 aa, Zea mays
  misc_feature: PFam Name: Lum_binding; PFam Description: Lumazine binding domain
  misc_feature: GI Number: 21593865; NR Description: putative riboflavin
  misc_feature: GI Number: 20197688; NR Description: putative riboflavin synthase alpha chain [Arabidopsis thaliana] >gi|19548077|gb|AAL87403.1| At2g20690/F5H14.34 [Arabidopsis thaliana] >gi|13605593|gb|AAK32790.1| At2g20690/F5H14.34
  misc_feature: GI Number: 51243463; NR Description: riboflavin synthase
  misc_feature: GI Number: 66848005; NR Description: riboflavin synthase,
  misc_feature: GI Number: 37720048; NR Description: riboflavin synthase [Pichia guilliermondii] >gi|18252608|gb|AAL66353.1| riboflavin
MAPPAAAVAAVRHHSPHLLLRRGGGGLLSSPSGPATLPFASRGAASAPARLRLPPPQFSLSPVPKSLSAASSSHVIVRSLFTGIVEEVGRVRRLGPPLAPSGGGGGEALGLDLEVETKDLLAGTQLGDSVAVDGACLTVAAIDPAASTLTFGVAPETLRRTSLGERAPGDGVNLERALTPSSRMGGHFVQGHVDGTGEIVAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVDS

SEQ ID NO: 3381 - DNA, 1138 bp, Zea mays
  misc_feature (1)..(1138): Ceres cDNA ID no. 21665683
  misc_feature (1)..(1138): Ceres CLONE  ID no. 277929
  misc_feature (1)..(1138): Also known as  Ceres CDNA ID no. 24360988
ctaaaaggctaggcactcgtccatccaacacaagctgacagagagagctagcaacgctctgcaagatccgccatctaaactttgcagcactctactccaccactctcctccgtctgcgactgcgactaggtcccaaatggccgctccaccggtggccgccgctctgtctgcgctccatgaggcacaagagacccacggccatgacgacagccgcgctgggcacgcgagaggccactggcggccagccgaggatgccaagctcaaggacctcgtggcgctgtacggccccaagaactggaacctcatcgccagcaaactccacggcagatcagggaaaagctgccggctgcggtggttcaaccagctggacccgcgggtgaaccgccgcccgttctcggcggcggaggagcagcggctggtagcggcgcaccgcgcccacggcaacaagtgggcgctcatcgcgcgcctcttcccaggccgcaccgacaacgccgtcaagaaccactggcacgtcctcacggcgcgcaggcagcgggagcggaccggcgcgccgccgcgccgacgcaagccctcctcgtcgtcatcacccgccgcccaccaccaccgtgcaccatctcccctgccgttccgcgccggcaaggccacccgaccccgctcgtgcggcgacggcaacggcgggtccgagtccgacgagtccgcatcgtccacctcctccggcaccgacctctcctccctaggctccgtgtgcgccgccgccgtcccctgcttccacttccaccgccggcgacagagccagagctcgtgcgacggcacgacgtgcgcgtgcctcctcggctcctcctcggcctcgccactgctgcgctgcatcatgcttcgctccgttccgtcgcctgcagcggcttccgacggcggcggcggatgtggaaagctcgccgccctgcccttcttcgacttccttggcgttggcgcgacgtgatcgatcgtagtcgtagcccgccccccggcccggcacactgcagtggtgtcgggatccccagtggccagtgaacactgatcagaatgaactctgagtagtttacctttttctttatttgaatatgatttgatttgaattttggcatgaaaaaaaaaaaaaaaa

SEQ ID NO: 3382 - protein, 279 aa, Zea mays
  misc_feature: PFam Name: Myb_DNA-binding; PFam Description: Myb-like
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: GI Number: 56783716; NR Description: putative transcription factor [Oryza sativa (japonica cultivar-group)] gi|56783693|dbj|BAD81105.1| putative transcription factor [Oryza
  misc_feature: GI Number: 6979341; NR Description: myb-like protein [Oryza sativa]
  misc_feature: GI Number: 50946085; NR Description: putative MYB transcription factor [Oryza sativa (japonica cultivar-group)] >gi|42407517|dbj|BAD10634.1| putative MYB transcription factor
  misc_feature: GI Number: 25403271; NR Description: protein T24P13.16 [imported] - Arabidopsis thaliana >gi|9295726|gb|AAF87032.1|
  misc_feature: GI Number: 13430158; NR Description: putative transcription factor MYB117 [Arabidopsis thaliana] >gi|18396049|ref|NP_564261.1| myb family transcription factor (MYB117) [Arabidopsis thaliana] >gi|41619126|gb|AAS10029.1| MYB
MAAPPVAAALSALHEAQETHGHDDSRAGHARGHWRPAEDAKLKDLVALYGPKNWNLIASKLHGRSGKSCRLRWFNQLDPRVNRRPFSAAEEQRLVAAHRAHGNKWALIARLFPGRTDNAVKNHWHVLTARRQRERTGAPPRRRKPSSSSSPAAHHHRAPSPLPFRAGKATRPRSCGDGNGGSESDESASSTSSGTDLSSLGSVCAAAVPCFHFHRRRQSQSSCDGTTCACLLGSSSASPLLRCIMLRSVPSPAAASDGGGGCGKLAALPFFDFLGVGAT

SEQ ID NO: 3383 - DNA, 1153 bp, Zea mays
  misc_feature (1)..(1153): Ceres cDNA ID no. 21665684
  misc_feature (1)..(1153): Ceres CLONE  ID no. 314810
  misc_feature (1)..(1153): Also known as  Ceres CDNA ID no. 24362665
aattcgttctgctgcacaggacagcgggagtgtcggtaggcgttcgctgcctgcttggtgccgccgtttctctgctagtagctctttcacgtgcgcgccatggccgcctcctcgagctcctccgccgcctcccgcctctccgtcctcctcgcgtcgtggctcgtgtgcgcggcgtgcctcttcgtctccggagacgcctcgggggcggcgcacagggtggtcgaccccgagtggcacccggccaccgccacctggtacggcagcgccgagggcgacggcagcgacggcggcgcgtgcgggtacgggacgctggtggacgtggtgccgatgaaggcgcgcgtaggcgccgtgagccccgtgctgttcaagtccggcgagggctgcggcgcctgctacaaggtgcggtgcctcgaccacggcgtctgctcgcgccgcgccgtaacggtcatcgtcaccgacgagtgccccggcggggtctgcgcgggcggccgcacgcacttcgacctcagcggcgccgcgttcggccgcctcgccgtggccggcgccggcggccagctgcgcgaccggggcgagatcaacgtcgtgttccgcaggacggcgtgcaggtacgggggcaagaacatcgccttccacgtgaacgagggctccactagcttctggctctccctgctggtggagttcgaggacggcgacggcgacatcggatccatgcagctcaaacaggccaactcggcgcagtggcgagacatgcagcacgtctggggggccacgtggagcctcaccccgggcccgctcgtcgggcccttctccgtgcggctgacgaccctgtcgggcaagcagacgctcacggcccaggacgtcatccccaagaactgggccgccaaggccacctacacctcccgcctcaacttcgcgtagaggccaggccttctgcgggtcattatcgttcccggaatcccgggaggtagtagtcagttgagcttagacattcggaggctcacattgttctgtgcagtttgatgtcgcgtgaaggggataagctggtatagtagtagtggataaacctgggtgctgtttggttcaaaaaatgtaacgcaaatggtaatggtaatagtttcggctcgattactgacggtgaaaaaaaaaaaaaaaa

SEQ ID NO: 3384 - protein, 272 aa, Zea mays
  misc_feature: PFam Name: Pollen_allerg_1; PFam Description: Pollen allergen
  misc_feature: PFam Name: DPBB_1; PFam Description: Rare lipoprotein A
  misc_feature: GI Number: 22136782; NR Description: putative beta-expansin/allergen protein [Arabidopsis thaliana] >gi|14532724|gb|AAK64163.1| putative beta-expansin/allergen protein [Arabidopsis thaliana] >gi|20138391|sp|Q9M0I2|EXB3_ARATH
  misc_feature: GI Number: 21592834; NR Description: putative
  misc_feature: GI Number: 21536717; NR Description: beta-expansin 1 precursor (At-EXPB1) (Ath-ExpBeta-1.5) [Arabidopsis thaliana] >gi|28827426|gb|AAO50557.1| putative beta-expansin pollen allergen protein [Arabidopsis thaliana]
  misc_feature: GI Number: 50911068; NR Description: putative beta-expansin [Oryza sativa (japonica cultivar-group)] >gi|49388230|dbj|BAD25350.1| putative beta-expansin [Oryza sativa
  misc_feature: GI Number: 7269679; NR Description: putative beta-expansin/allergen protein [Arabidopsis thaliana] >gi|7484871|pir||T09041 cim1 protein homolog F26K10.130 -
MAASSSSSAASRLSVLLASWLVCAACLFVSGDASGAAHRVVDPEWHPATATWYGSAEGDGSDGGACGYGTLVDVVPMKARVGAVSPVLFKSGEGCGACYKVRCLDHGVCSRRAVTVIVTDECPGGVCAGGRTHFDLSGAAFGRLAVAGAGGQLRDRGEINVVFRRTACRYGGKNIAFHVNEGSTSFWLSLLVEFEDGDGDIGSMQLKQANSAQWRDMQHVWGATWSLTPGPLVGPFSVRLTTLSGKQTLTAQDVIPKNWAAKATYTSRLNFA

SEQ ID NO: 3385 - DNA, 611 bp, Zea mays
  misc_feature (1)..(611): Ceres cDNA ID no. 21665685
  misc_feature (1)..(611): Ceres CLONE  ID no. 322440
  misc_feature (1)..(611): Also known as  Ceres CDNA ID no. 24362155
aagaaaagcctccattcccgagtctccagccaactgcatccagtccacccccatccccctcgaccccgacaaccccgacccgatggcgcccaaggccgagaagaagccagcggagaagaagccggcggccgaggagaaggcggagaagacgaccgcaggtaagaagcccaagtccgagaagcgcctgccggcctcgaagtcctccggtaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggcagtgggaagagaaggttgtcagaattggttcggcaggtgtctaataaaggcttcctgttgggaaagaattggatccacgggcagcttttagtcatttgtttggaggcattggattcattggagggtcgatttgtgattgtaatcacgattaatgtaatggattggaaattcggaaggggccagatctctttttcatacaaaaaaaaaaaaaaaaaaaaaaaaaaaaa

SEQ ID NO: 3386 - protein, 130 aa, Zea mays
  misc_feature: PFam Name: Histone; PFam Description: Core histone H2A/H2B/H3/H4
  misc_feature: PFam Name: Ras; PFam Description: Ras family
  misc_feature: PFam Name: Arv1; PFam Description: Arv1-like family
  misc_feature: PFam Name: Nsp1_C; PFam Description: Nsp1-like C-terminal region
  misc_feature: PFam Name: BLVR; PFam Description: Bovine leukaemia virus
  misc_feature: GI Number: 21801; NR Description: histone H2B [Triticum aestivum] >gi|122022|sp|P27807|H2B1_WHEAT Histone H2B
  misc_feature: GI Number: 577825; NR Description: H2B histone [Zea mays]
  misc_feature: GI Number: 22325; NR Description: H2B histone [Zea mays] >gi|399854|sp|P30756|H2B2_MAIZE Histone H2B.2
  misc_feature: GI Number: 1708107; NR Description: Histone H2B >gi|7439752|pir||T02077 histone H2B - maize
  misc_feature: GI Number: 13898834; NR Description: histone H2B-3 [Lolium perenne]
MAPKAEKKPAEKKPAAEEKAEKTTAGKKPKSEKRLPASKSSGKEGGEKKGKKKAKKSVETYKIYIFKVLKQVHPDIGISSKAMSIMNSFINDIFEKLAGEAVGREGCQNWFGRCLIKASCWERIGSTGSF

SEQ ID NO: 3387 - DNA, 1228 bp, Zea mays
  misc_feature (1)..(1228): Ceres cDNA ID no. 21665686
  misc_feature (1)..(1228): Ceres CLONE  ID no. 346733
  misc_feature (1)..(1228): Also known as  Ceres CDNA ID no. 24364716
aaccaaccaaaatcgtggctgcggctgtggacaatcggcagcttgcgagtagctccggtacggaggggatcatggaggaggggcggcaactggaagcggcggcgttcggttttccggcgccggtgcagccgggggccacgcgcgtggggtggatcggcatcggcgtcatgggcggcgccatggccaagcgcctcctcgcggcagggtacgcggtcaccgcgtacgctcgcacgccgtccagggcggagagcctcgtcgcggcgggcgcgagcctcgcggactcgccggccgccgtggccgccgcgtccgacgtggtgttcaccatggtcgggaaccccggcgacgtccgcgcggtggtcctggacccggccgccggggccctcgcgggcctccgccgcggcggcgtgctggtggactgcacgagctcctccccgtccctcgcgcgcgaggtcgccgcggccgcggccgcggcgggctgccacgccgtcgacgcgccggtctccggaggcgacgtgggcgcgcgggacggcacgctggccgtcttcgccggcggcgacgaggccgtcgtcgcctggctcgcgccgctcttcgccagcctcggcagggcgacccgcatgggcgcgccgggcagcggccagagcagcaagatcgccaaccaggtcgcggtggccggcgcggtggtgggcctcggcgaggccgtgtccttcgcccgcgcggcggggctcgacgcgccgctgttcctcggcgcggtgtccaggggcgcggcctggtcgcgcgtcatggacgtcttcggcggccgcttgctccgccgcgagttcgcgtccgggggcagcgtacggtacatcgtcaaggacctcggcatggcgctggaggtcggagacggcggggaggaggaggtcaacgtgctgcctggagcggcgctgtaccggcagatgttctcggccatggtggccaatggcgacgcggacctgagcttgcagggactgatcaccgttatcgagcgcctgaacggcattgcaaagtagcgaaggctgcagcaggcaaggtgctgcttttttgttgatggagactgcaggaaaggtgttcgccggaatgcaacactggacccgaagacgcctgagcttgtgacatggacttgttttttgtattcaaaacactgtttcgagcttgatttgcgtttgtaatttcgcccctaaataaaactttgcttccaaaaaaaaaaaaaaaa

SEQ ID NO: 3388 - protein, 1228 aa, Zea mays
  misc_feature: PFam Name: NAD_binding_2; PFam Description: NAD binding
  misc_feature: PFam Name: Peptidase_S8; PFam Description: Subtilase family
  misc_feature: PFam Name: 2-Hacid_dh_C; PFam Description: D-isomer specific
  misc_feature: PFam Name: Aminotran_3; PFam Description: Aminotransferase
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
  misc_feature: GI Number: 32472744; NR Description: 3-hydroxyisobutyrate dehydrogenase [Pirellula sp. 1] >gi|32443981|emb|CAD73423.1|
AACCAACCAAAATCGTGGCTGCGGCTGTGGACAATCGGCAGCTTGCGAGTAGCTCCGGTACGGAGGGGATCATGGAGGAGGGGCGGCAACTGGAAGCGGCGGCGTTCGGTTTTCCGGCGCCGGTGCAGCCGGGGGCCACGCGCGTGGGGTGGATCGGCATCGGCGTCATGGGCGGCGCCATGGCCAAGCGCCTCCTCGCGGCAGGGTACGCGGTCACCGCGTACGCTCGCACGCCGTCCAGGGCGGAGAGCCTCGTCGCGGCGGGCGCGAGCCTCGCGGACTCGCCGGCCGCCGTGGCCGCCGCGTCCGACGTGGTGTTCACCATGGTCGGGAACCCCGGCGACGTCCGCGCGGTGGTCCTGGACCCGGCCGCCGGGGCCCTCGCGGGCCTCCGCCGCGGCGGCGTGCTGGTGGACTGCACGAGCTCCTCCCCGTCCCTCGCGCGCGAGGTCGCCGCGGCCGCGGCCGCGGCGGGCTGCCACGCCGTCGACGCGCCGGTCTCCGGAGGCGACGTGGGCGCGCGGGACGGCACGCTGGCCGTCTTCGCCGGCGGCGACGAGGCCGTCGTCGCCTGGCTCGCGCCGCTCTTCGCCAGCCTCGGCAGGGCGACCCGCATGGGCGCGCCGGGCAGCGGCCAGAGCAGCAAGATCGCCAACCAGGTCGCGGTGGCCGGCGCGGTGGTGGGCCTCGGCGAGGCCGTGTCCTTCGCCCGCGCGGCGGGGCTCGACGCGCCGCTGTTCCTCGGCGCGGTGTCCAGGGGCGCGGCCTGGTCGCGCGTCATGGACGTCTTCGGCGGCCGCTTGCTCCGCCGCGAGTTCGCGTCCGGGGGCAGCGTACGGTACATCGTCAAGGACCTCGGCATGGCGCTGGAGGTCGGAGACGGCGGGGAGGAGGAGGTCAACGTGCTGCCTGGAGCGGCGCTGTACCGGCAGATGTTCTCGGCCATGGTGGCCAATGGCGACGCGGACCTGAGCTTGCAGGGACTGATCACCGTTATCGAGCGCCTGAACGGCATTGCAAAGTAGCGAAGGCTGCAGCAGGCAAGGTGCTGCTTTTTTGTTGATGGAGACTGCAGGAAAGGTGTTCGCCGGAATGCAACACTGGACCCGAAGACGCCTGAGCTTGTGACATGGACTTGTTTTTTGTATTCAAAACACTGTTTCGAGCTTGATTTGCGTTTGTAATTTCGCCCCTAAATAAAACTTTGCTTCCAAAAAAAAAAAAAAAA

SEQ ID NO: 3389 - DNA, 512 bp, Zea mays
  misc_feature (1)..(512): Ceres cDNA ID no. 21665688
  misc_feature (1)..(512): Ceres CLONE  ID no. 359490
  misc_feature (1)..(512): Also known as  Ceres CDNA ID no. 24364616
gttcctcacgccgcctccacgcctccaacagaagaaccctaagctgccctcgctccggcgccgccacctcgtcgtccgtccgcatcgattcgatggcccgcgtctccgccttcgtcgccgccgtgatcaccgccgccgttgtcgttgacgcgctgttcacagccgcctccgccaccgaggcaccggcccccgccccgatgtccggcgcgggcgaaaagaagctgtacgaggccaaggtgtgggagaaggcgtgggagaacttcaagcagctgcagagcttcgagctcgtcggagacgccgcggtcgcctgaggcgcacaggcttttcgctggaggctggagcacaacaatgaaagaatttaactgtcatcccactggaaaagtatgatataatgaataaaccagcgtcttacccacatgtattgtaccctaatgagatatttgaccactgtaatagaatgagatgtgctaaggaatctgaaagccttcttgcttataaaaaaaaaaaaaaaa

SEQ ID NO: 3390 - protein, 72 aa, Zea mays
  misc_feature: PFam Name: FH2; PFam Description: Formin Homology 2 Domain
  misc_feature: PFam Name: Cystatin; PFam Description: Cystatin domain
  misc_feature: PFam Name: LMBR1; PFam Description: LMBR1-like membrane protein
  misc_feature: PFam Name: GATase_2; PFam Description: Glutamine
  misc_feature: PFam Name: Pyr_redox_2; PFam Description: Pyridine
  misc_feature: GI Number: 1277164; NR Description: cysteine proteinase inhibitor [Glycine max] >gi|7438238|pir||T07051 cysteine proteinase
  misc_feature: GI Number: 288188; NR Description: cysteine proteinase inhibitor [Vigna unguiculata] >gi|1169196|sp|Q06445|CYTI_VIGUN Cysteine proteinase inhibitor (Cystatin) >gi|481817|pir||S39506
  misc_feature: GI Number: 31505485; NR Description: cystatin [Saccharum
  misc_feature: GI Number: 18030077; NR Description: cystatin [Vigna radiata]
  misc_feature: GI Number: 11559283; NR Description: cysteine proteinase
MARVSAFVAAVITAAVVVDALFTAASATEAPAPAPMSGAGEKKLYEAKVWEKAWENFKQLQSFELVGDAAVA

SEQ ID NO: 3391 - DNA, 1716 bp, Zea mays
  misc_feature (1)..(1716): Ceres cDNA ID no. 21665689
  misc_feature (1)..(1716): Ceres CLONE  ID no. 362760
  misc_feature (1)..(1716): Also known as  Ceres CDNA ID no. 23855821
attgtcggcaccgtgccctccgctccgctccccttcctcttggttttcggttccttcctccctcaaccagtcatctgctgctatttatgccacagccactcccagcagcggtgggaacaaagagtgccagcgtctcacccctgaggccgcgcagagccactgcttgcgtctctgtctctctgtctgctcgtttttctccttctgcgactcgtaggagggtgaggtcttgcctcgcggaatggcggcgtccggggcatggctggcccgtgcgacggcgacggcggtgctgggtttcgtcctggcggtggcgtcagctgaggcggcatcgggggacgtggagatggtgttcctcaaggccgcggtggccaaaggcgcagtgtgcttggacggcagcccaccggtgtaccatttctctcccggctccggttctggcgccaataactgggtcgtccacatggagggaggagggtggtgcaggaatcctgatgagtgtgctgtccgcaagggcaacttcaggggctcctccaaatttatgaagccactctcgttttcagggatattaggcggcaaccaaaaatccaatcctgatttctacaactggaatagagtaaagatcagatactgtgatggttcatcatttactggtgacgttgaggctgtggacactgcgaaagatctccgttacagagggttcagagtctggcgtgccgtcatcgatgatctacttactgtgaggggaatgagcaaggcgcaaaatgctcttctttctggatgctcagccggaggtctagcagcaatactacactgtgacagattccatgatctgtttccagcgaaaacaaaggtcaagtgtttttctgatgctggatattttttcgatgggaaggatatctccgggaacttttacgctaggtcaatctataagagcgttgtgaatctacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgtcctagcacctagtccagctgatccgaagaagacttgggcccaatgcaagcttgacatcaagagctgctccgccagccaactcacaaccttgcaaaatttcaggacagattttctggcagcactccctaaaacgcagtctgtaggcatgttcatcgactcatgcaatgctcactgccaatcaggatctcaagacacgtggctagccgatggttctcccacggttaacaagacgcaaattggcaaggcggtgggggactggtactacgatagggaggtccctcggcagattgattgcccgtatccctgcaacccaacttgcaagaaccgtgatgatgattgagcaattgtataagtagttcatgttatcgaaatgaaaacaataaaggatcacaacgcgcgcccgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgtatattgtgtcttcgcctatgcttaagacattggactagttgattggtcaatttaatttattaaatgccaaaaaaaaaaaaaaaaaa

SEQ ID NO: 3392 - protein, 397 aa, Zea mays
  misc_feature: PFam Name: PAE; PFam Description: Pectinacetylesterase
  misc_feature: GI Number: 21593445; NR Description: pectin acetylesterase
  misc_feature: GI Number: 10176999; NR Description: pectin acetylesterase [Arabidopsis thaliana] >gi|16323123|gb|AAL15296.1| AT5g45280/K9E15_6 [Arabidopsis thaliana] >gi|15242357|ref|NP_199341.1| pectinacetylesterase, putative
  misc_feature: GI Number: 52421285; NR Description: At4g19420 [Arabidopsis thaliana] >gi|50198791|gb|AAT70429.1| At4g19420 [Arabidopsis thaliana] >gi|22328797|ref|NP_193677.2| pectinacetylesterase family
  misc_feature: GI Number: 1431629; NR Description: pectinacetylesterase precursor [Vigna radiata var. radiata] >gi|7488883|pir||S68805
  misc_feature: GI Number: 21592972; NR Description: putative pectinacetylesterase protein [Arabidopsis thaliana] >gi|17978691|gb|AAL47339.1| putative pectinacetylesterase protein [Arabidopsis thaliana] >gi|15450902|gb|AAK96722.1| putative
MAASGAWLARATATAVLGFVLAVASAEAASGDVEMVFLKAAVAKGAVCLDGSPPVYHFSPGSGSGANNWVVHMEGGGWCRNPDECAVRKGNFRGSSKFMKPLSFSGILGGNQKSNPDFYNWNRVKIRYCDGSSFTGDVEAVDTAKDLRYRGFRVWRAVIDDLLTVRGMSKAQNALLSGCSAGGLAAILHCDRFHDLFPAKTKVKCFSDAGYFFDGKDISGNFYARSIYKSVVNLHGSAKNLPASCTSKPKQSPELCMFPQYVVPTMRTPLFILNAAYDSWQVKNVLAPSPADPKKTWAQCKLDIKSCSASQLTTLQNFRTDFLAALPKTQSVGMFIDSCNAHCQSGSQDTWLADGSPTVNKTQIGKAVGDWYYDREVPRQIDCPYPCNPTCKNRDDD

SEQ ID NO: 3393 - DNA, 2769 bp, Zea mays
  misc_feature (1)..(2769): Ceres cDNA ID no. 21665690
  misc_feature (1)..(2769): Ceres CLONE  ID no. 363399
  misc_feature (1)..(2769): Also known as  Ceres CDNA ID no. 24364600
actcgcggtaccagcgcggtggaggaggcactggcggcccatcgtccgcgccgagcgatggcgtccccgctcctgtgcgtcctcctctacctactccgccaccttacggcctgccacgccgccagggacaccatcacgccggaccggccgctggcgggcaacgagacgctggtctcgggcggcgagggcaacttcgcgctcggcttcttcaccccgccgggcgccaacagcacctacctcggcgtgtggtacaacaaggtctccctccgcaccgtggtgtgggtggccaaccgcgaggccccgatcgcgggcgccgtcggggacaaccccggcgccacgctctccgtgtccgccggcggcacgctcgccattgccgcggggaacaggaccgtcgtgtggtccgtcgagccggcgtccaggctggcgagcccggccgcccagatcctggacaacggcaacctggtgctcaaggacggtgccggcggcggcgccgtggcgtgggaggggttcgactacccgacggacacgatgctcccggagatgaagctggggatcgactacgtgaaagggaagaacaggacgctgacgtcgtggaaaagcccgtcggacccctccccgggccccgtggccatggtgatggacaccagcggcgacccgcaggtgttcatctggaacggcggcgagaaggtctggcggtccgggccctgggacggcgtccagttcaccggcgtgccggacacggccacctactccggcttcaccttcagcttcgtaaacagcgcgcgggaggtgacgtacagcttccaggtgcacaacgtgtccatcatctcgcacctgggcgtcgtgagcacggggaactacgggctgctgcagcgctcgacgtgggtggaggcggcgcgggcgtggaacctgtactggtacgcccccaaggaccagtgcgacgcggtgtcgccgtgcgggcccaacggcgtgtgcgacaccaacaacatgccggtctgctcctgcctccgcggcttcaccccgaggacccccgccgcgtgggcgctgcgggacggccgcgacgggtgcgtgcggtccacgccgctggactgccgcaacggcaccgacggcttcgtcacggtgcgccacgccaaggtgcccgacacggagcggagcgcggtggactggagcctgacgctggaccagtgccgccaggcgtgcctccgcaactgctcctgcaccgcgtacgccagcgccaacgtcagcggcggcgccggcggtgggcgccgcgccggcgccggctcgggctgcgtcatgtggaccacggggctcaccgacctgcgcgtgtaccccgacttcggccaggacctcttcgtccgcctcgccgccgcggatctcgatgtagaagctaaatcaagggaggcgcgcatcaaaatcgcagtcggcgccagcgtctcggcgctggcgcttcttctagcagtcgctggtctcctcatctggtcatggaggagaagactaacaagaacagacggatcaagtaaatggagtagctcccgccccaccggccgccggtacgagggaagcagccacggtgacgacctggagctgccaatatttgatgtggggacgattgcagctgccacggatggttactcgatcgaaaacaagcttggcgagggtggatttggaccagtgtacaagggtaagctcgaggacggaatggaaatcgcagtgaagacactctcgaagacgtctgcacaagggctagacgagttcaagaacgaggtcttgttgatagccaagctccagcatcgcaatcttgtccggcttcttgggtgcagcgtcagtgggcaagaaaggatgcttgtttacgagtacatggcaaacaagagcctggactatttcctgtttgagaaggacaacgttgtgctcgattggcaagtgcggtaccgtataatagaaggcattactcgaggtctactctacctccaccaggactcgagatacaggatcatccacagagatctgaaggcagctaatgtccttctggacaaggagatgacgcccaaaatctcagactttggcatggcgaggatatttggcaacgaagagacagaaatcaatacccgaaaagtggtcggcacatacggttatatgtctccggagtatgcaatggatgggatcttctctgtcaagtcggacgtattcagctatggagtattgctgctggaaatcgtcagcggtaggaggaacagaggagtgtattcctattcaaacaaccaaagccttctaggccatgcatggagcttgtggaacgaggagaagagcatagagctagcagacgaaagaatgaatgggtcgttcaactcggacgaagtgcagaagtgcatcagagttgggctcttgtgcgtgcaggagaacccagacgaccgtccgctgatgtctcaggtgcttctgatgctggctagtaccgatgccacctcactgccaactcctaagcaacctggcttcgccgctaggagagttctgatggaaacagacacgtcgtcaaccaagccagactgcagcatatttgacagtgcaacaattaccatgcttgaaggtcgatagtagtagttatgagttatgactgaaatgaaacttaaactgctagggaaatgtgtattgtagagtaaatttggcggcctcttcagtatcttgtgtgcttaagcagcagaaaattatatgaatattgaataatagcaggcagcagctggtagaaactttgttgcttttaaaaaaaaaaaaaaa

SEQ ID NO: 3394 - protein, 843 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: PFam Name: S_locus_glycop; PFam Description: S-locus
  misc_feature: GI Number: 913141; NR Description: ARK3 product/receptor-like serine/threonine protein kinase ARK3 [Arabidopsis thaliana,
  misc_feature: GI Number: 730831; NR Description: Putative serine/threonine-protein kinase receptor precursor (S-receptor
  misc_feature: GI Number: 12246842; NR Description: S locus receptor kinase
  misc_feature: GI Number: 15220348; NR Description: S-locus lectin protein
  misc_feature: GI Number: 15220351; NR Description: S-locus lectin protein
MASPLLCVLLYLLRHLTACHAARDTITPDRPLAGNETLVSGGEGNFALGFFTPPGANSTYLGVWYNKVSLRTVVWVANREAPIAGAVGDNPGATLSVSAGGTLAIAAGNRTVVWSVEPASRLASPAAQILDNGNLVLKDGAGGGAVAWEGFDYPTDTMLPEMKLGIDYVKGKNRTLTSWKSPSDPSPGPVAMVMDTSGDPQVFIWNGGEKVWRSGPWDGVQFTGVPDTATYSGFTFSFVNSAREVTYSFQVHNVSIISHLGVVSTGNYGLLQRSTWVEAARAWNLYWYAPKDQCDAVSPCGPNGVCDTNNMPVCSCLRGFTPRTPAAWALRDGRDGCVRSTPLDCRNGTDGFVTVRHAKVPDTERSAVDWSLTLDQCRQACLRNCSCTAYASANVSGGAGGGRRAGAGSGCVMWTTGLTDLRVYPDFGQDLFVRLAAADLDVEAKSREARIKIAVGASVSALALLLAVAGLLIWSWRRRLTRTDGSSKWSSSRPTGRRYEGSSHGDDLELPIFDVGTIAAATDGYSIENKLGEGGFGPVYKGKLEDGMEIAVKTLSKTSAQGLDEFKNEVLLIAKLQHRNLVRLLGCSVSGQERMLVYEYMANKSLDYFLFEKDNVVLDWQVRYRIIEGITRGLLYLHQDSRYRIIHRDLKAANVLLDKEMTPKISDFGMARIFGNEETEINTRKVVGTYGYMSPEYAMDGIFSVKSDVFSYGVLLLEIVSGRRNRGVYSYSNNQSLLGHAWSLWNEEKSIELADERMNGSFNSDEVQKCIRVGLLCVQENPDDRPLMSQVLLMLASTDATSLPTPKQPGFAARRVLMETDTSSTKPDCSIFDSATITMLEGR

SEQ ID NO: 3395 - DNA, 1262 bp, Zea mays
  misc_feature (1)..(1262): Ceres cDNA ID no. 21665691
  misc_feature (1)..(1262): Ceres CLONE  ID no. 385167
  misc_feature (1)..(1262): Also known as  Ceres CDNA ID no. 23860560
ccccaacgccgtcgtcgtcgtgtctccgctccagagtgatcgagcacactgacctggcctgcccacccaagcctcagctcgtgagccagcgcgcctcgccatggccatggtgcaggcggcggacgcggccgtcaaggccaacgagatcctggcgcggtttcggcccatcgcgcccaatcccacactggcggccgagggcgtggtggccgcgaaccgcgtgctgtgccatctgcagagcaagccgtgccgcgcgcggaaacgcggccgccccggccccgccgtcgtggctccgtcgcccgagtcgggcttacagccgcccgccaagcggaagagagccacgacgccgtacccgcctctccggtgcagggggccgcgtgcgtccgcggccgtcccgggcagtgcaggcctccctctggcgtcggcgtcgctcccgccggcgggtgcgggtactgccgaggacctcgcgaaggtggcggcggaggggagggacgtccccgtggagcgcgacctgctgcggaagctgctggagcccaaggtcatctcgccgcgggcggtgcgccccgtgtgctccgccatccacgtcgggtgcatccaccgcgccgacgcgacctgcaccgccgccgtctcgaagacagcggttcgtgtggaggcggagctggaggtcgacgcgctcccggcggttgtctccgacgccagcaaccgcgtccggctcgtgaacgacgcgtacaaggagatggtggggcagcccgagtgcccgtggctcgacgccgtggctgccacgtcgaggaggatcagcggggaggtcgcgctggtggtagccaaccagtcctccctgccagagtcgtacggggtgttcacatgcacggcaaagatcgagtgggaggacgacgggaaggtcgcctccatcgatgtaccctgcgacgtcagccggctgcagtgcgagtccagagagtacctcttcgtctggaggttccgtaccgccgacgccgacgccgacgcatccgttggctgcagctccgaggagattagtgagagttaggggaagcttgcttgagctgcatcctgtgcgcgctgcagtgaaaccaggtgcataggctaagcaagctgcatctcaaaaactggccagcttcctctttcgcctagtccatagagtgtagacccagttctgaaatctggagtaaatataagatctcgactggagaatgcaaatggaaaattggaaatataacatgtactttttcacgaaaaaaaaaaaaaaaaaa

SEQ ID NO: 3396 - protein, 312 aa, Zea mays
  misc_feature: PFam Name: Transferase; PFam Description: Transferase family
  misc_feature: GI Number: 25403312; NR Description: protein F17L21.26 [imported] - Arabidopsis thaliana >gi|9802540|gb|AAF99742.1|
  misc_feature: GI Number: 66780099; NR Description: PE-PGRS family protein [Anaeromyxobacter dehalogenans 2CP-C] >gi|66854329|ref|ZP_00398411.1| PE-PGRS family protein
MAMVQAADAAVKANEILARFRPIAPNPTLAAEGVVAANRVLCHLQSKPCRARKRGRPGPAVVAPSPESGLQPPAKRKRATTPYPPLRCRGPRASAAVPGSAGLPLASASLPPAGAGTAEDLAKVAAEGRDVPVERDLLRKLLEPKVISPRAVRPVCSAIHVGCIHRADATCTAAVSKTAVRVEAELEVDALPAVVSDASNRVRLVNDAYKEMVGQPECPWLDAVAATSRRISGEVALVVANQSSLPESYGVFTCTAKIEWEDDGKVASIDVPCDVSRLQCESREYLFVWRFRTADADADASVGCSSEEISES

SEQ ID NO: 3397 - DNA, 1477 bp, Zea mays
  misc_feature (1)..(1477): Ceres cDNA ID no. 21665692
  misc_feature (1)..(1477): Ceres CLONE  ID no. 390787
  misc_feature (1)..(1477): Also known as  Ceres CDNA ID no. 25088200
gactccctagcattttgggctggctggctccccctccctccctgggatttctccttgcgtgcctccctcgctagggtttagggttctacagccagatagccaccatgcatcaccacttcctctcgcgcctcctcacccaccgtctcctcctccccgccgccacctctccctacgccgcgacgctctccacgccccccaggcgcgcttacgcccgccgcgccaagccgccaccagcgggggactccggagaccacgctgccgcctcctcccctgtagcaccgccgccgccgccggactcggaggcgaaggctgcgtttcagagagagaagctgtcgggcgagctgccgcggccgcccactgtcccgttccagccgcgtgtcgctaacgccgtgcacctcgtcggcaccatctgcgcgcccgtgcacatgcagaggctgcccgacggcgacgcgcaggggcgtggcggcggcaagggcggcgggaagcggcagcagtgcaagaacctcgaggcggagcggaagcggcggaagaagctcaacgagcggctctacaagctcaggtcgctcgtcccgaacatctccaagatggaccgcgcggcgatcctcggggacgccatcgactacatcgtgggcctgcagaaccaggtgaaggcgctgcaggacgagctggaggacccggcggacggcgccggcgcccccgacgtcctcctggaccacccgccgccggcgagcctggtggggctggagaacgacgagtcgccgcccacgagccaccagcacccgctcgccgggaccaagagggcccgtgcggcggcggaggaggaggaggaggagaaggggaatgacatggagccgcaggtggaggtgcggcaggtggaggccaacgagttcttcctgcagatgctgtgcgagcgccggcccgggcgcttcgtccagatcatggactccatcgccgacctgggactggaggtcaccaacgtcaacgtcacctcccacgagagcctcgtcctcaacgtcttccgcgccgccaggcgggacaatgaggtggcagtgcaggcggacagactgagggactcgctgctggaggtgatgcgggagccgtacggcgtatggtcgtcgtcggcgccgcccgtggggatgagcggcagcggcatcgccgacgtgaagcatgacagcgtggacatgaagctcgatggcatcatcgacgggcaggcggcaccgagcgtcgcagtgggggtttcagaggatcactacggcggctacaaccatctcctccaatacctcgcttgatcattatttaattgcgttcgttcatgttgaaagttcgatcaaactatcaaaggatggatcaactaataaaaacgggatccatatataagtaactgtgaattgcgatcattaattgtatgcatacaagcatatggtcgtggattaaagtttgttaattgggttttctcactgcaaaaaaaaaaaaaaaa

SEQ ID NO: 3398 - protein, 394 aa, Zea mays
  misc_feature: PFam Name: HLH; PFam Description: Helix-loop-helix
  misc_feature: PFam Name: TolA; PFam Description: TolA protein
  misc_feature: PFam Name: Transferase; PFam Description: Transferase family
  misc_feature: PFam Name: Collagen; PFam Description: Collagen triple helix
  misc_feature: PFam Name: GRP; PFam Description: Glycine rich protein family
  misc_feature: GI Number: 50904837; NR Description: bHLH protein-like [Oryza sativa (japonica cultivar-group)] >gi|41052625|dbj|BAD08134.1| bHLH protein-like [Oryza sativa (japonica cultivar-group)] >gi|41052738|dbj|BAD07594.1| bHLH protein-like [Oryza sativa
  misc_feature: GI Number: 3757520; NR Description: bHLH transcription factor [Arabidopsis thaliana] >gi|25411751|pir||G84545 bHLH transcription
  misc_feature: GI Number: 22325727; NR Description: basic helix-loop-helix
  misc_feature: GI Number: 27650307; NR Description: bHLH transcription
  misc_feature: GI Number: 34907076; NR Description: OSJNBa0093F16.27 [Oryza sativa (japonica cultivar-group)] >gi|20161831|dbj|BAB90745.1| OSJNBa0052O12.3 [Oryza sativa (japonica cultivar-group)] >gi|20805240|dbj|BAB92907.1| OSJNBa0093F16.27 [Oryza sativa
MHHHFLSRLLTHRLLLPAATSPYAATLSTPPRRAYARRAKPPPAGDSGDHAAASSPVAPPPPPDSEAKAAFQREKLSGELPRPPTVPFQPRVANAVHLVGTICAPVHMQRLPDGDAQGRGGGKGGGKRQQCKNLEAERKRRKKLNERLYKLRSLVPNISKMDRAAILGDAIDYIVGLQNQVKALQDELEDPADGAGAPDVLLDHPPPASLVGLENDESPPTSHQHPLAGTKRARAAAEEEEEEKGNDMEPQVEVRQVEANEFFLQMLCERRPGRFVQIMDSIADLGLEVTNVNVTSHESLVLNVFRAARRDNEVAVQADRLRDSLLEVMREPYGVWSSSAPPVGMSGSGIADVKHDSVDMKLDGIIDGQAAPSVAVGVSEDHYGGYNHLLQYLA

SEQ ID NO: 3399 - DNA, 586 bp, Zea mays
  misc_feature (1)..(586): Ceres cDNA ID no. 21665694
  misc_feature (1)..(586): Ceres CLONE  ID no. 413021
  misc_feature (1)..(586): Also known as  Ceres CDNA ID no. 24360986
atttcccatctctctctgcgccgtcccgtgctccctccgctagttctcccaattccttccccacctcctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctgaggtttgcggatgattcatggcgttggacgggacgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcagtgcagctccggcgtagatgagattgtattgtgaccaagccgggagggaaagcagggaggggaggacaaagatgttttgtcacgtttcaggctccggccatcgccggagtttgtccggggaatatatcgatttcctacagaaatccgcgcaaaaaaaaaaaaaaaaaa

SEQ ID NO: 3400 - protein, 94 aa, Zea mays
  misc_feature: PFam Name: Ras; PFam Description: Ras family
  misc_feature: GI Number: 1619841; NR Description: rab1-like [Caenorhabditis
  misc_feature: GI Number: 34906164; NR Description: putative GTP-binding protein [Oryza sativa (japonica cultivar-group)] >gi|9711867|dbj|BAB07961.1| putative GTP-binding protein [Oryza
  misc_feature: GI Number: 2144601; NR Description: GTP-binding protein Rab1
  misc_feature: GI Number: 27924279; NR Description: Rab1-prov protein [Xenopus laevis] >gi|49250530|gb|AAH74522.1| MGC69496 protein [Xenopus tropicalis] >gi|52345478|ref|NP_001004787.1| MGC69496
  misc_feature: GI Number: 34853590; NR Description: similar to Ras-related
MNPEYDYLFKLLLIGDSGVGKSCLLLRFADDSWRWTGRDGTEAYDRLYIQGLGLGRELGFLLGFPLGGERGSAVESQRAVSRAVQCSAVQLRRR

SEQ ID NO: 3401 - DNA, 518 bp, Zea mays
  misc_feature (1)..(518): Ceres cDNA ID no. 21665695
  misc_feature (1)..(518): Ceres CLONE  ID no. 439296
  misc_feature (1)..(518): Also known as  Ceres CDNA ID no. 24364651
gatgggaatcacctcctcaacctccagcccaacctccagcccgggatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtcgccacagccgtcgagttcatcaactgcattacctagccgagcaaggagcaactgcatttgcagtgccattgtcgtgcaaaaatatgaataaagtacttcgtcatgtccagttcataaaccaccccacaccttcaaaaaaaaaaaaaaaaaa

SEQ ID NO: 3402 - protein, 518 aa, Zea mays
  misc_feature: PFam Name: Tim17; PFam Description: Tim17/Tim22/Tim23 family
  misc_feature: PFam Name: Glutaredoxin; PFam Description: Glutaredoxin
  misc_feature: GI Number: 52353640; NR Description: putative amino acid
  misc_feature: GI Number: 60279270; NR Description: pom14 [Solanum tuberosum]
  misc_feature: GI Number: 3758827; NR Description: amino acid selective
  misc_feature: GI Number: 1370287; NR Description: core protein [Pisum
  misc_feature: GI Number: 15637350; NR Description: glutaredoxin [Tilia
GATGGGAATCACCTCCTCAACCTCCAGCCCAACCTCCAGCCCGGGATCGAGAGCAATGGCGCTCGCCAAGGCCAAGGAGATCGTTGCCTCCGCTCCCCTCGTCGTCTTCAGCAAAACTTCCTGCCCTTTCTGCGTCCGTGTGAAGCAGTTGTTCGAGAAGCTCGGAGCAAGCTACAAGGCCATTGAGTTGGATAAGGAAAGTGATGGAGTTTATGTGGGCATGGTGTACGGCGTGGAAAGGGTCCGTGGCCGCAGTGACTGGAAGAACGCGATGATCGGGGGCGCCTTGTCCGGCGCCCTGATCTCCGGCGCCAGCAACAGCGACAGAGGCAAGGTCGTCAAGGACGCCATCACCGCCGGCGCGGTCGCCACAGCCGTCGAGTTCATCAACTGCATTACCTAGCCGAGCAAGGAGCAACTGCATTTGCAGTGCCATTGTCGTGCAAAAATATGAATAAAGTACTTCGTCATGTCCAGTTCATAAACCACCCCACACCTTCAAAAAAAAAAAAAAAAAA

SEQ ID NO: 3403 - DNA, 1518 bp, Zea mays
  misc_feature (1)..(1518): Ceres cDNA ID no. 21665696
  misc_feature (1)..(1518): Ceres CLONE  ID no. 442660
  misc_feature (1)..(1518): Also known as  Ceres CDNA ID no. 24364730
ctcatctcgatcacccccctccagtagtagtgcctctccgagagacagcagcaactgcatcagcagctagcttctcttgttgctagctagctaggtttacatacagctgcacgacttgggagctcactgcagtgcagtgcgtggtcgctgtacataccaagacaaagctgcgagagggggtctccgggggcggcgctgtccgtgtccgtgggcggcgagccggcatggacaacatcacgcacaactcgagcagcagcagctcatgggatctggacatgagcctcggcagccaccaccacccgctcctcttcgacagccatcacaacccgggcccgccgccgccgccgccattacccttccacctctcctcctcctcccaccaccctccgccgcatcctgcacacccacaccaccaccatcccggcctggatccttcgccgtcttcctccctcttcccacaaccgcaccaccaccaccggctccaccacctcggcctcgacatcgaccccgcctcccattcccaccggcaccacgagtacggcgagcagcaggagcccggcggcggcgccggcgggcacgagcacgggcatcaggaggaggcgaggcagcagcagcagcaccacgaggcgggcggcgggcaggaggaccgcggcgccgaggacgtggaggaggagctcggcgccatgaaggagatgatgtaccgaatcgccgccatgcagccggtggacatcgacccggccaccatcaagaagccccggcgccgcaacgtgcgcatcagcgaggaccctcagagcgtggcggcgcggcaccggcgcgagcggatcagcgagcgcatccgcatcctgcagcgcctcgtccccggcggcaccaagatggacaccgcctccatgctcgacgaggccatccgctacatcaagttcctcaagcgccaggtgcaggagctgcagcaccaaccgccgcagccgcagcaccagcagtacccggcggcagccggagccgggcccagcacctcggtcgtgggctcggcggcgccagggcgacccggcggcgtgccgccgtttttgccgctgggtccagggccgcttattgactgggccgggctcgtcaggcccgtcgacatccacgggccgacgtcgtcttcgtcctcgtcgtccatgggcggcgcccatgccgccctaggcttcggcttcagcagcgccggcggtggccagagcagccatggaatgcactgatgagcgagcgaccaaggaggggggattaattgaaggtgcttcctttgcttaatttgtagcggatcggattaactaggaaccattaatctatccatgatagatggtggtggatcgatggatggatggatggagatgacgaactagagatcatatcagaggtaattttgattttatcaatcataatataatcattctagctactagctatatacagctagctagccagcactttgtcatcgagggtagtaatctatgtgttatcgatcgagcaaaaaaaaaaaaaaaa

SEQ ID NO: 3404 - protein, 335 aa, Zea mays
  misc_feature: PFam Name: HLH; PFam Description: Helix-loop-helix
  misc_feature: PFam Name: Extensin_2; PFam Description: Extensin-like region
  misc_feature: PFam Name: FH2; PFam Description: Formin Homology 2 Domain
  misc_feature: PFam Name: Drf_FH1; PFam Description: Formin Homology Region 1
  misc_feature: PFam Name: 7tm_1; PFam Description: 7 transmembrane receptor
  misc_feature: GI Number: 51970182; NR Description: putative bHLH
  misc_feature: GI Number: 50946733; NR Description: bHLH protein family-like [Oryza sativa (japonica cultivar-group)] >gi|42408644|dbj|BAD09865.1| bHLH protein family-like [Oryza sativa
  misc_feature: GI Number: 47605761; NR Description: INDEHISCENT protein
  misc_feature: GI Number: 51536285; NR Description: basic helix-loop-helix (bHLH)-like protein [Oryza sativa (japonica cultivar-group)] >gi|51535231|dbj|BAD38280.1| basic helix-loop-helix (bHLH)-like
  misc_feature: GI Number: 34910410; NR Description: P0692C11.28 [Oryza sativa (japonica cultivar-group)] >gi|19571105|dbj|BAB86530.1| P0692C11.28 [Oryza sativa (japonica cultivar-group)] >gi|20804650|dbj|BAB92339.1| P0510F09.13 [Oryza sativa (japonica
MDNITHNSSSSSSWDLDMSLGSHHHPLLFDSHHNPGPPPPPPLPFHLSSSSHHPPPHPAHPHHHHPGLDPSPSSSLFPQPHHHHRLHHLGLDIDPASHSHRHHEYGEQQEPGGGAGGHEHGHQEEARQQQQHHEAGGGQEDRGAEDVEEELGAMKEMMYRIAAMQPVDIDPATIKKPRRRNVRISEDPQSVAARHRRERISERIRILQRLVPGGTKMDTASMLDEAIRYIKFLKRQVQELQHQPPQPQHQQYPAAAGAGPSTSVVGSAAPGRPGGVPPFLPLGPGPLIDWAGLVRPVDIHGPTSSSSSSSMGGAHAALGFGFSSAGGGQSSHGMH

SEQ ID NO: 3405 - DNA, 543 bp, Zea mays
  misc_feature (1)..(543): Ceres cDNA ID no. 21665697
  misc_feature (1)..(543): Ceres CLONE  ID no. 444142
  misc_feature (1)..(543): Also known as  Ceres CDNA ID no. 23806693
acggttgcctcttgtctcgtgtggatactggattggctgtatcatatcaccatactgtaccaggttgacgagcgaggactaataacagacaacaatggcgttcatgcggtactaccgtgcgctgccgcagggggagacgacggtggaggagttcagggcgtggctgagccagttcgacgcggacggcgacggcaggatcagccgggaggagctggagcgggcactgcgcagcctcaacctgtggttcgtgtggtggaaggcgcgggaggcggtgcgcgcggccgacgccaaccgcaacggcgcggtggacggcgacgagatgggccggctgtacgccttcgcgcacaagcacctccacctcaagatgagccagctgggcctgggcctggaggagtagcgctagccggcctgctgggccgtctccaggaacgctgtaaattagactattattattagagtcaagtgtaaatgtcggttttagtgtgcttgtgctcttggaggtttggtatgcaactttcatgatcgttaaaaaaaaaaaaaaaa

SEQ ID NO: 3406 - protein, 543 aa, Zea mays
  misc_feature: PFam Name: efhand; PFam Description: EF hand
  misc_feature: GI Number: 50920991; NR Description: Putative calmodulin-like protein [Oryza sativa] >gi|14029016|gb|AAK52557.1| Putative
ACGGTTGCCTCTTGTCTCGTGTGGATACTGGATTGGCTGTATCATATCACCATACTGTACCAGGTTGACGAGCGAGGACTAATAACAGACAACAATGGCGTTCATGCGGTACTACCGTGCGCTGCCGCAGGGGGAGACGACGGTGGAGGAGTTCAGGGCGTGGCTGAGCCAGTTCGACGCGGACGGCGACGGCAGGATCAGCCGGGAGGAGCTGGAGCGGGCACTGCGCAGCCTCAACCTGTGGTTCGTGTGGTGGAAGGCGCGGGAGGCGGTGCGCGCGGCCGACGCCAACCGCAACGGCGCGGTGGACGGCGACGAGATGGGCCGGCTGTACGCCTTCGCGCACAAGCACCTCCACCTCAAGATGAGCCAGCTGGGCCTGGGCCTGGAGGAGTAGCGCTAGCCGGCCTGCTGGGCCGTCTCCAGGAACGCTGTAAATTAGACTATTATTATTAGAGTCAAGTGTAAATGTCGGTTTTAGTGTGCTTGTGCTCTTGGAGGTTTGGTATGCAACTTTCATGATCGTTAAAAAAAAAAAAAAAA

SEQ ID NO: 3407 - DNA, 678 bp, Zea mays
  misc_feature (1)..(678): Ceres cDNA ID no. 21665698
  misc_feature (1)..(678): Ceres CLONE  ID no. 446216
  misc_feature (1)..(678): Also known as  Ceres CDNA ID no. 23836927
aaagtctatagctttgacaatgtctgccgatctccagttcttaaaaactgaacatatgtcagtagatagacgactgattctacatcgacgacacgccaatcagggagatggtgcggacggagtccatgggcgcgcagttcccgtccaagcccatgtcgctgtacgccaccatctgggacggctccagctgggccacctcggggggccgctacaaggtggactacaagtacgcgccctacgtcgccgagttcgccgacctcgcgctccgcggctgcgcggccggccccgccgcggcgtgcgcgacgtctggcggcgacgacgacgcgtacggccacgctgctgccgcgatgccgcccgcgcggcgttcggcgatggaggcgttccgggcgcgctacatgacgtacggctactgctacgaccgcctccggtaccccgcgccgctgccggagtgcagcgtcggcgcggaggccgcggcgttcctcccgtcaggggacgcgcgggcggcgttgcataggcacggtaggcgcagccggatgcgccgcggcgccgactttgccgtctgatccaccggcagcgctggtgtgtgtgtgtgtgccgtgtgcccgtgtcgactgtgatgtgatgtcatctgatatatgattagggttcttgattagcgccaaaaaaaaaaaaaaaaaa

SEQ ID NO: 3408 - protein, 151 aa, Zea mays
  misc_feature: PFam Name: Glyco_hydro_16; PFam Description: Glycosyl
  misc_feature: PFam Name: XET_C; PFam Description: Xyloglucan
  misc_feature: GI Number: 50911745; NR Description: putative xyloglucan endo-1,4-beta-D-glucanase [Oryza sativa (japonica cultivar-group)] gi|51964238|ref|XP_506903.1| PREDICTED B1053A04.26-1 gene product [Oryza sativa (japonica
  misc_feature: GI Number: 50904979; NR Description: putative xyloglucan endo-1,4-beta-D-glucanase [Oryza sativa (japonica cultivar-group)] >gi|41053043|dbj|BAD07973.1| putative xyloglucan
  misc_feature: GI Number: 32470643; NR Description: putative xyloglucan
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
MVRTESMGAQFPSKPMSLYATIWDGSSWATSGGRYKVDYKYAPYVAEFADLALRGCAAGPAAACATSGGDDDAYGHAAAAMPPARRSAMEAFRARYMTYGYCYDRLRYPAPLPECSVGAEAAAFLPSGDARAALHRHGRRSRMRRGADFAV

SEQ ID NO: 3409 - DNA, 1620 bp, Zea mays
  misc_feature (1)..(1620): Ceres cDNA ID no. 21665699
  misc_feature (1)..(1620): Ceres CLONE  ID no. 457826
  misc_feature (1)..(1620): Also known as  Ceres CDNA ID no. 24358289
agtcagtccccgaggaggaggaacagctaggtgtggacaggcagctctcagtctcacactctgccactcccaatcccagcctgagttctgctctgctctgcttctagccatggtggcctcgcggatcttgctcccgctgctgctctccctcttcctaggctcgcattgctgtaccggagcggcggcggcgaagcggcagctgctgcaggcgcgtcgagccggggacccgagctcgcagtcgcaggtgaagttcgacttctccccgttcctgatcgagtacaagaacgggcgcgtgaagcggctgatgggcacgaacgtggtggccgcgtcgtcggacgcgctgacgggcgtcacctcccgcgacgtgaccatcgacgcttcgacgggcgtcgccgcgcggctctacctcccgagcttccgcgccagcgcccgggtgcccgtgctcgtctacttccacggcggcgcgttcgtggtggagtcggcgttcacgcccatctaccacgcctacctcaacacgctggccgccagggcgggcgtggtggccgtgtcggtgaactaccggctggcgccggagcacccgctcccggcggcgtacgacgactcctgggcggcgctcaggtgggtgctggcgagcgcggccgcgtcggacccgtggctggcccagtacggcgacctgtcccgcctgttccttgccggcgacagcgccggcggcaacatcgcgcacaacctggcactgcgcgcgggggaggaaggcctggacggcggcgcgcggatcaagggcgtggcgctgctggacccctacttccagggccggagccccgtgggcgccgagtccgcggacccggcgtacctccagtccgcggcgcgcacctggagcttcatctgcgcggggaggtacccgatcaaccacccctacgcggacccgctcctgctgccggcctcctcgtggcagcacctcggcgcctcacgcgtgctggtcaccgtgtcggggcaggaccgcctcagcccctggcagcgcgggtactacgccgcgctccagggcagcggctggcccggcgaggccgagctgtacgagacccccggcgaaggccacgtctacttcctcaccaagcttggctcgccgcaggcgctcgccgagatggccaagctcgtcgccttcattaaccgcgactagcagccgccggagtaaatccggtacatgcaggctgctgcagtgccgcgacaacatcagcatacctatagtaactagagagagcgaggtgattggtagtggtaattacattttttttgtccttgatgttgattactgtgcgtcggaagaaaagaacggttcctctctccagcaacctcgtccggacggataggagggaccggaccggtgtgttcgcttgcgcggcgttgcgtgtcattgactgcagtctacaggctaccgtgccgtgcactgttaactgcgtgtagcgcggtactgccagttacagtagtcttcagagtataatattttttttagtatagaagcgtcactctactaccgacccaatgcatcgtgtaacttttgtggtactagtgctatatggtggtgattttgtcggagtggtcaaaaaaaaaaaaaaaaaaaaaaaa

SEQ ID NO: 3410 - protein, 354 aa, Zea mays
  misc_feature: PFam Name: Abhydrolase_3; PFam Description: alpha/beta
  misc_feature: PFam Name: COesterase; PFam Description: Carboxylesterase
  misc_feature: GI Number: 51535276; NR Description: putative PrMC3 [Oryza
  misc_feature: GI Number: 50946799; NR Description: putative PrMC3 [Oryza sativa (japonica cultivar-group)] >gi|42408209|dbj|BAD09345.1|
  misc_feature: GI Number: 50946793; NR Description: putative PrMC3 [Oryza sativa (japonica cultivar-group)] >gi|42408206|dbj|BAD09342.1|
  misc_feature: GI Number: 51535283; NR Description: putative PrMC3 [Oryza
  misc_feature: GI Number: 50946797; NR Description: putative PrMC3 [Oryza sativa (japonica cultivar-group)] >gi|42408208|dbj|BAD09344.1|
MVASRILLPLLLSLFLGSHCCTGAAAAKRQLLQARRAGDPSSQSQVKFDFSPFLIEYKNGRVKRLMGTNVVAASSDALTGVTSRDVTIDASTGVAARLYLPSFRASARVPVLVYFHGGAFVVESAFTPIYHAYLNTLAARAGVVAVSVNYRLAPEHPLPAAYDDSWAALRWVLASAAASDPWLAQYGDLSRLFLAGDSAGGNIAHNLALRAGEEGLDGGARIKGVALLDPYFQGRSPVGAESADPAYLQSAARTWSFICAGRYPINHPYADPLLLPASSWQHLGASRVLVTVSGQDRLSPWQRGYYAALQGSGWPGEAELYETPGEGHVYFLTKLGSPQALAEMAKLVAFINRD

SEQ ID NO: 3411 - DNA, 1109 bp, Zea mays
  misc_feature (1)..(1109): Ceres cDNA ID no. 21665700
  misc_feature (1)..(1109): Ceres CLONE  ID no. 457946
  misc_feature (1)..(1109): Also known as  Ceres CDNA ID no. 24364643
atcgcctccacgaacaaaccacacaccccacctaccccggccggaccggcaggcagcacaacatggacctcgccctcctggagaaggccctgctgggcctgttcgccgcggctgtggtggccatcgccgtggccaagctgagcggcaagcggtaccgcctcccaccggggcccccgggcgcccccgtggttggaaactggctgcaggtgggcgacgacctgaaccaccgcaacctgatggccatggcgaagcggttcggcgacatcttccaccaccaccagcagccgatccacatggccgccgcgggccaccacacgccgcggccgctggcgctgccgtccacgtcccacagctggcgcgacgacggcgacgactacctctccggggggatggcggccgccgggccggtgtcggcgctgggcccgcttggcctgggcggcggcatgtccctcggcggcggcggcgccgggccctccggcgggtccggcaagaagcggttccgcaccaagttcacccaggagcagaaggacaggatgctggcgttcgcggagcgcgtggggtggcgcatccagaagcacgacgaggccgccgtgcagcagttctgcgacgaggtctgcgtcaagcgccacgtgctcaaggtgtggatgcacaacaacaagcacaccctcggcaagaagccgtagcccgtaggcgtaggcgtagctaagcagcaggcagcgtcacacctgacacccccaccccaacgcgtgtactgtacacacgcaagagccacgcgcctcgcgcatgcatcacattcacacacacacacagcggttgatcgcagtcgcagatcgatcgacggtggccgtggccagcctctcctccgggtacgggtaggtacacctgcatcctctttgttagcattcggctccggcgccttcgtggcgggctggcggccggagtaggttagttgcagtaagtaactcgtagcgaggtgctcgatcgatctttcttgcttggctttattaggccgttcttttttacttgtcatttaaccgtacttgctggtgttgtttattaattaattcctgcggcatgggccattttccggtttaaaaaaaaaaaaaaaa

SEQ ID NO: 3412 - protein, 206 aa, Zea mays
  misc_feature: PFam Name: Homeobox; PFam Description: Homeobox domain
  misc_feature: PFam Name: p450; PFam Description: Cytochrome P450
  misc_feature: PFam Name: Pkinase; PFam Description: Protein kinase domain
  misc_feature: GI Number: 14192803; NR Description: cinnamic acid
  misc_feature: GI Number: 10442761; NR Description: cytochrome P450
  misc_feature: GI Number: 586082; NR Description: Trans-cinnamate 4-monooxygenase (Cinnamic acid 4-hydroxylase) (CA4H) (C4H) (P450C4H) (Cytochrome P450 73) >gi|322722|pir||JC1458 trans-cinnamate 4-monooxygenase (EC 1.14.13.11) cytochrome P450
  misc_feature: GI Number: 13548653; NR Description: putative cinnamate 4-hydroxylase [Ruta graveolens] >gi|29337128|sp|Q9AR74|TCMO_RUTGR Trans-cinnamate 4-monooxygenase (Cinnamic acid 4-hydroxylase)
  misc_feature: GI Number: 3915095; NR Description: Trans-cinnamate 4-monooxygenase (Cinnamic acid 4-hydroxylase) (CA4H) (C4H) (P450C4H) (Cytochrome P450 73) >gi|1526537|dbj|BAA13414.1|
MDLALLEKALLGLFAAAVVAIAVAKLSGKRYRLPPGPPGAPVVGNWLQVGDDLNHRNLMAMAKRFGDIFHHHQQPIHMAAAGHHTPRPLALPSTSHSWRDDGDDYLSGGMAAAGPVSALGPLGLGGGMSLGGGGAGPSGGSGKKRFRTKFTQEQKDRMLAFAERVGWRIQKHDEAAVQQFCDEVCVKRHVLKVWMHNNKHTLGKKP

SEQ ID NO: 3413 - DNA, 1790 bp, Zea mays
  misc_feature (1)..(1790): Ceres cDNA ID no. 21665701
  misc_feature (1)..(1790): Ceres CLONE  ID no. 458118
  misc_feature (1)..(1790): Also known as  Ceres CDNA ID no. 24364751
actagccagtggacggtgccgttacaaaaatataacccggaaaccgacgagctccccccgctgctgccggctgttcccggaggccggagcgccgtttcacgcgtcgcccagctcaaaggccgccacatctgcttccgcgaaccggcggccctccgttaccattcctattatatataggcggctttaccaccgttaccctctctctcatcgctcccctcgccgctgctccccgcccaccatccgccactggattttttagccaccgcaagtaccggcagctccagcaagagtgccactcccacccacacggcacacgcacactttgatgcgcgtagccgccgcggtccatggcctccgccgtcaccagtaacctccccgctggcgcgccggcgccgtacccgcacgggtggctcagcccgcgcgtgtccatcagccgcgacgtgaccgcggatcccgtggccacgaccacgccagagcccgcgatctccaaggacttcatcgacttcgagttcagcctgggcggctccgccaccatgctccccgcggacgagctgttcgccgacggcaagctgctgccgctgaggaaggtagcgccttcgccggatccggcggaggccgccgcgcccccgccggtgcggccggaggaggcaatgctgccggcgcccagcaccgcggagccgatcaagcccctccgcgcggcggtcgcggcggctgacggcgccgacccctacgtgttgtcgcccaaggcgcccagctgctccggccgctggcgcgagctgctcgggctcaagagagcggcggacgcgcggagcccgtgggacgccaaggggctcaaggtctcggcggcggcgaagacccccgcgcccgcggccaggtccggggcggcgaggtcgctcaagctcctgctccagcggaacaccgggcgcgcgtcggacctcgcgtcggcgccgctgctccgcgacagctccgactcggaggcgtcgctgtcgctggcgtcctcccgcttctcgcactcgtcgtcgtcctcgtcctcctccggccacgacgacgcgccccgcctctcgctcgactcggccaagatcgttttcgccgacccaaacccgccccgctcctcccactcccactcccactcccaccaccgccactccacctcctccgcccgcgcgcggcgccggccgtctccgccggcgctcccgcgctgctgcctgtccgtggactccccgcgcatgaactcgtcgggcaagatcgtgttccaggggctagaactggaacgcagctccatctccccttgcagcttccacgcggcggcgcccaagccgcggttccgcgccgtggaccggtcctactcgtccgcctgcgtccgcgtggcgcccgtggtgctgaacgtctccgtgtgcccgcgccccgtgttcggcttcttcaaggacaggaaggactccagcgccaggtcgtcgtcgctggggcggagagcgccgccgccgccgcaagggtggagcggcgagatggtggcgagatcatccggctgatttgacgctcccgtttgtctgacttgaccaggcagccgcgggacctccttgtctcgttcccgtgcacagggctgttcgttgccatcgaccgtcatgatgatgagaggatggatagcttggctgccggttggtcttaactgattttgtttgttctttggagaagacggccgcgggggaggctgtattttttttctttcttttgctcctttttcacaaccgcgatgcaaacaaaacaaaatgatggcaacaaaaaaaaaaaaaaaa

SEQ ID NO: 3414 - protein, 392 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: APC_basic; PFam Description: APC basic domain
  misc_feature: PFam Name: Extensin_2; PFam Description: Extensin-like region
  misc_feature: PFam Name: 7tm_1; PFam Description: 7 transmembrane receptor
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 33150824; NR Description: Ser/Arg-related nuclear matrix protein [Homo sapiens] >gi|3005587|gb|AAC09321.1|
  misc_feature: GI Number: 5821145; NR Description: RNA binding protein [Homo
  misc_feature: GI Number: 47124032; NR Description: SRRM2 protein [Homo sapiens]
  misc_feature: GI Number: 5821143; NR Description: RNA binding protein [Homo
MASAVTSNLPAGAPAPYPHGWLSPRVSISRDVTADPVATTTPEPAISKDFIDFEFSLGGSATMLPADELFADGKLLPLRKVAPSPDPAEAAAPPPVRPEEAMLPAPSTAEPIKPLRAAVAAADGADPYVLSPKAPSCSGRWRELLGLKRAADARSPWDAKGLKVSAAAKTPAPAARSGAARSLKLLLQRNTGRASDLASAPLLRDSSDSEASLSLASSRFSHSSSSSSSSGHDDAPRLSLDSAKIVFADPNPPRSSHSHSHSHHRHSTSSARARRRPSPPALPRCCLSVDSPRMNSSGKIVFQGLELERSSISPCSFHAAAPKPRFRAVDRSYSSACVRVAPVVLNVSVCPRPVFGFFKDRKDSSARSSSLGRRAPPPPQGWSGEMVARSSG

SEQ ID NO: 3415 - DNA, 2239 bp, Zea mays
  misc_feature (1)..(2239): Ceres cDNA ID no. 21665702
  misc_feature (1)..(2239): Ceres CLONE  ID no. 459390
  misc_feature (1)..(2239): Also known as  Ceres CDNA ID no. 24365277
atttaaagaaaggaaaccgttttcgatttccttcctacgcgtctcgcgttggcagcgcgatccttcggagccgacgaatcccaccaggccaccactgcccgcgccgccttcgcagacgacgcaactgacagtcaccgacgcgacgcggctcgcctcctccgcccttctgttcagcctcctcgcccgcgatggctccgggcgccgacgccggctacggccagtgggcggcggcgtgccccccgctgcggcggaacctgcagctgctttcgcccgacgaggttgagctagcaaaaatgctgttgaatgaaggccagattcacctgttcgaacactggcctgaaccaggtgtcgatgatgacaataaaagaggcttctttgatcaggttcgccgacttaattcaagctatcctggaggtctggtatcttacatccagaatgccaaaaaacttcttgcggattcaaaggtgccttcaggggaggtttttacttttggcaatgacaattttgtttcactggaagcagctgggataaaagaagcctgcaatgctgcatttgttcttgtagccggagggcttggcgaaaggcttggctacaaaggaattaaggtagcacttccccgggaaacaactactggaaaatgtttccttcaacactatatagagtctatcctggcttttcaggaggccagctgcaaaatggttgatgaggggtgccaaacaaagattccatttgttattatgacttctgatgatacaaatgcgctaactatcaagcttttagagtcaaactcctactttggaatggaaccatctcaagtgaaaatactaaagcaggaaaaagtagcgtgtctagctgacaatgatgcaaggcttgcattagacccaagtgacaagtacaaaattcagacaaagccacatgggcatggagatgttcattctcttctttattcaagtggcttgcttgaacaatggaagactgaaggacggaagtgggttctctttttccaggatacaaatggattgcttttcaatgcaataccatcagcattaggtgtcagtgccaccaagggttacaatgtaaattctctcgctgttcctaggaaagccaaggaagcaattggaggaattaccaaacttactcatgccgatggtagaacaatggtcatcaacgtagagtacaatcagcttgatccactccttcgtgcaactggacatcctgatggagattcaaattgcgagacaggctattctccatatcctggaaatataaaccagttgatactggagcttggaccatatattgaggagctcaagaaaactcatggcgccatttctgaatttgtaaatcccaagtatactgattcgaccaagacagcatttaaatcatccactcgtctagaatgcatgatgcaagactatccaaagacgttgcctccctcagcaaaagttggattcacggtgatggatacatggcttgcttacgctcctgtgaagaataatcccgaagacgcagctaaagttccaaagggcaacccttatcatagtgcaacatccggagagatggcaatttacagggcgaacagccttattttgagaaaggctggtgctcagatagctgatcctgttgttcacaccttcaacggacaagaggtagaggtttggccacgcgtaacctggagcccacggtggggtctcaccttcaagagtgtcaaggagaaagtgcacgggaactcttcagtttctcagaggtcagctttggtcatcaatggtcagaacgtcttccttgaaggcctctcgttggacggcactcttgttgtcaacgccatcgatgaagcagaggttaaacttaccggtcatatacagaataaaggctggactatccagcatgtcgactacaaggacacctcggagaaggaagagatcaggatccgcggatttaagttggagaagattgagcagctagaggtgaactacacggagccaggaaaccatagcttgagtgcatgaaacaaaacattcttggttgacccgactagcttcctaccgattgggaatagttcgcattgcctcccagattctgggaggccattccagcataagttgaagctgttcttctccttgccaaagaattgtactccctcagttgcattttagttcaaaattaaactagtggacaacaaatatttaagaatggtggtagtaataaggagccaaatatttaagcaaaaaaaaaaaaaaaa

SEQ ID NO: 3416 - protein, 605 aa, Zea mays
  misc_feature: PFam Name: UDPGP; PFam Description: UTP--glucose-1-phosphate
  misc_feature: GI Number: 53792734; NR Description: UDP-N-acetylglucosamine
  misc_feature: GI Number: 46229406; NR Description: secreted UDP-N-acetylglucosamine pyrophosphorylase family protein, signal
MAPGADAGYGQWAAACPPLRRNLQLLSPDEVELAKMLLNEGQIHLFEHWPEPGVDDDNKRGFFDQVRRLNSSYPGGLVSYIQNAKKLLADSKVPSGEVFTFGNDNFVSLEAAGIKEACNAAFVLVAGGLGERLGYKGIKVALPRETTTGKCFLQHYIESILAFQEASCKMVDEGCQTKIPFVIMTSDDTNALTIKLLESNSYFGMEPSQVKILKQEKVACLADNDARLALDPSDKYKIQTKPHGHGDVHSLLYSSGLLEQWKTEGRKWVLFFQDTNGLLFNAIPSALGVSATKGYNVNSLAVPRKAKEAIGGITKLTHADGRTMVINVEYNQLDPLLRATGHPDGDSNCETGYSPYPGNINQLILELGPYIEELKKTHGAISEFVNPKYTDSTKTAFKSSTRLECMMQDYPKTLPPSAKVGFTVMDTWLAYAPVKNNPEDAAKVPKGNPYHSATSGEMAIYRANSLILRKAGAQIADPVVHTFNGQEVEVWPRVTWSPRWGLTFKSVKEKVHGNSSVSQRSALVINGQNVFLEGLSLDGTLVVNAIDEAEVKLTGHIQNKGWTIQHVDYKDTSEKEEIRIRGFKLEKIEQLEVNYTEPGNHSLSA

SEQ ID NO: 3417 - DNA, 634 bp, Zea mays
  misc_feature (1)..(634): Ceres cDNA ID no. 21665703
  misc_feature (1)..(634): Ceres CLONE  ID no. 460440
  misc_feature (1)..(634): Also known as  Ceres CDNA ID no. 0
aaacgaaacaaaacaaaacaatggcgacagcgagtgagatcgcggcggtgggcgtaataggcgcggggcagatgggctcgggcatcgcccagctcgccgccggcggcggctgtgccgtacttctcctcgacgccgaccccactgccctctcccgtgccgtcgtctccatctccgcctccctacggcgcctcgccgccaagggccagctctcccaggccgcgtgcgaggactcaataaagcggataaggtgcgtctccgccgtgcaggatctcagggacgcggatcttgtgatcgaggccgtcgtggagaacgaagacgtcaagaagaagctattcgtggagctggataaggtcacgaagccctcggccggcgccgccgccggcctccgtcccaccgtcgccttcgccgtattcgccgttgccgcggctgtctactccttctagattatccagtggtcctgatccctcctcaggttcttcgtcacttcgttgttccttgctcccgcttttgttttgttttgtttttttttctcccctttttcttctctgtcctcacacccacgtgcttgttcgtatgaactgttgtaattacgataattgatttaatttatctatttctaaaaaaaaaaaaaaaa

SEQ ID NO: 3418 - protein, 140 aa, Zea mays
MATASEIAAVGVIGAGQMGSGIAQLAAGGGCAVLLLDADPTALSRAVVSISASLRRLAAKGQLSQAACEDSIKRIRCVSAVQDLRDADLVIEAVVENEDVKKKLFVELDKVTKPSAGAAAGLRPTVAFAVFAVAAAVYSF

SEQ ID NO: 3419 - DNA, 1057 bp, Zea mays
  misc_feature (1)..(1057): Ceres cDNA ID no. 21665704
  misc_feature (1)..(1057): Ceres CLONE  ID no. 461248
  misc_feature (1)..(1057): Also known as  Ceres CDNA ID no. 24364528
tactctctccacaaggatccaatccatcttggttattcgtccccacgatggcgtccaagaaccaagttgatctcgagtcccagaagcccatgccgacgcacgccgtcgttgcatcggctcccgcagcttccgtgccggcttcttctggtacaggctccgtcgttgctggcatctccgacgctgcgccggagacccagccactcctggctgagccgaacggccacagccaggaggaggggctgggagacggtgggggtaccgacgacgagacaacgcagctggagcgagcaatggcgcaggcgttccggagcaccgccgagctggccaagcacctccccaccggcgcggtgctcgcgttcgaggtgctgtcgccggtgttcaccaacggtggcaaatgcgacgacgtgaaccgcgtcatgacgtcctggcttgtggggctctgcgccgcggcgtgcttcttcctctgcttcaccgacagcttccatgacgccaaggggaccgtgcggtacgcggtggccactcgccgcgggctgtgggtcatcgacggcacgccggcgccgccgccagtggaggccgccgagaaacggatcaagttcatcgacttcttccacgcgttcttgtcggtcatcgtgttcatgtccgtggccatgttcgacgggaatgtcggggcgtgcttcaaccctgtcatgtcctacgacactcggcaggtgctgactgccgtgccgcttgccggagggctcgtcggcacgctgctcttcgccaccttcccgtccacacggcacgggatcggattcccgatccatgcttcctgagatacgcctgttgttgttgctacgaactagcagctgatttctttgggttgcgtgtctccatgttcttagagctaggtttgttgtgccggggtcgtattgggagggttgacaaacacagacagtaccattggttgggaacttcggatattcctggacatgcattattgtttatatttttagcttgtgacctcaagtaattaataccggtgcaaatgtatattatatacaaaaaaaaaaaaaaaaaa

SEQ ID NO: 3420 - protein, 1057 aa, Zea mays
  misc_feature: GI Number: 34896260; NR Description: OSJNBb0008D07.22 [Oryza sativa (japonica cultivar-group)] >gi|28564704|dbj|BAC57885.1|
  misc_feature: GI Number: 50902186; NR Description: B1065E10.15 [Oryza sativa (japonica cultivar-group)] >gi|20161440|dbj|BAB90364.1|
TACTCTCTCCACAAGGATCCAATCCATCTTGGTTATTCGTCCCCACGATGGCGTCCAAGAACCAAGTTGATCTCGAGTCCCAGAAGCCCATGCCGACGCACGCCGTCGTTGCATCGGCTCCCGCAGCTTCCGTGCCGGCTTCTTCTGGTACAGGCTCCGTCGTTGCTGGCATCTCCGACGCTGCGCCGGAGACCCAGCCACTCCTGGCTGAGCCGAACGGCCACAGCCAGGAGGAGGGGCTGGGAGACGGTGGGGGTACCGACGACGAGACAACGCAGCTGGAGCGAGCAATGGCGCAGGCGTTCCGGAGCACCGCCGAGCTGGCCAAGCACCTCCCCACCGGCGCGGTGCTCGCGTTCGAGGTGCTGTCGCCGGTGTTCACCAACGGTGGCAAATGCGACGACGTGAACCGCGTCATGACGTCCTGGCTTGTGGGGCTCTGCGCCGCGGCGTGCTTCTTCCTCTGCTTCACCGACAGCTTCCATGACGCCAAGGGGACCGTGCGGTACGCGGTGGCCACTCGCCGCGGGCTGTGGGTCATCGACGGCACGCCGGCGCCGCCGCCAGTGGAGGCCGCCGAGAAACGGATCAAGTTCATCGACTTCTTCCACGCGTTCTTGTCGGTCATCGTGTTCATGTCCGTGGCCATGTTCGACGGGAATGTCGGGGCGTGCTTCAACCCTGTCATGTCCTACGACACTCGGCAGGTGCTGACTGCCGTGCCGCTTGCCGGAGGGCTCGTCGGCACGCTGCTCTTCGCCACCTTCCCGTCCACACGGCACGGGATCGGATTCCCGATCCATGCTTCCTGAGATACGCCTGTTGTTGTTGCTACGAACTAGCAGCTGATTTCTTTGGGTTGCGTGTCTCCATGTTCTTAGAGCTAGGTTTGTTGTGCCGGGGTCGTATTGGGAGGGTTGACAAACACAGACAGTACCATTGGTTGGGAACTTCGGATATTCCTGGACATGCATTATTGTTTATATTTTTAGCTTGTGACCTCAAGTAATTAATACCGGTGCAAATGTATATTATATACAAAAAAAAAAAAAAAAAA

SEQ ID NO: 3421 - DNA, 1560 bp, Glycine max
  misc_feature (1)..(1560): Ceres cDNA ID no. 21665706
  misc_feature (1)..(1560): Ceres CLONE  ID no. 464342
  misc_feature (1)..(1560): Also known as  Ceres CDNA ID no. 23668300
tctctcttcattctccaacatctacgttatctcctccaattccatcccgatctctttattgtcttcttcttctctcttcctggttttcgttggagaatcctgaaagccgtttgattttaatcaaagggtcatcaggattcggacaccaatatctcgaatcactcctctgttgtcttggaagaagaccaagcaaaggaaacgaagaaaaacatcaatttttgcaagcaacaatcttctttcttcttcttctgccccttttcttctcttctcttgtcttaaaacacacacacacacaacatagccacccatctgctgaggctgaagctgaagcgtcacaagtcacatacatatgattcgagtggccacaaattaagagtgagagagaatggaatcgagtagcattgagagcagcactgtgtcatcgatgactatgatggaagaggatgagcatccccatcatcagttttcttcaatctccaagcttcataacagtggccccaccactaccagtgtccatgaccttcttgaatgccccgtttgcaccaactctatgtaccctcctatccatcagtgccacaacggtcacacactttgctcaacttgcaagacaagggtacacaatcgatgcccaacttgccggcaggaactcggtgatataaggtgtttggcattagagaagatagcagaatcacttgaactgccttgcagatacatttctcttgggtgtccagagatatttccctattacagcaaacttaaacatgaggctatttgtaacttcagaccatacaactgcccttatgccgggtcagactgctcggtggttggggatattccatgccttgtcgctcatttaagggacgaccacagggttgatatgcattctggatgcacttttaaccatcgctatgtcaagtccaatcccatggaagtagaaaatgctacatggatgctaacggttttccactgttttggtcagtatttttgcctccattttgaggccttccagctgggcatggctccagtttacatggcattcctccgattcatgggtgatgaaagagaggcgcggaactacagctacagcttggaggtgggaggaaatggacgtaaactaacttttgaggggagtccaagaagcattagagatagccataagaaggtaagagacagccatgatggtctcatcatttaccgcaacatggcgcttttcttctcgggtggagacaggaaagagttgaagctacgagtaacaggaaggatatggaaagaacagcaaaaccctgaaggtggagtgtgcatacccaacctgtgtagctaggttgattgcatattctcttgattgctatttcttgctgtagataatttgagaagtgttaatctttgactggtgaatggttatggggatatttcaacttccaaacaaaataaaaaaactgagttctaaccaagatactgtcagatatttggtctcctacgtgtatcatatgctaaatcacttgagattctcaaaaatatttaagggggttgttacttttcaacaaaaaaaaaaaaaaaaaa

SEQ ID NO: 3422 - protein, 311 aa, Glycine max
  misc_feature: PFam Name: Sina; PFam Description: Seven in absentia protein
  misc_feature: GI Number: 5834248; NR Description: SINAH1 protein [Gossypium hirsutum] >gi|11291753|pir||T50560 SINAH1 protein [imported] -
  misc_feature: GI Number: 46577512; NR Description: Ubiquitin ligase SINAT5
  misc_feature: GI Number: 50907133; NR Description: putative Ubiquitin ligase SINAT5 [Oryza sativa (japonica cultivar-group)] >gi|47847698|dbj|BAD21478.1| putative Ubiquitin ligase SINAT5
  misc_feature: GI Number: 28827536; NR Description: putative seven in absentia protein [Arabidopsis thaliana] >gi|28393157|gb|AAO42011.1| putative seven in absentia protein [Arabidopsis thaliana] >gi|46577447|sp|Q84JL3|SIN3_ARATH Ubiquitin ligase SINAT3 (Seven
  misc_feature: GI Number: 53749302; NR Description: putative ubiquitin
MESSSIESSTVSSMTMMEEDEHPHHQFSSISKLHNSGPTTTSVHDLLECPVCTNSMYPPIHQCHNGHTLCSTCKTRVHNRCPTCRQELGDIRCLALEKIAESLELPCRYISLGCPEIFPYYSKLKHEAICNFRPYNCPYAGSDCSVVGDIPCLVAHLRDDHRVDMHSGCTFNHRYVKSNPMEVENATWMLTVFHCFGQYFCLHFEAFQLGMAPVYMAFLRFMGDEREARNYSYSLEVGGNGRKLTFEGSPRSIRDSHKKVRDSHDGLIIYRNMALFFSGGDRKELKLRVTGRIWKEQQNPEGGVCIPNLCS

SEQ ID NO: 3423 - DNA, 1519 bp, Glycine max
  misc_feature (1)..(1519): Ceres cDNA ID no. 21665707
  misc_feature (1)..(1519): Ceres CLONE  ID no. 464557
  misc_feature (1)..(1519): Also known as  Ceres CDNA ID no. 24429579
gagtcaccaaacgttccagaagctgcttcttagtttctccaaacccaaactttcaccacagggacctgtcagatttagttaacgtttttacatcatcactgtgtgaagataatatagatatggaaatctcccatgacatcaagatcaaggatgacaagctaggtggtgtgaaggaagagaagattaaggtagaagttgaactgaagaataaatcagttgagaaagagcatacaaaaagtaaagaagagaagaaacataaagatgaagataaatcaaagaaaaaaaagaaagagaagggggaagaggaagatgaagagggagagaagaaagaaaaagatgtaaaagataaaggggaggatggtgaagagaaagagaaaaaggagaaggataagaaggagaggaaaaaggaaaagaaagacaaggatgacaaaactgatgtagagaaggttaaggggaaagaacatgatggggaggatgctgaagagaagaaagaaaagaagaaaaaggaaaagaaagacaaggatgacaaaactgatgtagagaaggtcaaggggaaagaagacaaagaggagaagaagaaaaaggaaaagaaagtcaaggatgacaaaactgatgctgagaaggtcaaggggaaagaagatgatggggaggacaatgaagagaaggaggaaaagaaaaaaaagaaaaagaaggaaaaggatgacaaaattgatgtagagaaggtcaaggggaaagaagatgatggggaagatgaagggaagaaggagaagaaggacaaggagaagaagaaaaaggaaaagaaggacaaagatgaagaaacagacacattaaagggaaagggaaaaaatggtgatggtgaagagaagaaggaaaagaaagagaaggagaagaaaaaggaaaagaaggacaaagatgaagaaacagacacattaaaggaaaagggaaaaaatggcgaaggcgaggatgatgaagaaaataagaaaaataagaaaaaggataagaaggagaaagagaaggatcacaaaaaagaaaaggaggatggaaaagaagagggtgagaaagagaaaagcaaggttgaagtttctgtaagggatattgatatagaagaaaccacaaaggaaggtgaaaaagaagataaagaaaaggatgatgggaaggaagtgaaagagaagaagaaaaaagaagacaaagacaagaaggagaagaagaaagttactggaaaggacaagaccaaggatcttagtgcgctgaagcagaagcttgaaaaattaacggaaaaatacaaccactccttgaaaagaaggctgatatagaaaggcagataaaagaagctgaagctgagggtcatgtagtcaatgggaaggacaaggatgaggtacagtagctgtttaggatacacttatactatcttgcgtaatatgcaaactatgtttgctctttttaagttgttttgtgtaataaagttgcctttttatttgagtgaggagtgatacatttgtacaaaaaaaaaaaaaaaaaa

SEQ ID NO: 3424 - protein, 397 aa, Glycine max
  misc_feature: PFam Name: Chromadorea_ALT; PFam Description: Chromadorea
  misc_feature: PFam Name: E-MAP-115; PFam Description: E-MAP-115 family
  misc_feature: PFam Name: TolA; PFam Description: TolA protein
  misc_feature: PFam Name: Caldesmon; PFam Description: Caldesmon
  misc_feature: PFam Name: Dehydrin; PFam Description: Dehydrin
  misc_feature: GI Number: 8096269; NR Description: KED [Nicotiana tabacum]
  misc_feature: GI Number: 34899982; NR Description: Neurofilament triplet M protein-like protein [Oryza sativa (japonica cultivar-group)] >gi|22202765|dbj|BAC07421.1| Neurofilament triplet M protein-like
  misc_feature: GI Number: 23484285; NR Description: Ran-binding protein
  misc_feature: GI Number: 60465188; NR Description: myb domain-containing
  misc_feature: GI Number: 46226717; NR Description: large low complexity coiled coil protien with large repeat region [Cryptosporidium
MEISHDIKIKDDKLGGVKEEKIKVEVELKNKSVEKEHTKSKEEKKHKDEDKSKKKKKEKGEEEDEEGEKKEKDVKDKGEDGEEKEKKEKDKKERKKEKKDKDDKTDVEKVKGKEHDGEDAEEKKEKKKKEKKDKDDKTDVEKVKGKEDKEEKKKKEKKVKDDKTDAEKVKGKEDDGEDNEEKEEKKKKKKKEKDDKIDVEKVKGKEDDGEDEGKKEKKDKEKKKKEKKDKDEETDTLKGKGKNGDGEEKKEKKEKEKKKEKKDKDEETDTLKEKGKNGEGEDDEENKKNKKKDKKEKEKDHKKEKEDGKEEGEKEKSKVEVSVRDIDIEETTKEGEKEDKEKDDGKEVKEKKKKEDKDKKEKKKVTGKDKTKDLSALKQKLEKLTEKYNHSLKRRLI

SEQ ID NO: 3425 - DNA, 811 bp, Zea mays
  misc_feature (1)..(811): Ceres cDNA ID no. 21665708
  misc_feature (1)..(811): Ceres CLONE  ID no. 465488
  misc_feature (1)..(811): Also known as  Ceres CDNA ID no. 24364672
gagaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggacaagaaggcagctgatgagcgtgctgccgctgccaaggcctcttctaaaaagaaagaaagtggtaaatcctccgtccttatggatgtaaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagtttatcccttctagtctattacagaaacgttgttcggagctgagtctattataaacatcttggtctgagtttattgttgagtggtgccagtttttttcaatatacatttatcttaaaaacagcggtactgatgtttttttgtctaaagttaatgagtttgcaatggttctgagtcaaaaaaaaaaaaaaaa

SEQ ID NO: 3426 - protein, 148 aa, Zea mays
  misc_feature: PFam Name: EF1_GNE; PFam Description: EF-1 guanine
  misc_feature: GI Number: 38232568; NR Description: translational elongation
  misc_feature: GI Number: 21593028; NR Description: putative elongation
  misc_feature: GI Number: 4874292; NR Description: putative elongation factor beta-1 [Arabidopsis thaliana] >gi|20197598|gb|AAM15146.1| putative elongation factor beta-1 [Arabidopsis thaliana] >gi|20148479|gb|AAM10130.1| putative elongation factor 1-beta
  misc_feature: GI Number: 48209911; NR Description: putative elongation
  misc_feature: GI Number: 218161; NR Description: elongation factor 1 beta' [Oryza sativa (japonica cultivar-group)] >gi|322851|pir||S29224 translation elongation factor eEF-1 beta' chain - rice >gi|232031|sp|P29545|EF1D_ORYSA ELONGATION FACTOR 1-BETA'
MAASEAAAAAATPVTPTEGTVIAIHSLEEWSIQIEEDKKAADERAAAAKASSKKKESGKSSVLMDVKPWDDETDMKKLEEAVRSVQMEGLTWGASKLVPVGYGIKKMTIMLTIVDDLVSIDTLIEDHLTQEPINEYVQSCDIVAFNKI

SEQ ID NO: 3427 - DNA, 1741 bp, Glycine max
  misc_feature (1)..(1741): Ceres cDNA ID no. 21665709
  misc_feature (1)..(1741): Ceres CLONE  ID no. 467357
  misc_feature (1)..(1741): Also known as  Ceres CDNA ID no. 23668125
aaatgactgagtgaaacgacttccctagccggcgttcaatcaggtagaacaggaagcgtctgtgtccgttgattttccctcttcttcttcttcttgcacgaaacactcaccaaattgcgcattcgcagcgatggattattcagactacagctaccaacagcaaccgcaacaacattcctatggctacgacccttctcagatcccaatccaaccctacgatcaatcctatgctgcgtaccaacaatactacgcttacaatccccaatacgcgtattaccccaacgcacaccaaacccagtttcagttccaacccgaaaccgctccgcttcaccctcccggcgtcaatcccgccgctctggaacccaccccgactgggccatctcaatacagaggtaggggtggcaggggtggtagaccatttagaggggctggtcgtggtcgaggccatggtaggggacatggaatggggggtggtagacacataccatctcattcttctggacctgctttttctaatgtgccagctcgagtgcaaccaccagtaccaccacgtaaagtgtgctgtgaaatttgtaaggttgagtgcaatagtccagaaatcttggagcaacataaggttgggaggaaacatcagaagaatatgagggtgcatgaagaatcacaaaggcgcaatgctataaatggacaacaaagtgagaaaattcctacctctcaattgaacttaacagaccaacctaaggaagttcaggagtccgagaaaaatgaatgccccacagaaaatatgggctcgggggttataatcaatagtcacaaggaggaaatgcagctgcagaataatgtaggaaacatttctgaggttccagctgaagtgcccgagggaaaaaccgaggataactctgctgcaagaggccaaggattgaagcggaagaagaaaggaggaaaaggaggtaaatacatgagaactaatgatggttctaagccagtggaacctgcacaaactatgtcttttagatgtgagctgtgtgatgttaaatgtgagtcacaagttgtttaccagagtcatgtggctgggaaaaaacacctatcaaaactaaggcgtgcttcatctggagtaggccagcaccagcagcaagctctgtctggggcactcttagggcttcaagcaatttacccacctgacatcaatgctctgtctaatgcaataaatgttcaagtccaacaaggtgataatgatccgcaggtacttttggctcagctcctaatgaccgtactatctcaagcacaggttccagcaacggcaccagtgacaggtggcgtggtcgctcagataccagtacccacatccatggctggaccaagttatgaaccccagttgttgcagacaaatccttctggggaaacaaaaactgagctgccaggttcaagtgtcggcacccaaattgaaggtggaggttctgaaactaaacaacaggtgtgaagtttcagatagtgctggtggtgctgacatctgcagccaattaaccttcagaatatgaagctcccaccagttggtagggccaaagaagatttaattactctctctctttagtttttttttcacttttttaggcccgaagggttgttcattatatctgttggtattttcttttgtcagagggagatttgaatactgtaggatttgctcatatgaatgttagaatgtgtcagaaacgctttatgttagaaaaaaaaaaaaaaaaaa

SEQ ID NO: 3428 - protein, 448 aa, Glycine max
  misc_feature: PFam Name: GRASP55_65; PFam Description: GRASP55/65 family
MDYSDYSYQQQPQQHSYGYDPSQIPIQPYDQSYAAYQQYYAYNPQYAYYPNAHQTQFQFQPETAPLHPPGVNPAALEPTPTGPSQYRGRGGRGGRPFRGAGRGRGHGRGHGMGGGRHIPSHSSGPAFSNVPARVQPPVPPRKVCCEICKVECNSPEILEQHKVGRKHQKNMRVHEESQRRNAINGQQSEKIPTSQLNLTDQPKEVQESEKNECPTENMGSGVIINSHKEEMQLQNNVGNISEVPAEVPEGKTEDNSAARGQGLKRKKKGGKGGKYMRTNDGSKPVEPAQTMSFRCELCDVKCESQVVYQSHVAGKKHLSKLRRASSGVGQHQQQALSGALLGLQAIYPPDINALSNAINVQVQQGDNDPQVLLAQLLMTVLSQAQVPATAPVTGGVVAQIPVPTSMAGPSYEPQLLQTNPSGETKTELPGSSVGTQIEGGGSETKQQV

SEQ ID NO: 3429 - DNA, 918 bp, Zea mays
  misc_feature (1)..(918): Ceres cDNA ID no. 21665710
  misc_feature (1)..(918): Ceres CLONE  ID no. 468972
  misc_feature (1)..(918): Also known as  Ceres CDNA ID no. 24358652
atcaatcctcatcgccacccaacccgccgagtccccaagcaagttaagcatccatccatccatggcgggaggcaagtccaccggcaatgccgcgcgcagcaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaagcgctcgcccaccgcctccattgccggagctaaggtgagagtcgactgcaaatcgaagaccaccggggcaaatacatgcagcttcgaggggcatactgaccgcaccggcacctacaacatccttgtcattgatgagcatgagcatgagctctgcgagtccgtccttgtgagcagcccggacaaggggtgtgccaatgttgtggctggtcgtgagagggcccccgtcttccttgccagcaacaacggtgttgcatccaacgttcgtttggcaaatgctctggggttccagaaggacgttgcccttcctagatgcgcgcagatcctcaagatgtaccaggatgaggatgaccgtgtctaattatgcctgagtttagatgtacttggcgagttacaatatatttatgtggtgtctgaaatgttctagaacctctaaatctattactaagagcaacgatattgtcgcttcttaaaccttagtactacggatgttatgagctaataaatatatttggctaatgtgatgcagttaaaaaatagtctattgctgggccagctggggctaaaaaaaaaaaaaaaaaa

SEQ ID NO: 3430 - protein, 211 aa, Zea mays
  misc_feature: PFam Name: Pollen_Ole_e_I; PFam Description: Pollen proteins
  misc_feature: PFam Name: Atrophin-1; PFam Description: Atrophin-1 family
  misc_feature: PFam Name: MAGE; PFam Description: MAGE family
  misc_feature: GI Number: 47026963; NR Description: pollen-specific protein
  misc_feature: GI Number: 50940237; NR Description: putative HMG type nucleosome/chromatin assembly factor D [Oryza sativa (japonica cultivar-group)] >gi|38637289|dbj|BAD03552.1| putative HMG type nucleosome/chromatin assembly factor D [Oryza sativa (japonica
  misc_feature: GI Number: 6561156; NR Description: allergen-like protein
  misc_feature: GI Number: 20310; NR Description: pollen specific gene [Oryza
MAGGKSTGNAARSRKRVEATVLKRSRDGSAFTRCEACNKDVPVVLIDMHSCSLDEKIRMTLEAQVVEKTVEVASADRKKSSAKGGGNKDAKRKRSPTASIAGAKVRVDCKSKTTGANTCSFEGHTDRTGTYNILVIDEHEHELCESVLVSSPDKGCANVVAGRERAPVFLASNNGVASNVRLANALGFQKDVALPRCAQILKMYQDEDDRV

SEQ ID NO: 3431 - DNA, 1168 bp, Glycine max
  misc_feature (1)..(1168): Ceres cDNA ID no. 21665711
  misc_feature (1)..(1168): Ceres CLONE  ID no. 470930
  misc_feature (1)..(1168): Also known as  Ceres CDNA ID no. 24366964
aacaatttattagaaacatccaactttaaacatatttgtgattcactcttgcagtgtgttttcaataggaaaagttagcttttgagtttcttacagcattcaattatattgaaatttatagattgccatgctaacctgttcaagtccactattctacagtgcaaagccaggattttttcatgaggaaaatcgtgccaccctatttgaggttgtgcctgagactggaatgctactcaatacagataatggctctcctataccccaggtgggtaatacctcagcaaggctattcacagaagcaaagaatcatgcttgtccagttttccagggaggcaatgtttctcatctgcataaactgctttccattgaatcaagttcacaggttctctatgttggggatcacatttatggagatatactacgcagcaaaaaggttcttggatggagaacaatgcttgtaatcccagagctggagaaggaggttaaactactctgggaatctagggatacccgcaaggaacttcaattcttgaggagtgagcgtgactgcattgaggatgaaatacatcatttgaaatggtctctcaaattcaagaatccagatgctgattccaagcagaagttatcttctgaacttgataaattaaagcttgaaagagagagagtgcgattaagtcatcaagaagctcagaaaaaattacatcaaaggtttcacgagccatggggacagcttatgaaaactggttatcagaattctcgctttgctcatcaggttgagagatttgcttgcctttatactagtcaagtatctaacctgggcttatactctccagacaagtattacagacctagtgaagatttcatgcaacatgaatttggcattatggcttgtgagacgccagacatttaagttgaggaatttggggtagtttggatttggaaaccgaattgccgaattctgctctgcccagtgttcagtgttcctggttctcatctcccttctctgttttgttggctttggacagagctccgtttagtaattgatctctccccctcccccccaaagaaaagaaaaagaaaaaattgctatatagtattatttttaacgtttgctacagtgggtaaaaaatactagattttagcgttgtataaaaaaaaaaaaaaaaaa

SEQ ID NO: 3432 - protein, 260 aa, Glycine max
  misc_feature: PFam Name: 5_nucleotid; PFam Description: 5' nucleotidase family
  misc_feature: GI Number: 20260154; NR Description: cytosolic IMP-GMP specific 5-nucleotidase, putative [Arabidopsis thaliana] >gi|28059263|gb|AAO30041.1| cytosolic IMP-GMP specific 5-nucleotidase, putative [Arabidopsis thaliana]
  misc_feature: GI Number: 52840350; NR Description: cytosolic IMP-GMP specific 5'-nucleotidase [Legionella pneumophila subsp. pneumophila str. Philadelphia 1] >gi|52627461|gb|AAU26202.1| cytosolic IMP-GMP specific 5'-nucleotidase [Legionella pneumophila subsp.
  misc_feature: GI Number: 22327657; NR Description: 5' nucleotidase family
  misc_feature: GI Number: 59808721; NR Description: Unknown (protein for
  misc_feature: GI Number: 34863770; NR Description: similar to Cytosolic purine 5-nucleotidase (5-nucleotidase cytosolic II) [Rattus
MLTCSSPLFYSAKPGFFHEENRATLFEVVPETGMLLNTDNGSPIPQVGNTSARLFTEAKNHACPVFQGGNVSHLHKLLSIESSSQVLYVGDHIYGDILRSKKVLGWRTMLVIPELEKEVKLLWESRDTRKELQFLRSERDCIEDEIHHLKWSLKFKNPDADSKQKLSSELDKLKLERERVRLSHQEAQKKLHQRFHEPWGQLMKTGYQNSRFAHQVERFACLYTSQVSNLGLYSPDKYYRPSEDFMQHEFGIMACETPDI

SEQ ID NO: 3433 - DNA, 1466 bp, Glycine max
  misc_feature (1)..(1466): Ceres cDNA ID no. 21665712
  misc_feature (1)..(1466): Ceres CLONE  ID no. 472258
  misc_feature (1)..(1466): Also known as  Ceres CDNA ID no. 23673522
agttcgaccaaacggcgtcgttgccatacgatttctcggagttacccgatctcgacacggatcagattcaaaacctcaaaccaacgctggtaacaatggaagaagactcagggataagactcgttcacacgctgatgacgtgtgcggattccgtgcaacatggcgacctccctttcgcgggctccctcatcgagaacatgcaggggctgctggcgcacgtgaataccaacatcggaatcggtaaagtcgccggatacttcatcgatgccttgcgccgccgtatctttgcgcaaggcgtgtttctaacgtcgtgttcgtatccgatcgaggacgacgtactctaccaccactactacgaggcctgcccttacttgaagttcgcgcatttcactgcgaaccaggctattttagaagccttcaacggccatgattgtgtccacgtgattgacttcaacctcatgcaggggctccagtggcccgcgctgattcaggccctggcgcttcggcccggtgggcctccgctgttgaggctcacgggaattgggcttccctcgtccgacaaccgcgacacgctccgcgaaattgggctcaggctcgctgagctggcgcggtccgtgaatgttaggtttgcatttcgtggcgtggcggcgtggcgccttgaagacgtgaagccgtggatgctgcaggtgaatccgaacgaagccgtggcggttaactccatcatgcagttgcatcggcttcttgcttcggactccgatccagcaggttcgggcatcgaaaccgtgctgggttggatccgaagcttgaacccgaagattatttccgttgtagaacaggaggcgaatcataacgaggacatgttcttggagcggttcacggaagcgttacattactactcgaccgttttcgactcgcttgaagcgtgtccggtcgaaccggacaaggcgcttgcggagatgtacctgcagagggagatatgcaacgtggtgtgctgcgagggaccggcgcgagtcgagaggcacgagccgctggataagtggaggaagcggctcgggaaagccggcttcaagccgctgcatttggggtccaacgcgtacaagcaggccagcatgttgttgactcttttctcggctgaagggtattgcgtggaagagaatcaaggatgcttgactttggggtggcatagccgccctctcattgcggcttcggcttggcatgccgcgccggtgcaggacagggaaacgctgcgtttcgagcagtgagtcatgggtttgaagaaacggaaaatttgtttatttattgtagtaactagtaaacaaaaagagtggtgtataatgtaaatttttctatctttctttattttctctttctttttttttcttttctgtttttttttaaatggtcatttttgcgaaattagtttgtggatcgtctatcctttcaattttcaaaaaaaaaaaaaaaaa

SEQ ID NO: 3434 - protein, 388 aa, Glycine max
  misc_feature: PFam Name: GRAS; PFam Description: GRAS family transcription
  misc_feature: GI Number: 39841619; NR Description: GAI protein [Oryza sativa]
  misc_feature: GI Number: 34911732; NR Description: putative OsGAI [Oryza sativa (japonica cultivar-group)] >gi|13603445|dbj|BAB40172.1| putative OsGAI [Oryza sativa (japonica cultivar-group)] >gi|21901982|dbj|BAC05533.1| putative OsGAI [Oryza sativa
  misc_feature: GI Number: 63054405; NR Description: GIA/RGA-like gibberellin
  misc_feature: GI Number: 20334379; NR Description: GAI-like protein 1
  misc_feature: GI Number: 60656561; NR Description: DELLA protein [Brassica rapa]
MEEDSGIRLVHTLMTCADSVQHGDLPFAGSLIENMQGLLAHVNTNIGIGKVAGYFIDALRRRIFAQGVFLTSCSYPIEDDVLYHHYYEACPYLKFAHFTANQAILEAFNGHDCVHVIDFNLMQGLQWPALIQALALRPGGPPLLRLTGIGLPSSDNRDTLREIGLRLAELARSVNVRFAFRGVAAWRLEDVKPWMLQVNPNEAVAVNSIMQLHRLLASDSDPAGSGIETVLGWIRSLNPKIISVVEQEANHNEDMFLERFTEALHYYSTVFDSLEACPVEPDKALAEMYLQREICNVVCCEGPARVERHEPLDKWRKRLGKAGFKPLHLGSNAYKQASMLLTLFSAEGYCVEENQGCLTLGWHSRPLIAASAWHAAPVQDRETLRFEQ

SEQ ID NO: 3435 - DNA, 969 bp, Glycine max
  misc_feature (1)..(969): Ceres cDNA ID no. 21665713
  misc_feature (1)..(969): Ceres CLONE  ID no. 476084
  misc_feature (1)..(969): Also known as  Ceres CDNA ID no. 23664547
tacaaccaaatggttgtttatattgaagcctgtgaatctggatctatgtttaacaagatccttcctgccaatatcagcatttatgccactactgcttctaatcctgatgaaagctcatgggctacctattgctctcctgatgacaaggtcaatggcaaagaaattggctcatgcttgggagacttgtactctgtgaatttcttggagaatttggaatctgccaaccctgctaaggagactttgttgaagcaatatcagattattaagaagaagactacagcttctgaagttatgcaatatggtgagcttaagattgataaggaaatcattggattattcgaaggaaataacactaaagaagaagctctggttgctgaaaaggaagaagattttgcaaagtacacttctttggtcgactcaagatatgtcaagttaaattatttgaagagaaagcatgaaaaactcggcactgaacaaactgcttatggtcttgctgaagaattggactccatgaagaaatttgatagcagctttggaagcttgagctctgctcttaatttgaatgttgatgctaaagttgatgacattgatttcgagtgcttgaagactagagtcgctatgtatgaaggtgtctgtggaaagttcagtgattatggcttgaagtacgtcagatatttgcacttctcttgtgtccaaggtgttgatatttacgatttcgaaagtgctttaatgagagcttgctaatgtatggtcgattgatgaaatagttattgagagaaaataggtagtgtcatgcattcattgatactttataaaatttcaggatagtatcttgaaattactttaatacttatactttgaactatattacatactttcgtaacatataatgactttataactatgcatgaagtgaaaattacattttaataaaaatacttgatataactaaaaaaaaaaaaaaaaaaa

SEQ ID NO: 3436 - protein, 969 aa, Glycine max
  misc_feature: PFam Name: Peptidase_C13; PFam Description: Peptidase C13 family
  misc_feature: GI Number: 27544010; NR Description: vacuolar processing
  misc_feature: GI Number: 14594819; NR Description: putative vacuolar
  misc_feature: GI Number: 511938; NR Description: cysteine proteinase [Glycine max] >gi|7488655|pir||T07132 cysteine proteinase (EC 3.4.22.-) precursor [similarity] - soybean >gi|1351410|sp|P49045|VPE_SOYBN Vacuolar processing enzyme
  misc_feature: GI Number: 4154279; NR Description: C13 endopeptidase NP1
  misc_feature: GI Number: 16323336; NR Description: At1g62710/F23N19_8 [Arabidopsis thaliana] >gi|22002012|sp|Q39044|VPEB_ARATH Vacuolar processing enzyme, beta-isozyme precursor (Beta-VPE) >gi|14194097|gb|AAK56243.1| At1g62710/F23N19_8 [Arabidopsis
TACAACCAAATGGTTGTTTATATTGAAGCCTGTGAATCTGGATCTATGTTTAACAAGATCCTTCCTGCCAATATCAGCATTTATGCCACTACTGCTTCTAATCCTGATGAAAGCTCATGGGCTACCTATTGCTCTCCTGATGACAAGGTCAATGGCAAAGAAATTGGCTCATGCTTGGGAGACTTGTACTCTGTGAATTTCTTGGAGAATTTGGAATCTGCCAACCCTGCTAAGGAGACTTTGTTGAAGCAATATCAGATTATTAAGAAGAAGACTACAGCTTCTGAAGTTATGCAATATGGTGAGCTTAAGATTGATAAGGAAATCATTGGATTATTCGAAGGAAATAACACTAAAGAAGAAGCTCTGGTTGCTGAAAAGGAAGAAGATTTTGCAAAGTACACTTCTTTGGTCGACTCAAGATATGTCAAGTTAAATTATTTGAAGAGAAAGCATGAAAAACTCGGCACTGAACAAACTGCTTATGGTCTTGCTGAAGAATTGGACTCCATGAAGAAATTTGATAGCAGCTTTGGAAGCTTGAGCTCTGCTCTTAATTTGAATGTTGATGCTAAAGTTGATGACATTGATTTCGAGTGCTTGAAGACTAGAGTCGCTATGTATGAAGGTGTCTGTGGAAAGTTCAGTGATTATGGCTTGAAGTACGTCAGATATTTGCACTTCTCTTGTGTCCAAGGTGTTGATATTTACGATTTCGAAAGTGCTTTAATGAGAGCTTGCTAATGTATGGTCGATTGATGAAATAGTTATTGAGAGAAAATAGGTAGTGTCATGCATTCATTGATACTTTATAAAATTTCAGGATAGTATCTTGAAATTACTTTAATACTTATACTTTGAACTATATTACATACTTTCGTAACATATAATGACTTTATAACTATGCATGAAGTGAAAATTACATTTTAATAAAAATACTTGATATAACTAAAAAAAAAAAAAAAAAAA

SEQ ID NO: 3437 - DNA, 560 bp, Zea mays
  misc_feature (1)..(560): Ceres cDNA ID no. 21665715
  misc_feature (1)..(560): Ceres CLONE  ID no. 489361
  misc_feature (1)..(560): Also known as  Ceres CDNA ID no. 24364680
atcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggtaaatatcaacgtggaggaatactgggatgccatactgtttttcagatctctgaagttggcacagcttgatataaaaggaaatgcagttgcaagcaaggagaacttcagaactattgtcatgatgctcattccttgtctaaaatggtttgatggtgaagatgtcaattaaaatggagttgagcaatgatagtgtcaaggctcacgctgtaaaccattttttgctagaaggcattgatttgcatcatatgtactgctatatttgtttaaaaaactcggccggtaggggaaagaccgtccccctcctgtattatattaataagaagttcaatcgcaaaaaaaaaaaaaaaaaaaaa

SEQ ID NO: 3438 - protein, 96 aa, Zea mays
  misc_feature: GI Number: 52076908; NR Description: putative Rab geranylgeranyl transferase, a subunit [Oryza sativa (japonica cultivar-group)] >gi|52076622|dbj|BAD45523.1| putative Rab geranylgeranyl transferase, a subunit [Oryza sativa (japonica
  misc_feature: GI Number: 34911640; NR Description: P0039G05.22 [Oryza sativa (japonica cultivar-group)] >gi|20161543|dbj|BAB90465.1| P0510C12.9 [Oryza sativa (japonica cultivar-group)] >gi|20805132|dbj|BAB92803.1| P0039G05.22 [Oryza sativa (japonica
MASLKAAKPSGVAAQGKEPAPKLSETATKPSAAKSGGVKKVNINVEEYWDAILFFRSLKLAQLDIKGNAVASKENFRTIVMMLIPCLKWFDGEDVN

SEQ ID NO: 3439 - DNA, 609 bp, Zea mays
  misc_feature (1)..(609): Ceres cDNA ID no. 21665716
  misc_feature (1)..(609): Ceres CLONE  ID no. 489757
  misc_feature (1)..(609): Also known as  Ceres CDNA ID no. 24396469
gagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcgtcgccgtgctggcgctcgtcgccgccgccgccgccgccgccgccgccgccggtcagggcgaggaggggggcgggccgccgctgccgttcgcggtgggcgcggcgccggcgggctgcgacgtcgcgcagcccgccggcgaaggccaccgcgtaggcgtagctcccagcccaaatgcccaattgatgagtgccccggcattggtcggcaaacggcatgtatccctccaacaaggtcagtagcggtatgtggtaatcttgagtgtgaccggtgtacgtatggcgaaggaagtaggcaggcgactgttgtataggcagggtaacccatcatctgtgacgcagcaagctcagctgcaatggcaatggcaatggcgcgtcggttccaaaaaaaaaaaaaaaa

SEQ ID NO: 3440 - protein, 84 aa, Zea mays
  misc_feature: PFam Name: Protamine_P1; PFam Description: Protamine P1
MKVLVVAVLALVAAAAAAAAAAGQGEEGGGPPLPFAVGAAPAGCDVAQPAGEGHRVGVAPSPNAQLMSAPALVGKRHVSLQQGQ

SEQ ID NO: 3441 - DNA, 739 bp, Zea mays
  misc_feature (1)..(739): Ceres cDNA ID no. 21665717
  misc_feature (1)..(739): Ceres CLONE  ID no. 492982
  misc_feature (1)..(739): Also known as  Ceres CDNA ID no. 24361007
ctttatcctatccaccgctgttctccttcattctcatttcttgcacgccgacaccagcccctccattttctattggccgccccttgctccctcccatggggctccccctcgatccctctccatggcatggatcagccccagcttcccatggatgtcgccctcctctccctgatggctggcatctccactccctgcagcaaggacgctttcctctgctccctgctcttcctcccatggccaacccatggtaagctcgccatgcctttctactcgtccatggtctctcccgattgctgcatctctcctgctcacttccaatggtgtggacgtcaccctctccctcaccttccagttgtggtgctcgccctggctccagccccttccacagtcggcaccctccccatctgctgcagattggagaagaggaaccccaggttttgcgtagagaggaaatccatgtggcgtgtgctaggtgtttgatagaatggatgaatcagagatccttgttgctcttgcgaattccgagtctatttagtgttggtaagttaattcattattaatgttgattgaattattagatgaatggtatagatatgttttatgaatatatatatatatgaatcatgagtcagtggtaatacctcttcgtggatagtgacatgattgtattcatgattatggttaaaataagtgatgacggtattgtagttcgaacctgcacttaaaaaaaaaaaaaaaa

SEQ ID NO: 3442 - protein, 117 aa, Zea mays
MDQPQLPMDVALLSLMAGISTPCSKDAFLCSLLFLPWPTHGKLAMPFYSSMVSPDCCISPAHFQWCGRHPLPHLPVVVLALAPAPSTVGTLPICCRLEKRNPRFCVERKSMWRVLGV

SEQ ID NO: 3443 - DNA, 1667 bp, Zea mays
  misc_feature (1)..(1667): Ceres cDNA ID no. 21665719
  misc_feature (1)..(1667): Ceres CLONE  ID no. 508498
  misc_feature (1)..(1667): Also known as  Ceres CDNA ID no. 24365243
ttcttccccaccggaaaccaccacccacctcccctcctcgatgggccacgtcctcagctgcagccgcgacggcgctgacttgttccgcgcggtgcagcacggcgacctggacgccctcctcgccgtcgacccggagctcgcccgccgcgccaccaccatatacgaccgtctgtccctgctccacatcgccgccgccaatggccagctgcaggtgctctccatgttgttgttcgatgacggtggcgccggcgggaacgtggacgtgctgaaccggaagaagcagaccccgttgatgctggcggccatgcacggcaggacggactgcgtgctcagcctgctagacgccggagcaaatatcctcatgttcgactcggtacacgcgcggacatgcctccaccacgcggcctactacggccatgcccactgcctccaagccatcctctcggccgccaagaccacgccggtggccgactcatggggcttcgcgcgcttcgtgaacgtgagggacgagcacggcgccacgccgctgcacctggcggcaaggcaggggcggccgcagtgcgtccgccacctgctccacgccggcgccatcgtctccgccccaacagcctcctacggcttccccggcagcacggcgttgcacctggctgcacgccgcggcaacctggactgcgtccgggagctcctcgcctggggcgctgaccgcctccacagggactcggcggggaggatcgcctacgcggtggccctcaagcacagccaccgagagtgcgccgcgctgctgaacccggcggcggcggaaccaatggtgtggccgtccccgctcaagttcatcagcgagctcagcccggaggccaaggcgctcctggagggggctctcatggaagccaacagggagcgcgagaagcgcatcacggacaccacaaccaaaacaaacaacgacggcggccttgacgacgacgacgagcagctgtgcggcatctgcctggagcaggcgtgcaccatggaggtgcaggactgcgggcaccagatgtgcgccgcgtgcacgctggcgctgtgctgccacagcaagcccaacccgacgaccctggcactgcagccacccgcctgccccttctgccgcgccaccatcacccggctgctggtggccaacagcaagactactgctacctccaacagcttcaggggactcacctcggccatcaggtccttgtccttgtccaggattgctcgtggctccgggagggtagccgacagctcattaccccagtcattctttgaggaacaaggatccaaatgattaccaagcctcattacctgcaataatccactccagtcattctttgaggatcaatcaaggatccaaatgattatcaagcccaagcaagatggagtattacaacaactaattaatggtgcccgatgcaatacaagtagatgtttttttatacaagggagggaatgagcagagttagtagccactaaattttggatttgttagtcaatgatatgttgtgtattttgtgttgtagtatatataggtgtgagtctgggacatcagcattcagcgtcataaaggccggagcatgaacagattcagaatgcatgcaatatgatgcgcatggagatatatgtaaaggatgtgtttcctttaaaaaaaaaaaaaa

SEQ ID NO: 3444 - protein, 419 aa, Zea mays
  misc_feature: PFam Name: Ank; PFam Description: Ankyrin repeat
  misc_feature: PFam Name: zf-C3HC4; PFam Description: Zinc finger, C3HC4
  misc_feature: GI Number: 52353644; NR Description: putative receptor-like kinase Xa21-binding protein 3 [Oryza sativa (japonica cultivar-group)] >gi|14279688|gb|AAK58690.1| receptor-like kinase
  misc_feature: GI Number: 34906062; NR Description: putative receptor-like kinase Xa21-binding protein 3 [Oryza sativa (japonica cultivar-group)] >gi|15290134|dbj|BAB63825.1| putative receptor-like kinase Xa21-binding protein 3 [Oryza sativa
  misc_feature: GI Number: 23397172; NR Description: putative RING zinc finger ankyrin protein [Arabidopsis thaliana] >gi|20148259|gb|AAM10020.1| putative RING zinc finger ankyrin protein [Arabidopsis thaliana] >gi|14596109|gb|AAK68782.1|
  misc_feature: GI Number: 3927831; NR Description: putative RING zinc finger ankyrin protein [Arabidopsis thaliana] >gi|13926222|gb|AAK49587.1| putative RING zinc finger ankyrin protein [Arabidopsis thaliana]
  misc_feature: GI Number: 16226319; NR Description: At2g28840/F8N16.13
MGHVLSCSRDGADLFRAVQHGDLDALLAVDPELARRATTIYDRLSLLHIAAANGQLQVLSMLLFDDGGAGGNVDVLNRKKQTPLMLAAMHGRTDCVLSLLDAGANILMFDSVHARTCLHHAAYYGHAHCLQAILSAAKTTPVADSWGFARFVNVRDEHGATPLHLAARQGRPQCVRHLLHAGAIVSAPTASYGFPGSTALHLAARRGNLDCVRELLAWGADRLHRDSAGRIAYAVALKHSHRECAALLNPAAAEPMVWPSPLKFISELSPEAKALLEGALMEANREREKRITDTTTKTNNDGGLDDDDEQLCGICLEQACTMEVQDCGHQMCAACTLALCCHSKPNPTTLALQPPACPFCRATITRLLVANSKTTATSNSFRGLTSAIRSLSLSRIARGSGRVADSSLPQSFFEEQGSK

SEQ ID NO: 3445 - DNA, 2124 bp, Zea mays
  misc_feature (1)..(2124): Ceres cDNA ID no. 21665720
  misc_feature (1)..(2124): Ceres CLONE  ID no. 509259
  misc_feature (1)..(2124): Also known as  Ceres CDNA ID no. 24365037
acaatggcaaccactacccctgctgtcacggaaccggacaatgctgacgcatctcctccatctccgacgtctccaccgtccaagaagctcatgtacgagctcgccgcccggaacatctactacgccaagcctactgcagcgccgaggtcgctcgcgcagcttttgaagccgtgcggcgcggccccgacgccgccggactacatcctccgcgatgtatccctcacggctcgggccggggagatcctggccgtcgtcggcccgagcggcgccgggaagtccacgctgctcgacatcctcgccgcgcgcacagcgccgacgcacgggaggctcctgctcaattccgcgccgctgcggccgtcgtcattccgcaggctgtcgtcgcacgtgccccaggcagatgtcgcgctcaccctgctcaccgtctccgagaccttcgcgttcgcagcgtcgctgctgcacccggagtcggagtccgctgtctcggccgcggtcaccgcgctcctcgcggacctcaggcttgcccacgtcgcgcacacgcgggtctcccccgcgcggctgtccggcggcgagcggcggcgcgtgtccatcggcctcgccctcctgcgcaaccccgcggtgctcctcctcgacgagccgacgtccggcctagactcctcctcggcgcacgtggtcgtcagttgcctccgcgccgtcgcggccgcccggggcacaacggtggtgttttccatccaccagccaagcgcgcgcctcctctccgctgtggactgcctgctcctcctctcccgtggcaccgtcctccaccacggctccctcgcatccctcgacgctgccctcctctcacacggcctggtcgtccccgcgcagctcaacccactcgagttcgcccttgaggtcctcgaccagctccctcaccccaccccctctacccctgaacccaaggcgacgacgcaagaactgaactcgtcgtcgggccaccacaagatggtggccacggcgacgccgtctactggtccgccgtcgtcgtggctgcacgagttgatggtactgtacaagagggcgtggaaggtggtgtacaggagcaagcagctgcttctcaccaacttcctagaggccgtgctcgtgggcacgctgctgggcacgatctacatccacgctggctacggcgaggccggggcgcacaagcggctgggtctgttcgccttcacgctgaccttcctgctgacttcgacgaccgagacgctgccgacgttcgtgacggagcggcccatcgttctggcggagacggcggccggactgtaccggctgtcgtctcacgcggcggcgggcacgctggtgttcctgccgtaccttcttgctgtggcgctgctctactccgtgtgcgtctacttccttgtggggctctgctcgtcagcgggcgccttcgcgtcgttcgtgctggtggtgtgggcggtggtgctgacggcgaacttgttcgtgctgttcgtgagctcgttcgcgccggactacatcgcgggcatgtccctcgtatccgtgtcgctggccgggttcttcctcttctccggctacttcctgtcgcgggggagcatgccgtcgtactgggtgttcatgcactacgtgtcgccctacaagtacgcgctggacgcgctgctggcgaacgagtacacgtgcgcggggaaccggtgcttcggtgtgggcggcggcagcgagtgctcgcagacggggctcgacgtgctggtggagaaggggctgacggcggaggagcggtggaccggcgtccaggttctgttcggcttcttccttctctaccgggtgctctactgggtggtgctcagccggcgagcgtccagggcgaagagatgatgagatcagaatcagatgaggtgaggtgagcagccggcgaacatcggatgctctcgcctccatgtactacgtacgcatgcaaacaagcttagccagctagcagaggtatgtcaaaaaaaaaaaaacaaatgccaacttggagaggaggaagatgaagaggcgagcgatattaactggaattagtaattacgctgtcatatactgtactgatgtaaattgtgaagataaaattcctttataaaaaaaaaaaaaaaaaaaaaaaaa

SEQ ID NO: 3446 - protein, 2124 aa, Zea mays
  misc_feature: PFam Name: ABC2_membrane; PFam Description: ABC-2 type transporter
  misc_feature: PFam Name: ABC_tran; PFam Description: ABC transporter
  misc_feature: GI Number: 10177100; NR Description: ABC transporter-like protein [Arabidopsis thaliana] >gi|15237291|ref|NP_200098.1| ABC
  misc_feature: GI Number: 52076443; NR Description: putative ABCG4 [Oryza
  misc_feature: GI Number: 34912660; NR Description: putative white protein; ATP-binding cassette transporter [Oryza sativa (japonica cultivar-group)] >gi|11034589|dbj|BAB17113.1| putative white protein; ATP-binding cassette transporter [Oryza sativa (japonica
  misc_feature: GI Number: 50511408; NR Description: 'putative ABC
  misc_feature: GI Number: 15239738; NR Description: ABC transporter family
ACAATGGCAACCACTACCCCTGCTGTCACGGAACCGGACAATGCTGACGCATCTCCTCCATCTCCGACGTCTCCACCGTCCAAGAAGCTCATGTACGAGCTCGCCGCCCGGAACATCTACTACGCCAAGCCTACTGCAGCGCCGAGGTCGCTCGCGCAGCTTTTGAAGCCGTGCGGCGCGGCCCCGACGCCGCCGGACTACATCCTCCGCGATGTATCCCTCACGGCTCGGGCCGGGGAGATCCTGGCCGTCGTCGGCCCGAGCGGCGCCGGGAAGTCCACGCTGCTCGACATCCTCGCCGCGCGCACAGCGCCGACGCACGGGAGGCTCCTGCTCAATTCCGCGCCGCTGCGGCCGTCGTCATTCCGCAGGCTGTCGTCGCACGTGCCCCAGGCAGATGTCGCGCTCACCCTGCTCACCGTCTCCGAGACCTTCGCGTTCGCAGCGTCGCTGCTGCACCCGGAGTCGGAGTCCGCTGTCTCGGCCGCGGTCACCGCGCTCCTCGCGGACCTCAGGCTTGCCCACGTCGCGCACACGCGGGTCTCCCCCGCGCGGCTGTCCGGCGGCGAGCGGCGGCGCGTGTCCATCGGCCTCGCCCTCCTGCGCAACCCCGCGGTGCTCCTCCTCGACGAGCCGACGTCCGGCCTAGACTCCTCCTCGGCGCACGTGGTCGTCAGTTGCCTCCGCGCCGTCGCGGCCGCCCGGGGCACAACGGTGGTGTTTTCCATCCACCAGCCAAGCGCGCGCCTCCTCTCCGCTGTGGACTGCCTGCTCCTCCTCTCCCGTGGCACCGTCCTCCACCACGGCTCCCTCGCATCCCTCGACGCTGCCCTCCTCTCACACGGCCTGGTCGTCCCCGCGCAGCTCAACCCACTCGAGTTCGCCCTTGAGGTCCTCGACCAGCTCCCTCACCCCACCCCCTCTACCCCTGAACCCAAGGCGACGACGCAAGAACTGAACTCGTCGTCGGGCCACCACAAGATGGTGGCCACGGCGACGCCGTCTACTGGTCCGCCGTCGTCGTGGCTGCACGAGTTGATGGTACTGTACAAGAGGGCGTGGAAGGTGGTGTACAGGAGCAAGCAGCTGCTTCTCACCAACTTCCTAGAGGCCGTGCTCGTGGGCACGCTGCTGGGCACGATCTACATCCACGCTGGCTACGGCGAGGCCGGGGCGCACAAGCGGCTGGGTCTGTTCGCCTTCACGCTGACCTTCCTGCTGACTTCGACGACCGAGACGCTGCCGACGTTCGTGACGGAGCGGCCCATCGTTCTGGCGGAGACGGCGGCCGGACTGTACCGGCTGTCGTCTCACGCGGCGGCGGGCACGCTGGTGTTCCTGCCGTACCTTCTTGCTGTGGCGCTGCTCTACTCCGTGTGCGTCTACTTCCTTGTGGGGCTCTGCTCGTCAGCGGGCGCCTTCGCGTCGTTCGTGCTGGTGGTGTGGGCGGTGGTGCTGACGGCGAACTTGTTCGTGCTGTTCGTGAGCTCGTTCGCGCCGGACTACATCGCGGGCATGTCCCTCGTATCCGTGTCGCTGGCCGGGTTCTTCCTCTTCTCCGGCTACTTCCTGTCGCGGGGGAGCATGCCGTCGTACTGGGTGTTCATGCACTACGTGTCGCCCTACAAGTACGCGCTGGACGCGCTGCTGGCGAACGAGTACACGTGCGCGGGGAACCGGTGCTTCGGTGTGGGCGGCGGCAGCGAGTGCTCGCAGACGGGGCTCGACGTGCTGGTGGAGAAGGGGCTGACGGCGGAGGAGCGGTGGACCGGCGTCCAGGTTCTGTTCGGCTTCTTCCTTCTCTACCGGGTGCTCTACTGGGTGGTGCTCAGCCGGCGAGCGTCCAGGGCGAAGAGATGATGAGATCAGAATCAGATGAGGTGAGGTGAGCAGCCGGCGAACATCGGATGCTCTCGCCTCCATGTACTACGTACGCATGCAAACAAGCTTAGCCAGCTAGCAGAGGTATGTCAAAAAAAAAAAAACAAATGCCAACTTGGAGAGGAGGAAGATGAAGAGGCGAGCGATATTAACTGGAATTAGTAATTACGCTGTCATATACTGTACTGATGTAAATTGTGAAGATAAAATTCCTTTATAAAAAAAAAAAAAAAAAAAAAAAAA

SEQ ID NO: 3447 - DNA, 1525 bp, Glycine max
  misc_feature (1)..(1525): Ceres cDNA ID no. 21665721
  misc_feature (1)..(1525): Ceres CLONE  ID no. 512627
  misc_feature (1)..(1525): Also known as  Ceres CDNA ID no. 0
gtgcttaatggaaggcccttgagcttttctttctttctctgctctcttttcttttaggtttccactctcacacactctccctcttctctttctctgcaataatctctcttctcttcttcactctctcaactcctgccaaacccccatttccgcagttcttaaatttggagtctgatgtctccgccattgctggttaccgaagatgaagggcagtgccatgcctcgatggtagcatctgcatcttcaccatccctgaactgtttctccctaaatgaggccggatttaaagaatgcaattacctgggattgtcagattgctcttcggtggacagttctactgtcccgaatttgtctgatgagaaaaaggagaatctgaatttgaaggctactgagttgaggcttggccttccgggatcccagtcacctgaaagggagacagaacttttctcgttgagctcaacaaaacttgatgagaaaccactgttccctttgcttcctacaaaggatggaatctgctcattgtctcaaaaaactgtggtctcgggcaacaaaagaggttttgctgacacaatggaccctgagtttcctggcaatgcagggataaacatgatgctatcacctaaaccttctggagttcagcctaccacagtgaaagaaataccaagcaaggtgttacaagaacttccttcagcggcaaatggaactggtcataaccatacatcaggagcttctatcagtggcagtgcaccggctgctaaggcacaggttgttggttggcctcctataagatcatttaggaaaaactcattggccaccacttcaaagaataatgatgaagtagatggaaaaccgggtgcagcagcactctttgtgaaggtcagcatggatggtgctccctatctgaggaaggtagatctaagaaattatacaatgtaccaggaactgtcttctgcccttgagaaaatgttcagctgtttcactctaggtcaatgtggttcccatggagctccaggaagagaaatgttgagtgagagcaagctgaaggacctcctgcatggttcagaatatgtactcacttatgaagataaagatggtgactggatgcttgtcggagatgtaccatgggatatgttcattgacacatgcaaaagactgaaaatcatgaagggttctgatgccattggcttagctcccagggccatggaaaaatccaggagcaggtgctagttggtattggaacatgaagagtgtggaaagagaacttatgatataaatgactgaatgccgggttttgatggttaactgctattcaagatgttgtctatggttacaagtatcataatagtgtcttggtcttttgtttgtgttacatttgtttctactataataccttatgaagctaccttgaatattagtaattgtggagcttgtaatctttataggaacatgtttgtttggataagttgaatgtatgttgcaatcagtgtattgttttcaatgttttgccaaaaaaaaaaaaaaaaaa

SEQ ID NO: 3448 - protein, 350 aa, Glycine max
MSPPLLVTEDEGQCHASMVASASSPSLNCFSLNEAGFKECNYLGLSDCSSVDSSTVPNLSDEKKENLNLKATELRLGLPGSQSPERETELFSLSSTKLDEKPLFPLLPTKDGICSLSQKTVVSGNKRGFADTMDPEFPGNAGINMMLSPKPSGVQPTTVKEIPSKVLQELPSAANGTGHNHTSGASISGSAPAAKAQVVGWPPIRSFRKNSLATTSKNNDEVDGKPGAAALFVKVSMDGAPYLRKVDLRNYTMYQELSSALEKMFSCFTLGQCGSHGAPGREMLSESKLKDLLHGSEYVLTYEDKDGDWMLVGDVPWDMFIDTCKRLKIMKGSDAIGLAPRAMEKSRSRC

SEQ ID NO: 3449 - DNA, 1310 bp, Glycine max
  misc_feature (1)..(1310): Ceres cDNA ID no. 21665722
  misc_feature (1)..(1310): Ceres CLONE  ID no. 513754
  misc_feature (1)..(1310): Also known as  Ceres CDNA ID no. 25088369
ttcttgccctcggaacattcaagagacaacaaggatcatcatgccaaaatgtgtttatatcatcacatgccaacatatccctctttgtcctcttcttgttcccctctgtgttcttcttcgtcttcttcttcttctccagctgcaccctacttcgccgctgctgccgcggcgtatagggctgccacggccacaaggtttaatggaatttccggggaggctttcaaatctcatcatccattgcaccaccatcactcatcatcaccacactatggggttggacttggaccctctcatgagacctctgcagggttgatgagatcaaggtttttgccaaagttgccagcaaagaggagcatgagagcaccgagaatgcggtggacaagcacactccacgctcgatttgtccatgctgtggagcttcttggtggccatgaaagagctacaccaaagtcagttcttgagctcatggatgtgaaggatctcacattagctcatgtcaaaagccatttgcagatgtatcgaactgttaagaccactgacaagcctgctgcttcttcaggcctttcagatggatcaggagaagatgacatgtctccaatgggaagcagtggtggaatgcgtcaattttcagaccaaagaagcctttctgatcgaccactgcaacaagatatggactactcttcaggcaacaacactctatggagtaactcttcaagtagagaaacatggcaacaaaataactctaatgacgtagatggtttcagacccccaatcttccagtcacaacaaatatcaggagggcatcaaattcaggagtgtgattcaacccaactcaagaacagtttgtcaggatcaaatttagagtgcaagaacccaagtttggagttcacattagggagaccagattggaatggcaaaggacaagcctaattttcattggttcccttattgtctctagctagtttgcttaattagtttaattacaacccacggtaacatgtgacaaacttcgtaatctttcctgaaatagagaggtgttgtactatatatatatatatatatatatatatatatatatatatatatatatatgtattcaatcagaaaaataaaattaaaagccctatatagttctataaagttgattcttttttggaagttttacgagttcgtgaacaaatttgtttagcctttttcttgtatttaatattttatttattggtgagaggaggcacagggaaagaaactgatgtagcagctgcaaattactgcagaagaacaatgaagagaaataaaaaaaaaaaaaaaaa

SEQ ID NO: 3450 - protein, 1310 aa, Glycine max
  misc_feature: PFam Name: Myb_DNA-binding; PFam Description: Myb-like
  misc_feature: GI Number: 15723591; NR Description: GARP-like putative transcription factor KANADI1 [Arabidopsis thaliana] >gi|14345995|gb|AAK59989.1| KANADI protein [Arabidopsis thaliana] >gi|18418011|ref|NP_568334.1| myb family transcription factor
  misc_feature: GI Number: 50945913; NR Description: myb family transcription factor-like [Oryza sativa (japonica cultivar-group)] >gi|29837235|dbj|BAC75613.1| myb family transcription factor-like
  misc_feature: GI Number: 50911755; NR Description: myb family transcription factor-like [Oryza sativa (japonica cultivar-group)] >gi|41053204|dbj|BAD08167.1| myb family transcription factor-like [Oryza sativa (japonica cultivar-group)] [Oryza sativa (japonica
  misc_feature: GI Number: 34905232; NR Description: myb family transcription factor-like protein [Oryza sativa (japonica cultivar-group)] >gi|29467563|dbj|BAC66733.1| myb family transcription factor-like protein [Oryza sativa (japonica cultivar-group)]
  misc_feature: GI Number: 15723597; NR Description: GARP-like putative transcription factor KANADI3 [Arabidopsis thaliana] >gi|18414945|ref|NP_567535.1| myb family transcription factor
TTCTTGCCCTCGGAACATTCAAGAGACAACAAGGATCATCATGCCAAAATGTGTTTATATCATCACATGCCAACATATCCCTCTTTGTCCTCTTCTTGTTCCCCTCTGTGTTCTTCTTCGTCTTCTTCTTCTTCTCCAGCTGCACCCTACTTCGCCGCTGCTGCCGCGGCGTATAGGGCTGCCACGGCCACAAGGTTTAATGGAATTTCCGGGGAGGCTTTCAAATCTCATCATCCATTGCACCACCATCACTCATCATCACCACACTATGGGGTTGGACTTGGACCCTCTCATGAGACCTCTGCAGGGTTGATGAGATCAAGGTTTTTGCCAAAGTTGCCAGCAAAGAGGAGCATGAGAGCACCGAGAATGCGGTGGACAAGCACACTCCACGCTCGATTTGTCCATGCTGTGGAGCTTCTTGGTGGCCATGAAAGAGCTACACCAAAGTCAGTTCTTGAGCTCATGGATGTGAAGGATCTCACATTAGCTCATGTCAAAAGCCATTTGCAGATGTATCGAACTGTTAAGACCACTGACAAGCCTGCTGCTTCTTCAGGCCTTTCAGATGGATCAGGAGAAGATGACATGTCTCCAATGGGAAGCAGTGGTGGAATGCGTCAATTTTCAGACCAAAGAAGCCTTTCTGATCGACCACTGCAACAAGATATGGACTACTCTTCAGGCAACAACACTCTATGGAGTAACTCTTCAAGTAGAGAAACATGGCAACAAAATAACTCTAATGACGTAGATGGTTTCAGACCCCCAATCTTCCAGTCACAACAAATATCAGGAGGGCATCAAATTCAGGAGTGTGATTCAACCCAACTCAAGAACAGTTTGTCAGGATCAAATTTAGAGTGCAAGAACCCAAGTTTGGAGTTCACATTAGGGAGACCAGATTGGAATGGCAAAGGACAAGCCTAATTTTCATTGGTTCCCTTATTGTCTCTAGCTAGTTTGCTTAATTAGTTTAATTACAACCCACGGTAACATGTGACAAACTTCGTAATCTTTCCTGAAATAGAGAGGTGTTGTACTATATATATATATATATATATATATATATATATATATATATATATATATGTATTCAATCAGAAAAATAAAATTAAAAGCCCTATATAGTTCTATAAAGTTGATTCTTTTTTGGAAGTTTTACGAGTTCGTGAACAAATTTGTTTAGCCTTTTTCTTGTATTTAATATTTTATTTATTGGTGAGAGGAGGCACAGGGAAAGAAACTGATGTAGCAGCTGCAAATTACTGCAGAAGAACAATGAAGAGAAATAAAAAAAAAAAAAAAAA

SEQ ID NO: 3451 - DNA, 1307 bp, Glycine max
  misc_feature (1)..(1307): Ceres cDNA ID no. 21665723
  misc_feature (1)..(1307): Ceres CLONE  ID no. 514524
  misc_feature (1)..(1307): Also known as  Ceres CDNA ID no. 24360059
ttattgaggtagtatcaattcatcatactccaaaagtattctgagcatttgttctttgggtttttcatttcagcaaagtgaaacatggtttaatttcattttgtaatttttagattgtatgctgtaaaattcctgaaactaacagaagaacacaaagctctggtgcttgcttctggaatgtcattgatgaataactcctttgttaatgattcaatattgctgttgttgatgcctcccaattggttacttatagcttttgtaaccttagtcccatatagtttagaaagcaaagatggttcttgcagataaagcaatacatttgaagtggatttttctattctgctatcgtctgaagcaatattttgataatttttactgtcaggtggaagatcatggtcttagcagctgttcctttccatttatagttgcagagcaagaagtttgttcggagatctgcaagctggaaaatgtgattgaggaagctgaaaccactgatgatatccagataaaaaaccaacatatggaagaaaagactcaagctttggatttcttgcaagaaatgggttggcttcttcatagaagccatgtgaaatttaagctaggttccatggctcctttccatgatctcttccaattcaatcggttcgcttggcttgttgacttctccatggaccatggttggtgtgctgtgatgaagaaactcttggacattatatttgagggtggtgttgatgcaggagagcatgcctccattgagcttgcattgttgaacatgggtcttctacacagagctgtaaagagaaactgtaggcctatggtagaactactgttaagatttgttccagttaaaacctcagatggtgcagacagtgaaatgaagcaagttgccgaagcccctgacagattcttatttagacctgatactgtcgggccagctgggttgactcctcttcatgttgcagcaagtatgagtggctcagagaatgtgttggatgcattaaccaatgatccacgaatggtaatcctttattgtctgtatgctttatgtattttcaggcttttagagcagtgtctccaagattgaaatgagatggctataaaggcttcaataattttacttagagcactgtctctcccacttttcactttatatttagtctggtggaatggaggtggatagaatgggaagagaattgagctaaaaatgagtttaaacaatcactttctccaaattagaatcgtggtattataaattcaataatctgtattccatgtgcttttctgaaatgaaaaaaaaaaaaaaaaaa

SEQ ID NO: 3452 - protein, 263 aa, Glycine max
  misc_feature: GI Number: 62319825; NR Description: squamosa promoter
  misc_feature: GI Number: 5931653; NR Description: squamosa promoter binding protein-like 1 [Arabidopsis thaliana] >gi|25456640|pir||T52602 squamosa promoter binding protein 1 [imported] - Arabidopsis
  misc_feature: GI Number: 5931655; NR Description: squamosa promoter binding protein-like 1 [Arabidopsis thaliana] >gi|3650274|emb|CAA09698.1| squamosa-promoter binding protein-like 1 [Arabidopsis thaliana] >gi|25456637|pir||T52601 squamosa promoter protein-like 1 (SPL1)
  misc_feature: GI Number: 50919907; NR Description: putative SBP-domain protein [Oryza sativa (japonica cultivar-group)] >gi|40714694|gb|AAR88600.1| putative SBP-domain protein [Oryza
  misc_feature: GI Number: 50947593; NR Description: putative SPL1-Related2 protein [Oryza sativa (japonica cultivar-group)] >gi|42408812|dbj|BAD10073.1| putative SPL1-Related2 protein [Oryza
MVLADKAIHLKWIFLFCYRLKQYFDNFYCQVEDHGLSSCSFPFIVAEQEVCSEICKLENVIEEAETTDDIQIKNQHMEEKTQALDFLQEMGWLLHRSHVKFKLGSMAPFHDLFQFNRFAWLVDFSMDHGWCAVMKKLLDIIFEGGVDAGEHASIELALLNMGLLHRAVKRNCRPMVELLLRFVPVKTSDGADSEMKQVAEAPDRFLFRPDTVGPAGLTPLHVAASMSGSENVLDALTNDPRMVILYCLYALCIFRLLEQCLQD

SEQ ID NO: 3453 - DNA, 574 bp, Glycine max
  misc_feature (1)..(574): Ceres cDNA ID no. 21665724
  misc_feature (1)..(574): Ceres CLONE  ID no. 515602
  misc_feature (1)..(574): Also known as  Ceres CDNA ID no. 23677785
aacaaattctccaacgctaactcaaactcagctcaactcaattacattaaggaatctgaagagattcgacttgccatgctaccggtggaactgataaaaagagtgagggagattgagcaggaagtatacactgaaccagaaactgcccagaagaaagacacaaagctgactgctgcagttgatctgtctaaaaggttaaaggatttccgttccttgaatgatgctgccagcttgaaagctttggaggaatggcgaaagaggaagatggagagggccagacaaagagaattggagaaaaatggaacaacttcttctcaagcttgactttatatattctcttatatcaagtgaaagttgacatgctgatttcaatacataatgggacaattagtagtcatttagtgtacactgtatagcatctttaagattttccacagcttatgttataaaggaatctttcttcggacagaatttgtgattaatagtttgatactattactcatctactttagttttctttatattttaaaaattaaaataaataatttaccatcaaaaaaaaaaaaaaaaaaaa

SEQ ID NO: 3454 - protein, 82 aa, Glycine max
MLPVELIKRVREIEQEVYTEPETAQKKDTKLTAAVDLSKRLKDFRSLNDAASLKALEEWRKRKMERARQRELEKNGTTSSQA

SEQ ID NO: 3455 - DNA, 2046 bp, Glycine max
  misc_feature (1)..(2046): Ceres cDNA ID no. 21665725
  misc_feature (1)..(2046): Ceres CLONE  ID no. 516056
  misc_feature (1)..(2046): Also known as  Ceres CDNA ID no. 24360156
ttttaatcctactgaggatggaagagagatcacagcttccagcaattgcagggacaaagatgaatcactaatttctgcttatgtgattcctcaggatattgttcctgcttccatcagctatagtgaggtcgaccaactacctgaactaaatattggttttccttctgttttaacaaaattaaggtctaaaaggggttcaagggatcctgaaagtccatccaagcatgaaacaaaatcttcagtgctaaagaatagtgcatgtagcactaatgataagaataatttcaacaatgaacagcatgtggttgtggatgaccacaacaacactagagtagcatctaatcagggagagaatggatctcaagaagtagatcctcagattaggcaaaatagtacttcacaggatttgccagaaccacattcacaaagagataaaatgtataaagctgtttatagaagatcaagatctcatagggctgtgactaatttagctgacagtagtggccagggagaattcaattcaaatgggagaaacagtaatttcaatgctacagcaaacttcagcaatggcacaaatgaagctattcatacaaatggatccttagagttggaaccaaccacttgtgatccaaattatgagcggaataatctcaaagtgctgcaaggacctggaaattgtatggttaaaagtccacagaatgtttccacaagtggaggacaactcacagaagaagaaaggggttctaattcaaaattgactgttggtttaaggtccaatagaaatcggaggtctagttataatatttgtgagactagtcctgtaaataaaaggaaatcactacaatcagctaccagaggatcatggttgctgttatcaacccatgaggaaggatgcagatatattccccaacagggggatgaagttgcatatttgagacaggggcaccaggagtatatagattattgccgtaaaagagagtcagggccttgggtatcacttaagggacatataagagctgtagaatattgtagagttcaaagtctagagtattcccatcttccagggtccggtgatagctgctgcaaaatgaaccttcagtttgtagatcctaattcaagtgttgttggaaaatcttttaaattaaccctacctgaagtgaccagtttcccagattttcttgttgaaagaaccaggtttgacgctgctatgcaaagaaattggacacgcagggataaatgcagggtttggtggaagaatgaggatagttcctctggtaattggtgggatggtcgaattctgtgcatgaaagccaagtcttctgaatttccagacagtccatgggagagttatactgttcgttacaagagtgacctcactgaaacacatttgcatagtccttgggagctttttgatgctgatactgaatgggaacagcctcacattgatgatgacatgagaaataaactgcagtccacactcaccaaattacagcagtcaggcaacccagtccaggatcgttatggagtgcatgaattgaagaaaatttcaaataagtccaaatttataaacaggtttcctgttcctatatctattgaattgatacagtcaaggttggagaacaattactaccgtagtttggaggcactgaagcatgatgtgagtattctactgtctaatgccaccacttttcttgaaaaggatgcagcgctgtcagcaaaaatcaaacgcctttcagaatggttcacacgggcattatcatctctatagctcttggctttctggagtcacaggccagcattatggccgaagcagcctagctggttattcccccccccatacattttttgtagatagatttttaaattatccccttggattcgttttctcttgttcgctgaattagcttctgaggatagagataggaatatcgagataaagtagcattttgctgtggaaaattcatgcggctacattcattgtttgtacagagacaccacattgtggcaaatgtataattcgcattcagaaaaaaaaaaaaaaaaaaa

SEQ ID NO: 3456 - protein, 2046 aa, Glycine max
  misc_feature: PFam Name: Bromodomain; PFam Description: Bromodomain
  misc_feature: GI Number: 42568419; NR Description: transducin family
  misc_feature: GI Number: 25409048; NR Description: probable WD-40 repeat
  misc_feature: GI Number: 42570440; NR Description: transducin family
  misc_feature: GI Number: 22135972; NR Description: putative WD-40 repeat
TTTTAATCCTACTGAGGATGGAAGAGAGATCACAGCTTCCAGCAATTGCAGGGACAAAGATGAATCACTAATTTCTGCTTATGTGATTCCTCAGGATATTGTTCCTGCTTCCATCAGCTATAGTGAGGTCGACCAACTACCTGAACTAAATATTGGTTTTCCTTCTGTTTTAACAAAATTAAGGTCTAAAAGGGGTTCAAGGGATCCTGAAAGTCCATCCAAGCATGAAACAAAATCTTCAGTGCTAAAGAATAGTGCATGTAGCACTAATGATAAGAATAATTTCAACAATGAACAGCATGTGGTTGTGGATGACCACAACAACACTAGAGTAGCATCTAATCAGGGAGAGAATGGATCTCAAGAAGTAGATCCTCAGATTAGGCAAAATAGTACTTCACAGGATTTGCCAGAACCACATTCACAAAGAGATAAAATGTATAAAGCTGTTTATAGAAGATCAAGATCTCATAGGGCTGTGACTAATTTAGCTGACAGTAGTGGCCAGGGAGAATTCAATTCAAATGGGAGAAACAGTAATTTCAATGCTACAGCAAACTTCAGCAATGGCACAAATGAAGCTATTCATACAAATGGATCCTTAGAGTTGGAACCAACCACTTGTGATCCAAATTATGAGCGGAATAATCTCAAAGTGCTGCAAGGACCTGGAAATTGTATGGTTAAAAGTCCACAGAATGTTTCCACAAGTGGAGGACAACTCACAGAAGAAGAAAGGGGTTCTAATTCAAAATTGACTGTTGGTTTAAGGTCCAATAGAAATCGGAGGTCTAGTTATAATATTTGTGAGACTAGTCCTGTAAATAAAAGGAAATCACTACAATCAGCTACCAGAGGATCATGGTTGCTGTTATCAACCCATGAGGAAGGATGCAGATATATTCCCCAACAGGGGGATGAAGTTGCATATTTGAGACAGGGGCACCAGGAGTATATAGATTATTGCCGTAAAAGAGAGTCAGGGCCTTGGGTATCACTTAAGGGACATATAAGAGCTGTAGAATATTGTAGAGTTCAAAGTCTAGAGTATTCCCATCTTCCAGGGTCCGGTGATAGCTGCTGCAAAATGAACCTTCAGTTTGTAGATCCTAATTCAAGTGTTGTTGGAAAATCTTTTAAATTAACCCTACCTGAAGTGACCAGTTTCCCAGATTTTCTTGTTGAAAGAACCAGGTTTGACGCTGCTATGCAAAGAAATTGGACACGCAGGGATAAATGCAGGGTTTGGTGGAAGAATGAGGATAGTTCCTCTGGTAATTGGTGGGATGGTCGAATTCTGTGCATGAAAGCCAAGTCTTCTGAATTTCCAGACAGTCCATGGGAGAGTTATACTGTTCGTTACAAGAGTGACCTCACTGAAACACATTTGCATAGTCCTTGGGAGCTTTTTGATGCTGATACTGAATGGGAACAGCCTCACATTGATGATGACATGAGAAATAAACTGCAGTCCACACTCACCAAATTACAGCAGTCAGGCAACCCAGTCCAGGATCGTTATGGAGTGCATGAATTGAAGAAAATTTCAAATAAGTCCAAATTTATAAACAGGTTTCCTGTTCCTATATCTATTGAATTGATACAGTCAAGGTTGGAGAACAATTACTACCGTAGTTTGGAGGCACTGAAGCATGATGTGAGTATTCTACTGTCTAATGCCACCACTTTTCTTGAAAAGGATGCAGCGCTGTCAGCAAAAATCAAACGCCTTTCAGAATGGTTCACACGGGCATTATCATCTCTATAGCTCTTGGCTTTCTGGAGTCACAGGCCAGCATTATGGCCGAAGCAGCCTAGCTGGTTATTCCCCCCCCCATACATTTTTTGTAGATAGATTTTTAAATTATCCCCTTGGATTCGTTTTCTCTTGTTCGCTGAATTAGCTTCTGAGGATAGAGATAGGAATATCGAGATAAAGTAGCATTTTGCTGTGGAAAATTCATGCGGCTACATTCATTGTTTGTACAGAGACACCACATTGTGGCAAATGTATAATTCGCATTCAGAAAAAAAAAAAAAAAAAAA

SEQ ID NO: 3457 - DNA, 1187 bp, Glycine max
  misc_feature (1)..(1187): Ceres cDNA ID no. 21665726
  misc_feature (1)..(1187): Ceres CLONE  ID no. 517652
  misc_feature (1)..(1187): Also known as  Ceres CDNA ID no. 23686345
atgttgcaacagagagacagaaaaaggactcacaatcacgaaggagaagaaacccaataagtgattctcatttttatggctcttgccctgaagtcaagttgcttcttgcaattgaagaaacctgaggctggtttcaatgtttgtttttcatctaagaaagctataatctccgtgaaacgacacactcccgtggctgctatcaggaccatggaagcagtgggactctctgcaacattcaccaggttgaaaaaagaaggaaaagtagctttcatcccgtatgtcactgctggtgatcctgacctttcaaccacagcagaagcactgaaagtgcttgattcatgtgggtctgacataattgagctaggtgttccatactctgatcctttggcagatggtcctgttatccaggctgctgctacaagatctttagcaaaggggaccaatttgaatgcgattattgatatgttgaaggaggttgttccgcaactgtcatgtccaattgcactgtttacatattacaatccaatactgaagcgtggtactgataaatttatgtccactataagagacagtggtgtacatgggcttgtagtcccagatgtccctctggaggagacggaaactttaaggacagaagctaagaaacatggaattgaactggtactcctcacaacacccacaactccaacaaaccgaatgagagccattgttgatgtggcagaaggatttgtgtatcttgtgagctcagtgggggtcactggagcccgagcatcagttagtggttctgttcagtctcttttgaaggaaattaaagaggcaactactaaacctgtggcagttggttttggaatatcaaaacctgagcatgtgaaacaggtagtggtatggggagctgatggtgtgattgttggcagtgctatagtgaaggtgcttggtgaggccaaatctcctcaagagggattgaaagaacttgaagttttcacccgctccttaaaagcggcacttccttaaaaaatatgttttaagagctcgaacttcatgtagttgttgtcgtcatcgtagatattggattcaataaaatgcggttcagttgtttttcttctgttcatgatatagtagttttgacatttttatttccttttcaattatgattggatttcttagttaccaaaaaaaaaaaaaaaaaa

SEQ ID NO: 3458 - protein, 311 aa, Glycine max
  misc_feature: PFam Name: Trp_syntA; PFam Description: Tryptophan synthase
  misc_feature: GI Number: 21593559; NR Description: tryptophan synthase
  misc_feature: GI Number: 7258367; NR Description: tryptophan synthase alpha chain [Arabidopsis thaliana] >gi|619753|gb|AAC49117.1| tryptophan synthase alpha chain >gi|18410104|ref|NP_567004.1| tryptophan synthase, alpha subunit (TSA1) [Arabidopsis thaliana]
  misc_feature: GI Number: 52673242; NR Description: tryptophan synthase, alpha subunit (TSA1) [Isatis tinctoria] >gi|52673240|emb|CAH56477.1| tryptophan synthase, alpha subunit
  misc_feature: GI Number: 29824243; NR Description: putative tryptophan synthase alpha 1 chain [Arabidopsis thaliana] >gi|26450413|dbj|BAC42321.1| putative tryptophan synthase alpha 1 [Arabidopsis thaliana] >gi|7269021|emb|CAB80754.1| chain T10P11.11
  misc_feature: GI Number: 11993328; NR Description: putative tryptophan
MALALKSSCFLQLKKPEAGFNVCFSSKKAIISVKRHTPVAAIRTMEAVGLSATFTRLKKEGKVAFIPYVTAGDPDLSTTAEALKVLDSCGSDIIELGVPYSDPLADGPVIQAAATRSLAKGTNLNAIIDMLKEVVPQLSCPIALFTYYNPILKRGTDKFMSTIRDSGVHGLVVPDVPLEETETLRTEAKKHGIELVLLTTPTTPTNRMRAIVDVAEGFVYLVSSVGVTGARASVSGSVQSLLKEIKEATTKPVAVGFGISKPEHVKQVVVWGADGVIVGSAIVKVLGEAKSPQEGLKELEVFTRSLKAALP

SEQ ID NO: 3459 - DNA, 1292 bp, Glycine max
  misc_feature (1)..(1292): Ceres cDNA ID no. 21665727
  misc_feature (1)..(1292): Ceres CLONE  ID no. 518341
  misc_feature (1)..(1292): Also known as  Ceres CDNA ID no. 0
atcagcactagcaacagccatgggagaggtagacccagctttcatccaagacctagaacacagaccaaagctctccataatccaagctgaaggaattcccataattgacctctctccaatatccaaccacacagtttcagatccatcttccattgaaaacttagtgaagcagatagggagtgcatgcaaggaatggggtttcttccaagtaaccaaccatggggtgcccctcactctaaggcaaaacattgagaaagcctcaagattgttctttgcacagaatttggaggagaaaagaaaggttagcagagatgagagttctccaaatggttactatgacacagaacacaccaagaacattagggactggaaagaagtctttgattttcaagccaaagaccccactttcatccctgtcacttttgatgaacatgatgatcgagtcactcactggactaatcattctcctcaataccctccaaactttagggatataatcgaagagtatgttcaagaggtggaaaagctgtcctttaagctgttggagattatagctctgagcttaggccttgaggcaaagaggtttgaagagtttttcatcaaagatcaaactagctttattcgactcaaccactatcctccatgcccttcccctcatctagctcttggtgttggtcgacacaaggacattggagccttaaccattcttgcacaagatgatgttggaggacttgaagtcaaacgcaaagcagatcaagagtggataagagtgaaacctacaccaggtgcttatataatcaacgttggtgatcttattcaggtttggagcaatgacttatatgagagtgtggaacacagagcgatggttaactctgagaaagaaaggttttccataccttttttcttattccctgcacactacactgaagtcaagcctttggaggagttgacaaatgaccaaaaccctgcaaaatataggccatacaattggggcaagtttcttgtccgtagaaagggcagcaatttcaagaaactaaatgtggagaatattcagatttatcattataagatagcttaaaaggatggtaaattagcagtgccttttagcctatgcatgtaaaacaaactgattcaagaatgtttctgatatgtgggactgtgatcttatgctgctaaaattactagtgtgcaatgtgcattatgtatgccaggagcatctaataaaagaaaaataaatcaagattaatgatatttgaacacttcaaaaaaaaaagaaaaaaaaaaaaaaaaaa

SEQ ID NO: 3460 - protein, 352 aa, Glycine max
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPNGYYDTEHTKNIRDWKEVFDFQAKDPTFIPVTFDEHDDRVTHWTNHSPQYPPNFRDIIEEYVQEVEKLSFKLLEIIALSLGLEAKRFEEFFIKDQTSFIRLNHYPPCPSPHLALGVGRHKDIGALTILAQDDVGGLEVKRKADQEWIRVKPTPGAYIINVGDLIQVWSNDLYESVEHRAMVNSEKERFSIPFFLFPAHYTEVKPLEELTNDQNPAKYRPYNWGKFLVRRKGSNFKKLNVENIQIYHYKIA

SEQ ID NO: 3461 - DNA, 1402 bp, Glycine max
  misc_feature (1)..(1402): Ceres cDNA ID no. 21665728
  misc_feature (1)..(1402): Ceres CLONE  ID no. 518886
  misc_feature (1)..(1402): Also known as  Ceres CDNA ID no. 23685024
gttagttgaggtgtccactgaaatggtgtccttcatgagaccttggaattgaaacgaacgtcgaagggacgtgtctgactccgatggcttcctcataccgtgaccgtacgtcggagttccgattactatcggagactatgaagaagatcggaggtccggttcaacccgagaatcctccttcgacctctcgcggcggcgagtcgtcgtattcgagatccgaattcaaccgaaaggcctcgcgaatcgggttggggatccacgagacctcgcagaagatcgcgaggctcgcgcagctggcgaggaaatcgtccatgttcaacgatcccgccgtggagattcaggagctgactgttctgatcaagaacgagatcacgacactgaactcggctctctccgatttgcaaaccattcagaacacggatatggctgacggcggttactcgcaggatacgattgtgcattccaccgcggtttgtgatgacttgaagagcaaactcatgggagccacaaaacaccttcaagatgtcttaactgctaggacagagaatatcaaggctcatgagaacaggaagcagatattttccaagaatgcatcaagagagaaccctttccagcatcagccaaagccagctaatgagccgccaccttggtcaaattcatcgaatgcatcagagagtttgcaacaagaatcagcattaccatcaaatggagctcctgttggcaatcaactaagacgaaggttggctgtggacaacactccatcccagcaaatggaaatgtctatggtacagcaggttgtgcctcggcatgaaaactatgctcaaagtcgagcaactgctctgcacaatgtggaatctactatcacagaactaagtgggattttctcacatttggctacaatggttgcccatcaaggggagcttgctatcaggattgatgacaatatggatgagtcattggcaaatgttgaaggagctcacagttctttattgaggcatctcaaccgaatatcatcaaataggtggcttctaataaagatatttgccattctgatacttttcctcacgatcttcatattctttgtcgcctaatatacttccatatgctaatcatggaagtttcacttcgtggcttacttggatttgttttcgttcttctgtggagacaaaaacacaagagcaggtaaatgtgcggatgtattctatttgaatgtagatagagagctccgtcatctgtaaacattttacaatattcccatattcttagtttggcaatcattataggtgttattaaaatttcgttggtatgtaatccccatattaagcaaattgagtaagaaatatacgagtgtttggtaaattgatatagattcataatatttttcaaaaaaaaaaaaaaaaaa

SEQ ID NO: 3462 - protein, 1402 aa, Glycine max
  misc_feature: PFam Name: Syntaxin; PFam Description: Syntaxin
  misc_feature: PFam Name: SNARE; PFam Description: SNARE domain
  misc_feature: GI Number: 2981439; NR Description: syntaxin of plants 31
  misc_feature: GI Number: 9759101; NR Description: t-SNARE SED5 [Arabidopsis thaliana] >gi|17978873|gb|AAL47408.1| AT5g05760/MJJ3_17 [Arabidopsis thaliana] >gi|15809834|gb|AAL06845.1| AT5g05760/MJJ3_17 [Arabidopsis thaliana]
  misc_feature: GI Number: 34906154; NR Description: putative t-SNARE SED5 [Oryza sativa (japonica cultivar-group)] >gi|9711872|dbj|BAB07966.1| putative t-SNARE SED5 [Oryza sativa
  misc_feature: GI Number: 30793955; NR Description: putative syntaxin SYP32 [Arabidopsis thaliana] >gi|11994697|dbj|BAB02935.1| probable t-SNARE (soluble NSF attachment protein receptor) SED5; ER to Golgi transport [Arabidopsis thaliana]
  misc_feature: GI Number: 42733918; NR Description: similar to syntaxin 5
GTTAGTTGAGGTGTCCACTGAAATGGTGTCCTTCATGAGACCTTGGAATTGAAACGAACGTCGAAGGGACGTGTCTGACTCCGATGGCTTCCTCATACCGTGACCGTACGTCGGAGTTCCGATTACTATCGGAGACTATGAAGAAGATCGGAGGTCCGGTTCAACCCGAGAATCCTCCTTCGACCTCTCGCGGCGGCGAGTCGTCGTATTCGAGATCCGAATTCAACCGAAAGGCCTCGCGAATCGGGTTGGGGATCCACGAGACCTCGCAGAAGATCGCGAGGCTCGCGCAGCTGGCGAGGAAATCGTCCATGTTCAACGATCCCGCCGTGGAGATTCAGGAGCTGACTGTTCTGATCAAGAACGAGATCACGACACTGAACTCGGCTCTCTCCGATTTGCAAACCATTCAGAACACGGATATGGCTGACGGCGGTTACTCGCAGGATACGATTGTGCATTCCACCGCGGTTTGTGATGACTTGAAGAGCAAACTCATGGGAGCCACAAAACACCTTCAAGATGTCTTAACTGCTAGGACAGAGAATATCAAGGCTCATGAGAACAGGAAGCAGATATTTTCCAAGAATGCATCAAGAGAGAACCCTTTCCAGCATCAGCCAAAGCCAGCTAATGAGCCGCCACCTTGGTCAAATTCATCGAATGCATCAGAGAGTTTGCAACAAGAATCAGCATTACCATCAAATGGAGCTCCTGTTGGCAATCAACTAAGACGAAGGTTGGCTGTGGACAACACTCCATCCCAGCAAATGGAAATGTCTATGGTACAGCAGGTTGTGCCTCGGCATGAAAACTATGCTCAAAGTCGAGCAACTGCTCTGCACAATGTGGAATCTACTATCACAGAACTAAGTGGGATTTTCTCACATTTGGCTACAATGGTTGCCCATCAAGGGGAGCTTGCTATCAGGATTGATGACAATATGGATGAGTCATTGGCAAATGTTGAAGGAGCTCACAGTTCTTTATTGAGGCATCTCAACCGAATATCATCAAATAGGTGGCTTCTAATAAAGATATTTGCCATTCTGATACTTTTCCTCACGATCTTCATATTCTTTGTCGCCTAATATACTTCCATATGCTAATCATGGAAGTTTCACTTCGTGGCTTACTTGGATTTGTTTTCGTTCTTCTGTGGAGACAAAAACACAAGAGCAGGTAAATGTGCGGATGTATTCTATTTGAATGTAGATAGAGAGCTCCGTCATCTGTAAACATTTTACAATATTCCCATATTCTTAGTTTGGCAATCATTATAGGTGTTATTAAAATTTCGTTGGTATGTAATCCCCATATTAAGCAAATTGAGTAAGAAATATACGAGTGTTTGGTAAATTGATATAGATTCATAATATTTTTCAAAAAAAAAAAAAAAAAA

SEQ ID NO: 3463 - DNA, 1547 bp, Glycine max
  misc_feature (1)..(1547): Ceres cDNA ID no. 21665732
  misc_feature (1)..(1547): Ceres CLONE  ID no. 521420
  misc_feature (1)..(1547): Also known as  Ceres CDNA ID no. 24359970
tttctgcgccggccactcagtttctctttcgtttttctttttcttttctccttttcttcttctttcacttatcctattagtatttccctcagtcggtttattcattctctctgtttttttccttccaccgactgctagttttcgtttacaccactaacttcaaggttggtagcattatcttctcctttaaattatactaatcttacttcccttaactttcgtttggtttttattcttccatttattgtattttacatcatgaagaagaggcttttgtgcaagtcaaggttctttcttctttcctcggttcccttccctccaagggaagaacctctttagataccctttttgctctgagaacacatacgaccacactctcttccatttcatccataaaacttggagtgcagtcaaagagtcaaagattcacaacatgtttccgaggggcagaaggagtgacattggtggccatggcaacacaaacgtggctgaatgggaattacggccaggaggaatgctcgtgcagaaacgtaacttggatttgaatcaaaattctgcatctaaatctaccatcaaagtcaaagtgaagtatggctcatcctatcaccaaattcaaatcagttctcatgcaagttttggggaattgaagaaaatgttaacagaacctacaggattgcacattcaggatcagaaattgatttacaagaaaaaagagagggattcaaagtcatatcttgatgtcgagagggtcaaagatggatcaaaattggtgctgcttgtggacattgagagtagagaaagaaggatacttgagacgttaaaaattgctaagaaggagaagacattaaaatccttgacagaaataaaggtggaggttgataaacttgccacgaaggtagcagctttggaagctgctacttccacaggtggggttatagcagagttagatatagagactttgacagagaatttgatgagaacattgattgcattggatgaaatttatggtgagggtgaactgaaattgcagagaagagagcagattaggagagttcagaaacacattgagactctagatatgttgaggatggcaagggaaaactcaatttctctgaaaaatgaagaaaaaaacatggcacgtgagagcaaggtgcattgtggtggtcacatgcaggggagacagggaaatcctaagaagcagcaaccgttaaaacatcctgactcggttgtagtcacaacaaaatgggaaacttttgattgaggcttttagatttgcaacgaaaatgcctcacacaccttaagagtgcaatattcagtgagtcatctagttgtgggttgcttctgccataaaagaaattattatttttctcattatatatctgcaaattagaataatgtttggttcacattatttttgctttacatctacttgcaccctttaaagcatagaatcatttcataggacgaatagcaaaggtaaaaagctgtttaatagtagttgtaaaagtatgtggaataaaaactgacttaaaaaaaaaaaaaaaaaa

SEQ ID NO: 3464 - protein, 275 aa, Glycine max
  misc_feature: PFam Name: ubiquitin; PFam Description: Ubiquitin family
  misc_feature: PFam Name: BAG; PFam Description: BAG domain
  misc_feature: GI Number: 50948201; NR Description: putative BAG domain containing protein [Oryza sativa (japonica cultivar-group)] >gi|42408090|dbj|BAD09231.1| putative BAG domain containing protein
  misc_feature: GI Number: 30697630; NR Description: BAG domain containing
  misc_feature: GI Number: 21537107; NR Description: unknown [Arabidopsis thaliana]
  misc_feature: GI Number: 30697627; NR Description: BAG domain containing
  misc_feature: GI Number: 21553443; NR Description: unknown [Arabidopsis thaliana]
MFPRGRRSDIGGHGNTNVAEWELRPGGMLVQKRNLDLNQNSASKSTIKVKVKYGSSYHQIQISSHASFGELKKMLTEPTGLHIQDQKLIYKKKERDSKSYLDVERVKDGSKLVLLVDIESRERRILETLKIAKKEKTLKSLTEIKVEVDKLATKVAALEAATSTGGVIAELDIETLTENLMRTLIALDEIYGEGELKLQRREQIRRVQKHIETLDMLRMARENSISLKNEEKNMARESKVHCGGHMQGRQGNPKKQQPLKHPDSVVVTTKWETFD

SEQ ID NO: 3465 - DNA, 1644 bp, Glycine max
  misc_feature (1)..(1644): Ceres cDNA ID no. 21665733
  misc_feature (1)..(1644): Ceres CLONE  ID no. 521542
  misc_feature (1)..(1644): Also known as  Ceres CDNA ID no. 23684414
acaatcaaccaaacacaacacttcactctcaagcttcaagcatgactcctttttacttcctcctatttgccttcatccttttcctctccataaacttcttgatccaaacaagaaggttcaaaaaccttcctccgggaccattttctttccctataatcggaaacctccaccaactcaagcaacccctccaccgcacgttccatgccttatcacaaaaatatggccctattttctccctctggttcggctcccgttttgtcgtcgtcgtttcgtcgccgctcgcggtgcaagaatgcttcaccaagaacgacatcgtcttggccaaccgccctcacttcctcaccggcaagtatatagggtacaacaacaccaccgtcgccgtttccccctacggcgaccactggcgcaacctccgccgcatcatggcgctcgaggttctctccacccaccggataaactccttcttggaaaatcggagggacgagatcatgaggctcgtgcaaaagcttgctcgggactcgcgcaatggcttcaccaaagtagaacttaaatccaggttttcggagatgacatttaacactataatgaggatggtgtcagggaagaggtactatggtgaagactgtgatgtgagtgatgtacaggaagcaaggcaatttagagagatcattaaagagttggtgacgttaggaggggctaataaccctggggacttcttggctttgcttaggtggtttgattttgatggtttggagaagagactaaagaggattagtaagagaaccgatgcgtttttacaaggactcattgatcagcatcgtaatggaaagcatcgtgccaatactatgatagatcatcttcttgctcaacagcaatcacaacctgaatattacaccgatcaaatcatcaaaggacttgcactggtaatgctacttgcaggaacagatacatcagcagtaactttagaatgggcaatgtctaatttattaaaccatccagaaatattaaagaaggcaaaaaatgaattagacactcatataggacaagatcgtctagtagatgagcctgacattccaaaactcccttaccttcaaagcattgtttatgagacacttcgtttgcatcctgctgctccaatgttggtaccccatttgtcttcagaagattgcaccataggagaatataatatcccacaaaacacaattttgttggtgaatgcttgggccattcatagagatcccaagttgtggagtgacccaacacactttaagcctgagaggtttgagaatgaaagtgaagcaaacaagttacttccatttgggttagggaggagggcttgccctggagctaacttggctcaacgcacactgagcttaactctggccttattaatccaatgttttgagtggaaaaggactactaaaaaagaaattgatatgactgaaggaaagggacttactgtgtcaaaaaatatcccttagaagctatgtgccaagtgtgccaatcactgacagttaaggatatttataacttctagtgctgttaaaagcataaacatcttataatgtttttgaagaacttatatatgtaaaataaaatttatagtagtgctttatttattcaaaaaaaaaaaaaaaaaaaaaa

SEQ ID NO: 3466 - protein, 479 aa, Glycine max
  misc_feature: PFam Name: p450; PFam Description: Cytochrome P450
  misc_feature: GI Number: 33521521; NR Description: CYP81E8 [Medicago truncatula]
  misc_feature: GI Number: 3850630; NR Description: cytochrome P450 [Cicer
  misc_feature: GI Number: 4894170; NR Description: cytochrome P450 [Cicer
  misc_feature: GI Number: 4200044; NR Description: cytochrome P450
  misc_feature: GI Number: 7415996; NR Description: cytochrome P450 [Lotus
MTPFYFLLFAFILFLSINFLIQTRRFKNLPPGPFSFPIIGNLHQLKQPLHRTFHALSQKYGPIFSLWFGSRFVVVVSSPLAVQECFTKNDIVLANRPHFLTGKYIGYNNTTVAVSPYGDHWRNLRRIMALEVLSTHRINSFLENRRDEIMRLVQKLARDSRNGFTKVELKSRFSEMTFNTIMRMVSGKRYYGEDCDVSDVQEARQFREIIKELVTLGGANNPGDFLALLRWFDFDGLEKRLKRISKRTDAFLQGLIDQHRNGKHRANTMIDHLLAQQQSQPEYYTDQIIKGLALVMLLAGTDTSAVTLEWAMSNLLNHPEILKKAKNELDTHIGQDRLVDEPDIPKLPYLQSIVYETLRLHPAAPMLVPHLSSEDCTIGEYNIPQNTILLVNAWAIHRDPKLWSDPTHFKPERFENESEANKLLPFGLGRRACPGANLAQRTLSLTLALLIQCFEWKRTTKKEIDMTEGKGLTVSKNIP

SEQ ID NO: 3467 - DNA, 1530 bp, Glycine max
  misc_feature (1)..(1530): Ceres cDNA ID no. 21665734
  misc_feature (1)..(1530): Ceres CLONE  ID no. 522179
  misc_feature (1)..(1530): Also known as  Ceres CDNA ID no. 24360098
gagtggcagtggcaccttcagctgcacaaagattcccaaagttgagaaacagcacactctctcactcacttgtcattgttatttttgttttacattttgtcacaatctgtgactgttcgagttatccgaggcccctcttttatatggtcgttaataaaaatggcttcgacccttttcacaaagatgcttttgggccaacgattgatccatccttattcgttcctcactcaccagccacagattctctcttctctattcagtaaacggctgttttgtatacgagctgtcccagtctcagcctatacatcccaaaacatcaaaacaactggttgggctccttgtatggcttcttcctcagttggtagaagggctacatattcaacacaatctgtatcaacaaatgagccagttgtatctgtagattggctttatgataacctgaaggagccagatatcaaggtactagatgcttcgtggtacatgccggatgagcagaggaatccaattcaagaatatcaggttgctcacattcctggtgcccttttctttgacgtagatggaatagcagatcggactacaaaattaccacatatgctgccatcagaggaagcttttgctgctgctgtttctgctcttggcattgagaacaaagatgatttggttgtttatgatggaaaagggttatttagtgcagctcgtgtttggtggatgttccgagtatttgggcatgacagagtttgggtattagatggtggcctgccgagatggcgtgcatcaggttatgatgttgaatccagtgcttcaagtgatgctattcttaaggccagtgctgctagtgaggctatagagaaagtatataagggacagacagttggcccactcacatttcagactaaatttcagccacatcttgtttggaacattgatcaggtaaagaaaaatatagaggacaaaactcaccaacacatagatgctcgatcaaagcctaggtttgatggagctgtacaagagcctcgaaagggaatcagaagtggtcatgtacctggtagcaaatgcatcccttttgcccagttgttagatagttcacagacattgttaccagcagatgagttgaagaagcgatttgaacaagaaggcatctctgtggaaagcccagctgtgacttcatgtggaacgggcgtaactgcttgcattcttgcattgggtcttcatcgtcttggaaagtctgatgttgcagtttatgatggatcttggactgaatggggagcacaatctgatacacttgttgacacttcatgaattcaatacagctaaatttgcatgccaccagaaagtatctgcaagtgaaggggctgtatccatttgtcaaacattttgaagacaccaatttttctatgctttactgtttgtttgttgttctggtttagttgtggttgagattcttgagaatcgcaaatatgttccatgtcaaatgttactaatattaaatcctatcatgtggcttataaaaataaaaaaaaaaaaaaaaaa

SEQ ID NO: 3468 - protein, 379 aa, Glycine max
  misc_feature: PFam Name: Rhodanese; PFam Description: Rhodanese-like domain
  misc_feature: GI Number: 4406372; NR Description: thiosulfate
  misc_feature: GI Number: 21592746; NR Description: mercaptopyruvate sulfurtransferase (Mst1/Rdh1) [Arabidopsis thaliana] >gi|26451462|dbj|BAC42830.1| putative mercaptopyruvate sulfurtransferase [Arabidopsis thaliana]
  misc_feature: GI Number: 6686778; NR Description: 3-mercaptopyruvate sulfurtransferase [Arabidopsis thaliana] >gi|25288794|pir||T52658 thiosulfate sulfurtransferase (EC 2.8.1.1) Mst1 precursor
  misc_feature: GI Number: 30684873; NR Description: mercaptopyruvate
  misc_feature: GI Number: 7581972; NR Description: 3-mercaptopyruvate sulfurtransferase [Arabidopsis thaliana] >gi|25456716|pir||T52655 thiosulfate sulfurtransferase (EC 2.8.1.1) [validated] -
MASTLFTKMLLGQRLIHPYSFLTHQPQILSSLFSKRLFCIRAVPVSAYTSQNIKTTGWAPCMASSSVGRRATYSTQSVSTNEPVVSVDWLYDNLKEPDIKVLDASWYMPDEQRNPIQEYQVAHIPGALFFDVDGIADRTTKLPHMLPSEEAFAAAVSALGIENKDDLVVYDGKGLFSAARVWWMFRVFGHDRVWVLDGGLPRWRASGYDVESSASSDAILKASAASEAIEKVYKGQTVGPLTFQTKFQPHLVWNIDQVKKNIEDKTHQHIDARSKPRFDGAVQEPRKGIRSGHVPGSKCIPFAQLLDSSQTLLPADELKKRFEQEGISVESPAVTSCGTGVTACILALGLHRLGKSDVAVYDGSWTEWGAQSDTLVDTS

SEQ ID NO: 3469 - DNA, 1953 bp, Glycine max
  misc_feature (1)..(1953): Ceres cDNA ID no. 21665735
  misc_feature (1)..(1953): Ceres CLONE  ID no. 522593
  misc_feature (1)..(1953): Also known as  Ceres CDNA ID no. 24424734
aaagaacaagttgaaggaaaaaagactccttcaactagtactgcattctttcttttcttcaaatggtagcaagaggcatcaagagcaaaagacattgttaatttcggagatggcgagttacgaggctattaagaactttgatgatgatgatgatgaagatgtggagatggcactcctccataaccagatctctgaatcaagatctgccactgtttctcccaccattgcccaaactaccccgcttcaccttcacatcaacaacattattgaggaacaacacataatcgcaaggcaccaacctcaaccccaacccaaatctccccgtctagtttctcttgatgtttttcgtggtctcaccgtcgcgcttatgatacttgttgatgatgctggcggactcattcctgcactcaatcattcaccatggaatggtttaacgctagctgattatgtcatgccatttttcctatttattgttggtgtttcgcttgcactcacatacaagaaactgtcttgcggagttgatgcatctaggaaagcaagtttacgggctctaaaacttcttgtgttaggccttttccttcaaggaggttatttccatcgggtgaatgatctgacctatggagtggatttgaaacagataagatggatgggaatactacagagaattggggtagcatatttggttgccgcactgtgtgaaatttggctcaagagtgatgatactgttaattcaggaccatccctgttaaggaagtatcggtaccagtgggctgtggctttgattctttctttcctttatctttgcttgctatatggattgtacgttcctgattgggtgtatcaaattcaaacagaaccttcttcagagccaaagacattttcagttaaatgtggagtaaggggtaacactgggccagcctgcaatgcagttggaatgattgatcgaacgatattgggtatacaccacctgtaccagagaccaatatatgctcggatgcctgaatgcagtattaattctcccaactatggaccattgcctcctgacgctcctgcttggtgtcaggccccttttgatcccgaaggactcctaagttcagtgatggctattgtcacctgcttgattgggctgcactacggacatattattgtccattttaaggaccacagagtgagaatcatatactggatgatcccgacctcttgtcttgtagtttttggccttgcgttggacttatttggaatgcatataaataaggttctctactcgcttagttacacatgtgtcactgctggtgctgcaggcatcctctttgttggaatatacttgatggttgatgtatgtgggtgtcgtcgcatgaccttggttctggagtggatgggcatgcatgcattaatgatttatatccttgcggcttgcaatgtttttccaattttccttcaaggattttattggggaagtcctcacaataacattctcaagttaattggagttggtacttgaagagaggcacatacacatgctcgtggataaagattatatgcagtaagacagtgagacatgttttactgtaaaagaaattggctaccacgcggtgtttattgattattacccgagttttggagctaatcttttgatcaagaacaagaacgggtgtatcatattcctctaatctcttgatgacgtcacctgcatggatgatggatatagtttagagttcgctatatctcttgatggcataacctttctatatatggaaagcagcttttgtttataatagcaccactgcaatataatgtgtacttttacttcatatccttgaaatgatttcaagagagtaaccattggacacgatattgatgtaaaatttagttttagattttttaatttattgttactattagcctagaaatgtcaatttcttctgtaaaaaaaaaaaaaaaaaaaaaaaaaaa

SEQ ID NO: 3470 - protein, 463 aa, Glycine max
  misc_feature: GI Number: 32487909; NR Description: OJ000315_02.13 [Oryza
  misc_feature: GI Number: 34907126; NR Description: OSJNBa0052O12.29 [Oryza sativa (japonica cultivar-group)] >gi|15623878|dbj|BAB67936.1| P0506E04.14 [Oryza sativa (japonica cultivar-group)] >gi|20161856|dbj|BAB90770.1| OSJNBa0052O12.29 [Oryza sativa
  misc_feature: GI Number: 48124947; NR Description: similar to
  misc_feature: GI Number: 48894060; NR Description: COG4299: Uncharacterized
  misc_feature: GI Number: 62662832; NR Description: PREDICTED: similar to
MASYEAIKNFDDDDDEDVEMALLHNQISESRSATVSPTIAQTTPLHLHINNIIEEQHIIARHQPQPQPKSPRLVSLDVFRGLTVALMILVDDAGGLIPALNHSPWNGLTLADYVMPFFLFIVGVSLALTYKKLSCGVDASRKASLRALKLLVLGLFLQGGYFHRVNDLTYGVDLKQIRWMGILQRIGVAYLVAALCEIWLKSDDTVNSGPSLLRKYRYQWAVALILSFLYLCLLYGLYVPDWVYQIQTEPSSEPKTFSVKCGVRGNTGPACNAVGMIDRTILGIHHLYQRPIYARMPECSINSPNYGPLPPDAPAWCQAPFDPEGLLSSVMAIVTCLIGLHYGHIIVHFKDHRVRIIYWMIPTSCLVVFGLALDLFGMHINKVLYSLSYTCVTAGAAGILFVGIYLMVDVCGCRRMTLVLEWMGMHALMIYILAACNVFPIFLQGFYWGSPHNNILKLIGVGT

SEQ ID NO: 3471 - DNA, 1694 bp, Glycine max
  misc_feature (1)..(1694): Ceres cDNA ID no. 21665736
  misc_feature (1)..(1694): Ceres CLONE  ID no. 524003
  misc_feature (1)..(1694): Also known as  Ceres CDNA ID no. 24363014
aatctcattcttcttgttgttcttccgcagcacacacacatagcatagcattcgcgaatccctgtgtctctgagcagcaatgccagcccagaagcgctctctgcccgactctctcgacgaaggggacacttcgcagcagaacctcttccattctcgacatgcgaagcaacaacaacaggaccagtcgcaggaacacgacgaggatgagaacgaagacgaagaaggagaagatggagaagaagaagaaggagaagaagaaggggaaggggaaggagaagaagatgaggaggaggaggaagaagaagaagtagaagaagcggcgcaacatgacaacaacgacaaggaaaaaccacaggattccgacgaaaccccatcttctggctctgaagaaaaacctgaattcgtgtatgttgaacttctggaaattcgtaaagatgtccaatgcccaatttgccttggcattattaagaagacaagaactgttatggaatgcttgcaccgtttttgcagggaatgcattgataaatcaatgcgactagggaacaatgaatgccctgcttgtcgcacacattgtgccagtcgtcgttccttgagagacgatccaaattatgatgccctcattgccgctttatatccagatattgagaagtacgaacaagaggagcttgaatttcgtgaagaggagaagaaccgcaataagcagattcaagcttcaatagcaaaagtagttcaacggcaatctgaagcattggttaagagacgtaaagacacaccaggtgcatttgtaactagaccgcagcgtaatcagcgaaacattcattctaggagacaaactcaagcaattgaaggatctgaagataatgaggaggaaaatgacaataatgaaaaggactcatcttcagctgatgaacgaagtacagaacaccggcagagaaggagaaagagatgggctagagttcgcccctctcaaccctcatcatccatggcaagtcctgatggtggatgcaatgatagtgatatggatataagtaaagaaaatcgtggaatttcaaggcaggtgtcgaaacatggaaagcttacatggggaaggggtggttttagaagtaacactcggcatggcagtggtggtggtagcaataacaaaagttctcgcagtagtcgattgtctaagtttgttgaccatctccgcaacttggatgaaaacactgatgagtttgatgtccatctcatgcttgtttctcttgaccaactaagtacaccaagtttgcagcaaccttacctttgctgtcgaccaactttgtctgtcaagcacctttatgaacacgttgctcgtcagacacctttgccggttgaaggaattgagatagtggcagtcaaaggatgctgcagtacgaactgtgacaagtcagctgatgagaattcggcccttgcatatgatgagctatcaaagctggttatagatccacacaaagatgaactggaaattttgcaaggacatgagactctggcagggcttagatccaaatgcatatccaagatggggcatttgattattgcatacaagcagaaggaggtatcatagtcttggtttcattggcgatcttgacattggctatgccataaatttctttgttatgtacataaaaagaacaattgccttttgcatcctcaaccccaaaaaaaaaaaaaaaaaa

SEQ ID NO: 3472 - protein, 500 aa, Glycine max
  misc_feature: PFam Name: zf-C3HC4; PFam Description: Zinc finger, C3HC4
  misc_feature: PFam Name: TT_ORF1; PFam Description: TT viral orf 1
  misc_feature: PFam Name: Prothymosin; PFam Description:
  misc_feature: PFam Name: ig; PFam Description: Immunoglobulin domain
  misc_feature: PFam Name: Protamine_P1; PFam Description: Protamine P1
  misc_feature: GI Number: 53792319; NR Description: putative ring finger
  misc_feature: GI Number: 50931917; NR Description: putative zinc finger protein [Oryza sativa (japonica cultivar-group)] >gi|48475210|gb|AAT44279.1| putative zinc finger protein [Oryza
  misc_feature: GI Number: 15219551; NR Description: zinc finger (C3HC4-type
  misc_feature: GI Number: 34908892; NR Description: P0699H05.18 [Oryza
  misc_feature: GI Number: 14041698; NR Description: dJ1033B10.8.2 (Ring
MPAQKRSLPDSLDEGDTSQQNLFHSRHAKQQQQDQSQEHDEDENEDEEGEDGEEEEGEEEGEGEGEEDEEEEEEEEVEEAAQHDNNDKEKPQDSDETPSSGSEEKPEFVYVELLEIRKDVQCPICLGIIKKTRTVMECLHRFCRECIDKSMRLGNNECPACRTHCASRRSLRDDPNYDALIAALYPDIEKYEQEELEFREEEKNRNKQIQASIAKVVQRQSEALVKRRKDTPGAFVTRPQRNQRNIHSRRQTQAIEGSEDNEEENDNNEKDSSSADERSTEHRQRRRKRWARVRPSQPSSSMASPDGGCNDSDMDISKENRGISRQVSKHGKLTWGRGGFRSNTRHGSGGGSNNKSSRSSRLSKFVDHLRNLDENTDEFDVHLMLVSLDQLSTPSLQQPYLCCRPTLSVKHLYEHVARQTPLPVEGIEIVAVKGCCSTNCDKSADENSALAYDELSKLVIDPHKDELEILQGHETLAGLRSKCISKMGHLIIAYKQKEVS

SEQ ID NO: 3473 - DNA, 928 bp, Glycine max
  misc_feature (1)..(928): Ceres cDNA ID no. 21665737
  misc_feature (1)..(928): Ceres CLONE  ID no. 524804
  misc_feature (1)..(928): Also known as  Ceres CDNA ID no. 23709176
atctttactctctctttcccctaattccgaccatggaagccacggcctccgcaatgagcttcgcccttccctcaacaaaagcccaagcccaagcccaactcctgacccggcccaccaatccattcaccattccctcccgcagcccagcccaccgccccccgccgcgcctccccaccatccgcgccgcaattccccgcacaaagaaagaggcaacggtggagactgtgcgggagcagctcgagaactgttacctcctcgccggcatcaactacaagggcttcacggtgaagcagttccaggagcttcgaaagacgctcccagaaacaacgaaactgatcgtggcgaagaacacgctcgtttacaaggccgtggaaggcacgccctgggagacgctgaagccctgcatgaagggcatgaacgtgtggctcttcgtccacaccgaggagatcccttccgccatcaagccctacaggaacttccagaaggagaagaagctcgaggacaacgacttcaccggcgccgttttcgaaggcaagttttacggccccgatgaggttaagaacctcgaatccttgcccacgcgcgctgagatttacgccacccttttgggggctttgaagagccctgcttccgctcttgttggcactcttcagtctcctgctagggaacttgttacggttctcaaggcgcatattaagaaccttgaagaacaacaaggtgttgcgcaatagataccaataggtgtgtagccttgtttatgtgttttctttattgcatttcagttgttctttgtttccttatttgtctatggatgtgtagattattattattatcatgtgttttcttgtgaagaaaaaaaaatgtagaatggtgcctaggaattgggaatgctggaaaatctgttcccttcaaaaaaaaaaaaaaaaaa

SEQ ID NO: 3474 - protein, 232 aa, Glycine max
  misc_feature: PFam Name: Ribosomal_L10; PFam Description: Ribosomal protein L10
  misc_feature: GI Number: 7489195; NR Description: ribosomal protein L10, chloroplast - common tobacco >gi|3298441|dbj|BAA31511.1|
  misc_feature: GI Number: 3777602; NR Description: 50S ribosomal protein L10
  misc_feature: GI Number: 50920575; NR Description: Putative 50S ribosomal protein L10 [Oryza sativa (japonica cultivar-group)] >gi|27476079|gb|AAO17010.1| Putative 50S ribosomal protein L10
  misc_feature: GI Number: 32307548; NR Description: ribosomal protein rpL10
MEATASAMSFALPSTKAQAQAQLLTRPTNPFTIPSRSPAHRPPPRLPTIRAAIPRTKKEATVETVREQLENCYLLAGINYKGFTVKQFQELRKTLPETTKLIVAKNTLVYKAVEGTPWETLKPCMKGMNVWLFVHTEEIPSAIKPYRNFQKEKKLEDNDFTGAVFEGKFYGPDEVKNLESLPTRAEIYATLLGALKSPASALVGTLQSPARELVTVLKAHIKNLEEQQGVAQ

SEQ ID NO: 3475 - DNA, 1605 bp, Glycine max
  misc_feature (1)..(1605): Ceres cDNA ID no. 21665738
  misc_feature (1)..(1605): Ceres CLONE  ID no. 524910
  misc_feature (1)..(1605): Also known as  Ceres CDNA ID no. 25088223
tcttcttctctcacactgagccattccttcctctcaaactcgaaacgcatgccgtttccgcagattccgacgacgatgacctagacgccgtttcatctccgagcggaagcaaaaatgaagatcaacaaagcctgcgatcttaactccatctctgtctttcctcctcctctcgtttatcctaggaaagcgaacaatatatcgagtggattgcaagcgtctcactctcagcatcgctcgcagccatctcagcagtcgctttctcagggactttcgtctcagcacggagtgctgtcgcatttctcccaaaactctctcgacgaggccgtcacgactaacgatcagagagttggttctcaagaacatgagaactctttgaggaggatttctagcttgtcccgacctacatattcacgggaagagagtcaagcacctaactcaagatcttcatccaatctaatgctcaaatggaattctgcagatcataaaagtcagttaagtgaaggacttgaacaccgaattggcataatggaaacttcattgagcaggttcacaatgatcttggattctgttcaaagtgacgtaatgcaagtaaacaaaggaacaaaggaaattattttggaggtggaatgcataaggcagaagttgattgctcaggataactcacttcagttaatgactaaaggacaagaagaaattaaagcaatcattgaaaggagcttgaaatctttagctgaacaaatgagccatgtttcaaagaaagagaagttacaggatgtatatttggcagtttctgcgttacctcagctaattgaagcctctctgcaaaatgtacaaaatgatctccgtaacatcaccaaggaaatgcaggaaatttcttgcaatctaaaaagtgtcaaccaaaaggatctggtgccgaccagtttgtcttcgaagagtattagcaaacagattaccacaccgaaaatgcgtcagcctcttgctaatgaggcgaaggtgagtatacaagccactgtagctccagaggtggaaagcggaggctggaagccagtaaaaaaagaaagagtcactttttcagatagaacttctgagaaggtgcagaagaaaaaagaaccacacactcagaagtatataaggggaggtagagactgtgctattgtcattgaatctgatgaggagattgatggaggtttttcctgcttggtccaagaaaacgcaggagtaaaccttcttggcaacttgaccaaggaagcactggaagaaactgagcgaattttgcggaaagcaaggaggcgcaagaggaaaagtattttttaatactataataacaatagagtgaaggtcctttaaaaaaaacaacaatatagtgaaggaggaatttgatactttcagatgcagaaggaaaaaccccgggctaaaatttggataaaagttatggaacttttggtattttccctaataaagtgaaatctcaccttagtataaatctttgttatacagatactactcatttttaactttaattagaaatagtatcaaaaccacgtattaaactgtatccaagtttatcttttaagaaattattcgtttttaaaaaaaaaaaaaaaa

SEQ ID NO: 3476 - protein, 399 aa, Glycine max
  misc_feature: GI Number: 8671857; NR Description: T1N6.6 [Arabidopsis thaliana] >gi|25406724|pir||G86147 protein T1N6.6 [imported] -
  misc_feature: GI Number: 46240833; NR Description: coiled-coil protein
MKINKACDLNSISVFPPPLVYPRKANNISSGLQASHSQHRSQPSQQSLSQGLSSQHGVLSHFSQNSLDEAVTTNDQRVGSQEHENSLRRISSLSRPTYSREESQAPNSRSSSNLMLKWNSADHKSQLSEGLEHRIGIMETSLSRFTMILDSVQSDVMQVNKGTKEIILEVECIRQKLIAQDNSLQLMTKGQEEIKAIIERSLKSLAEQMSHVSKKEKLQDVYLAVSALPQLIEASLQNVQNDLRNITKEMQEISCNLKSVNQKDLVPTSLSSKSISKQITTPKMRQPLANEAKVSIQATVAPEVESGGWKPVKKERVTFSDRTSEKVQKKKEPHTQKYIRGGRDCAIVIESDEEIDGGFSCLVQENAGVNLLGNLTKEALEETERILRKARRRKRKSIF

SEQ ID NO: 3477 - DNA, 1711 bp, Glycine max
  misc_feature (1)..(1711): Ceres cDNA ID no. 21665739
  misc_feature (1)..(1711): Ceres CLONE  ID no. 525819
  misc_feature (1)..(1711): Also known as  Ceres CDNA ID no. 23665209
gatcaaaccaacattcagttcataatttcttccaacaaattatatttttcttacaaaaaaaatggcaggtgaggtggtgaagaaggaagagtctctcaacctgaaagtcactaacaagagccatgttcaatcagaggagaaaattggaagaaaagagtaccaattggtcacttttgatcttccctacttggccttttactacaaccagaagctcttgttttacaagggtgaagatttcgagggcatggtccaaaaactcaaagttggacttggagtggtgctgaaggagttccaccaacttgctggcaagttagggaaagatgaagagggggtgttcagagtggagtatgatgatgacatgcttggtgtggaggttgttgaagctgttgtagctgatgatgaaattggtgtggatgatctaactgtggctgaaattagtaacactaatttgaaggagctgataccttatagtggtatcttgaatttggaaggcatgcataggcccttgctggctgttcagttaacgaagctcaaagatgggctcgcaatgggcctagcgttcaaccatgctgtcttggacgggactgccacgtggcagttcatgacctcatgggccgagatctgcagcggttcaccttccacgtcagcaccacccttcctggaccggaccaaggcccggaacacacgcgtgaagctggacctttcgctaccagagcccaacggcccaccaacttccaacggtgaagcaaagcccgcgccagcacttagggaaaaaatcttcaaattctctgagtcagccatcgacaagatcaagtcaacggtcaacgagaaccctccatcggacggctcaaaaccattctcaacatttcaggctctttcctcccacgtttggcgccatgtaagccatgcacgtaacttgaagccggaggattataccgtgttcaccgtctttgccgattgccggaagcgggtggacccgccaatgccggagacttatttcggaaacttaattcaggctatttttaccgttacagcggttgggctcttaacggcccatccgccacaattcggggcttcattggtgcagaaagccattgaagcccacaatgctaagactattgaggaacgtaacaaagagtgggaaagtgcacccaaaatttttgaattcaaagatgctggggtgaattgtgtggctgtgggaagttccccaaggtttaaagtttatgacattgattttggatgggggaagccagagaatgtgaggagtgggactaataacaagtttgatgggatgatttatttgtatccggggaaaagtggaggaaggagcattgatgtggaactaaccttggagcctgaggctatggggaagttggagcaagacaaggattttcttttggaagcataaaattgctagagcaagtgcaataaaaaaaatggctagaaaaagtacgttgagcaaatttggaagtagtactgctcagattgttgaaggggtcgacttcaatgtccaattatgaattctgatgtgattcatggatgcaatttaatttaaagttgtgctgttttaggattttatatattttgtggttctacgcttgattgattttgaacctactaatgtctgttccatatgtatggtcaatgattgtagttcatgacaagtgaaaggaattattgtgagttttaattgaaaaaaaaaaaaaaaaaa

SEQ ID NO: 3478 - protein, 448 aa, Glycine max
  misc_feature: PFam Name: Transferase; PFam Description: Transferase family
  misc_feature: GI Number: 24111347; NR Description: At5g23940/MRO11_2 [Arabidopsis thaliana] >gi|23397255|gb|AAN31909.1| putative acyltransferase [Arabidopsis thaliana] >gi|10176861|dbj|BAB10067.1| acyltransferase [Arabidopsis
  misc_feature: GI Number: 7415599; NR Description: acyltransferase homolog
  misc_feature: GI Number: 18447767; NR Description: acyltransferase-like
  misc_feature: GI Number: 50948543; NR Description: putative AER [Oryza sativa (japonica cultivar-group)] >gi|42408433|dbj|BAD09615.1| putative AER [Oryza sativa (japonica cultivar-group)] >gi|45736184|dbj|BAD13230.1| putative AER [Oryza sativa (japonica
  misc_feature: GI Number: 47026980; NR Description: acyltransferase
MAGEVVKKEESLNLKVTNKSHVQSEEKIGRKEYQLVTFDLPYLAFYYNQKLLFYKGEDFEGMVQKLKVGLGVVLKEFHQLAGKLGKDEEGVFRVEYDDDMLGVEVVEAVVADDEIGVDDLTVAEISNTNLKELIPYSGILNLEGMHRPLLAVQLTKLKDGLAMGLAFNHAVLDGTATWQFMTSWAEICSGSPSTSAPPFLDRTKARNTRVKLDLSLPEPNGPPTSNGEAKPAPALREKIFKFSESAIDKIKSTVNENPPSDGSKPFSTFQALSSHVWRHVSHARNLKPEDYTVFTVFADCRKRVDPPMPETYFGNLIQAIFTVTAVGLLTAHPPQFGASLVQKAIEAHNAKTIEERNKEWESAPKIFEFKDAGVNCVAVGSSPRFKVYDIDFGWGKPENVRSGTNNKFDGMIYLYPGKSGGRSIDVELTLEPEAMGKLEQDKDFLLEA

SEQ ID NO: 3479 - DNA, 755 bp, Glycine max
  misc_feature (1)..(755): Ceres cDNA ID no. 21665740
  misc_feature (1)..(755): Ceres CLONE  ID no. 526185
  misc_feature (1)..(755): Also known as  Ceres CDNA ID no. 24363188
aaatacaaataaaaactaataattgtttagctcctacaaagtatccaaatgaagaaagtcattatcatcttagctcttcttgcagtagcttttgcaggtttttccgatgattgtctctactctcacaaccaagctagatccgtccttgggcttccaaaaatgacttattcaagcaaattagcctctacagccctcaagtacgctaaagttctggctggaactaatcacttgaaacacagtagcggtagaaataatattggtgaaaatcttgctatgggaacaaagggatcttatgacaccgaaagacttatctctttatggactaaggaaaagaagaactatattcccgcaaagaaattccccaacgtatctagaactggaaactggaaggatgtcgcacattacactcagatcgtctggagaaacactaaacaagttggttgtggtaccgctactaatagcaagaacattatcatagtttgtcactacagtggtgccggtaactgggttggttcatatccctattagataatagatgatataattaatgacagctaaacattatcgtgttttttgaacaaaagaacctgattaaaaagctcaacttattttttcatttgaatgcatttacaaagttatatattactaacttctaaacattgtatgtaagtacacacatactctatacttttttaataattcaaacctcaaatgtctctaagacattgagtacaaacaaaaaaaaaaaaaaaaaa

SEQ ID NO: 3480 - protein, 159 aa, Glycine max
  misc_feature: PFam Name: SCP; PFam Description: SCP-like extracellular protein
  misc_feature: GI Number: 8569094; NR Description: Contains similarity to PR1a protein precursor from Nicotiana tabacum gb|D90196 and contains an SCP domain PF|00188. EST gb|R64931 comes from this gene. [Arabidopsis thaliana] >gi|15222865|ref|NP_175428.1|
  misc_feature: GI Number: 40646968; NR Description: cytoplasmic small heat
  misc_feature: GI Number: 34914926; NR Description: rice pathogenesis-related protein class 1 [Oryza sativa (japonica cultivar-group)] >gi|7442184|pir||T04299 pathogenesis-related protein class 1 - rice >gi|1888551|gb|AAB49685.1|
  misc_feature: GI Number: 15625250; NR Description: pathogenesis-related
  misc_feature: GI Number: 3660529; NR Description: pathogenesis-related protein PR1a (P4) [Lycopersicon esculentum] >gi|548586|sp|Q04108|PR04_LYCES Pathogenesis-related leaf protein 4 precursor (P4) >gi|2119761|pir||S26238 pathogenesis-related
MKKVIIILALLAVAFAGFSDDCLYSHNQARSVLGLPKMTYSSKLASTALKYAKVLAGTNHLKHSSGRNNIGENLAMGTKGSYDTERLISLWTKEKKNYIPAKKFPNVSRTGNWKDVAHYTQIVWRNTKQVGCGTATNSKNIIIVCHYSGAGNWVGSYPY

SEQ ID NO: 3481 - DNA, 1154 bp, Glycine max
  misc_feature (1)..(1154): Ceres cDNA ID no. 21665741
  misc_feature (1)..(1154): Ceres CLONE  ID no. 530270
  misc_feature (1)..(1154): Also known as  Ceres CDNA ID no. 24361135
gagagaaccataaccaaagccatagccaccttcctgaaacccaattcctcaatagtttctcacccttctcttcatctactctttccaaaagaattgatgtataaagtctggtggcctctgatgtgatccccttttgatgtcaaataccagaagagaatgaaactatgattgattgacgttgttttgatttaacaaaagaattagtggaaaatgggaggttgctgttgttctgccagaaaacctcatctgcaaggggcaccagtgtattactattgcccaccaacttttgaagagcgtgagtctttaacatctaatgatggcttgaatgcttcagtcaatgctggatttcttgttggtttgaacctggaagcatccatgcctgatactttccagccccctcctgtgcctctaccttatgatatggtcttgggaggttctgcatcaacagattctgaatctggcagagaaacagttagtagttttgaaacttcaattacacttgaagatgttgaagaatcagattgtaaagctcaagccaattctgctcctacatctccaaagaaggcacaactatcaaaatcaaatgtaactcaagaattagtgacagaagaagaggatgtctgtccaatttgtcttgaagaatttgatgttgaaaatcctagaaatttgacaaaatgtgaacaccattttcacttatcatgcattcttgagtggatggaaagaagtgactcatgtcctatatgtgatcaggagatgatattttgaccagacaatgaattagtttgattgttctaaaatcaagcttgtaaaatgaatggaagatagatgaagatcattttatgataattggttagatgatggtagctacagattcattttcaattcgtggtgcattgacaaagtcttcattttagtaggcccaacctctagtcacgaggttttgacagaatgctaaaccatatgatatagcatatctgttcaaatgcaattcctttggtcagaatttgcccattattgttagtgaaaaaatgcagcaattctctagatgccaacattcattttcacagatgcatttttatttactgctctccattctcttgtaaaaaaattctcaatatttatttgtcttgcctaatttaaaaaaaaaaaaaaaa

SEQ ID NO: 3482 - protein, 184 aa, Glycine max
  misc_feature: PFam Name: zf-C3HC4; PFam Description: Zinc finger, C3HC4
  misc_feature: GI Number: 39104581; NR Description: putative RING-H2 finger
  misc_feature: GI Number: 42572783; NR Description: zinc finger (C3HC4-type RING finger) family protein [Arabidopsis thaliana] >gi|18411296|ref|NP_567171.1| zinc finger (C3HC4-type RING finger)
  misc_feature: GI Number: 21593116; NR Description: RING-H2 finger protein RHB1a [Arabidopsis thaliana] >gi|3790581|gb|AAC69853.1| RING-H2 finger protein RHB1a [Arabidopsis thaliana] >gi|11358782|pir||T51851 RING-H2 finger protein RHB1a [imported] -
  misc_feature: GI Number: 31430121; NR Description: putative RING-H2 finger protein RHB1a [Oryza sativa (japonica cultivar-group)] gi|37530980|ref|NP_919792.1| putative RING-H2 finger protein RHB1a [Oryza sativa (japonica cultivar-group)] protein RHB1a
  misc_feature: GI Number: 23505815; NR Description: At5g41350/MYC6_6 [Arabidopsis thaliana] >gi|15081801|gb|AAK82555.1| AT5g41350/MYC6_6 [Arabidopsis thaliana] >gi|18422087|ref|NP_568590.1| zinc finger
MGGCCCSARKPHLQGAPVYYYCPPTFEERESLTSNDGLNASVNAGFLVGLNLEASMPDTFQPPPVPLPYDMVLGGSASTDSESGRETVSSFETSITLEDVEESDCKAQANSAPTSPKKAQLSKSNVTQELVTEEEDVCPICLEEFDVENPRNLTKCEHHFHLSCILEWMERSDSCPICDQEMIF

SEQ ID NO: 3483 - DNA, 1577 bp, Glycine max
  misc_feature (1)..(1577): Ceres cDNA ID no. 21665742
  misc_feature (1)..(1577): Ceres CLONE  ID no. 534346
  misc_feature (1)..(1577): Also known as  Ceres CDNA ID no. 24360160
aactcatgttagttaaagtctcaaagaccactatcaactgaataagaaaagctgtgaactcgattctgtcaagctagctagctacctataattttggctttctgttcttagctgtgtttgtattggccagtatatgaactcttcatcaactcaactagtcctcacgaaaaggatgggtatatatgacccattccatcaagtgaacatgtggggggacagctttaaaattgatggaagcttgaactcaattgctccccaaatgttaatgattaagcctagcatgcagaacaagtctgaatgtactcctcacgaatcaagggaaccttctggagatgatcaagagactaatgaaaaagctgatactaaggcactaagacgtcaagctcaaaatcgcgaggctgctcggaaatgtcggctgcggaagaaggcttatgttcaacaattagaaacaagccgtgtgaagctcatgcaattggagttggagattgagaaagcaagaaagcagcagggtatgtacatacgtagtgcactagatgtcagctatatgggatcatccggaacaattaacccagggataactttgtttgaacttgaatatgcacaatggattgaagagcaagatagacagaatcaagaactgagaaatacattacaaactcaagcatctgaaatgcagcttcatctacttgttgagagttgcttgagccactactcaaatcttttcagaatgaaagcagaagctgcaaaggctgatgtcttctatttaatctctggtgcatggaaagcatcagtggaacgcctttttctttggattggaggatcccgtccatcacaacttctaaatatcattgcaccacagcttgagcctttgactgatcaacaaattgtgagcattaacaacctccggctttcatctcagcaagctgaagatgctctttcactaggattggacaaactccagcagagtctggtccacaacataccatcagatccattggctgtaggacactacgggtttgagatagctgctgccatggaaaaaggtgaagcactagaacgttttgtaaaccaggcagatcaccttaggcaacaaactctgattcacatgtctcggatcctgacaactgctcaagctgctaaaggcttgctggctatgggagaatactttcatcgtcttcgcacccttagttctttatggactgctcgttcatgtgatccttcctttcccactcaactctcaaactgatatctctttctttgaacctcaactgtaatgtggtttgcacaaataggtgttcaaatctacggagatctctgttttgtttaacatgttaatgtatatgcatgctagttattaatggtgcctagctagtaccatgaaggctgaagcaaagtttatatgatttgttgatctagagaacaaatgaaccactctgtacataaatattgtatcatcttccacatggaatcatgaaaaaggatttaggacaaccttgataaatttctctgcaaatacttgcgggaaaaaaaaagaaaaaatatttttcatctcttaaaagaaaaaaaaaaaaaaaaaa

SEQ ID NO: 3484 - protein, 370 aa, Glycine max
  misc_feature: PFam Name: bZIP_1; PFam Description: bZIP transcription factor
  misc_feature: GI Number: 44888358; NR Description: Transcription factor TGA3 (AtbZIP22) >gi|1076421|pir||S46523 transcription factor TGA3 - Arabidopsis thaliana >gi|18395068|ref|NP_564156.1| bZIP family transcription factor (TGA3) [Arabidopsis thaliana]
  misc_feature: GI Number: 15148922; NR Description: TGA-type basic leucine
  misc_feature: GI Number: 33589734; NR Description: At1g77920/F28K19_13 [Arabidopsis thaliana] >gi|16209663|gb|AAL14391.1| At1g77920/F28K19_13 [Arabidopsis thaliana] >gi|44888526|sp|Q93ZE2|TGA7_ARATH Transcription factor TGA7
  misc_feature: GI Number: 14586402; NR Description: bZIP50 protein [Arabidopsis thaliana] >gi|6573762|gb|AAF17682.1| F28K19.13
  misc_feature: GI Number: 25402956; NR Description: protein F2E2.14 [imported] - Arabidopsis thaliana >gi|9280681|gb|AAF86550.1|
MNSSSTQLVLTKRMGIYDPFHQVNMWGDSFKIDGSLNSIAPQMLMIKPSMQNKSECTPHESREPSGDDQETNEKADTKALRRQAQNREAARKCRLRKKAYVQQLETSRVKLMQLELEIEKARKQQGMYIRSALDVSYMGSSGTINPGITLFELEYAQWIEEQDRQNQELRNTLQTQASEMQLHLLVESCLSHYSNLFRMKAEAAKADVFYLISGAWKASVERLFLWIGGSRPSQLLNIIAPQLEPLTDQQIVSINNLRLSSQQAEDALSLGLDKLQQSLVHNIPSDPLAVGHYGFEIAAAMEKGEALERFVNQADHLRQQTLIHMSRILTTAQAAKGLLAMGEYFHRLRTLSSLWTARSCDPSFPTQLSN

SEQ ID NO: 3485 - DNA, 1154 bp, Glycine max
  misc_feature (1)..(1154): Ceres cDNA ID no. 21665743
  misc_feature (1)..(1154): Ceres CLONE  ID no. 539478
  misc_feature (1)..(1154): Also known as  Ceres CDNA ID no. 24359974
gaactgaagaagctcacacgtacatctatcactccccccaaacccacaccgttttattctctcaaatgggtcttgatcaggatgccaatagctcaggccttcacctcgttctagggctttctttgactgctagtgttaaggaaaccgctccgtccaccaagcccgatgatcatcatctttgtgttatcaagccaactccaacgaaaccttatccttccaaagaaccgtctttgacgttggggctgtccggtaagggttaccacgtgcccagaaataacgttgccatcaacaaggtttattgtgaggaccctcttgagttctctagacagacatcacctcacagtgttgtttcgtctttctcaactgggagggtcatcaagagggagagagatcttagctgtgaagacatggaggtagacgcagaagaaagggtttcttcacgagtgagtgatgaagacgaagatggaaccaatgctagaaagaagctcagactcaccaaagaacaatctgcactgctagaagagagcttcaaacaacacagcactctcaaccccaaacagaagcaagctttagccaggcagttaaatctccggcctcgacaagttgaagtgtggttccagaatcggagagccagaacaaagctgaagcaaacggaggtggactgtgagttcttaaagaaatgctgtgaaacattgacggacgaaaacaggaggctaaagaaggagctgcaagagctgaaggcactgaaactagctcaacccttgtacatgcctatgcctgctgccacactcaccatgtgcccttcttgcgagaggctcggtggcgttagcgataacggttcgaataaaagccccttctccatggctcccaagcctcacttctataaccccttcgccaatccttctgcagcatgttgattattgtggttaggttttcactcttctataaaaaagacaagagttatttcccacaaccattgtatttttttggttgagggcgatgcgtctagccagggaaaattaagctgtaattagctaatactgttgagagtagtaactgctgattgaaattacctttttctttttcttcatctattgtatgtttatataaaccgttatagaaggtgttcatctacgaaaaaaaaaaaaaaaaaa

SEQ ID NO: 3486 - protein, 283 aa, Glycine max
MGLDQDANSSGLHLVLGLSLTASVKETAPSTKPDDHHLCVIKPTPTKPYPSKEPSLTLGLSGKGYHVPRNNVAINKVYCEDPLEFSRQTSPHSVVSSFSTGRVIKRERDLSCEDMEVDAEERVSSRVSDEDEDGTNARKKLRLTKEQSALLEESFKQHSTLNPKQKQALARQLNLRPRQVEVWFQNRRARTKLKQTEVDCEFLKKCCETLTDENRRLKKELQELKALKLAQPLYMPMPAATLTMCPSCERLGGVSDNGSNKSPFSMAPKPHFYNPFANPSAAC

SEQ ID NO: 3487 - DNA, 1220 bp, Glycine max
  misc_feature (1)..(1220): Ceres cDNA ID no. 21665744
  misc_feature (1)..(1220): Ceres CLONE  ID no. 544072
  misc_feature (1)..(1220): Also known as  Ceres CDNA ID no. 24426091
gactccttctggtcactcttgggagaagaggtcgagtttcacagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagcttgatgcagaggttcatcggaaatatgtttttggtggacatgttgctgcctatatgaagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgagtgaaagttcattgcagatgccttctcatggctacactagtagaaactatcttatttggtatctacagaatcattttcttgaaaatttatttgcctgcctgtttatttctaggcccaaaatttggatactttttttggagttgagtaagccttaattttggtcaatttcgggttagtttgaatttgaagttttaccttgtttttatggttcactactttcactcgagcaatgttcgtataaaatcagtttttgttaacgtaaaaaaaaaaaaaaaaaa

SEQ ID NO: 3488 - protein, 298 aa, Glycine max
  misc_feature: PFam Name: Ribosomal_L18p; PFam Description: Ribosomal
  misc_feature: GI Number: 34484312; NR Description: 60S ribosomal protein L5
  misc_feature: GI Number: 30984512; NR Description: At5g39740 [Arabidopsis thaliana] >gi|10177974|dbj|BAB11380.1| 60S ribosomal protein L5 [Arabidopsis thaliana] >gi|20260448|gb|AAM13122.1| ribosomal protein L5 - like [Arabidopsis thaliana]
  misc_feature: GI Number: 30984510; NR Description: At3g25520 [Arabidopsis thaliana] >gi|30103105|gb|AAO73340.1| ribosomal protein L5 [Arabidopsis thaliana] >gi|23198406|gb|AAN15730.1| putative ribosomal protein [Arabidopsis thaliana]
  misc_feature: GI Number: 21592804; NR Description: ribosomal protein,
  misc_feature: GI Number: 56785265; NR Description: putative ribosomal
MVYVKAQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKNVHAAIRADPTLKKSDKQTPKEHKRYNLKKLTYEERKAKLISRVAALNSAADNDEDDE

SEQ ID NO: 3489 - DNA, 1276 bp, Glycine max
  misc_feature (1)..(1276): Ceres cDNA ID no. 21665745
  misc_feature (1)..(1276): Ceres CLONE  ID no. 546002
  misc_feature (1)..(1276): Also known as  Ceres CDNA ID no. 23691216
agctaaagcgcacacatcactcctcactcactcggcggcacacacaaaaccctttctcagtcactcactcggcaaagagaagcgtcgacggtctgcacggtgggtgcttcatcgacggcagcgacctgtggcggaggacagggttcccttcgctcttggagttcgcatcgggcagagaagcttctctgcattgcgctgggacgcaaaaccctggcagcaatcagcaccacggcgcagccgcacacctctgagacgccaccgcaatcaggatgagtgaacttctttttgatgacattttcaaggtcgagaaggtagaccctgatggtaaaaagtatgacaaggtttctcggattgtggcacggagtgagaagtgtgacatgaacatgcttctagatgtaaataccgagatttatccaatgggggaaaaagaaagattcttgatggctttgtctccttcacttgttttgaatactaaggatggttcagtgtcaattcaagacaagtttgaatacatcatgcacgggaggttatataacattacgaaacctcagcttgaaaagaaagaaaagaaagagaaacgttcagaatctcagcctgaagagaatgaggaatgttcaaaacctcagcttgaagtggaggtatatgcatcgtttggtgggcttcagttgatgctgaaaggacatgcttcccactgtgttaagtttgcagtcgatcagaagttgtttttacttataaggaaggttgaaagttgatgttggtgatgggcctgaaaagaaaaacatgctagcattaagttttaagtaatctgtataaaataaattgatttttcagaagaatgatttttgtgttttgaaagtttctctgaagttagttttttggtacattagataatttttaggcattctcttatatttattaaactgaaatatttttgccatatatatataaggaatcaacttacattaagaataactcttttagagtttcttttcattctcttcattcatttttaaaaatctaatgattgtaatgtcattaattttatctgttagattacaagaaaatgaagataaggatgaagtgtagctctaaaagagttagttagtgtaagttgatccccctttctctattttttaattggtaggaatctaaaatggtatcaaaagggttataatagtcgtatatcattttcaattaattaagttagacccttctctatatgtgttattaggaatctgtaatttatattttcattataaaaaaaaaaaaaaaaaaa

SEQ ID NO: 3490 - protein, 160 aa, Glycine max
  misc_feature: PFam Name: RNA_pol_Rpb8; PFam Description: RNA polymerase Rpb8
  misc_feature: GI Number: 53793231; NR Description: putative RNA polymerase I, II and III 16.5 kDa subunit [Oryza sativa (japonica
  misc_feature: GI Number: 50920087; NR Description: putative RNA polymerase [Oryza sativa (japonica cultivar-group)] >gi|29244685|gb|AAO73277.1| putative RNA polymerase [Oryza sativa (japonica cultivar-group)] >gi|41469638|gb|AAS07361.1| putative
  misc_feature: GI Number: 4585968; NR Description: RNA polymerase I, II and III 16.5 kDa subunit [Arabidopsis thaliana] >gi|21555812|gb|AAM63939.1| RNA polymerase II subunit, putative [Arabidopsis thaliana] >gi|28466897|gb|AAO44057.1| Arabidopsis
  misc_feature: GI Number: 60470212; NR Description: RNA polymerase II core
  misc_feature: GI Number: 31239495; NR Description: ENSANGP00000011232 [Anopheles gambiae] >gi|21288037|gb|EAA00358.1| ENSANGP00000011232
MSELLFDDIFKVEKVDPDGKKYDKVSRIVARSEKCDMNMLLDVNTEIYPMGEKERFLMALSPSLVLNTKDGSVSIQDKFEYIMHGRLYNITKPQLEKKEKKEKRSESQPEENEECSKPQLEVEVYASFGGLQLMLKGHASHCVKFAVDQKLFLLIRKVES

SEQ ID NO: 3491 - DNA, 1301 bp, Glycine max
  misc_feature (1)..(1301): Ceres cDNA ID no. 21665746
  misc_feature (1)..(1301): Ceres CLONE  ID no. 547127
  misc_feature (1)..(1301): Also known as  Ceres CDNA ID no. 24402068
gagcatctatacattaaatactcaaattctgtggtaggtagtgatagtagatgggatcagtggaaagatcaagaaagaaagtcatgtcatggaagaaagccatggtgcatttttctctctgttttgtgatggggttcttcacaggctttgctcctacaggtaaatctatatttcacagccatgttgattattcaaataggtcagagtttgcaccacaacctattgaagtgtcacagaagacaacaaatgtcaatagaagttggatagctccaacaccaaggtctttagtccacaagcaaaaattgcatgtaaaaatagggccccagttgaagcctagaagacttataatcattgtaactccaacaagcacaaaacttcccttccaaacagtgattttggcaaggctggcaaacactataaagctggttcctcaacccttgctgtggattgttgtggaagggcaaactgattccacagaactttctaagacacttaggaagactggcatcatgtataggcatttggtttcaaaggaaaacttcacggacttggaagctgaactgaatcaccagagaaatcttgcactcaagcacattgtgcatcacaggctaagtgggatcgtacactttgctgaactttccaatgtttatgatctcgaattcttccaacaactaagatatattgaggtatttggaacatggccaacggcatcgttagcagcaaacaggaagaaagtgatgatagaaggacctgtgtgtgattcttcaaaagtcatagggtggcatttaaggaatatgaacaatgaaactgatataattactcctccgattcatatttcaagttttgcattcaatagctccattctctgggaccctgagagatggggtcgcacttcctctcttcaagacacctctcagaattcaatcaaattcgtgaaggaagtagttcttgaggatcaagaaaagttgaggggaattcctccagaggattgctccagaatcttgctttggcgtttcaattttcatgctcgcaccacttcaaatcataaatttccgactactgcatctggtgttatccgaaaataatgggaaataaacagaaaataatgtatagcaaaatattcaacttccctacaccaggaatttattcattattttttacttgtacaaatttctcctgtgtgcttataattttatacgtccctgctattttcacaagtttttttagcttctataagtgtaactgtgtaagttctgatgggaagcaaaaacattttatcatataaaaaaaaaaaaaaaaaa

SEQ ID NO: 3492 - protein, 1301 aa, Glycine max
  misc_feature: PFam Name: Glyco_transf_43; PFam Description:
  misc_feature: GI Number: 61673388; NR Description:
  misc_feature: GI Number: 60657596; NR Description: secondary cell wall-related glycosyltransferase family 43 [Populus tremula x
  misc_feature: GI Number: 60657594; NR Description: secondary cell wall-related glycosyltransferase family 43 [Populus tremula x
  misc_feature: GI Number: 63087726; NR Description: glycosyltransferase
  misc_feature: GI Number: 33771692; NR Description:
GAGCATCTATACATTAAATACTCAAATTCTGTGGTAGGTAGTGATAGTAGATGGGATCAGTGGAAAGATCAAGAAAGAAAGTCATGTCATGGAAGAAAGCCATGGTGCATTTTTCTCTCTGTTTTGTGATGGGGTTCTTCACAGGCTTTGCTCCTACAGGTAAATCTATATTTCACAGCCATGTTGATTATTCAAATAGGTCAGAGTTTGCACCACAACCTATTGAAGTGTCACAGAAGACAACAAATGTCAATAGAAGTTGGATAGCTCCAACACCAAGGTCTTTAGTCCACAAGCAAAAATTGCATGTAAAAATAGGGCCCCAGTTGAAGCCTAGAAGACTTATAATCATTGTAACTCCAACAAGCACAAAACTTCCCTTCCAAACAGTGATTTTGGCAAGGCTGGCAAACACTATAAAGCTGGTTCCTCAACCCTTGCTGTGGATTGTTGTGGAAGGGCAAACTGATTCCACAGAACTTTCTAAGACACTTAGGAAGACTGGCATCATGTATAGGCATTTGGTTTCAAAGGAAAACTTCACGGACTTGGAAGCTGAACTGAATCACCAGAGAAATCTTGCACTCAAGCACATTGTGCATCACAGGCTAAGTGGGATCGTACACTTTGCTGAACTTTCCAATGTTTATGATCTCGAATTCTTCCAACAACTAAGATATATTGAGGTATTTGGAACATGGCCAACGGCATCGTTAGCAGCAAACAGGAAGAAAGTGATGATAGAAGGACCTGTGTGTGATTCTTCAAAAGTCATAGGGTGGCATTTAAGGAATATGAACAATGAAACTGATATAATTACTCCTCCGATTCATATTTCAAGTTTTGCATTCAATAGCTCCATTCTCTGGGACCCTGAGAGATGGGGTCGCACTTCCTCTCTTCAAGACACCTCTCAGAATTCAATCAAATTCGTGAAGGAAGTAGTTCTTGAGGATCAAGAAAAGTTGAGGGGAATTCCTCCAGAGGATTGCTCCAGAATCTTGCTTTGGCGTTTCAATTTTCATGCTCGCACCACTTCAAATCATAAATTTCCGACTACTGCATCTGGTGTTATCCGAAAATAATGGGAAATAAACAGAAAATAATGTATAGCAAAATATTCAACTTCCCTACACCAGGAATTTATTCATTATTTTTTACTTGTACAAATTTCTCCTGTGTGCTTATAATTTTATACGTCCCTGCTATTTTCACAAGTTTTTTTAGCTTCTATAAGTGTAACTGTGTAAGTTCTGATGGGAAGCAAAAACATTTTATCATATAAAAAAAAAAAAAAAAAA

SEQ ID NO: 3493 - DNA, 1618 bp, Glycine max
  misc_feature (1)..(1618): Ceres cDNA ID no. 21665747
  misc_feature (1)..(1618): Ceres CLONE  ID no. 548670
  misc_feature (1)..(1618): Also known as  Ceres CDNA ID no. 24360023
gagagtttcatgtttcacagtcccatccctgctcacactgctccagtgctacttcctcttccatcacataaaaccctagtaaatccaattggggatttttttttctagaagaggattgaaagtgaaaaaaaggaaataacaaaatgaagaatattcctctgattctaatgggttgtggaggagttggtcgtcaacttctccaacacattgtctcgtgtcgttctcttcactttacacaggggctgtgcttgagagttgtaggagtcggtgatagtaaatctttggtggttacggaggatttgctgcatgaggggttgaatgatggcttcttgttagaactttgccgggtcaagagtgtcggcgaatctctattaaaacttcttgattttgggaaatgccaggcatttgtgcatccggagtcacaaggaaagattctagagattgcatttcaacttggtaaaaagacaggtttggtatttgtagattgctctgctagctctgacactgttgcggtgctaaagcaagcgattgatatgggttgttgtgctgttatggcaaataagaagcctcttacatctacaatggaggattttaaaaaacttttcatctatccacgtcgtattcggcatgagtcaactgtaggcgctggtcttcctgtgatagcatcactgaatcgcataatctcttctggtgatcccgttcatcaaattattgggagtttgagcgggacattgggttatgtaatgagtgaggttgaagatggaaagccattgagccaagttgttagagatgctaaaagtttggggtatactgaaccagatccacgtgatgaccttggtggaatggacgtcgctagaaaggctttaatacttgctcgaatacttggccatcaaattaatctggatagcattcagattgagagcttgtatcccaaagaaatggggcctggcgtaatgactgttgaagacttcttgaaccgtggactcttgttgcttgataaagatattcaagatagagttgagaaggcagcttcaaatggaaatgtgttgcgctatgtctgtgtgatcatgggttcaaggtgtgaagttggtattcaggagcttccaaagaattctcccttgggaagactaagaggaagtgataatgtgttggaaatatatactcgatgctatagtaaacaaccactggttattcaaggtgctggagctggaaatgacactactgctgctggggttcttgctgatatcgtagatattcaagacttatttccttgaagggaaatttttgtgagccatcctaattaaagaatgtagaaggtacagctgctaaaggtcttgccctggattgtagctgatgcgcgtttctctttggttgtgcattgtgaaagattggatacacattgttctgaagcaagaataaataagtagcttttatgttttttgggatatttgacatgaaatttgtgtaaacgtccatgcagaaccagacacactgaaataaaatgaattctgcatttcacctgtgtattttactgtacagggtgttcatcactatttgtaataggttaaaggtacaagattaatgaaaggaatttctaatgaaaaaaaaaaaaaaaaaa

SEQ ID NO: 3494 - protein, 376 aa, Glycine max
  misc_feature: GI Number: 22135828; NR Description: At1g45200 [Arabidopsis thaliana] >gi|25090355|gb|AAN72283.1| At1g45200/At1g45200 [Arabidopsis thaliana] >gi|42571769|ref|NP_973975.1| lipase class 3
  misc_feature: GI Number: 50913119; NR Description: lipase class 3-like [Oryza sativa (japonica cultivar-group)] >gi|46806075|dbj|BAD17323.1| lipase class 3-like [Oryza sativa
  misc_feature: GI Number: 42568828; NR Description: lipase class 3 family
  misc_feature: GI Number: 15223573; NR Description: lipase class 3 family
  misc_feature: GI Number: 51090505; NR Description: lipase class 3-like
MKNIPLILMGCGGVGRQLLQHIVSCRSLHFTQGLCLRVVGVGDSKSLVVTEDLLHEGLNDGFLLELCRVKSVGESLLKLLDFGKCQAFVHPESQGKILEIAFQLGKKTGLVFVDCSASSDTVAVLKQAIDMGCCAVMANKKPLTSTMEDFKKLFIYPRRIRHESTVGAGLPVIASLNRIISSGDPVHQIIGSLSGTLGYVMSEVEDGKPLSQVVRDAKSLGYTEPDPRDDLGGMDVARKALILARILGHQINLDSIQIESLYPKEMGPGVMTVEDFLNRGLLLLDKDIQDRVEKAASNGNVLRYVCVIMGSRCEVGIQELPKNSPLGRLRGSDNVLEIYTRCYSKQPLVIQGAGAGNDTTAAGVLADIVDIQDLFP

SEQ ID NO: 3495 - DNA, 1420 bp, Triticum aestivum
  misc_feature (1)..(1420): Ceres cDNA ID no. 21665748
  misc_feature (1)..(1420): Ceres CLONE  ID no. 555268
  misc_feature (1)..(1420): Also known as  Ceres CDNA ID no. 24361290
tgatgacagctaggctctgcatatccaaatcaaaccaaaatatggcattacacgaaagcagccaatagagtgcattaccaataagggtcgcgggaacactatcaccatggagctcgcatggatactttgttgatatgatattgctccatgtgtcagtctccgaggaaaaaacacaggcgagtggttgatgatctcttctgtgggacaccaagacaaccttgaaagggctgcaatgacagtggccgtgcacatgatcctgctcgccagcagcacagagcatcgccccgtagaggatggacggcggcccgaattcggcaggaacagccaggtagcgctgctccccggtgatgggggcgaacacaataagctgcctgaatacccggtgtaaggcgagcacgcggccgccacggcaccccaaaacttcaaagccgcgggaggccatgccgaacgggatgtggatgcgctcagcagggatacggtcgggagggtgcaggatgtcctggttgaacacgatcttccgtcggcgctcgaagaagccgagcaggggcggcttccagctcctgcggcgggcttggaactggcagatgaagttggggtcggtggccaggcctcgccagcgcctggagaccaaggatgcgagcaggcgggacgacggctgtgggggcagaaggagaaggatctcccaaagcatatccaacggcagcgactcgcacggggcgggcggacgacggccgtcgttccgcggcgtatcgccgtcgcccggcagagggacaggcgcctccggagagttgcggcggcggcggcggcggcgatcctcgctcgccccgattcgggagcggcggcggcgaccgggggggaccagccccccgtcctcctcgcttgccccgatttgggagcggctacggcgaccggggcgggtcaccccgatctgggagcggcggcgactgcggcgagtgccgggcatttcggcggcctcctcgctcgcgccgatttgagaacggctgcggcggcggccgcctggggaaaccccgtggtaggttttcattctggtggcggtttttattcggtcatagacgactccggcgagctttcacggcggcccgttcaatcgggcgccgccaaggtggtgggtaggggttagggttttcttttccgttccaaggggatgacactgctaccaagttctactctggaggccccacctgaagactagctgcgccgttgtcttgctgggccaaagacccacaacaccctgaaagcaagttgagacaattatctccaggtttggcctcattttggaggattttcatagaaaaacacaaaaacaaggatagatgcattcggttttgtaagaaatgcttacaggaatttagtggaaatactattcattttctgtgtttttaggaaaaaaaaaaaaaaa

SEQ ID NO: 3496 - protein, 215 aa, Triticum aestivum
  misc_feature: PFam Name: GRP; PFam Description: Glycine rich protein family
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 9453857; NR Description: EBNA-1 [Cynomolgus
MGANTISCLNTRCKASTRPPRHPKTSKPREAMPNGMWMRSAGIRSGGCRMSWLNTIFRRRSKKPSRGGFQLLRRAWNWQMKLGSVARPRQRLETKDASRRDDGCGGRRRRISQSISNGSDSHGAGGRRPSFRGVSPSPGRGTGASGELRRRRRRRSSLAPIRERRRRPGGTSPPSSSLAPIWERLRRPGRVTPIWERRRLRRVPGISAASSLAPI

SEQ ID NO: 3497 - DNA, 1926 bp, Triticum aestivum
  misc_feature (1)..(1926): Ceres cDNA ID no. 21665749
  misc_feature (1)..(1926): Ceres CLONE  ID no. 555401
  misc_feature (1)..(1926): Also known as  Ceres CDNA ID no. 24360245
ctataatttttcccacaaaatcgtcccaattctctccatgccaatctcacctcgcactgctctcctttcgatcccgacgaaagagggagcgcccgcggcaccaaacgactatggggatttggagggggtcgctgccgctgcttctgctcgccgccgcggcggcggctgagccggcgtcgacgctggagggaccgtcgtggccggtgacggtgccgctgcgggaagacaggggccacgcggtggacctgccggacacggacccccgggtgcagcgtcgggtcacaggctgggctcccgagcagatcgccgtcgcgctctccgccgctcccacctccgcctgggtctcctggatcacaggggatttccagatgggcggcgccgtcaaaccgctggaccccggcacggtcggcagcgtcgtgcgctacggcctcgccgccgattctttggtccgcgaggccaccggcgacgcgctcgtgtacagccagctctaccccttcgagggcctccagaactacacctccggcatcatccaccacgtccgcctccaagggcttgagcctgggacgaagtactactaccagtgcggcgacccagccatcccgggtgcgacgagcgccgtgcacgcgttccggacgatgccggccgtcgggccgcggagctacccggggaggatcgccgtggtcggggacctcgggctcacgtacaacaccacctcgaccgtggagcacatggcgagcaaccagcccgacctggtcctcctcctcggcgacgtgagctacgccaacctgtacctgaccaacggcaccggaacggactgctactcctgctcgttcgccaagtccacccccatccacgagacgtaccagccgcgctgggattactgggggaggtacatggagtccgtgacgtcgaccacgccgatgatggtggtcgaagggaaccatgagatcgagcagcagatcggcaacaagacgttcgcggcttacagcgcgcggttcgcgttcccgtccaaagagagcgactccttctcccccttctactactcgttcgacgctggcggcatccatttcatcatgctcgctgcctacgctgcctacagcaaatcaggagagcagtacagatggttggagaaggacctggcaaaggtggacagatcggtgaccccgtggctggtcgccgggtggcacgcgccatggtacagcacctacaaggctcactacagggaggcagagtgcatgagagtggccatggaggagctgctctactcctacggcctcgacatcgttttcaccggccatgtgcacgcgtacgagcgctccaaccgggtgttcaactacacgctggacccgtgcggcgccgtgcacatctcggtgggcgacggcgggaaccgcgagaagatggccaccacccacgccgacgacccagggcgctgcccggagccactgtccacgcctgacgacttcatgggcggcttctgcgccttcaacttcacgtccgaccccgccgccggcagcttctgctgggaccggcagccggactacagcgcctaccgggagagcagcttcggccacggcattctcgaggtgaagaatgagacgcacgctctgtggaaatggcacaggaaccaggatctgtatcaaggtggtgtcggagatgagatttatatcgtccgggagccggaaagatgcctgctcaaatccagcatagcggcatacttttgatctaacactagccaaatcaaattcacgtgtataatgtgtagtactagctggtaggtactttgacctgtggtccaagcgaactctctattctttcacgagctctctgcgagctctgacgagattaagataggttgagatttgtggggtagcatgaaagacttgtgatctagtatcagtctatacactgacaaaaaaaaaaaaaaaa

SEQ ID NO: 3498 - protein, 536 aa, Triticum aestivum
  misc_feature: PFam Name: Metallophos; PFam Description: Calcineurin-like
  misc_feature: GI Number: 13925771; NR Description: phytase [Glycine max]
  misc_feature: GI Number: 42571023; NR Description: purple acid phosphatase
  misc_feature: GI Number: 50920095; NR Description: putative phytase [Oryza sativa (japonica cultivar-group)] >gi|28269395|gb|AAO37938.1| putative phytase [Oryza sativa (japonica cultivar-group)] >gi|29244681|gb|AAO73273.1| putative phytase [Oryza sativa
  misc_feature: GI Number: 50943425; NR Description: putative phytase [Oryza sativa (japonica cultivar-group)] >gi|37806076|dbj|BAC99527.1|
  misc_feature: GI Number: 25229114; NR Description: putative purple acid phosphatase [Arabidopsis thaliana] >gi|6642652|gb|AAF20233.1| putative purple acid phosphatase [Arabidopsis thaliana] >gi|15231398|ref|NP_187369.1| serine/threonine protein
MGIWRGSLPLLLLAAAAAAEPASTLEGPSWPVTVPLREDRGHAVDLPDTDPRVQRRVTGWAPEQIAVALSAAPTSAWVSWITGDFQMGGAVKPLDPGTVGSVVRYGLAADSLVREATGDALVYSQLYPFEGLQNYTSGIIHHVRLQGLEPGTKYYYQCGDPAIPGATSAVHAFRTMPAVGPRSYPGRIAVVGDLGLTYNTTSTVEHMASNQPDLVLLLGDVSYANLYLTNGTGTDCYSCSFAKSTPIHETYQPRWDYWGRYMESVTSTTPMMVVEGNHEIEQQIGNKTFAAYSARFAFPSKESDSFSPFYYSFDAGGIHFIMLAAYAAYSKSGEQYRWLEKDLAKVDRSVTPWLVAGWHAPWYSTYKAHYREAECMRVAMEELLYSYGLDIVFTGHVHAYERSNRVFNYTLDPCGAVHISVGDGGNREKMATTHADDPGRCPEPLSTPDDFMGGFCAFNFTSDPAAGSFCWDRQPDYSAYRESSFGHGILEVKNETHALWKWHRNQDLYQGGVGDEIYIVREPERCLLKSSIAAYF

SEQ ID NO: 3499 - DNA, 1501 bp, Glycine max
  misc_feature (1)..(1501): Ceres cDNA ID no. 21665751
  misc_feature (1)..(1501): Ceres CLONE  ID no. 562984
  misc_feature (1)..(1501): Also known as  Ceres CDNA ID no. 23693410
aggaaagaaaagaaaaacatggttggtgaaggagaaaagccgaaggcagtgataataggaggtagcatagcagggatatcaagtgcacatgctctcaccttagctggttgggatgtacttgtgcttgagaaaaccacctcacctccaactggaagccccactggtgcaggtcttggactcaattctttgtcccaacaaatcatccactcttggcttccaccacaccaaaaacaactccttcacaacaccactttaacactcaccattgatcagaaccatgcaactgatagtgagaagaagtttagctggacattgacaagagatgagagttttaacttcagagcagcacattgggctgatctccatggccttctgtacaatgcactgccaccaaatgtatttttgtggggtcacctttttctctcagtccatgttgctgatgataagggttcagtcatagtaaaggctaaagtactagaaactggcaagattatagagatagtaggggattttcttgttgcggcagatggttgtctctcttccctccgccagaaatatctccccgattttaaactcagatattctggctattgtgcttggagaggggttcttgatttttcaaaaattgagaattcagaaaccatcaatggtatcagaaaggcataccctgatctaggaaaatgcttgtactttgacttggcctctggcacacacactgtgttgtatgagctgcaaaacaagaagctcaattggatttggtatgtgaatcagcctgagcctgaagttaagggaacatcggtgacaatgaaagtaaacaatgacatgatccagaaaatgcaccaagaagcggaacaagtttggattcctgagttggtaaaggtcataaaggaaacaaaggaccctttcttaaatttcatatatgatagtgatcccttagagaagatcttttgggacaatgtggtattggtaggggatgcagctcaccccacaactcctcactgccttagaagcactaacatgtcaatattggatgcagcagtgttaggcaaatgcatagagaagtggggaccagaaaagcttggatcagctttagaagagtatcagttcgttaggctaccagtcacttccaaggaagttctgtactcaaggcgtcttggccgattgaaacaagggctagttctacctgatagagaaccttttgacccaaagttaattaggccagaggactgccaggagcttctactgaggaacacaccattttttaatgatgagccgttgtcactgctttgataccatcttacatttcttcatctgattgcttatagcagtgagttttatgactgctttgaaaatagatgtcttacttagcaccatccatacatctgtttgcacactgataatattttggaccctttcccataactgatttggtgccttttggcctcaaatttttgtttttgctattaatagttttatcatcaaaaaaaaaaaaaaaaaaaaa

SEQ ID NO: 3500 - protein, 423 aa, Glycine max
  misc_feature: PFam Name: FAD_binding_3; PFam Description: FAD binding domain
  misc_feature: PFam Name: DAO; PFam Description: FAD dependent oxidoreductase
  misc_feature: GI Number: 46311681; NR Description: COG0654: 2-polyprenyl-6-methoxyphenol hydroxylase and related FAD-dependent
  misc_feature: GI Number: 33601729; NR Description: putative monooxygenase [Bordetella bronchiseptica RB50] >gi|33576166|emb|CAE33245.1|
  misc_feature: GI Number: 46319756; NR Description: COG0654: 2-polyprenyl-6-methoxyphenol hydroxylase and related FAD-dependent
  misc_feature: GI Number: 48787285; NR Description: COG0654: 2-polyprenyl-6-methoxyphenol hydroxylase and related FAD-dependent
  misc_feature: GI Number: 46314234; NR Description: COG0654: 2-polyprenyl-6-methoxyphenol hydroxylase and related FAD-dependent
MVGEGEKPKAVIIGGSIAGISSAHALTLAGWDVLVLEKTTSPPTGSPTGAGLGLNSLSQQIIHSWLPPHQKQLLHNTTLTLTIDQNHATDSEKKFSWTLTRDESFNFRAAHWADLHGLLYNALPPNVFLWGHLFLSVHVADDKGSVIVKAKVLETGKIIEIVGDFLVAADGCLSSLRQKYLPDFKLRYSGYCAWRGVLDFSKIENSETINGIRKAYPDLGKCLYFDLASGTHTVLYELQNKKLNWIWYVNQPEPEVKGTSVTMKVNNDMIQKMHQEAEQVWIPELVKVIKETKDPFLNFIYDSDPLEKIFWDNVVLVGDAAHPTTPHCLRSTNMSILDAAVLGKCIEKWGPEKLGSALEEYQFVRLPVTSKEVLYSRRLGRLKQGLVLPDREPFDPKLIRPEDCQELLLRNTPFFNDEPLSLL

SEQ ID NO: 3501 - DNA, 1234 bp, Glycine max
  misc_feature (1)..(1234): Ceres cDNA ID no. 21665752
  misc_feature (1)..(1234): Ceres CLONE  ID no. 567052
  misc_feature (1)..(1234): Also known as  Ceres CDNA ID no. 24360178
attttttctttctttcccttctctctatgcctgcttccatctgcttatgaaaaagacttttacctacgccatcctatcttatcaaaagcaaaatcatattagtctatttgcaattttcgccgcaacgtcaaaatttttaagatctctaccatcgtaacgcagttacaattgtgactacattagtgagtaatttctcacgaatcaaagatcgctaccaaatttcaattgcaactgcaatttaaaggatcaggattgttactagttatacattaatgtcttccaacaagaggaggttcatgagagccctattcaaagcaaatggaggctgtgggtgtagcaaaccgaaatcctctgacgtacacgaacccaccccaaaacccaaaatctccatttaccaaaacacaaaaactagcagcctcaattcatccaccacttccggtgaccgcaacgaggacgacgaagtcttcacttccaccaccatctccgaatccgacacaaatcatcaaaaccccaacaacaacaacatgccaaaacctagcccaaaactcgttgacagcatcgccgtcgagaaggactcaaacgacccacataaggattttcgagcctccatactccaaatgatcctggagagagagatctacacagaaaccgaactccaagagcttctcgagtgcttcctccagctgaacgccacgtgccaccaccaagtcatcgttcaagccttcatggagatctgcgaagaagtgttcccgaagaagaacatcgtcagtggtggtggcgctcctgaacaacgtcgcaggaaccagatcacgcgaaagagtcggtgaatgttgttgatgctagctaggtcaaccgtgaacgatcgtatgtgtgaaagccacgtgaaggcgttgaattcgcacgtgggatgaagctgcatggaaacgtcacggtttcaaactgatctattaaatcttatcgtattcattctctctcatttattcgttttatctaacggttcaaaatttattgaggttttgcgggatttgagatttcaaatttatatgtcaaagataaagagggaaattcaagtataaatatcgcaagaatgaaggatgtaaatactagtttagtatatcattctttagaatgactttaatttgatgcatttgtaactgtaaagctctcgcctctcgttgacttatgtaatggcagaattcattaaaaaaaaaaaaaaaaaaaaaaaaaaaaaaaa

SEQ ID NO: 3502 - protein, 184 aa, Glycine max
  misc_feature: PFam Name: Arv1; PFam Description: Arv1-like family
  misc_feature: PFam Name: Nsp1_C; PFam Description: Nsp1-like C-terminal region
  misc_feature: GI Number: 22331750; NR Description: ovate protein, putative
  misc_feature: GI Number: 15241148; NR Description: ovate protein, putative
  misc_feature: GI Number: 23429649; NR Description: ovate protein
  misc_feature: GI Number: 32488495; NR Description: OSJNBa0011J08.2 [Oryza
  misc_feature: GI Number: 57900260; NR Description: ovate family
MSSNKRRFMRALFKANGGCGCSKPKSSDVHEPTPKPKISIYQNTKTSSLNSSTTSGDRNEDDEVFTSTTISESDTNHQNPNNNNMPKPSPKLVDSIAVEKDSNDPHKDFRASILQMILEREIYTETELQELLECFLQLNATCHHQVIVQAFMEICEEVFPKKNIVSGGGAPEQRRRNQITRKSR

SEQ ID NO: 3503 - DNA, 1307 bp, Glycine max
  misc_feature (1)..(1307): Ceres cDNA ID no. 21665753
  misc_feature (1)..(1307): Ceres CLONE  ID no. 567087
  misc_feature (1)..(1307): Also known as  Ceres CDNA ID no. 24426699
gtgtccttgccggttcgtgcagaaaggtccattgcattgcagtgtaagtatttacaaagcaaagcgaagcaagcattcactgaatgcgctctatctctctctttcgatctgggtactaaccctaacccgcttcgaaccgtggcttcctcaggctcgcagaacctctctcgaagaaaaccttcttcttcttcgtcttcgtcttctcaacaaacacccgggtcgacccggatcgtttaccgagaatctcggatcccatcggaatccgatttcccgatctggcagcagaactggttcatcgcattgctcttcgtcatggctctcggattcttcgccctcgccattttcctcttcctcactctcgactctgacatcgctccttcttccaccgcctccgcctccgcctccgccgcttcctccgaaggcgtcgaggtgcaggttacttacggcacggttctgaagcttatgcacgagaagaccaaatttcggttgcattctcatgacgtgccctacggttctggcagtggacaacaatcggttactggtttcccaaatgtcgacgattccaatagttactggattgtaagacctgagccaggaacttctgctaaacaaggtgaccccattaaaagtggcacaatcattagattgcagcacatgagaacaaggaagtggctgcacagccatttgcatgcatccccgatatcaggcaatcttgaggtcagttgttttggaggagaatccgaatctgacaccggggactattggaagcttataatagaaggaagtggaaagacttggaagcaggatcagaggattcgccttcagcatattgacactggaggctatctacatagtcatgataagaaatacagtcgtattgctgggggtcagcaggaggtttgtggtgttcgtgaaaagcgtgctgacaatgtgtggttggcagccgaaggtgtctaccttcccgttacggaaagcaaatgagttacttagtatcgatacttattctaaacgggtaaaccatggatagtgggagtgggtggctggcaccggttctgataacaaatgcaggtttttctattgaaggataaatatacaggagcatttaggattagataacggtagtaatattttgtcataggtacactttgttatgtagtaagtgcatgccccattttcattttccccgctgaaaatacttggtgtctgttgttttgtgaacgccatataccattcctctaataggactacgaaacgcaatgagtctatttttcaattgaattattatacggataaaaaaaaaaaaaaaa

SEQ ID NO: 3504 - protein, 222 aa, Glycine max
  misc_feature: PFam Name: MIR; PFam Description: MIR domain
  misc_feature: GI Number: 23505803; NR Description: At2g25110/F13D4.70 [Arabidopsis thaliana] >gi|24212393|sp|Q93ZE8|SDF2_ARATH Stromal cell-derived factor 2-like protein precursor (SDF2-like protein) >gi|16209645|gb|AAL14383.1| At2g25110/F13D4.70 [Arabidopsis
  misc_feature: GI Number: 21593658; NR Description: unknown [Arabidopsis thaliana]
  misc_feature: GI Number: 50943411; NR Description: Stromal cell-derived factor 2-like protein [Oryza sativa (japonica cultivar-group)] >gi|37805903|dbj|BAC99752.1| Stromal cell-derived factor 2-like protein [Oryza sativa (japonica factor 2-like protein [Oryza
  misc_feature: GI Number: 50946177; NR Description: putative stromal cell-derived factor 2 precursor [Oryza sativa (japonica cultivar-group)] >gi|42408674|dbj|BAD09894.1| putative stromal cell-derived factor 2 precursor [Oryza sativa (japonica
  misc_feature: GI Number: 31241809; NR Description: ENSANGP00000013320 [Anopheles gambiae] >gi|21288655|gb|EAA00948.1| ENSANGP00000013320
MALGFFALAIFLFLTLDSDIAPSSTASASASAASSEGVEVQVTYGTVLKLMHEKTKFRLHSHDVPYGSGSGQQSVTGFPNVDDSNSYWIVRPEPGTSAKQGDPIKSGTIIRLQHMRTRKWLHSHLHASPISGNLEVSCFGGESESDTGDYWKLIIEGSGKTWKQDQRIRLQHIDTGGYLHSHDKKYSRIAGGQQEVCGVREKRADNVWLAAEGVYLPVTESK

SEQ ID NO: 3505 - DNA, 1015 bp, Triticum aestivum
  misc_feature (1)..(1015): Ceres cDNA ID no. 21665754
  misc_feature (1)..(1015): Ceres CLONE  ID no. 567465
  misc_feature (1)..(1015): Also known as  Ceres CDNA ID no. 23720819
gtcagcaagcaacattaactcacttgttgagctccacactccagctccagcgcagccgcagagtgcagagtgagtgagtgggcatgggcgaggaggccaattgcgacgccgtgatggaggacggcaacggcaacgacaacggcaaggccaaggagaacggccacgccacagccgttgtggccatgccggacgtcaaggccaaggccgaggacgccgtggtggcgccgggtgacccccgcctgcagggcatctccgacgccatccgcgtcgtcccgcacttccccaagcaaggcatcatgttcaacgacatcacgacgctcctgctgcggcccggggtgttcaaggacgccctggacatgtttgtggagcgctaccgcggcatgggcatcgccgccgtcgccgggattgaggcgagaggatttatatttggccccgcgattgcactagccatcggtgccaagttcattccgttgcgcaagcctaagaaactcccaggtgaggtgatttctgagacctatgttctcgaatacggaactgattgtctggagatgcatgttggtgctatcgaaccccgtgagcgtgttttgatagttgatgatctggttgcaactggtgggacactttgtgctgctataaatcttctggaacgtgctggagctgatgtcgttgagtgtgcttgtctcattgggctccctaaatttaaggatttttacaagctcaacgggaagcctgtctatgtactggtggagtctctggaatatgaaaaataagaaaccggtgaccaggtgagggacgcatcatggcttcatcctgctgcggtagtattagggagtgggggaggttagggagcggtacgtgaatggatgggtgtagtctttgtaggctgagtggtttcttcaactgtactgaagagcttcttccttgtgctcgggagaaatgatcgttagctgagacgcgagtcctgtagttccattattatcattggttattattattaaaaaaaaaaaaaaaaaaa

SEQ ID NO: 3506 - protein, 228 aa, Triticum aestivum
  misc_feature: PFam Name: Pribosyltran; PFam Description: Phosphoribosyl
  misc_feature: GI Number: 32693279; NR Description: adenine
  misc_feature: GI Number: 50910449; NR Description: putative adenine phosphoribosyltransferase form 2 [Oryza sativa (japonica cultivar-group)] >gi|47497651|dbj|BAD19719.1| putative adenine phosphoribosyltransferase form 2 [Oryza sativa (japonica
  misc_feature: GI Number: 50910451; NR Description: putative adenine phosphoribosyltransferase form 2 [Oryza sativa (japonica cultivar-group)] >gi|47497650|dbj|BAD19718.1| putative adenine phosphoribosyltransferase form 2 [Oryza sativa (japonica
  misc_feature: GI Number: 40019121; NR Description: adenine
  misc_feature: GI Number: 50937177; NR Description: putative adenine phosphoribosyl transferase [Oryza sativa (japonica cultivar-group)] >gi|33354190|dbj|BAC81171.1| putative adenine phosphoribosyl
MGEEANCDAVMEDGNGNDNGKAKENGHATAVVAMPDVKAKAEDAVVAPGDPRLQGISDAIRVVPHFPKQGIMFNDITTLLLRPGVFKDALDMFVERYRGMGIAAVAGIEARGFIFGPAIALAIGAKFIPLRKPKKLPGEVISETYVLEYGTDCLEMHVGAIEPRERVLIVDDLVATGGTLCAAINLLERAGADVVECACLIGLPKFKDFYKLNGKPVYVLVESLEYEK

SEQ ID NO: 3507 - DNA, 1721 bp, Triticum aestivum
  misc_feature (1)..(1721): Ceres cDNA ID no. 21665755
  misc_feature (1)..(1721): Ceres CLONE  ID no. 568357
  misc_feature (1)..(1721): Also known as  Ceres CDNA ID no. 24361277
actcactcatcgccatgccgatgccgatgccgatgccgccggcgctcccgtgcttgctcctcctcctgcttgtcgcccctctcctcgcgacgcccaccacgatcccgctctaccgccacctcccgccgctcccgcccgccgccgcgcagcaccacccgctctcccgcctcgcccaggcctccctcgcgcgcgcctcccgcctcagagccggccacggtcaccaccaaggccaagcctccgcctcaacccccgtgcgcgcggcgctgtacccgcactcctacggcggctacgccttctccctctccctcggcacgccgccgcagccgctgccggtgctgctcgacacgggcagccacctcacctgggtgccctgcacatccaactaccagtgccagaactgctccagcgccgccgccgccggctccttccccgtcttccaccccaagagctcctcctcctccctcgtcgtctcctgcagcagcccctcctgcctctggatccactccaggtcccacctctccgactgcgcccgcaactccgccccctgcaggcccagcaccgccaactgctccgccaccgccaagaacgtctgcccgccctacctcgtcgtctacggctccggctccaccgcggggctcctcgtctccgacacgctgcgcatgtcgccacggggcgccgccatgcgcaacttcgccgtgggctgcagcctcgcgtccgtgcaccagccgccgtcggggatcgcggggttcggccgcggcgcgccgtccgtgccggcgcagctcggggtcaacaagttctcctactgcctcctctcgcgccacttcgacgacgacgccaccgtcagcggcgagctcgtcctcggcgcctcctccgccggcaaggcgaaggcgatgcagtacgcgccgctgctcaagaacgcgggcgccaggccgccatactccgtgtactactacctgtcgctggccggcatcgcggtgggcgggaagagcgtggcgctcccggcgcaggccttcgcgcccgtgtccggcggcggcgggggcggcgccatcatcgactccggcacgaccttcacctacctggacccgacggtgttcaagccggtggcggcggcgatggtggccgcggtggggggcaggtacaaccggtccaaggccgtggaggacgcgctgggcctgcgcccctgcttcgcgctcccggcgggcgccaagaccatggacctccccgagctgtcgctccgcttcacggggggcgccgagatgcggctcccgatcgagaactacttcctggcggcgggcccggcgtccggcgaggcccccgaggcgatctgcctggccgtggtgtcggacgtgtcgagcgcgagcggcggcgccggggtgtccggcgggggcgggccggccatcatcctgggcagcttccagcagcagaactaccacgtggagtacgacctggagaagaaccggctcgggttccggccgcagccctgctcctcgtcgtcgtaggctccttcctcctcgcagcggcgagctggactgggactggagcgcgggagctgtgtagttaccggctcctgcttaattaattaattaatccaagagagtacaggcagccatgcaatgcatgctcgcttgcttacgtgctgtactgaatcgaatccagtggaaaagttagtgacagattaagctgcccgctcgtgcaggcagctttcggaaaaaaaaaaaaaa

SEQ ID NO: 3508 - protein, 1721 aa, Triticum aestivum
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Pkinase; PFam Description: Protein kinase domain
  misc_feature: GI Number: 16209647; NR Description: AT3g52500/F22O6_120
  misc_feature: GI Number: 44890125; NR Description: aspartic protease-like
  misc_feature: GI Number: 9758987; NR Description: chloroplast nucleoid DNA-binding protein-like [Arabidopsis thaliana] >gi|15242307|ref|NP_199325.1| aspartyl protease family protein
  misc_feature: GI Number: 34898762; NR Description: putative nucleoid DNA-binding protein cnd41 [Oryza sativa (japonica cultivar-group)] >gi|22831049|dbj|BAC15912.1| putative nucleoid DNA-binding protein
  misc_feature: GI Number: 50508279; NR Description: putative aspartic
ACTCACTCATCGCCATGCCGATGCCGATGCCGATGCCGCCGGCGCTCCCGTGCTTGCTCCTCCTCCTGCTTGTCGCCCCTCTCCTCGCGACGCCCACCACGATCCCGCTCTACCGCCACCTCCCGCCGCTCCCGCCCGCCGCCGCGCAGCACCACCCGCTCTCCCGCCTCGCCCAGGCCTCCCTCGCGCGCGCCTCCCGCCTCAGAGCCGGCCACGGTCACCACCAAGGCCAAGCCTCCGCCTCAACCCCCGTGCGCGCGGCGCTGTACCCGCACTCCTACGGCGGCTACGCCTTCTCCCTCTCCCTCGGCACGCCGCCGCAGCCGCTGCCGGTGCTGCTCGACACGGGCAGCCACCTCACCTGGGTGCCCTGCACATCCAACTACCAGTGCCAGAACTGCTCCAGCGCCGCCGCCGCCGGCTCCTTCCCCGTCTTCCACCCCAAGAGCTCCTCCTCCTCCCTCGTCGTCTCCTGCAGCAGCCCCTCCTGCCTCTGGATCCACTCCAGGTCCCACCTCTCCGACTGCGCCCGCAACTCCGCCCCCTGCAGGCCCAGCACCGCCAACTGCTCCGCCACCGCCAAGAACGTCTGCCCGCCCTACCTCGTCGTCTACGGCTCCGGCTCCACCGCGGGGCTCCTCGTCTCCGACACGCTGCGCATGTCGCCACGGGGCGCCGCCATGCGCAACTTCGCCGTGGGCTGCAGCCTCGCGTCCGTGCACCAGCCGCCGTCGGGGATCGCGGGGTTCGGCCGCGGCGCGCCGTCCGTGCCGGCGCAGCTCGGGGTCAACAAGTTCTCCTACTGCCTCCTCTCGCGCCACTTCGACGACGACGCCACCGTCAGCGGCGAGCTCGTCCTCGGCGCCTCCTCCGCCGGCAAGGCGAAGGCGATGCAGTACGCGCCGCTGCTCAAGAACGCGGGCGCCAGGCCGCCATACTCCGTGTACTACTACCTGTCGCTGGCCGGCATCGCGGTGGGCGGGAAGAGCGTGGCGCTCCCGGCGCAGGCCTTCGCGCCCGTGTCCGGCGGCGGCGGGGGCGGCGCCATCATCGACTCCGGCACGACCTTCACCTACCTGGACCCGACGGTGTTCAAGCCGGTGGCGGCGGCGATGGTGGCCGCGGTGGGGGGCAGGTACAACCGGTCCAAGGCCGTGGAGGACGCGCTGGGCCTGCGCCCCTGCTTCGCGCTCCCGGCGGGCGCCAAGACCATGGACCTCCCCGAGCTGTCGCTCCGCTTCACGGGGGGCGCCGAGATGCGGCTCCCGATCGAGAACTACTTCCTGGCGGCGGGCCCGGCGTCCGGCGAGGCCCCCGAGGCGATCTGCCTGGCCGTGGTGTCGGACGTGTCGAGCGCGAGCGGCGGCGCCGGGGTGTCCGGCGGGGGCGGGCCGGCCATCATCCTGGGCAGCTTCCAGCAGCAGAACTACCACGTGGAGTACGACCTGGAGAAGAACCGGCTCGGGTTCCGGCCGCAGCCCTGCTCCTCGTCGTCGTAGGCTCCTTCCTCCTCGCAGCGGCGAGCTGGACTGGGACTGGAGCGCGGGAGCTGTGTAGTTACCGGCTCCTGCTTAATTAATTAATTAATCCAAGAGAGTACAGGCAGCCATGCAATGCATGCTCGCTTGCTTACGTGCTGTACTGAATCGAATCCAGTGGAAAAGTTAGTGACAGATTAAGCTGCCCGCTCGTGCAGGCAGCTTTCGGAAAAAAAAAAAAAA

SEQ ID NO: 3509 - DNA, 1355 bp, Triticum aestivum
  misc_feature (1)..(1355): Ceres cDNA ID no. 21665756
  misc_feature (1)..(1355): Ceres CLONE  ID no. 568600
  misc_feature (1)..(1355): Also known as  Ceres CDNA ID no. 24361337
atcccccatctccttctccccaaaacttccgactgttcaaggttcagacccaagcaccgcacacaccaccaagcccatgtcggaggcgtcctcttcctcggcgccggccccggccccggccccgccccctgcgccggcgctggatccggaggcgatctccctcatggcggaggaggcgccgccggaggagattacgctggtcgtgaagtggagcgggaaggagtacacggtgcgggcgatgggggacgacacgctgttggagctgaagcggcgcatctgcgagttcaccgacgtgctccccaaacgccagaagcttctctaccccaagctcatactcaacgacgagtccgtcctcctctcctccctccccttcaagcccaacggcaagctgaccatgatcggtactgttgaagacgaaatatttgtggaccgaccagatgatccagaggtgctcgatgattatgaaattttcaaagatgaagttactgctatcaaggataatgttctctacaagcaaaaagtgaaacgtcgtgcaagccagtataagatcaagctcttgaatccatgccgcgaaggaaaaagattgcttgtgttagacattgactatactctgtttgaccataggtctccagctgagaatcctttggaactcatgcgtccatttctccacgaatttcttgctgctgcatatgcagagtatgatatcatgatatggtcagcaacaaatatgaaatgggtgcagctgaagatggagcaacttggagttcttagcaaccccaactacaagatcaccgcgcttctggatcacatggcgatgataactgtgcatgctcctgacaagaaggttttcgactgcaaacctcttggtgtcatctggaccaagttccccgagcactacaacgagaagaacacgatcatgtttgatgacctcaggaggaatttcgtgatgaacccacagaacggcctcgtgatcagaccgttcaagaacgccagtaagaaccgaggccgcgatcaggagctgcgaaagcttacgcagtacctgctctccattgcagagctagaagatttcagcaagctggagcacgacggttgggagtccttcatggacgaaaccggcaagagacgcaggcgcaggtagttttcttcggtatagcgatcggcaggcagaaactaggcgctactactttttgtcaaatgccatcgactgcacacactagcgcaccggaatgaccaggaaaaccctaatgtcaacttgaaacacactgcgagaacaccccatgcttaatctgcgttcgactttttggcaagttacacttgtttccgggccttcagctgtgcacaaaaaaaaaaaaaaa

SEQ ID NO: 3510 - protein, 353 aa, Triticum aestivum
  misc_feature: PFam Name: NIF; PFam Description: NLI interacting
  misc_feature: PFam Name: ubiquitin; PFam Description: Ubiquitin family
  misc_feature: PFam Name: TT_ORF2; PFam Description: TT viral ORF2
  misc_feature: GI Number: 50539706; NR Description: zgc:86634 [Danio rerio]
  misc_feature: GI Number: 58400827; NR Description: Unknown (protein for
  misc_feature: GI Number: 62859595; NR Description: LOC548815 [Xenopus tropicalis]
  misc_feature: GI Number: 51950004; NR Description: MGC81798 protein
  misc_feature: GI Number: 31200221; NR Description: ENSANGP00000019582 [Anopheles gambiae] >gi|21292680|gb|EAA04825.1| ENSANGP00000019582
MSEASSSSAPAPAPAPPPAPALDPEAISLMAEEAPPEEITLVVKWSGKEYTVRAMGDDTLLELKRRICEFTDVLPKRQKLLYPKLILNDESVLLSSLPFKPNGKLTMIGTVEDEIFVDRPDDPEVLDDYEIFKDEVTAIKDNVLYKQKVKRRASQYKIKLLNPCREGKRLLVLDIDYTLFDHRSPAENPLELMRPFLHEFLAAAYAEYDIMIWSATNMKWVQLKMEQLGVLSNPNYKITALLDHMAMITVHAPDKKVFDCKPLGVIWTKFPEHYNEKNTIMFDDLRRNFVMNPQNGLVIRPFKNASKNRGRDQELRKLTQYLLSIAELEDFSKLEHDGWESFMDETGKRRRRR

SEQ ID NO: 3511 - DNA, 1183 bp, Triticum aestivum
  misc_feature (1)..(1183): Ceres cDNA ID no. 21665757
  misc_feature (1)..(1183): Ceres CLONE  ID no. 568942
  misc_feature (1)..(1183): Also known as  Ceres CDNA ID no. 24361309
aattaattatcgctgccgtctcctcccccacgactccaccctcctcctccgccgccgcagccgcagccgccgtgcgaatctatctcgagggtgggggagatggcggacgccctggacatgtccctcgacgacctcatctccaagaacaagtcctcctcccagcgcggccgtggccgccgcaacccggcctcgggttcgggctcgggctcggcgtcgggaggacccgcacccgccggccgccgcttccaggctcgcgccgccacccgcgctgccgccgcgccctaccaccaattcaacttcccgcccccggcgccggcggcttttgcatatgctgcccagcaggcccatgcccatgcccacgcccaggtgatggccatggtggcgccgccgaccggggtcgaaacgggcaccaagctgtacatctccaacctcgactacaacgtttccaacgaggacatcaaggaactctttgctgaggtgggcgatctcaagcggtactccattaactacgacaagagtgggcgatcaaagggaactgcagaggttatattttcaaggaaatcggatgctctagctgctctaaagaggtacaacaatgtgcagcttgatggcaaacctatgaaaattgaggtcattggaacaaatattgaggcaccaccaccaccacctgctatttttactttgaataccccgacgataggaaacttcattccttcctacagtggcggacgtggaaggggcggtgatggtggtcggggatggcctcggggcagaggtggattcggcgggcgtagtgctgctgggcgtggtcgagggcgtggtgatgttgggcgtgggcgagggaggggagggcgtggcagtcagccagtttctgccaatgatctagacgcagacttggacaagtaccactcggaagcgatgcagaccagctaaatggctttggccctgccgcacctgcatcccgcacagccattagccttgtgtaggaatagatgcggccatgtattttagattgtaatttgtgagacaaatgaagcgtctgtcttttgttgtgtgatgatcaacgtggtgcgttccattgtagctctagtttctcttcctctgagttgtagcagttgagacggttggactaagatgagatttttataaagggtgatcacaagtgtcaaaaaaaaaaaaaaaa

SEQ ID NO: 3512 - protein, 277 aa, Triticum aestivum
  misc_feature: PFam Name: RRM_1; PFam Description: RNA recognition motif.
  misc_feature: PFam Name: Drf_FH1; PFam Description: Formin Homology Region 1
  misc_feature: GI Number: 51490665; NR Description: ALY protein [Nicotiana
  misc_feature: GI Number: 9757916; NR Description: RNA and export factor
  misc_feature: GI Number: 21555029; NR Description: transcriptional
  misc_feature: GI Number: 23198018; NR Description: transcriptional coactivator-like protein [Arabidopsis thaliana] >gi|22531190|gb|AAM97099.1| transcriptional coactivator-like
  misc_feature: GI Number: 42573738; NR Description: RNA and export
MADALDMSLDDLISKNKSSSQRGRGRRNPASGSGSGSASGGPAPAGRRFQARAATRAAAAPYHQFNFPPPAPAAFAYAAQQAHAHAHAQVMAMVAPPTGVETGTKLYISNLDYNVSNEDIKELFAEVGDLKRYSINYDKSGRSKGTAEVIFSRKSDALAALKRYNNVQLDGKPMKIEVIGTNIEAPPPPPAIFTLNTPTIGNFIPSYSGGRGRGGDGGRGWPRGRGGFGGRSAAGRGRGRGDVGRGRGRGGRGSQPVSANDLDADLDKYHSEAMQTS

SEQ ID NO: 3513 - DNA, 1666 bp, Triticum aestivum
  misc_feature (1)..(1666): Ceres cDNA ID no. 21665758
  misc_feature (1)..(1666): Ceres CLONE  ID no. 568959
  misc_feature (1)..(1666): Also known as  Ceres CDNA ID no. 24361317
gagaagcccaatggcgattaatttgatcactctgctggatacaccacgaaaatcattactggttatcgaatgacagttcgagagcaagtgatcggttcgtcaccctgctgcctcaagtcgccgcgaactgggcgccggccggcgtcaacccgggcgaaacgccgttgccaaacacccctgtctccgtgacccaactctcgatcatctcctgcgccgcgcgcccgttgtcggccggcaccatgtgcccagcgccgtacaccacggcgtgcgtcagcgccccggaccgctgcacgtacccggcgagctccgtctcctcgccgacgccgccggtccgccacactgcatgctcggcctcctcgaacgcgtgcagcccgccccaccggagctccttcatccacgcctcctgcgacgccacgccgatccaggggtcgcggatgccctggtacagcagcacgcgcgtccgccgccggagcagcgcctccacctccggcttgacgctcttcatcatgtcctcgtgcatcgcctccctcaccacgcggctgcactgctcccacgccacgtcccggcgcgcgcccagcgccgccttcacctccgcccggttcacgaaccgcgccacgcccgccgtcgcgtagggccgctgcctgcccaagtcgtagagcgtggcaagcccggtggcgttcagcagccacgagcgcacgcggccccgcgcgtccgacgcctcccgccaccgcgctgcccgcgccagcgccaccgccgacgcctgcagcgcctccagctcccgccgctgccgcgcgttgatgagccccgtgaagtaggccgagtcggcgtgcgtgggcagctgcgccacggggtgcgtcagcccgttgccgatggcggcgccgcggaggttgacccgccgccccgccggcaggccctggttcgcggcgaggatcagcgccccggcggccgggacgtacttcccggcgtagctctcgccggagaggaagaaggggcgcgcgcggaaggagggcgggctggcgtcgaagaaggactggagcgcggcgaggacgtgcgcggcgactgcggcctggtcccgcgggatggcggcgggggacggcgcggcgctgaagccggtgccgagcgggctgtcgaggaagaggagcccgaatcggcggttccaggcgaaggggttgcgggagagcgaggcggcgtccggggcgacgaggtacgggccgagctcgaagaagttgccgacgaggcccgagcagccgggcccgccctgcagccagagcagcagcggcgtgtcggccggcggggtgagcgggtcgctggcctcgtagaaggcgtagaatagggaggcgttggtgcgcgagtccaccggcaggtagccggagctggtcggcagggcctccttcgggaactccaccgcggccccggaggccgctgacagcgagaccgagacggtggccgcgaggaggacgccggcgaggagcagaagcggcggagccatcgatggatcagatcgcaagagcatgagatgtgcgcgcgtgctgttgctcactgcagcagcttcgttgactccggagaggtgacaagtctcgtcgattattgacaacggtagtagtctgtctgtcattacctcacttcccaaatataagacgttttaaacaaaaaaaaaaaaaaaaaa

SEQ ID NO: 3514 - protein, 329 aa, Triticum aestivum
  misc_feature: PFam Name: FH2; PFam Description: Formin Homology 2 Domain
  misc_feature: PFam Name: Pyr_redox_2; PFam Description: Pyridine
  misc_feature: PFam Name: Atrophin-1; PFam Description: Atrophin-1 family
  misc_feature: PFam Name: Pkinase; PFam Description: Protein kinase domain
  misc_feature: PFam Name: Drf_FH1; PFam Description: Formin Homology Region 1
  misc_feature: GI Number: 66778264; NR Description: LigA [Anaeromyxobacter dehalogenans 2CP-C] >gi|66856061|ref|ZP_00400131.1| LigA
  misc_feature: GI Number: 66776103; NR Description: LigA [Anaeromyxobacter dehalogenans 2CP-C] >gi|66858140|ref|ZP_00402169.1| LigA
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 66776896; NR Description: LigA [Anaeromyxobacter dehalogenans 2CP-C] >gi|66857361|ref|ZP_00401413.1| LigA
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
MLGLLERVQPAPPELLHPRLLRRHADPGVADALVQQHARPPPEQRLHLRLDALHHVLVHRLPHHAAALLPRHVPARAQRRLHLRPVHEPRHARRRVGPLPAQVVERGKPGGVQQPRAHAAPRVRRLPPPRCPRQRHRRRLQRLQLPPLPRVDEPREVGRVGVRGQLRHGVRQPVADGGAAEVDPPPRRQALVRGEDQRPGGRDVLPGVALAGEEEGARAEGGRAGVEEGLERGEDVRGDCGLVPRDGGGGRRGAEAGAERAVEEEEPESAVPGEGVAGERGGVRGDEVRAELEEVADEARAAGPALQPEQQRRVGRRGERVAGLVEGVE

SEQ ID NO: 3515 - DNA, 826 bp, Triticum aestivum
  misc_feature (1)..(826): Ceres cDNA ID no. 21665759
  misc_feature (1)..(826): Ceres CLONE  ID no. 569794
  misc_feature (1)..(826): Also known as  Ceres CDNA ID no. 23464466
cttctttctccttccctgcccaccagtccaccgccgccgcctctccccccatccccctctcccacctcctccggcgtcggccagcaagcagccatggcgagccccgcgcgcatcgacgtggataagctgagcgtggagcagctcaaggcgctcaaggagcagaccgatctggaggtcaatctcctccaggacagcctatccaagatccgcaccgccgccacccgcctcgagaacgccacggccgccctccacgagctctccctccgcccccaagggaagaagctgctcgtgccgctcacggcgtccctctacgtgcccggcacgctcgacgacgccgagaaggtcctcgtcgacgttggcaccggctactacattgagaaaactatgactcaaggaaaagaatactgtgaaaggaaaattaatttgctgaagtccaacttcgatgaactacttgagatggcgaccaaaaagaagagcatagcagatgaaatgggcatgtttctgcaagccaagctgaggcaggcatcaccgagctcgagttcgtgagagcggaatgcgcgccctgtcccttgctttgttgccttgttggagcgccggggtggttcgctcactcgcagccctcagggaacataggaggttctttagctgttttggccgtgtgtgcaaggttctctgagatgatttactgaaacagcctgctccatcgtcagacttcatcctcgagtaatttggaattcggtatcaaacgtgtgtgtcttggatgcacaatctgctttaatggctttgacaatcaattatgagtttgttgctaaaaaaaaaaaaaaaa

SEQ ID NO: 3516 - protein, 150 aa, Triticum aestivum
  misc_feature: PFam Name: Prefoldin; PFam Description: Prefoldin subunit
  misc_feature: PFam Name: Extensin_2; PFam Description: Extensin-like region
  misc_feature: GI Number: 20465871; NR Description: putative c-myc binding protein MM-1 [Arabidopsis thaliana] >gi|17381002|gb|AAL36313.1| putative c-myc binding protein MM-1 [Arabidopsis thaliana] >gi|10177818|dbj|BAB11184.1| c-myc binding protein MM-1-like
  misc_feature: GI Number: 57106326; NR Description: PREDICTED: similar to Prefoldin subunit 5 (C-myc binding protein Mm-1) (Myc modulator 1)
  misc_feature: GI Number: 50926001; NR Description: Zgc:100894 protein
  misc_feature: GI Number: 62859143; NR Description: LOC548939 [Xenopus tropicalis]
  misc_feature: GI Number: 31205497; NR Description: ENSANGP00000015014 [Anopheles gambiae] >gi|21295163|gb|EAA07308.1| ENSANGP00000015014
MASPARIDVDKLSVEQLKALKEQTDLEVNLLQDSLSKIRTAATRLENATAALHELSLRPQGKKLLVPLTASLYVPGTLDDAEKVLVDVGTGYYIEKTMTQGKEYCERKINLLKSNFDELLEMATKKKSIADEMGMFLQAKLRQASPSSSS

SEQ ID NO: 3517 - DNA, 1240 bp, Triticum aestivum
  misc_feature (1)..(1240): Ceres cDNA ID no. 21665760
  misc_feature (1)..(1240): Ceres CLONE  ID no. 570548
  misc_feature (1)..(1240): Also known as  Ceres CDNA ID no. 24360287
gtcaagaccattcgaggcagcccgcaaacacgcacgccagcacgcacgctcgcacaccactccatccaaagtccaggaagaaggagcgtacgtccgtcgggatggccggcgtcgtggtggtgttcgacttcgacaagaccatcatcgacgtcgacagcgacaactgggtcgtcgacggcctgggggccaccgacctcttcgaccgcctgctgcccaccatgccgtggaacaccctcatcgacaccgtcatgggggagctgcacgcgcaggggaagaccctccgcgacgtcgccgacgtgctccgggccgcgcccatcgacccgcacgtcgtcgccgccatccgggccgcctacagcctcggctgcgacctccgggtcctcagcgacgccaaccacttcttcatcgaggccgtcctcgaccaccacggcctccggggctgcttctccgagatcaacaccaaccccagccgcgtcgacgccgacggccgcctccgcatcgcgccgcaccacgacttccacgccgccccgcacggctgcggcctcggcacatgcccgcccaacatgtgcaagggccaggtgctcgaccgcatccgcgcctccgccgccgcggcggacggcggcaggaagcgcttcatctacctcggcgacggccgcggcgactactgcccgtccctgcggctcgccagggaggacttcatgatgccgcgcaagggcttccccgtgtgggacctcatctgcgagaaccccggcctgctccaggccgaggtgcacccatggagcgacggcaaggacatggaggaggcgctgctgcggctcgtcagccgggtgctcgtcgaggagagcacgctgctgccgctcgactgcaagctcgagtcgctgccggtgaccgtccaggacggcatgcccatgccgctcggcgtcaagaactgatccgcccaaccctgctgcattacgattaatttggggatcgataccttgtcttctgatttgcttgcctgatatgctggcgtgtagtgcgtacgagtttgggtagggcgtcggtggaaactaattaagggtgaggagttcgagcgccaatggcgaactcgatagtagtattgactaatttgtgcgtgtcgtccttgtgccgcctggcaatggtgaaggctcgctgtatcccatctatctattgatttgatgaaagaataaatgagttgatgcgacgaaagtcaatttcggctgaaagaaaaaaaaaaaaaaaa

SEQ ID NO: 3518 - protein, 275 aa, Triticum aestivum
  misc_feature: PFam Name: Put_Phosphatase; PFam Description: Putative Phosphatase
  misc_feature: PFam Name: Mucin; PFam Description: Mucin-like glycoprotein
  misc_feature: PFam Name: Peptidase_S8; PFam Description: Subtilase family
  misc_feature: PFam Name: Pkinase; PFam Description: Protein kinase domain
  misc_feature: PFam Name: Cation_efflux; PFam Description: Cation efflux family
  misc_feature: GI Number: 34910680; NR Description: P0690B02.4 [Oryza sativa (japonica cultivar-group)] >gi|18461219|dbj|BAB84416.1| P0690B02.4
  misc_feature: GI Number: 26986124; NR Description: putative phosphatase [Lycopersicon esculentum] >gi|26986118|emb|CAD30862.1| putative
  misc_feature: GI Number: 26986126; NR Description: putative phosphatase [Lycopersicon esculentum] >gi|26986116|emb|CAD30861.1| putative phosphatase [Lycopersicon esculentum] >gi|11837862|gb|AAG40473.1|
  misc_feature: GI Number: 50901932; NR Description: P0025A05.29 [Oryza
  misc_feature: GI Number: 26986120; NR Description: putative phosphatase
MAGVVVVFDFDKTIIDVDSDNWVVDGLGATDLFDRLLPTMPWNTLIDTVMGELHAQGKTLRDVADVLRAAPIDPHVVAAIRAAYSLGCDLRVLSDANHFFIEAVLDHHGLRGCFSEINTNPSRVDADGRLRIAPHHDFHAAPHGCGLGTCPPNMCKGQVLDRIRASAAAADGGRKRFIYLGDGRGDYCPSLRLAREDFMMPRKGFPVWDLICENPGLLQAEVHPWSDGKDMEEALLRLVSRVLVEESTLLPLDCKLESLPVTVQDGMPMPLGVKN

SEQ ID NO: 3519 - DNA, 2258 bp, Triticum aestivum
  misc_feature (1)..(2258): Ceres cDNA ID no. 21665761
  misc_feature (1)..(2258): Ceres CLONE  ID no. 570925
  misc_feature (1)..(2258): Also known as  Ceres CDNA ID no. 25088253
gtatcgcttagtctttaacttaaattataaaattagaaagtcttttctcttaaccctagatagaagatccccaattcgccgaatctctcggcaacgcgcctagacccctgattctctcggcgacgcgctcggcagatctatccgggacgaccctcgcatccccgtcgtgcgggcggtggtggatcagtcgggaccggaaagatgcagaaaaataagagggcgagtggtcacgcaagtagcttgagaaaggtgcaaagcaccatcaaaaagaaggaaaaaattggaagtagtcgcaaaagaggcattactactcggaaaggacacctgagagagaatatatttggctactcatcgcctgatcgggatatttctagcaccaagttcgaagagcgacaatttggcaatgtatatgaacctggtcaagctgactggtgtgaactaagtaaaagactagcttcacatttgtctgtggaagttgtctcacttgctttgttcgatggagataagatgttatatgcatgcacgggtatagttctaccacgtgggacatcaagactggacctaacaagattcctgacttcatcacagttggttgcagtctttaattttaaaagaaacaaggatgataaattgagggttttggtgcgccttcctgacaaaaaaactatacctgggatcttaggactatatgataaatatattgctattgttacatccgaatacttccaagatgttatgccattagacatgtatcagcaaacatatctgcctaatccttcgacgatggtagctgctgggcgtgcctacaattcaagcagtttgatgggcacgattggggagctgactgatataggagctgattatgaagatcttgtggcctctaactgtcagatcacagaggctggacttggagggccactcattgatcttgctggcaattttgttgggatcaacatttgttttcatggtgatacgcaaaggcctttgtttctaccaaggagattgcttcgtcaacgcttggagcaatatgaggtgctcattcctggaaaaggttatggagagaaaatgccaccttattgtgcaggtttgttaatgggaaaaaccagcaatagcaggcagggatcttatgaacctcctccaggtgcttccagaataatcccttcaggatttatggatacctgggagtggctagaatccatgggctaccctaaaccaccaccacttatgctggaattgaatgggcgcctggttaggacatttgaggaagtgtttggttggttacatgcttggaaaggttataaaaacttcgatatgttgcacggtcatggaaagaatgcctggcagaggcttgataagaagatagttgcaactatatccaatcgtgttatctcacttgtttcgttcaatggagagggtacgagttttttttcatgctcaggcttccttataaggggtccgccaagaaaagggcgcacacgcaatgtgattgtgacttcggccagtttggttagaacttgtgatgttacagacaaatttgatgagaatatgaggattgaggtgtttctcccaccgaatcagcgcttgaatgggacactggaatcatatcattccggatataatattgctattgtcactgttaagggtttgcgtgatatttgtccagaagatatgaaatttgatgatcccatgagtaaccaagagaatcctttacccagaagggtggtagctatagggcgtgagcccaaaggagtgttatgtgcctcaatgggtgaacctatactttgtgatgaagacctgcactggcctagcacatttggttgccagcaacttaagctgtccaattgtaaaatcacgaaggttggtattggaggccccctgataaacttctttaatgggcgtcttgttggcatgaacttttgtgatggaaggcctgatagaactccctacctgccttgtaagcaaattcgtgaagtcttacatagcacatggcgcttaactaccgaccgctctgtgctcagattggacaaaccagatgtgaacaacaaatgcagatggccagtgcccaagccatattggtatcacggtcttctcgagatgaataggtttggtccgatgcccatgataggatgggttcgccagtaggctcgcaccacatactgttaattgaagtttatgtctaccgcttattccctgtttgtaacaaagtactgcgttcctaaatataagaccttttagagattccaaaaaaaaaaaaaaaa

SEQ ID NO: 3520 - protein, 646 aa, Triticum aestivum
  misc_feature: GI Number: 37535324; NR Description: putative serine protease [Oryza sativa (japonica cultivar-group)] >gi|16905164|gb|AAL31034.1| putative serine protease [Oryza sativa] >gi|31432643|gb|AAP54251.1| putative serine protease
  misc_feature: GI Number: 34910018; NR Description: P0413G02.10 [Oryza
  misc_feature: GI Number: 50916226; NR Description: Putative polyprotein from transposon TNT [Oryza sativa (japonica cultivar-group)] >gi|24431600|gb|AAN61480.1| Putative polyprotein from transposon
  misc_feature: GI Number: 50948745; NR Description: ESTs AU068856(C50756),AU077979(C61370) correspond to a region of the predicted gene.~Similar to serine protease (AF097709) [Oryza sativa (japonica cultivar-group)] >gi|5803253|dbj|BAA83563.1|
  misc_feature: GI Number: 51090649; NR Description: serine protease-like
MQKNKRASGHASSLRKVQSTIKKKEKIGSSRKRGITTRKGHLRENIFGYSSPDRDISSTKFEERQFGNVYEPGQADWCELSKRLASHLSVEVVSLALFDGDKMLYACTGIVLPRGTSRLDLTRFLTSSQLVAVFNFKRNKDDKLRVLVRLPDKKTIPGILGLYDKYIAIVTSEYFQDVMPLDMYQQTYLPNPSTMVAAGRAYNSSSLMGTIGELTDIGADYEDLVASNCQITEAGLGGPLIDLAGNFVGINICFHGDTQRPLFLPRRLLRQRLEQYEVLIPGKGYGEKMPPYCAGLLMGKTSNSRQGSYEPPPGASRIIPSGFMDTWEWLESMGYPKPPPLMLELNGRLVRTFEEVFGWLHAWKGYKNFDMLHGHGKNAWQRLDKKIVATISNRVISLVSFNGEGTSFFSCSGFLIRGPPRKGRTRNVIVTSASLVRTCDVTDKFDENMRIEVFLPPNQRLNGTLESYHSGYNIAIVTVKGLRDICPEDMKFDDPMSNQENPLPRRVVAIGREPKGVLCASMGEPILCDEDLHWPSTFGCQQLKLSNCKITKVGIGGPLINFFNGRLVGMNFCDGRPDRTPYLPCKQIREVLHSTWRLTTDRSVLRLDKPDVNNKCRWPVPKPYWYHGLLEMNRFGPMPMIGWVRQ

SEQ ID NO: 3521 - DNA, 2115 bp, Triticum aestivum
  misc_feature (1)..(2115): Ceres cDNA ID no. 21665762
  misc_feature (1)..(2115): Ceres CLONE  ID no. 575533
  misc_feature (1)..(2115): Also known as  Ceres CDNA ID no. 25088254
aaaagtttccctagaatcgctcaagaaaaacaaaatccctctttcgtgaaaccctaagataggcggcggcggcggcggcggcggggtgcggcgggaggcgagggaaccacaaaaaggcgagcgatggcgggtggcagcccggcaaaagaggaggtacagacgcctcgtgagttggagatgcagatggaagagaaggtcgtgcagcggaatcagcctcgtcgcaagaggaatcgagctgaccttgctgatgagctcgagttcttcacggacctccgcaatacgctgatgaagaagaagaagaagaagcagaagaaggacaagggcacgcccgagaaggagaggttcgattcttccaactcctaccgtagtttgggcacgcagaaggggcttggttttctcgacaatcgtatcaaggtcttgcgcaagcggatggggataactgccggaactgcccacacctcccccgcgatctctgatctgtcggacccctcggggaagcatatgaatggtctcagtgatctgagttcgacattaggagcagatccaatttcagatgatgatgatggtgctgatggttctggtgacgacgaggaagaggataagatggagtgtggcaagccagccatggaggaggaggaggtccagaggatcaccggctccacaccaatttcggagattgatgctgaggcagtgatgggggcaaaagtgtccataaacggtgatggccatgatcgagctgacactgattgtgttgacgacgatgaggtagacagaggcaaatcagaggcacaattagccaaggagaagagggtgatgtctaccgagaagctcatgtttgagtccttcagtcgtgactgggaggctgcgtttagccgacgcagcggccacttccttaacaagacgacagtgagttccatgcagtttacacacttggcacctgggcgcatcccatggggcgctggcatagaacctgccgtgcagatcttctctgtcaagcttacagaggtgaaaggtggcttcaaatttccattgtccgtgtatggtgtggtcgctgcccgtgatggcgtggactacaaccgcaaccttatcttcttttgcgataggagcaactcccaagaacttactcaaaatgatccttatctgcgcctgatcgccccgtctcgcgctgttttgtttgaggactatgtcagttatgaggtccagcttatggtgaaaggcagcgtcaagtctcgggacaggccgttgatcacagatacataccgccaaacccgatgccgtattggtgtatccaccatctgctttcagaactgcttctgcacgatggagttacgcttggagcgatttctaggttcggtccaggccaccatcattggcgtacgtgtcgtcaaagacaatggggcgtggccttttggacatggtgttcgggttgcttgctccccggcatcacgggaacttatggaggacagtgatggtgaaatcaagtatgttgctcagccttcgtctggggaaatcttgctgcttgattcaaaagatggaagtagacctgcgcgttcagatggatacctttatctgtcaaggcaagttgtttctgtagaaccaagcggacagctggaagttgaaatacaggcctatgcaccacctggcgttctccctgcaaaaacgcaggtctgcttcgaagcccaagaatgcaacatagatcgtggtcggtgttgcctcctcggtgccgaggtggagatctctgttgcttggtcccgtcttgctttggacgtggagatgcttgcgggtgttgacagggattttcaaagggacgaaccagaggttgcgttcacacaagtggggctgaatggagagcctgacacggaacgaatcttttaagaactgcttggtattagcttgttgaagttcctgtagtagtatttctgcatcgtgtttagttatatatgtaagttgtccaactatgccttatgctatacatctgcattggattagctatatatataacctgtccaactatgactgatgcaccaggcaactatttgtttggttgtgtattgactgtgacttttaatatgctgtttgaaagcatttctgtgttgattaaaaaaaaaaaaaaaa

SEQ ID NO: 3522 - protein, 583 aa, Triticum aestivum
  misc_feature: GI Number: 21913313; NR Description: csAtPR5 [Aegilops tauschii]
  misc_feature: GI Number: 50902240; NR Description: P0408G07.8 [Oryza sativa (japonica cultivar-group)] >gi|20161235|dbj|BAB90162.1| P0408G07.8
  misc_feature: GI Number: 5777618; NR Description: CAA30376.1 protein [Oryza
MAGGSPAKEEVQTPRELEMQMEEKVVQRNQPRRKRNRADLADELEFFTDLRNTLMKKKKKKQKKDKGTPEKERFDSSNSYRSLGTQKGLGFLDNRIKVLRKRMGITAGTAHTSPAISDLSDPSGKHMNGLSDLSSTLGADPISDDDDGADGSGDDEEEDKMECGKPAMEEEEVQRITGSTPISEIDAEAVMGAKVSINGDGHDRADTDCVDDDEVDRGKSEAQLAKEKRVMSTEKLMFESFSRDWEAAFSRRSGHFLNKTTVSSMQFTHLAPGRIPWGAGIEPAVQIFSVKLTEVKGGFKFPLSVYGVVAARDGVDYNRNLIFFCDRSNSQELTQNDPYLRLIAPSRAVLFEDYVSYEVQLMVKGSVKSRDRPLITDTYRQTRCRIGVSTICFQNCFCTMELRLERFLGSVQATIIGVRVVKDNGAWPFGHGVRVACSPASRELMEDSDGEIKYVAQPSSGEILLLDSKDGSRPARSDGYLYLSRQVVSVEPSGQLEVEIQAYAPPGVLPAKTQVCFEAQECNIDRGRCCLLGAEVEISVAWSRLALDVEMLAGVDRDFQRDEPEVAFTQVGLNGEPDTERIF

SEQ ID NO: 3523 - DNA, 1589 bp, Glycine max
  misc_feature (1)..(1589): Ceres cDNA ID no. 21665763
  misc_feature (1)..(1589): Ceres CLONE  ID no. 577518
  misc_feature (1)..(1589): Also known as  Ceres CDNA ID no. 24360011
accaagaaaaaaggaagatgggcttatattttcaagacccggctgagttggacaaagcgggttttggagtgtgtgttcgggtcttggccgccaccgacgaagatgttcacttcaggattgtctccatctctcctattccccgcatttcatcacaaactttattcatttctcttctctattcgcaatcatcgctgttaactggtgcattctggaacactggctggttaatgattcatagtgttctaaaagcaagtaggtttcaaaatccacgtagagaagcccttgttttgaccattgctatcagtggttgtgtttgtcgtttagcatttagctcaatgaaagaaatcaattgtaaagtggattctagttcatgtactcttgcccccaatagggaaccctgcatcacagagtccttatcagttagtgggaatggtactactacttcatctatgagtgtaaaatccacccctgaaattgaaaagaagtttgttcatcatgtatatgatgctattgcgccgcatttcagtgccacccggtttgccaagtggccgaaggttgcagcatttttgtcatctttgcctttgggatctcttgtcctcgatgccggatgtgggaatgggaaatacttaggtttgaatcaggattgtttttttataggatgtgatataagtccttccttgattaagatctgctcggacagagagcatgaagttctggtcgcggatgctgtgaatctcccttacaggactggtttcggtgatgcagcgatatctatagctgtgttacatcatttaagcactgaaaatagaaggagaaaggcaatagaagaattggtcagagttgttaaaaagggtggccgtgttctgattacagtttgggctgtagagcaagaggatagtaagctgattaccaaatggactccactgaatgagaagtatgttgatgagtgggtaggaccaggtagtcctcatactcgggcaccttcatcctcgtcattggaaagtatccccgaaagtgaggtgagtacctctggtgagcacatggaagtttgccatgaggcacatgcatcaagatatttggaggaagaaaaaaatataaagaatcaacaggaatactttgttccctggcatttaccttatcatcgtgctgaaatcagtggcgcttctgccgaagctcttgctgctggtctggcaacgaaagatgacaaaaaaggtgctgtggtgtataatcgatattatcatgtttttagtgaaggcgagcttgaaagtttgacaactgaaataaacaatgctataattgttgatcagttttttgataaatccaactggtgcattattctagagaagacagtatgaccaagaaagaagaaacctggttgatatgtgtaagggaacaaaactaggctgctgcctcctttaaacatccgtccagcttctcatccttgagggagtatagcaggccggattgtagtataacaacttttacaacatttatcttgcaagttcaactttgaattaaggattgtagtataacaacttttacaacatctaacttgcaattaaaaaatatacacaaaaaaaaaaaaaaaa

SEQ ID NO: 3524 - protein, 445 aa, Glycine max
  misc_feature: PFam Name: Methyltransf_4; PFam Description: Putative
  misc_feature: PFam Name: CMAS; PFam Description:
  misc_feature: PFam Name: Ubie_methyltran; PFam Description: ubiE/COQ5
  misc_feature: GI Number: 50912813; NR Description: methyltransferase-like [Oryza sativa (japonica cultivar-group)] >gi|46390207|dbj|BAD15638.1| methyltransferase-like [Oryza sativa
  misc_feature: GI Number: 21592943; NR Description: unknown [Arabidopsis thaliana]
  misc_feature: GI Number: 50261863; NR Description: AT1G36310 [Arabidopsis
  misc_feature: GI Number: 62859801; NR Description: LOC550051 [Xenopus tropicalis]
  misc_feature: GI Number: 30046964; NR Description: 4930562C03Rik protein [Mus musculus] >gi|38089703|ref|XP_134612.3| RIKEN cDNA 4930562C03
MGLYFQDPAELDKAGFGVCVRVLAATDEDVHFRIVSISPIPRISSQTLFISLLYSQSSLLTGAFWNTGWLMIHSVLKASRFQNPRREALVLTIAISGCVCRLAFSSMKEINCKVDSSSCTLAPNREPCITESLSVSGNGTTTSSMSVKSTPEIEKKFVHHVYDAIAPHFSATRFAKWPKVAAFLSSLPLGSLVLDAGCGNGKYLGLNQDCFFIGCDISPSLIKICSDREHEVLVADAVNLPYRTGFGDAAISIAVLHHLSTENRRRKAIEELVRVVKKGGRVLITVWAVEQEDSKLITKWTPLNEKYVDEWVGPGSPHTRAPSSSSLESIPESEVSTSGEHMEVCHEAHASRYLEEEKNIKNQQEYFVPWHLPYHRAEISGASAEALAAGLATKDDKKGAVVYNRYYHVFSEGELESLTTEINNAIIVDQFFDKSNWCIILEKTV

SEQ ID NO: 3525 - DNA, 1158 bp, Triticum aestivum
  misc_feature (1)..(1158): Ceres cDNA ID no. 21665764
  misc_feature (1)..(1158): Ceres CLONE  ID no. 579413
  misc_feature (1)..(1158): Also known as  Ceres CDNA ID no. 23473758
gtcaataagtttttctccgccattttccccgtcctccgcgagaagcgcctcgaggtccccgtgtgcggctagctagatcggtggcgcctcccctccctcctcccccgcggaaggcgctcgcccccttcattcccggaaccgattctcgcaagggattcctcgctgctcggctcttcttgaggcatgcagagccagatcgtgtgccatgggtgcaggagcgttctactctaccccagaggggcccccagcgtgtgctgcgccgtgtgccacgccgtcaccagcgcgccgcctccaggaatggagatggctcagcttatatgcgtcggctgtcgaactttattgatgtatactcgcaatgcaactactgtcagatgctcatgttgtgatacagtcaaccttgccagaccagcaccgccagtgaatagtatagctcatgtgaactgtggccagtgccagacggtgttaatgtatccatacggagcatcttctgtcaaatgtgctatctgcaattttattacgaacatcggaatgaacaccgtgagacctttgccacctacaatgcatgcaccaaacggaatttcatatagtgtcccatcgacctctgcgccatccgctcaatcgcagaatgtaacggtggtcgtcgaaaacccaatgacagtagatgacaagggaaaattggtgagcaacgtcgtagtcggggttacgtccggcgggaaaaagtagcaaaacatgtcagcgcttgtaccaagtgatgccctgttctgtgtcttataatctggagttgggaacactttgtattatactcgtgtctggtgatcgaccgatcggtcgcatagaagaaaaccccgaagcgcgtaaacggactgcgccaacaaaaaaagagagtgcgggtgtggataatacggaaaaaaactgtattttgcttaccccctagattcttttgtatgtaaaatgtgggcactgtcagacctcactgcgtgatcaaatcctctctgtcctgtcctgtgtcctgtcctggaggggcctctcgttctggatgaataacagcaaataactttgcatatggctggccccacctgtcaatgattggtaattaaacgactgtaattattgtgatgaataattctttgaaggctgtatataaaaaaaaaaaaaaaa

SEQ ID NO: 3526 - protein, 179 aa, Triticum aestivum
  misc_feature: PFam Name: zf-LSD1; PFam Description: LSD1 zinc finger
  misc_feature: GI Number: 32400832; NR Description: 18S subunit ribosomal
  misc_feature: GI Number: 50881432; NR Description: zinc finger protein, putative [Oryza sativa (japonica cultivar-group)] >gi|50540706|gb|AAT77863.1| putative zinc finger protein [Oryza
  misc_feature: GI Number: 17981378; NR Description: zinc finger protein LSD1
  misc_feature: GI Number: 17981380; NR Description: zinc finger protein LSD2
  misc_feature: GI Number: 7268834; NR Description: zinc-finger protein Lsd1 [Arabidopsis thaliana] >gi|5262161|emb|CAB45804.1| zinc-finger protein Lsd1 [Arabidopsis thaliana] >gi|1872523|gb|AAC49661.1| zinc-finger protein Lsd1 [Arabidopsis thaliana]
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 3527 - DNA, 1881 bp, Triticum aestivum
  misc_feature (1)..(1881): Ceres cDNA ID no. 21665766
  misc_feature (1)..(1881): Ceres CLONE  ID no. 584947
  misc_feature (1)..(1881): Also known as  Ceres CDNA ID no. 24361329
atcgtcgtcagttctttctgccactgaacttgctcttgttaaattctctagctagctagttctcttcgtgctctccttttaccccttggcctggatggatgggtaaatgaagttgtgcctttgccccttttgattcgaacacatacatccatccttgtgttggttctggggttatatctatgtggaaggaacggttccaggaggtgtacgtgtttgcatcgtcgcttcgctcgccggagaaaagaaaagaatgtcgcgcgagagatggcagggatgcgttcttgttctcgtccttcttctcttcagcgcgtcaggcacttctctgggggacaacacgatcgtcccttcaaattctccgtcagacttcgcgagaatcatcgtgcagtctaagcagaccaagcgagcgcaggtgtgcggcggagccgaccaccggctgctgcggtccctcgccaacaccggcgcagaggtcatggtcaccatccccaactcacatctgcagcacctcgccgagttccgggacgaggcccggctctgggtggccgccaatgtggcgccgttcctcccggcgaccatgatcacgcacgtcctagcgggagacgaaatcctgtcgtccgtctcccccggagacgccgcctactcgctggtccccgctatgcggaacctccacgccgcccttgtcgctgccggacttgacggccacgtcagggtgtccaccgtgctctcctcggtgccgctcgccccgtcgtggtcccccggcatcgcagggcacgtcctgcggttcctgttggagaccggctcaccgttgttcctcaaggctcgcacgtcggatgtcagagtcgacgacgtgtacgccgcgatgcgggcgctgggcttctcaggcatcccactgatcgcggcagagtcggcggagctcgctctcagtggcgcgctggtgtaccacagctacttgtatggccgtcatcccatgaccgccggtggaggtgggaggcggtcgctggcgacggggacgttctgcgtggccttgcagaacgcggacccgacagcgctgcaggcgggcctgagctgggcgtgcgggcaggggcaggccgactgctcggcggtgcagcccggaggggcgtgctacaagcagaacaacgtggcggcgctggcctcctacgcctacaatgactactaccagaagagcgccagcaccggcgccacctgctccttcaacggcaccgccaccaccaccgccactgatcccagctcaggatcgtgcgtcttcgcaggaagcaccatggcaggagactccacctccaactcgagcgtgccgagcgccagccctccgacgagcctgggcgcccctccgtcagacgatctcactcctccggtcagctccagccctccgacgagcctgggcgcccctccgtcagacgatctcactcctccggtcagctcaagccctccgtccgacttcggccccccggcaaccgacacggcacctccgacgagctttgacgctcccgcaggtggcttcggaccaccgtctggcttcagtcccccgtctgtgttcggcagcccgccatcgacgttcggcccgcccgggagcttaaccgggagcgggagcttcgggccgagcagcaccctcgagccttacggcgtcgggtgtcgccacgtggcctccttggctgcctccactcttctgtccgccattgttctcgcggtcctttgcgcgtcaccagatctgatgtaaattctctgagtatacagagctaacgctgtcgttagcattactattgcatcttatgttcttggtcttgtagatgtcagattcaatgtttaggaatcgtatgtatatatatgatttgcagagtatttggcattgcaaaaaaaaaaaaaaaa

SEQ ID NO: 3528 - protein, 493 aa, Triticum aestivum
  misc_feature: PFam Name: X8; PFam Description: X8 domain
  misc_feature: PFam Name: Glyco_hydro_17; PFam Description: Glycosyl
  misc_feature: PFam Name: Drf_FH1; PFam Description: Formin Homology Region 1
  misc_feature: PFam Name: FH2; PFam Description: Formin Homology 2 Domain
  misc_feature: PFam Name: Pyr_redox_2; PFam Description: Pyridine
  misc_feature: GI Number: 51979050; NR Description: PREDICTED P0519E12.126 gene product [Oryza sativa (japonica cultivar-group)] >gi|51979048|ref|XP_507401.1| PREDICTED P0519E12.126 gene product [Oryza sativa (japonica cultivar-group)] [Oryza sativa (japonica
  misc_feature: GI Number: 50938623; NR Description: putative elicitor inducible beta-1,3-glucanase [Oryza sativa (japonica cultivar-group)] >gi|34393509|dbj|BAC83070.1| putative elicitor inducible beta-1,3-glucanase [Oryza sativa (japonica
  misc_feature: GI Number: 9280308; NR Description: beta-1,3-glucanase-like
  misc_feature: GI Number: 17104805; NR Description: putative glucan endo-1,3-beta-glucosidase precursor [Arabidopsis thaliana] >gi|14334498|gb|AAK59446.1| putative glucan endo-1,3-beta-glucosidase precursor [Arabidopsis thaliana]
  misc_feature: GI Number: 57899486; NR Description: putative elicitor inducible beta-1,3-glucanase NtEIG-E76 [Oryza sativa (japonica
MSRERWQGCVLVLVLLLFSASGTSLGDNTIVPSNSPSDFARIIVQSKQTKRAQVCGGADHRLLRSLANTGAEVMVTIPNSHLQHLAEFRDEARLWVAANVAPFLPATMITHVLAGDEILSSVSPGDAAYSLVPAMRNLHAALVAAGLDGHVRVSTVLSSVPLAPSWSPGIAGHVLRFLLETGSPLFLKARTSDVRVDDVYAAMRALGFSGIPLIAAESAELALSGALVYHSYLYGRHPMTAGGGGRRSLATGTFCVALQNADPTALQAGLSWACGQGQADCSAVQPGGACYKQNNVAALASYAYNDYYQKSASTGATCSFNGTATTTATDPSSGSCVFAGSTMAGDSTSNSSVPSASPPTSLGAPPSDDLTPPVSSSPPTSLGAPPSDDLTPPVSSSPPSDFGPPATDTAPPTSFDAPAGGFGPPSGFSPPSVFGSPPSTFGPPGSLTGSGSFGPSSTLEPYGVGCRHVASLAASTLLSAIVLAVLCASPDLM

SEQ ID NO: 3529 - DNA, 1788 bp, Glycine max
  misc_feature (1)..(1788): Ceres cDNA ID no. 21665767
  misc_feature (1)..(1788): Ceres CLONE  ID no. 588574
  misc_feature (1)..(1788): Also known as  Ceres CDNA ID no. 0
agcgtttctgcgaccaacagctacaacagtttttcccaactccgaactaatcgaagaagatgactcgcggcataaaacaccgtcagaaagccaagagcaagaagaagggctcgaagaaagagggtggttcttcttcatctttggcgccagaaattccagcgaaggtgtggcaaccgggcgtggataagttagaggaaggtgaagagcttcagtgtgatccttctgcttacaattctcttcatgcctttcacattggatggccatgtttgagctttgatattttacgcgactctttgggcttggttcgaacagaatttccccacacagtatatttcatggcagggactcaggcagagaaaccttcttggaattctattggaatttttaaagtatcaaatattactggaaagagacgtgagccagtgcctaaacttggaactgatgacactgaaatggatggtgaggatagtgacagtgatgatgatagtgaggaagaagacgaaggtggtgctcagggtcccagtttgcagttgcgtaaggttgctcaccaaggatgtgtcaaccgtatacgctccatgccacaaaatcctcatatatgtgcagcttgggccgataccggtcatgtacaggtctgggacctaaactctcacctcaatgttctagctgagactgaaacagaaggtgtccaaggagttgctgcagtttttaatcaggacccattgtataaatttaaacacaaagatgaaggttatgctatagactggagtcctcttgttcctggaaagcttgcatctggggattgcaataattgtatttatctgtgggagcctacatctgctggaacgtggaatgttgataatgctccatttattggacatactgctagtgttgaagatctgcaatggagccctacagaatctcatgtttttgcttcttgttctgtggatggaaacattgcaatatgggatacccgtttggggaagtcaccagctgcatcttttaaggcacataatgctgatgtgaatgtaatgtcatggaacaggttggctagttgtatgttggcctcggggagtgatgatgggactatttctattcgtgatctcagactgctcaaggaaggagattctgttgtagcacatttcgaatatcacaagcacccaatcacatccattgagtggagtccacatgaagcctcttcattggcagtttcttcatctgataatcagcttacaatatgggacctttctttagaaaaggacgaggaagaggaggctgaatttaaagctaaaactaaagaacaagttaatgctcctgaagatctgcctccccaactattatttattcatcagggacagaaagacctgaaggaactacattggcacacacagattcctggaatgattgtatctaccgctgaagatggattcaacgtccttatgccttcaaatattcagagcacactgccatcgaatggtgctttgtagacgccccccgtgctaaattttcaagcaataagctgcttctggttacgatcatcgtcaatctacttgaatgttgttgaagaaagtttcctattgtaacttttttttctttttggttccttttgttttcttctcggcccgtgcttcaagttttgtggattatctggttagcttggtattcttcacttgattttgaatgcaattttcgtgtatgccgtctaaactaagtcatgtagaccaaaagtaaagtggaaacaaacaggctaatttagccaaaaaaattatttaaacaaaaaaaaaaaaaaaa

SEQ ID NO: 3530 - protein, 474 aa, Glycine max
MTRGIKHRQKAKSKKKGSKKEGGSSSSLAPEIPAKVWQPGVDKLEEGEELQCDPSAYNSLHAFHIGWPCLSFDILRDSLGLVRTEFPHTVYFMAGTQAEKPSWNSIGIFKVSNITGKRREPVPKLGTDDTEMDGEDSDSDDDSEEEDEGGAQGPSLQLRKVAHQGCVNRIRSMPQNPHICAAWADTGHVQVWDLNSHLNVLAETETEGVQGVAAVFNQDPLYKFKHKDEGYAIDWSPLVPGKLASGDCNNCIYLWEPTSAGTWNVDNAPFIGHTASVEDLQWSPTESHVFASCSVDGNIAIWDTRLGKSPAASFKAHNADVNVMSWNRLASCMLASGSDDGTISIRDLRLLKEGDSVVAHFEYHKHPITSIEWSPHEASSLAVSSSDNQLTIWDLSLEKDEEEEAEFKAKTKEQVNAPEDLPPQLLFIHQGQKDLKELHWHTQIPGMIVSTAEDGFNVLMPSNIQSTLPSNGAL

SEQ ID NO: 3531 - DNA, 1533 bp, Glycine max
  misc_feature (1)..(1533): Ceres cDNA ID no. 21665768
  misc_feature (1)..(1533): Ceres CLONE  ID no. 605262
  misc_feature (1)..(1533): Also known as  Ceres CDNA ID no. 24362964
aacccaccctacccggagcttcgttctggacattattctctcttctcttctcttctgtgctgtgcttaatttccagtttttgttttcagcaatggatgacgtcaaagacaaggtgaagggcttcatgaagaaagtcaacaaccctttctcttcttcctcatctgccaaattcaagggccaaggtagagtccttggttcttcttcttctacacccgctaattccaatcctacccctcgcccctaccctaattcgcagaaaccctcctcctcttcagctgtaaccaatcccaaaccctcgccccagaaaacggagcaaaataaaaccaccgataagcctcgcaaagatgatggctttgacccctttgattctttggtcactaattccaatagatcgcaaaatgggtattcgctgaacgtgttcgaatgccccatttgtaaacaaccctttagatccgaagaagaggtgtctgcacacgttgacggttgtttgaataaccctgttgagcgtggaagtgatgatggaaatggggtctcagagagtgatggtgggtctaatgatactaatactgaattggaggtttgtgttgggacttacatatcagggaagccatctgagggatcggttgatgtgatcctcaaactgttgaggaatattggtagggaacctgagaatgtaaagtttaggaggatcaggatgaataatcccaagattaaagaggctgttggtgatgttgccgggggagttgagttgctgagtttcgtagggtttgaactcagggaggagaatggagagacatgggcagtgatggagtttccctctgaggaacaaataaaattcattcagagagcaatagtgttgctggaatcacaacttgtacaacaaggacctcctaagagagacgatttgccgtctgcaacttctaccgagatgggtccaaaggcagaaacaaagccggttgacagacaagtacaaattgtgtctcttggttgcatttaagtatagccaatgtgcattttgctcttataggaagtttttgtgcgttttgaattcatattctggctggaaaatctacctgtgaataatttactaatgtgttgaagatctagaaaaccactggttttaagctcagtagcacggattacaggattaagaacataaaagatatctaacactggaatagctgagttaagataggatatgaagcatatacaaggcctgtctgggtaagtttctttagaagcacttctatgagaagaagaaaactgaaatgagcttcttcataagctaaaattagctctccattagctaagctctctcatataatcattgccattaggtttggtaactgtaactttatatatagagttgaagcctaaggtttctttgttgcccttatatctttgcttttgtttctggatgtaaaagtagggggcatatcaaattataggttcttttggacagtggtctagggttgtgtggacaattagacattgtgaaaattgtgataggtttggccaaaaaaaaaaaaaaaa

SEQ ID NO: 3532 - protein, 301 aa, Glycine max
  misc_feature: PFam Name: zf-C2H2; PFam Description: Zinc finger, C2H2 type
  misc_feature: GI Number: 21536572; NR Description: unknown [Arabidopsis thaliana]
MDDVKDKVKGFMKKVNNPFSSSSSAKFKGQGRVLGSSSSTPANSNPTPRPYPNSQKPSSSSAVTNPKPSPQKTEQNKTTDKPRKDDGFDPFDSLVTNSNRSQNGYSLNVFECPICKQPFRSEEEVSAHVDGCLNNPVERGSDDGNGVSESDGGSNDTNTELEVCVGTYISGKPSEGSVDVILKLLRNIGREPENVKFRRIRMNNPKIKEAVGDVAGGVELLSFVGFELREENGETWAVMEFPSEEQIKFIQRAIVLLESQLVQQGPPKRDDLPSATSTEMGPKAETKPVDRQVQIVSLGCI

SEQ ID NO: 3533 - DNA, 1250 bp, Glycine max
  misc_feature (1)..(1250): Ceres cDNA ID no. 21665769
  misc_feature (1)..(1250): Ceres CLONE  ID no. 613792
  misc_feature (1)..(1250): Also known as  Ceres CDNA ID no. 23699174
gaaaccgccacgccaccaccacggtgcaagttgaagacgaaccacaatctgggaaaaggcaagacaaaaaaagtgcgcagggttaaggttgtggtttatagtttagtttatctatggctagcggcaccacaagaatgctagtgaaggagatgttgcaactctcttcttccacacttcacttctcttcttcggcgcttcgcggcctctctcctcctctgcccttctcaattcaattgcgacgctcgcgggggcgccctgcaattcgatgtgcttcctcttcctcagactcagatgcttccaacaaagtctcgtctcgtctgtcgcaggttcagcatcttcttcagcaggccgaacaccgcgctctctccgccgaccagggcccacctcctaaaatcaccttagatcatgttacggtgagctttgccagaagtggaggacctgggggtcagaatgtcaataaagtgaacaccaaggtggacatgcgcttcaatgttaaaaatgcatattggttgagtgacaggatcagagacaagattttgcaaacggagaaaaaccgtattaacaaggatggggagcttgtgatttcttcaaccaagactagaacgcagaagggtaacattgaggatgctttggcaaagcttcaggaaatcattgatgcggcatcttatgttccgccgcctccctcagaagagcaaaagaagaaaattgcgaagatggctgccataggagaacagaaacgcctcaaaagcaagaaggtgctttcagataagaaggcgtttaggagaagtaaaaatagctgggactaatatggtgttgtccagaatcttgaaactgttttatcatttttgacgcagaagcacagtcctcttatactaccatattggatacacacacattagatgaatggttgaatataaccgtgaattcaagtagcatagcccaacaagcaatcatcccgctggaaggacctcaatggtggtttgtgacaacctattgttagttagccaaaattgtgatgtagctaggatctaaacgaatacaatattttcaaatagaaatatcgtatattggttgaatctgtattgttttctgtgtcagccttttgcccttttaatgcgcctttggcacgtgtccagattgatggatctatacaaacattgaaagtcaacaaccttgggaacgtgcttcacgtaaaaacacgtcaatacataatgccgctgttattgcgaccgaaaaaaaaaaaaaaaaaa

SEQ ID NO: 3534 - protein, 230 aa, Glycine max
  misc_feature: PFam Name: RF-1; PFam Description: Peptidyl-tRNA hydrolase domain
  misc_feature: GI Number: 6630453; NR Description: F23N19.20 [Arabidopsis
  misc_feature: GI Number: 27690532; NR Description: similar to Ict1 protein
  misc_feature: GI Number: 62657335; NR Description: PREDICTED: similar to
  misc_feature: GI Number: 20306641; NR Description: Ict1 protein [Mus musculus]
  misc_feature: GI Number: 31221210; NR Description: ENSANGP00000019355 [Anopheles gambiae] >gi|21300517|gb|EAA12662.1| ENSANGP00000019355
MASGTTRMLVKEMLQLSSSTLHFSSSALRGLSPPLPFSIQLRRSRGRPAIRCASSSSDSDASNKVSSRLSQVQHLLQQAEHRALSADQGPPPKITLDHVTVSFARSGGPGGQNVNKVNTKVDMRFNVKNAYWLSDRIRDKILQTEKNRINKDGELVISSTKTRTQKGNIEDALAKLQEIIDAASYVPPPPSEEQKKKIAKMAAIGEQKRLKSKKVLSDKKAFRRSKNSWD

SEQ ID NO: 3535 - DNA, 1360 bp, Triticum aestivum
  misc_feature (1)..(1360): Ceres cDNA ID no. 21665772
  misc_feature (1)..(1360): Ceres CLONE  ID no. 615391
  misc_feature (1)..(1360): Also known as  Ceres CDNA ID no. 24360463
agttttccccgtcggtctcctcccccagatccacatccacccatcgccatggcgatctccccccgcctcctcctcccgctcctcctcgcggcggcggccgcctccgccttcgccggcgccaacgacctggtcggcgagctccagtccctccgctcccgctcccccgccggcgtgatccacctcaccgacacctccgtcacccgcttcctctcctcgccggccccgcgcccctactccgtcctcgtcttcttcgacgccacctcgctccactccaagaccgacctccacctcccccagctccgccgcgagttcgcgctcctctccgcctccttccacgccaacaaccccgactcctccgacctcttcttcgccgacatcgagttctccgagtcgcagcactccttctcccagttcggcgtcaactccctcccccacgtccgcctcatccgcccggagcactcccgcctcgccgactcggagcagatggaccagtcccacttctcccgcctcgccgactccatggtcgagttcgtggaggcccgcaccggcctcgaggtcggccccatcgtccgcccgcctctcgtctcccgcaaccagatgatcctgctcggcctcttgttcctgatctccatcccgttcgggatcaagaggatcatggaaggggacaccctgcttcatgaccgcaagctttggatggccggggcgctgttcgtctacttcttcagcgtctcagggggcatgtacgggatcatcaggcatacgcccatgttcatcaccgaccgggaggatccaaacaagctcgtcttcttctaccagggctcagggatgcagctcggcgcagaggggtttgctgtcggtttcctgtacaccctcgtggggctgatgatagctgtggtgacacacttgctggtgaaggtggagagcctgcagacacagcgatttgcgatgctggcagtcatggccatcgggtggtgggcagtcaggaaggtgatttacctggataactggaagactgggtacggcattcataccttctggccgagtagctggaggtaaatgttgtctcaaccggcgatcgatgcttctttcctttggttgcagaggacgcggagtcatccagatcggccatactgagatagagcatcattttggttgtaacgtcgtactagcaagtttagcatttcaattctctggtgctttattgtggaatatagagaaccgagtcattttataccgaggattttaacttgcagtattacttgaacaatggtaaatcctagctgatatctgttctcaggcagtaacaccggccaaggatattaaccgtggaaaaaaaaaaaaaaaaaaaaaaaaaaaaaaa

SEQ ID NO: 3536 - protein, 335 aa, Triticum aestivum
  misc_feature: PFam Name: OST3_OST6; PFam Description: OST3 / OST6 family
  misc_feature: PFam Name: FH2; PFam Description: Formin Homology 2 Domain
  misc_feature: PFam Name: GATase_2; PFam Description: Glutamine
  misc_feature: PFam Name: Extensin_2; PFam Description: Extensin-like region
  misc_feature: PFam Name: Pyr_redox_2; PFam Description: Pyridine
  misc_feature: GI Number: 15220421; NR Description: OST3/OST6 family protein
  misc_feature: GI Number: 25402667; NR Description: protein T23J18.22 [imported] - Arabidopsis thaliana >gi|6554189|gb|AAF16635.1|
  misc_feature: GI Number: 6523547; NR Description: hydroxyproline-rich
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
  misc_feature: GI Number: 32420163; NR Description: predicted protein [Neurospora crassa] >gi|28925602|gb|EAA34623.1| predicted protein
MAISPRLLLPLLLAAAAASAFAGANDLVGELQSLRSRSPAGVIHLTDTSVTRFLSSPAPRPYSVLVFFDATSLHSKTDLHLPQLRREFALLSASFHANNPDSSDLFFADIEFSESQHSFSQFGVNSLPHVRLIRPEHSRLADSEQMDQSHFSRLADSMVEFVEARTGLEVGPIVRPPLVSRNQMILLGLLFLISIPFGIKRIMEGDTLLHDRKLWMAGALFVYFFSVSGGMYGIIRHTPMFITDREDPNKLVFFYQGSGMQLGAEGFAVGFLYTLVGLMIAVVTHLLVKVESLQTQRFAMLAVMAIGWWAVRKVIYLDNWKTGYGIHTFWPSSWR

SEQ ID NO: 3537 - DNA, 1292 bp, Triticum aestivum
  misc_feature (1)..(1292): Ceres cDNA ID no. 21665773
  misc_feature (1)..(1292): Ceres CLONE  ID no. 616235
  misc_feature (1)..(1292): Also known as  Ceres CDNA ID no. 24356519
agccagggcaaacagagaggacggacggaagaagtaagttccaggcagaggagacagagtgaccgacggagggaaggttccacctacccaccgagcgatcgaccgggcgggcggcgatccatggcggcgaacgggcatcagatccagccggcggaggaggcgatgaagctcatcatcgacaccgatcccggcatagacgacagcgtggcgatcatgatggcgttccaagcgccgggcgtggaggtcctagggctcaccaccatcttcggcaactgcaccaccgcatacgccacccgcaacgccttgatactgtgtgagaaggcaggccgccccgacgtgccggtggcggagggcagcgccgagcctctcaagggagggaagccgcaagttgccgactttgttcacggatccgatggcctcgggaacgtatcagttcctgaacctaccaccaagaaagcagagcaaaccgccgcagagtttctggtcgacaaggtgtcgcagttccccggggaggtctcggtgctcgccttgggccctctgaccaacctcgcattggccatcaagatggacccctcctttgtgagcaaggtgaagaagatagtggtgctgggtggagccttctttgcagcagggaatgccaccccttcagccgaggcaaacatccacagcgacccagaggcggcggacatggtgttcacgtcgggcgcggacatcgccgtggtcggcctcaacatcaccacccaggtgagcttcacggaggcggacctgtcggagctgaggaggtccgggggcaagcaggcgcagttcctctgcgacatctgcaagttctacagcgactggcacctccactcgtacggcgaccccgccgtgttcctgcacgacccggtgagcctcgcggcgctggtccggccggagctcttcacgttcaggaagggcgtggtgcgggtggagacccagggcatctgcagaggccacacctccatggacatggggctcaagaagttcaagtcggagaacgcgtggtcgggctacacgcccatctcggtggcgtggacggtggacaaggccaaggtggtcgccttcgtcaaggagctcctcaaaaattaatcaggagttcatgatctgtatatctggtcatcaaatgatttgaaaccgtagagatccgtcggtcgatcgacccgtaatttatgtgtaccccattctgacgcacttcatgcagacacattgtctcgtggaattattgaactgctcgtcgtgaattgtcatgatggaacccaaaaaaaaaaaaaaaa

SEQ ID NO: 3538 - protein, 1292 aa, Triticum aestivum
  misc_feature: PFam Name: IU_nuc_hydro; PFam Description: Inosine-uridine
  misc_feature: GI Number: 52077164; NR Description: putative inosine-uridine
  misc_feature: GI Number: 50948453; NR Description: putative inosine-uridine nucleoside N-ribohydrolase [Oryza sativa (japonica cultivar-group)] >gi|42407950|dbj|BAD09089.1| putative inosine-uridine nucleoside
  misc_feature: GI Number: 46560602; NR Description: putative inosine-uridine
  misc_feature: GI Number: 41469366; NR Description: putative inosine-uridine preferring nucleoside hydrolase, 3'-partial (with alternative
  misc_feature: GI Number: 41469367; NR Description: putative inosine-uridine preferring nucleoside hydrolase (with alternative splicing) [Oryza
AGCCAGGGCAAACAGAGAGGACGGACGGAAGAAGTAAGTTCCAGGCAGAGGAGACAGAGTGACCGACGGAGGGAAGGTTCCACCTACCCACCGAGCGATCGACCGGGCGGGCGGCGATCCATGGCGGCGAACGGGCATCAGATCCAGCCGGCGGAGGAGGCGATGAAGCTCATCATCGACACCGATCCCGGCATAGACGACAGCGTGGCGATCATGATGGCGTTCCAAGCGCCGGGCGTGGAGGTCCTAGGGCTCACCACCATCTTCGGCAACTGCACCACCGCATACGCCACCCGCAACGCCTTGATACTGTGTGAGAAGGCAGGCCGCCCCGACGTGCCGGTGGCGGAGGGCAGCGCCGAGCCTCTCAAGGGAGGGAAGCCGCAAGTTGCCGACTTTGTTCACGGATCCGATGGCCTCGGGAACGTATCAGTTCCTGAACCTACCACCAAGAAAGCAGAGCAAACCGCCGCAGAGTTTCTGGTCGACAAGGTGTCGCAGTTCCCCGGGGAGGTCTCGGTGCTCGCCTTGGGCCCTCTGACCAACCTCGCATTGGCCATCAAGATGGACCCCTCCTTTGTGAGCAAGGTGAAGAAGATAGTGGTGCTGGGTGGAGCCTTCTTTGCAGCAGGGAATGCCACCCCTTCAGCCGAGGCAAACATCCACAGCGACCCAGAGGCGGCGGACATGGTGTTCACGTCGGGCGCGGACATCGCCGTGGTCGGCCTCAACATCACCACCCAGGTGAGCTTCACGGAGGCGGACCTGTCGGAGCTGAGGAGGTCCGGGGGCAAGCAGGCGCAGTTCCTCTGCGACATCTGCAAGTTCTACAGCGACTGGCACCTCCACTCGTACGGCGACCCCGCCGTGTTCCTGCACGACCCGGTGAGCCTCGCGGCGCTGGTCCGGCCGGAGCTCTTCACGTTCAGGAAGGGCGTGGTGCGGGTGGAGACCCAGGGCATCTGCAGAGGCCACACCTCCATGGACATGGGGCTCAAGAAGTTCAAGTCGGAGAACGCGTGGTCGGGCTACACGCCCATCTCGGTGGCGTGGACGGTGGACAAGGCCAAGGTGGTCGCCTTCGTCAAGGAGCTCCTCAAAAATTAATCAGGAGTTCATGATCTGTATATCTGGTCATCAAATGATTTGAAACCGTAGAGATCCGTCGGTCGATCGACCCGTAATTTATGTGTACCCCATTCTGACGCACTTCATGCAGACACATTGTCTCGTGGAATTATTGAACTGCTCGTCGTGAATTGTCATGATGGAACCCAAAAAAAAAAAAAAAA

SEQ ID NO: 3539 - DNA, 1993 bp, Glycine max
  misc_feature (1)..(1993): Ceres cDNA ID no. 21665774
  misc_feature (1)..(1993): Ceres CLONE  ID no. 624492
  misc_feature (1)..(1993): Also known as  Ceres CDNA ID no. 24361127
atattcaaaattcattccttcatttccatttccctttcttcttctctccctcaaaccaaaatgctattatccacacttcaaacccctcgctccctctctcgcctcacgcgccaccctcactccttcacctcacgcgcctccctcacccaccaaacccaaacgctcaccccctcctccccctcccctccgccgcagtccgaaatcctctccatccgccacgccctcctctcccgccgcgcctccgccgccgaccttgtcctctcccaactcgcgcgcctccgcctcgccgagccccgcctccgctccttcctccacctccccgacgatgacgccctccttgcccacgcgcgccgcctcgacgcccgcatcgccgccggggaggaccccggccccctcgccggcgtgctggtcggcgtcaaggacaacatttgcaccgccgacatgccgtcgaccgccgggtcccgcatccttgaagggtaccgggcgccgttcgacgccaccgcggtgaagagagtgagggagttaggagggatcgttgttgggaaaaccaatatggatgagtttggaatgggtagcaccactgaagcttctgcatttcaggtgactgccaacccatgggatgagtctagggtgccaggaggatcatcaggaggatcagcagctgcagtttctgccagacagtgtgttgtatcgttgggaagtgacactggtggaagtgtgaggcagccagcatctttttgtggtgttgtaggtttgaagccaacttatgggcgtgtctcaagatttggacttatggcgtatgcatcatcacttgatgctattggctgttttggttcatcggttgctgatactgggactctccttcatgcaattgctggccatgatagatttgatgccacctcaagtaagcaggatgtgcctgactttcaatctcattttgtcgctgtgagctccttggaaagtaagcccttgaagggactgagagttggtttgatccgtgaaactattgatgatggtgttgatgctggagtaatttctgcaattcgggcagctgctttgcattttgaggaattaggatgctctgtgaatgaggtttcactgccatccttttcccttgggttgccagcatattatatccttgctgtatctgaatcatcttccaacttgtctcgttatgatggtatcagatatggaaaccaagtttatgctgatgagctagattctctttatggaggttcccgggctcaagggtttggttctgaggttaaaatgagaattttgatgggaacatatgccctttcagctggttactatgatgcatattacaaacgtgcacagcaggtaaggaccataattaggaatagctttaaggaggccctcagtcaaaatgacatcttgatttcccctgcagctccttcagctgcttataaaattggtgaaaagaaaaatgatccattggctatgtatgcaggcgatatcatgactgtaaatgtcaatctagctggactacctgccttggttttgccatgcggatttgttgagggtgggccttcaggccttcctgttggtctgcaaatgattggtgctgcatttaatgagggagagctgctgagagtgggacatatctttgagcaaacccttgaaaattgcaaattcgttccaccaattgtagttgatgacattgcatactgagtataacttataattctacattttagtgttccatctatagttccattagtttcaagacaatgaggtgactggaacaggtatttttcagctcaggtaatacttcaaattttttagtcacactactgaaagggggttgggtgagaaagttcactatttgaaattgagtatgttcataataaaccttcaattagctttttgatgagggggtcatgtgctttggggacaaattgtatgaataattaatgttgtgttttattcaatgtagaattagctagattgtaattcaaaaaaaaaaaaaaaa

SEQ ID NO: 3540 - protein, 543 aa, Glycine max
  misc_feature: PFam Name: Amidase; PFam Description: Amidase
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Drf_FH1; PFam Description: Formin Homology Region 1
  misc_feature: GI Number: 23308481; NR Description: At3g25660/T5M7_8 [Arabidopsis thaliana] >gi|11994757|dbj|BAB03086.1| glutamyl tRNA amidotransferase, subunit A [Arabidopsis thaliana] >gi|15010726|gb|AAK74022.1| AT3g25660/T5M7_8 [Arabidopsis
  misc_feature: GI Number: 11078533; NR Description: Glu-tRNA(Gln)
  misc_feature: GI Number: 17228548; NR Description: glutamyl-tRNA (Gln) amidotransferase subunit A [Nostoc sp. PCC 7120] >gi|23821613|sp|Q8YY02|GATA_ANASP Glutamyl-tRNA(Gln) amidotransferase subunit A (Glu-ADT subunit A)
  misc_feature: GI Number: 45506853; NR Description: COG0154: Asp-tRNAAsn/Glu-tRNAGln amidotransferase A subunit and related
  misc_feature: GI Number: 46130304; NR Description: COG0154: Asp-tRNAAsn/Glu-tRNAGln amidotransferase A subunit and related
MLLSTLQTPRSLSRLTRHPHSFTSRASLTHQTQTLTPSSPSPPPQSEILSIRHALLSRRASAADLVLSQLARLRLAEPRLRSFLHLPDDDALLAHARRLDARIAAGEDPGPLAGVLVGVKDNICTADMPSTAGSRILEGYRAPFDATAVKRVRELGGIVVGKTNMDEFGMGSTTEASAFQVTANPWDESRVPGGSSGGSAAAVSARQCVVSLGSDTGGSVRQPASFCGVVGLKPTYGRVSRFGLMAYASSLDAIGCFGSSVADTGTLLHAIAGHDRFDATSSKQDVPDFQSHFVAVSSLESKPLKGLRVGLIRETIDDGVDAGVISAIRAAALHFEELGCSVNEVSLPSFSLGLPAYYILAVSESSSNLSRYDGIRYGNQVYADELDSLYGGSRAQGFGSEVKMRILMGTYALSAGYYDAYYKRAQQVRTIIRNSFKEALSQNDILISPAAPSAAYKIGEKKNDPLAMYAGDIMTVNVNLAGLPALVLPCGFVEGGPSGLPVGLQMIGAAFNEGELLRVGHIFEQTLENCKFVPPIVVDDIAY

SEQ ID NO: 3541 - DNA, 1370 bp, Triticum aestivum
  misc_feature (1)..(1370): Ceres cDNA ID no. 21665776
  misc_feature (1)..(1370): Ceres CLONE  ID no. 630477
  misc_feature (1)..(1370): Also known as  Ceres CDNA ID no. 24361364
gcgatcgggacaccaccccgccggctagcgatgttgccccctccgcgccgcggcccggcgtacaagaccaagatgtgcgcgctgtggcagaacggcaactgcgaccgcgagctctgcagcttcgcccacggcacggccgagctccgtcggcccccctcctcccggcccaccttcccgccccaccacgccgggagaagagattatagaggtggtgatttcagaggcaggattgaaaggaggttctcacctcgcaggaggcattcccctggaagagatttcaggggtcatcgttccctacatgatcgaaggccaacttctcgagaaagggagtctagcttttcacggtctcccagcaggaagagtgagaggaggcatgaaaagaagatggatgatggagaaaccaactcatctaagagttctcctatctctgataataatgataggaaaaaggaaaaagtcactagtggtgacgagaaagaggattatgaaaaggagctgaaacaagttagatcagatatggaggctttgcgtgacgataaatctcatctcgagattgttttggatgagaaaatggacgaagtgcgcaggatttctagccaagtaagtgaccttgatcagcagctgaggagggagaaagaagaatgtcatagaatgacgtcaaaaatgaagaagttcctaaaagctcatgtgcgttttatgaaagctcgggaggagttgaaaaggtcacaagctcgttttgagagacttggtgatatgcttgcttcagaaattttaaagcgtgctaatgaagaagcttccagcgtccatgttgatgaagatctaaatggaccttatgaaaggagtccaaatgctactccagctaaaaagagatcaatcccatactcaactagtgatgaggcaaaagctgctaagaaaagaagagagcgagactctgatacattcactaggtcagataaatataggtcagaaggcgatattacagaatatgataaaacaattaagggtagtgatggaacaaaatctatatatttgaagaagagactctgggaagatgaaaagaataagcttggaaatgctgcctcctctgcagaccagtatgaggacctcgacgaggaagtggatgtggacgtataagccgagcgcatagttgatatgataaacgacgcgatggcggtggctagcataatacaccagttggcttctgggagtccgaagactgttattagcatttccgtgtacaaagtggcatcttttgtgtttttttagcataatacctatctatttgatatatatattgggtgtttttagctttttactcagaatcctcgttttgtagtggcatcctttggtgttgaaaaaaaaaaaaaaaa

SEQ ID NO: 3542 - protein, 367 aa, Triticum aestivum
  misc_feature: PFam Name: zf-CCCH; PFam Description: Zinc finger
  misc_feature: GI Number: 51963878; NR Description: PREDICTED OJ9003_G05.19 gene product [Oryza sativa (japonica cultivar-group)] >gi|50905399|ref|XP_464188.1| putative BRI1-KD interacting protein [Oryza sativa (japonica cultivar-group)] [Oryza sativa
  misc_feature: GI Number: 42733472; NR Description: BRI1-KD interacting
  misc_feature: GI Number: 61742810; NR Description: RIKEN cDNA 3110050K21
  misc_feature: GI Number: 50761541; NR Description: PREDICTED: similar to Splicing factor, arginine/serine-rich 12 (Serine-arginine-rich splicing regulatory protein 86) (SRrp86) (SR-related protein of 86
MLPPPRRGPAYKTKMCALWQNGNCDRELCSFAHGTAELRRPPSSRPTFPPHHAGRRDYRGGDFRGRIERRFSPRRRHSPGRDFRGHRSLHDRRPTSRERESSFSRSPSRKSERRHEKKMDDGETNSSKSSPISDNNDRKKEKVTSGDEKEDYEKELKQVRSDMEALRDDKSHLEIVLDEKMDEVRRISSQVSDLDQQLRREKEECHRMTSKMKKFLKAHVRFMKAREELKRSQARFERLGDMLASEILKRANEEASSVHVDEDLNGPYERSPNATPAKKRSIPYSTSDEAKAAKKRRERDSDTFTRSDKYRSEGDITEYDKTIKGSDGTKSIYLKKRLWEDEKNKLGNAASSADQYEDLDEEVDVDV

SEQ ID NO: 3543 - DNA, 686 bp, Triticum aestivum
  misc_feature (1)..(686): Ceres cDNA ID no. 21665777
  misc_feature (1)..(686): Ceres CLONE  ID no. 631861
  misc_feature (1)..(686): Also known as  Ceres CDNA ID no. 23484823
ctcttcggatccttctcagatccctaatcctccatcggccctctcgacctctccagccggcgagcgacgctgtcggcggtcctggccagatccggtgttggctcccctccacagcttcttctccctacctcctgtcttccgctccggcttcaaggtcgcgtggatccgcctcccggccaggcccaacgtcgcgcggcgcatcatcgcagggattcgtcggccgtcgctagtcgtcctcgtcgatggccgcggccgcctcgcgcacaactgcctaggtcaccgtctggcctccaccatgccggactccgatgggttcgcgacagatccgaagacccgcggcacagagttgttagagaatacgcagcccagacggctacacgcgccagctcttcttcctgactccatcccctcactggctcagtatcaaggagattgagaagtcagacatctggattttggtgtagaacacatgttatgctccgggcatatgaagttccaagagcaagaaacagtataactggcggcaagagaagaacattctgtcatataccatcaggatagcaaagctgaacacaattttttaaagcaatgcttgttcagttgtgatccttaagtccttcgcactcattcttactggtcatgcactagaaatgatcatgtcaacttatgtaaaaaaaaaaaaaaaa

SEQ ID NO: 3544 - protein, 46 aa, Triticum aestivum
  misc_feature: PFam Name: Glyoxalase; PFam Description:
MPDSDGFATDPKTRGTELLENTQPRRLHAPALLPDSIPSLAQYQGD

SEQ ID NO: 3545 - DNA, 964 bp, Triticum aestivum
  misc_feature (1)..(964): Ceres cDNA ID no. 21665778
  misc_feature (1)..(964): Ceres CLONE  ID no. 632172
  misc_feature (1)..(964): Also known as  Ceres CDNA ID no. 23466337
ttctagaaccttctccacgatggcgttcctccgagccctccggcgagccctcccgccgctctactcgccggcggcgcctctttcccggcgcgcaccaggtcctcctccgctcccttcccgccctctccggctcctggatccgatcgggttccggccgttctccgccgcggccgccaccgccaccgccgtcgcgcgggtgccggaaatgggggccagcctcttcagagggctcacggagaccaggttccccaagcggcgcccggggttcgtgtcccggcgcaagagggccagcctgcgacccaaaggtccgcactactgggtgaggtgcacgccgggggagcctatcccttcgagccagccgaataagggcagcgtgcaggggaggaaggagaagaagcggatcaagcagcgcaaggacttcatcatggctgagaagaggaagcgcaaagcacagtattctgttgctgtgaagaggaaggaggcagaacggacagaaagaaagatggctgcagtggcaagagaccgggcatgggtggaaaggttggcagagctaaagcagatagaggcagaaaagaaagctgcaatggcttgaggagctcctctggaaacggcaaggcgtctaactcgtttctgctgctccgtttcgtctctttttttctgtgctacagttgccaacaatgccacaacccttctcggtgaaactttggctgtacccctcctctcaacagccatcccaaaatggcagattttgttttgatatgatgttctcaaatttgtcttaaatgtaatgaaatattgattctgtgttgtatttagaataaaccaaatgatcttagttgtgtgctggcaatcagaaatgacaaatgagtgcaaccttctgtcacatttatggcagagaagtttgtacggagtcagtattggaactacaagtgattgttattgatctaaaaaaaaaaaaaaaaaa

SEQ ID NO: 3546 - protein, 190 aa, Triticum aestivum
  misc_feature: GI Number: 21553452; NR Description: unknown [Arabidopsis thaliana]
MAFLRALRRALPPLYSPAAPLSRRAPGPPPLPSRPLRLLDPIGFRPFSAAAATATAVARVPEMGASLFRGLTETRFPKRRPGFVSRRKRASLRPKGPHYWVRCTPGEPIPSSQPNKGSVQGRKEKKRIKQRKDFIMAEKRKRKAQYSVAVKRKEAERTERKMAAVARDRAWVERLAELKQIEAEKKAAMA

SEQ ID NO: 3547 - DNA, 1292 bp, Triticum aestivum
  misc_feature (1)..(1292): Ceres cDNA ID no. 21665779
  misc_feature (1)..(1292): Ceres CLONE  ID no. 632926
  misc_feature (1)..(1292): Also known as  Ceres CDNA ID no. 24361333
atttgtgaaaaggtcgcctgtcacgtagctagctagccagtagccacgccaggcatttgttgtgggcgagagtcggtgagttgatgtgctgcggcgccgaggtggcggaccctggagagcaccggcggcggctagccgccggcgacgacgacgggggagatggacgggaggagcatgcactgtccccgccgcctctcaatacgacgatgtgggggcgcagacaggcgcaggagatgtcggccatggtatcggcgctagctcaggtcgtcgccggcggcgtgggcgagggtgtcatggcgtcttcgaccaagagacccgccgagcacgaggccttcgcggaggaggcgtggtggtcgacgtcgtacggaggtggagacggagacggcggagcgccgtcggcggcctcttccttccttgccgattacacggcagcgcccgcggcatcctactcgccgcacggggcggcagccggcgacgaggagcttccttcgccgtcctccgccgagtctggtggctccgggggcacgccgaggaagcggtacaggggcgtgcggcagcggccgcgggggaagtgggcggcggagatccgtgacccgcacaaggcggcgcgtgtgtggctcgggaccttcgacgacgccgaggccgccgcgcgtgcctacgacgccgccgccctcggattctgcggcagccgcgccaagctcaacttccccgagtcggccaccatcccgccgccgcagcagcctcctcatgcaccggcattagcgatgccaccgccgcagcagcctcctcatgcaccggcattagcgatgccaccgccgcagcggcccgaggcgctgctggagtcgcaggctctgttgggagggcaggcttattcccactacgccaggttcctgcggccgagcaccggcggctcgacgtcgggggcgccgagaacgccggcgcctcctctgatttacagcttcggagccggagcgagctaccccttgcagcccgagcgcagaggtgagggtgccagtacagaacgcccggccccggtggtgacctcagcagcggcgtgggcagcctacagccacgagcagcctcagcggcgggatgacccgtcggtgtgatcccaacgcaacattcgctcacagtcaaagcgaagccgacggatactgacaaggaagggagaaaaaagggtggactcgtttctcacgtcccgtggtcagcgtgttcacacggacagcaaattgtttggtttcttggtggaattggaatttctgaaaaacttgtgaccaaaaaaaaaaaaaaaa

SEQ ID NO: 3548 - protein, 341 aa, Triticum aestivum
  misc_feature: PFam Name: AP2; PFam Description: AP2 domain
  misc_feature: PFam Name: Transformer; PFam Description: Fruit fly
  misc_feature: PFam Name: Lipoprotein_5; PFam Description: Transferrin
  misc_feature: GI Number: 62701943; NR Description: AP2 domain, putative
  misc_feature: GI Number: 34908616; NR Description: P0677H08.8 [Oryza sativa (japonica cultivar-group)] >gi|20160854|dbj|BAB89793.1| P0677H08.8
  misc_feature: GI Number: 56784771; NR Description: AP2 domain transcription
  misc_feature: GI Number: 2281637; NR Description: AP2 domain containing
  misc_feature: GI Number: 21386995; NR Description: RAP2.6 [Arabidopsis thaliana] >gi|17065542|gb|AAL32925.1| RAP2.6 [Arabidopsis thaliana] >gi|3617742|gb|AAC36019.1| RAP2.6 [Arabidopsis thaliana]
MCCGAEVADPGEHRRRLAAGDDDGGDGREEHALSPPPLNTTMWGRRQAQEMSAMVSALAQVVAGGVGEGVMASSTKRPAEHEAFAEEAWWSTSYGGGDGDGGAPSAASSFLADYTAAPAASYSPHGAAAGDEELPSPSSAESGGSGGTPRKRYRGVRQRPRGKWAAEIRDPHKAARVWLGTFDDAEAAARAYDAAALGFCGSRAKLNFPESATIPPPQQPPHAPALAMPPPQQPPHAPALAMPPPQRPEALLESQALLGGQAYSHYARFLRPSTGGSTSGAPRTPAPPLIYSFGAGASYPLQPERRGEGASTERPAPVVTSAAAWAAYSHEQPQRRDDPSV

SEQ ID NO: 3549 - DNA, 1379 bp, Glycine max
  misc_feature (1)..(1379): Ceres cDNA ID no. 21665780
  misc_feature (1)..(1379): Ceres CLONE  ID no. 638386
  misc_feature (1)..(1379): Also known as  Ceres CDNA ID no. 24360082
actgcaattctccattcatccatccacggcaccaccatgcttcttcttctttacctctcccttctgtgttcccttccccacattgcattgtcatcccattgcaccgtggaaaccgccacgaaaacgtttaaaaaatgcatgaacctcccaacccagcaagcctccatagcgtggacattccaccctcacaactcaaccttagaactagtcttctttggaagcttcatatcaccttctgggtgggttggatggggcatcaatcccacatcacccgaaatgaccggaacacgtgccttaataaccttcccggacccaaactcaggccaaatagtgcttctaccgtatattcttgaccccacagtgaagcttcaaaaatctccactactctctcgcccactcgacatccacctcctctcctccaccgccactatgtacggcggaaaaatggccaccgtgcacaacggtgcagccatccaaatcttgggcacggtgaagctgcaaacgaacaagaccaagattcacctcgtttggaacagggggctgtacgttcagggctactctcccaccattcatccaactacttccaccgatctgtcttccattgttacctttgacgtattgtcgggttcgtcggctccacagcacacggatctcacgacgttgagagtgatccatggcaccgttaacgccatatcgtggggcattttgttaccaatgggagccatcaccgcacgctaccttaggcacattcaagcactcggccctgcatggttctatgctcatgcaggaatgcaagtgtttggtttcgttctgggaacagtggggtttgtgatcggaatcaggctggggcaactgtcgccgggagtggagtataggctccaccggaagcttggaatggcggtgttttgtctggggggtctgcagactctggccttgttatttaggccaaacacaaggaacaagttcagaaaatactggaagtcctaccatcactttgtagggtactcgtgtgtggtccttggctttgtgaatgtctttcagggatttgaggttatgggggcaagcagatcttacgccaagttgacttactgcttaggtctctccactctcattgggctttgcattgctttggaggtcaactcttgggttgtcttctgtaggaaatccaaggaagacaagatgaggagagagggactcattggaacttcccacaaacccatccacaattaacattcatcattattcttattatatattattacatttcattcctctttaatttctcttttactaatacattacattttctctccaattaatgccaaggtctgcaattatatataaagattaattttgtcgtttcaaaaaaaaaaaaaaaa

SEQ ID NO: 3550 - protein, 397 aa, Glycine max
  misc_feature: GI Number: 21536849; NR Description: unknown [Arabidopsis thaliana]
  misc_feature: GI Number: 50947767; NR Description: putative auxin-induced protein [Oryza sativa (japonica cultivar-group)] >gi|42407746|dbj|BAD08893.1| putative auxin-induced protein [Oryza sativa (japonica cultivar-group)]
  misc_feature: GI Number: 13785209; NR Description: putative membrane
  misc_feature: GI Number: 21593814; NR Description: unknown [Arabidopsis thaliana]
  misc_feature: GI Number: 27363428; NR Description: At4g17280/dl4675c [Arabidopsis thaliana] >gi|18086563|gb|AAL57706.1|
MLLLLYLSLLCSLPHIALSSHCTVETATKTFKKCMNLPTQQASIAWTFHPHNSTLELVFFGSFISPSGWVGWGINPTSPEMTGTRALITFPDPNSGQIVLLPYILDPTVKLQKSPLLSRPLDIHLLSSTATMYGGKMATVHNGAAIQILGTVKLQTNKTKIHLVWNRGLYVQGYSPTIHPTTSTDLSSIVTFDVLSGSSAPQHTDLTTLRVIHGTVNAISWGILLPMGAITARYLRHIQALGPAWFYAHAGMQVFGFVLGTVGFVIGIRLGQLSPGVEYRLHRKLGMAVFCLGGLQTLALLFRPNTRNKFRKYWKSYHHFVGYSCVVLGFVNVFQGFEVMGASRSYAKLTYCLGLSTLIGLCIALEVNSWVVFCRKSKEDKMRREGLIGTSHKPIHN

SEQ ID NO: 3551 - DNA, 628 bp, Triticum aestivum
  misc_feature (1)..(628): Ceres cDNA ID no. 21665781
  misc_feature (1)..(628): Ceres CLONE  ID no. 639108
  misc_feature (1)..(628): Also known as  Ceres CDNA ID no. 24361376
acacagccgagcaccaagatccctcttccttcctcctcctccagtcccctcctccagccagcgcgagcgagcgagcttgagagaggttggtacctgcagcaggtagccattgacggccaccgccgcgggccgcgccagattctgatgctcgaggcggcgttcaagaaatgtccccaccccgacaagacccaggtcgctaatctcagccgcgaaaccggcatggagtcccagcagatcgtatactggttccagacccggcgggcgcacatcaagggatcttcatcgaacacgaggcctctgacccagggatcttcatcgtcagatccttgatgctctcattccacaacttctccttcatgctgtgacacaagaaggagcgtcatagagatggaggctgatgtttctcgctgttcatgctatcgtgttcttcctcggcttagtgtttgtgtgtgtgtttcggcttgtgagccaagagccccctacgggtttgtatcgtgtccgtctgtgtgagtgtgtatgtgttggctcttgagccttagaccctagatgggtttttatcgtgttgtgttgtgtttgccttgcatttgaattttaaactctgccaatttctggaaaaaaaaaaaaaaaa

SEQ ID NO: 3552 - protein, 628 aa, Triticum aestivum
  misc_feature: PFam Name: Homeobox; PFam Description: Homeobox domain
  misc_feature: GI Number: 31339109; NR Description: GL2-type homeodomain
  misc_feature: GI Number: 51091201; NR Description: putative homeobox [Oryza
  misc_feature: GI Number: 31339105; NR Description: GL2-type homeodomain
  misc_feature: GI Number: 31339101; NR Description: GL2-type homeodomain
  misc_feature: GI Number: 31339107; NR Description: GL2-type homeodomain
ACACAGCCGAGCACCAAGATCCCTCTTCCTTCCTCCTCCTCCAGTCCCCTCCTCCAGCCAGCGCGAGCGAGCGAGCTTGAGAGAGGTTGGTACCTGCAGCAGGTAGCCATTGACGGCCACCGCCGCGGGCCGCGCCAGATTCTGATGCTCGAGGCGGCGTTCAAGAAATGTCCCCACCCCGACAAGACCCAGGTCGCTAATCTCAGCCGCGAAACCGGCATGGAGTCCCAGCAGATCGTATACTGGTTCCAGACCCGGCGGGCGCACATCAAGGGATCTTCATCGAACACGAGGCCTCTGACCCAGGGATCTTCATCGTCAGATCCTTGATGCTCTCATTCCACAACTTCTCCTTCATGCTGTGACACAAGAAGGAGCGTCATAGAGATGGAGGCTGATGTTTCTCGCTGTTCATGCTATCGTGTTCTTCCTCGGCTTAGTGTTTGTGTGTGTGTTTCGGCTTGTGAGCCAAGAGCCCCCTACGGGTTTGTATCGTGTCCGTCTGTGTGAGTGTGTATGTGTTGGCTCTTGAGCCTTAGACCCTAGATGGGTTTTTATCGTGTTGTGTTGTGTTTGCCTTGCATTTGAATTTTAAACTCTGCCAATTTCTGGAAAAAAAAAAAAAAAA

SEQ ID NO: 3553 - DNA, 1356 bp, Triticum aestivum
  misc_feature (1)..(1356): Ceres cDNA ID no. 21665782
  misc_feature (1)..(1356): Ceres CLONE  ID no. 639192
  misc_feature (1)..(1356): Also known as  Ceres CDNA ID no. 24361379
atcagtcagcttaccagataaacaccaacagaaatcacttcccagccaccaaagacttcccattcgatccgatcaccacaaaaaacctcaagcttctcgaccggtttattagttgttcaacagccaacaccatgagctctcggatggccggagccacgttgctgcgccacctgggcccccacctcttcgccgccgccgagccggcgtccgggctcgccgcgagcgcgaggggtatcctgcccgccgccgcgaggatcttccccgcgcggatggccagcaccgccgccggcgcgcatgccaaacaagaaggtgacgctgaaaagcccgagagcgccacagcgccggagcagaacaagaagcccgtggcgagctactggggcatcgagccgcggaagctcgtcaaggacgacggcacggagtggccgtggttctccttcaggccgtgggacacgtaccggccggacacgtccatcgacgtggccaagcaccacgagcccagggcggtggcggacaaggtggcgtacctcatcgtgcggacgctgcgcgcgggcagcgacctcttcttccagcgccgccacgctagccacgcgctgctgcttgagacggtggcggcggtgccgcccatggtgggcggcgtgctgctgcacctgcgctcgctccgccgattcgagcacagcggcggctggatccgcgcgctcatggaggaggccgagaacgagcgcatgcacctcatgaccttcatggaggtgacgcagcccctgtggtgggagcgcgcgctcgtgctcgccacgcagggcgtcttcttcaacgcctacttcgtcggctacctcatctcccccaagttcgcgcaccgcttcgtcggctacctcgaggaggaggccgtccactcctacaccgagtacctcaaggaccttgaggccggcttgatcgagaacacgcccgcgccggccattgccatcgactactggcgcctccccgccgacgccaggctcaaggacgtcgtcatcgccgtgcgcgccgacgaggcgcatcaccgcgacgccaaccactacgcatcggacatccattaccagggaatgacgctgaatcagacgcctgcgccgctcggctaccactgatcagttcaatggaccaccatagatcgatgcctgcccagtccttccgcccagtccaccgctgtcacctactaccactgccgccgacgtttgtcccgttaatttgagatggattgttgcgcgcgcagtatgtttatgtccatgagttttttgtgtcactttgtacccaaagatatgtttttgtaagccggtaattcttgtacatatgaattgattactttttacaaaaaaaaaaaaaaaa

SEQ ID NO: 3554 - protein, 328 aa, Triticum aestivum
  misc_feature: PFam Name: AOX; PFam Description: Alternative oxidase
  misc_feature: GI Number: 25989201; NR Description: alternative oxidase AOX3
  misc_feature: GI Number: 51860701; NR Description: mitochondrial
  misc_feature: GI Number: 51860697; NR Description: mitochondrial
  misc_feature: GI Number: 25989199; NR Description: alternative oxidase AOX2 precursor [Zea mays] >gi|39984776|gb|AAR36136.1| alternative
  misc_feature: GI Number: 51860695; NR Description: mitochondrial
MSSRMAGATLLRHLGPHLFAAAEPASGLAASARGILPAAARIFPARMASTAAGAHAKQEGDAEKPESATAPEQNKKPVASYWGIEPRKLVKDDGTEWPWFSFRPWDTYRPDTSIDVAKHHEPRAVADKVAYLIVRTLRAGSDLFFQRRHASHALLLETVAAVPPMVGGVLLHLRSLRRFEHSGGWIRALMEEAENERMHLMTFMEVTQPLWWERALVLATQGVFFNAYFVGYLISPKFAHRFVGYLEEEAVHSYTEYLKDLEAGLIENTPAPAIAIDYWRLPADARLKDVVIAVRADEAHHRDANHYASDIHYQGMTLNQTPAPLGYH

SEQ ID NO: 3555 - DNA, 1432 bp, Triticum aestivum
  misc_feature (1)..(1432): Ceres cDNA ID no. 21665783
  misc_feature (1)..(1432): Ceres CLONE  ID no. 639225
  misc_feature (1)..(1432): Also known as  Ceres CDNA ID no. 23482763
aaaaacctccaccgcgactgcgcgatcgatcgtcatctcatctcggcgtaccactactccctcaaacttgcccccttctcgatatcctgccttctcgtttacgtgctcggcgtgtgtgctagctagaggtgctgaacgaccgacatcggccggctgccatggggcgtggcgacggacacgacgacgcgctgcggcggtggctgcgggaagcgggcgggtggctggtggtcgacggggccctgggcacggagctggaggcgcacggcgcggacctgcaggacgagctctggagcgcccggtgcctcgtctccgctccccacctcatccgcaaggtccatctggactacctcgacgcaggcgccaacatcataaccacggcctcctaccaggccacgctgcaggggttccagtcgcgaggcgtgtcgagggagcagggcgaggcgctgctccggcggagcgtgcagatcgcgcaggaggcgcgcgccatcttcgtggaaggccggtcgaaaggcccctacgccgcgcgcgatgagtacgacggcgtggcgtccagagcgcaccggcccgtgctcgtggcggcctccgtcgggagctacggggcgtacctcgcggacggctccgagtacaccggggactatggcagatccgtcaccaaggaagcgctcaagaacttccacaggaggcggctccaggtgctggcggacgcagggccggatctcatcgccttcgagaccatcccaaacaagctggaagcacaggcttacgctgagctgttggaggagaacgacatcaggattcccgcctggttctccttcacctccaaggacggggccaacgcggcgagcggtgaccccatcaccgagtgcgccgccgtcgccgactcctgcaggagggtggccgccgtcgggataaactgcacggctcccaggctaatccatggcctcgtcctctccattagcaaggtgacgagcaagccgatcgtggtgtaccccaacaccggggagacgtacgtggccgagaccaaggagtgggtggactcggctgctgctggtggtggtgttgcggggacggacttcgtgtcgtgcgtcggcaagtggaggcaggcaggagcttccctcgtgggagggtgctgcaggacgggcccggcgacggtgagggccatcgcgcgggcgctgcgggaggaggatgctgccgccgacgccgataccgacgatgactaccctgccgtggccgtcctgtagagcctataggccaccctttctacatcgaccgcgatgctggcgtagaggtgtatgtagatcgtcgttctcatggccctgttgtgatgtaaatcgttatcatggctctttttgttatgacgaagcttggttctttgatctttctaattttagtcgtattctccgctgtgttgctgtcaaaaaaaaaaaaaaaa

SEQ ID NO: 3556 - protein, 360 aa, Triticum aestivum
  misc_feature: PFam Name: S-methyl_trans; PFam Description: Homocysteine
  misc_feature: GI Number: 53793355; NR Description: putative Homocysteine
  misc_feature: GI Number: 34909958; NR Description: putative homocysteine S-methyltransferase-4 [Oryza sativa (japonica cultivar-group)] >gi|20160918|dbj|BAB89855.1| putative homocysteine
  misc_feature: GI Number: 21593147; NR Description: putative selenocysteine
  misc_feature: GI Number: 33589736; NR Description: At3g63250/F16M2_100 [Arabidopsis thaliana] >gi|7523407|emb|CAB86426.1| homocysteine S-methyltransferase AtHMT-2 [Arabidopsis thaliana] >gi|50400668|sp|Q9M1W4|HMT2_ARATH Homocysteine
  misc_feature: GI Number: 6685163; NR Description: homocysteine S-methyltransferase AtHMT-2 [Arabidopsis thaliana] >gi|25453566|pir||T51939 homocysteine S-methyltransferase (EC
MGRGDGHDDALRRWLREAGGWLVVDGALGTELEAHGADLQDELWSARCLVSAPHLIRKVHLDYLDAGANIITTASYQATLQGFQSRGVSREQGEALLRRSVQIAQEARAIFVEGRSKGPYAARDEYDGVASRAHRPVLVAASVGSYGAYLADGSEYTGDYGRSVTKEALKNFHRRRLQVLADAGPDLIAFETIPNKLEAQAYAELLEENDIRIPAWFSFTSKDGANAASGDPITECAAVADSCRRVAAVGINCTAPRLIHGLVLSISKVTSKPIVVYPNTGETYVAETKEWVDSAAAGGGVAGTDFVSCVGKWRQAGASLVGGCCRTGPATVRAIARALREEDAAADADTDDDYPAVAVL

SEQ ID NO: 3557 - DNA, 1620 bp, Triticum aestivum
  misc_feature (1)..(1620): Ceres cDNA ID no. 21665784
  misc_feature (1)..(1620): Ceres CLONE  ID no. 639483
  misc_feature (1)..(1620): Also known as  Ceres CDNA ID no. 24361372
acactcactcgcggctagctcacacacctctcatctcatggtgctccagaccgctcagcaagaaccatccctgacgcgtccgcctcactgcagcgtcgccagcgcgcgctcgccggcggccatggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgcccctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctgattctgctctgccacgaaacgatcggtccacacgggctgattcgccccgaggatcgcgacacggaatttttgtcgggaccagcccacgtgcgcgcgcgccccgctctcaggtgcggtgggcccgggcggagtggtgcccacgtggatttccggccccacaccaccttccatttttggacgctggctcgcgtccccccctcctagccttgtttgtcacgactcgccatatgcatgccccctcctcacctagtgtacataccatggaaatcatggaatatatataatataatatatataaacgcatttcctgccagaaaaaaaaaaaaaaaa

SEQ ID NO: 3558 - protein, 417 aa, Triticum aestivum
  misc_feature: PFam Name: 2OG-FeII_Oxy; PFam Description: 2OG-Fe(II)
  misc_feature: GI Number: 50902214; NR Description: putative gibberelin 20-oxidase [Oryza sativa (japonica cultivar-group)] >gi|19422259|gb|AAL87949.1| gibberellin-20 oxidase [Oryza sativa] >gi|20152207|dbj|BAB89356.1| GA C20oxidase2 [Oryza putative
  misc_feature: GI Number: 37359180; NR Description: putative gibberellin 20
  misc_feature: GI Number: 50931425; NR Description: putative gibberellin 20-oxidase [Oryza sativa (japonica cultivar-group)] >gi|48475183|gb|AAT44252.1| putative gibberellin 20-oxidase [Oryza
  misc_feature: GI Number: 4164141; NR Description: gibberelin 20-oxidase
  misc_feature: GI Number: 12231168; NR Description: gibberellin 20-oxidase
MVLQTAQQEPSLTRPPHCSVASARSPAAMDTSPATPLLLQPPAPSIDPFAAKAAVNKGGGAATAVYDLRREPKIPAPFVWPHAEVRPTTAQELAVPVVDVGVLRNGDAAGLRRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 3559 - DNA, 1572 bp, Triticum aestivum
  misc_feature (1)..(1572): Ceres cDNA ID no. 21665785
  misc_feature (1)..(1572): Ceres CLONE  ID no. 639647
  misc_feature (1)..(1572): Also known as  Ceres CDNA ID no. 24361383
ctctctctctagctaggagttcctctctccctctcactctagagagagagggggaggaaggaagagagatctgaggccaggatcgatcgattgagggaggagggagggagttaggcatggacgacttcatgcagtgggcgatgaacacgctggaccagcagcagtaccacgccgccgccgtcgccgcggctcctcccgtatacggtggtgctggctccagctccggtggcagcagtgctggtgccgccttcccgtcgctgcaggcgctccgcgagtccacggcggccggcggcggcgtcagggacctgagggtgcaggtggaccaccaccagcccagcagctggagcaccagctccggcgacagccccggcgccgccatggaccacgacgcggccgccgccggacccgggtggtccccgcacacagcccgcgccaggaccaggaccaccaacagcagcaggcccatgagctggaacttcagcgccgccgccgcgtcctcgcaggccgcgcagctgccggctgacatcgacatctccccgcggccggcccctgcccccagaggccatagtacgcccgccgctgggaggagatcggggggcagcgcgcagggctcaacggccgggccgtcagcctctccggggcccgtgcaggaccacatcatcgccgagcgccgccgccgggagaagatcaaccagcgcttcatcgagctctccaccgtcatccccaacctcaaggagatggacaaggcgacgattctcggggacgcggtcaagtacgtgagggagctgcaggacaaggtgaagaccatggaggacgacgacagcgccgccgccaccacaaccaccaccatccgctccgccgtgctcgtcagcaagaagatcaaggccgccgccgacgacgaggaggacgaggacgccggcgagtcgagccacggcgggctgccggagatcgaggtgcgggtgtcggacgagaagaccgtgctggtgcgcatccactgcaagaacgcgagggggctgctggtgagggtgctggcggaggtggaggacctccggctcgccatcacccacaccagcgtcatgcccttcccggccgacaccgccatcatcaccatcaccgcaaaggtggaagagggattcaattcaacagtggaggagatcgtgaggcggctcaacttgtcactgcgccaacattacggcgccaataattcggacgatcgaaatagtgtcaccaagagagaatgctaagctagctgctcatgcaagtcgatcagccctttccttggatgactttatattctgaaaactgagagagaaattcatggtgaggaattgctcgtttcgattgtgtgcatgcatgcatgcatgatcagcttatagatatatgttgcacgcatgcgtgcatgcatggagacgaggatttctcagccacaggtttgcaagttttggttgctagctagctacttgctgttgctcaatcccgatcacactgatgaaataatgagggcagtaaccaggatacatataataagatttttctgcatctaagtatggatttccaaaaaaaaaaaaaaaa

SEQ ID NO: 3560 - protein, 375 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: HLH; PFam Description: Helix-loop-helix
  misc_feature: PFam Name: Pkinase; PFam Description: Protein kinase domain
  misc_feature: PFam Name: Extensin_2; PFam Description: Extensin-like region
  misc_feature: GI Number: 50428739; NR Description: putative transcription factor [Oryza sativa (japonica cultivar-group)] >gi|41469283|gb|AAS07165.1| putative symbiotic ammonium transport
  misc_feature: GI Number: 50917657; NR Description: putative ammonium transporter [Oryza sativa (japonica cultivar-group)] >gi|29788848|gb|AAP03394.1| putative ammonium transporter [Oryza
  misc_feature: GI Number: 30691602; NR Description: basic helix-loop-helix
  misc_feature: GI Number: 20127022; NR Description: putative bHLH
  misc_feature: GI Number: 30681819; NR Description: basic helix-loop-helix
MDDFMQWAMNTLDQQQYHAAAVAAAPPVYGGAGSSSGGSSAGAAFPSLQALRESTAAGGGVRDLRVQVDHHQPSSWSTSSGDSPGAAMDHDAAAAGPGWSPHTARARTRTTNSSRPMSWNFSAAAASSQAAQLPADIDISPRPAPAPRGHSTPAAGRRSGGSAQGSTAGPSASPGPVQDHIIAERRRREKINQRFIELSTVIPNLKEMDKATILGDAVKYVRELQDKVKTMEDDDSAAATTTTTIRSAVLVSKKIKAAADDEEDEDAGESSHGGLPEIEVRVSDEKTVLVRIHCKNARGLLVRVLAEVEDLRLAITHTSVMPFPADTAIITITAKVEEGFNSTVEEIVRRLNLSLRQHYGANNSDDRNSVTKREC

SEQ ID NO: 3561 - DNA, 1707 bp, Triticum aestivum
  misc_feature (1)..(1707): Ceres cDNA ID no. 21665786
  misc_feature (1)..(1707): Ceres CLONE  ID no. 639850
  misc_feature (1)..(1707): Also known as  Ceres CDNA ID no. 23414915
aagcaaacaaactttccttaaacccaagtagccaaagggaaagaaaaaaccccaagccatggcctcctcttccctcttcgccgccgggcgccgccttctccacttggggcgcggcaggcttctccaaggccgagtccgtccccacaatcccactcctctgctcctccctgtgcgcgccgcatcctctcctccctccaacagcgccgagaggccgccgcggcgacccccgggcctgcagtccacgctgtggccgctgggccacccggacacgcttctggtgccggagatcgagcgctgggcggagaagccccgcaaccgcctccgccccgtggagctcgagcgcatcgtcaaagagctccgcaagcgccgccgccaccgccaggccctcgaggtctccgaatggatgagtgctaagggtcatgtcagatttttgccaaaggatcatgctgttcacctggatttgatcggtcaagttcgtggaatcggagcagcagaagcctatttcaatcaactgcctgataaagataagacggagaaaccctacggtgcactcctgaactgctacacacgagaactcatggttgatgaatccttggctcattttcagaagatgaaagagctgggttttgtgttctgcagtctcccctacaacaacctcatgggcctctatactaacatagggcagcatgagaaggtcccttcagtgatagcagagatgaaaaggagtggtatcatgcctgacaacttcagctacagaatttgcataaactcttatggcacacgggcagattttttcgggatggagaacaccctggaagatatggagtgtgagcctcaaattgtagtcgattggaatacctatgccgttgcggcgagcaactacattaagggcaacctaagggagaaggcaatctctgccttaaagaaagcagaagcaaaaattgacataaaagattcagatacctacaaccacctgatgtccctctacggccagctgggggacaagtcagaggtgaagaggctgtgggcactccaaatgtcaaactgcaagaggcatattaataaggactacactacaatgcttgcaatgcttgtgagacttgatgaaattgaagaagctgaggccttgttgaaagagtgggagtcgagcgaaaacacattcgacttccatgttccgaatgtcttgatcactggataccgacagaaggacatgctggacaaggccgaagcgctgctggatgacttcttgaagaagggaaagatgcctccttcgagcagttgggccatcgtggcaatcggctatgctgagaaaggtgatgctgcgaaagcctatgagttgacaaaaaatgccctttgtgtttacgctccgaggagcggctggatcccgaggcctgcgatgattgagatgatactcaagtatcttggagacgaaggtgatctcaaggatgttgaaactttcattcaactgctgcaagctgctatgcctatgaacttagatatgaccgacgttttgtcaagggctcgtatgagagaagaaaagaaggctggagatgcagagaaggaagccctaagctcaacaaaggcatcaggataattttactgcaactctcaggaccaacttatttcaccatgtaatttatctagttagttaccggaatttatttgatattttactgagtctgaaacttgccaaaaaaaaaaaaaaaa

SEQ ID NO: 3562 - protein, 511 aa, Triticum aestivum
  misc_feature: PFam Name: PPR; PFam Description: PPR repeat
  misc_feature: PFam Name: FH2; PFam Description: Formin Homology 2 Domain
  misc_feature: GI Number: 50938991; NR Description: putative DNA-binding protein [Oryza sativa (japonica cultivar-group)] >gi|34393591|dbj|BAC83218.1| putative DNA-binding protein [Oryza
  misc_feature: GI Number: 29028736; NR Description: At1g02150/T7I23.8 [Arabidopsis thaliana] >gi|20453085|gb|AAM19786.1|
  misc_feature: GI Number: 22165054; NR Description: putative leaf protein [Oryza sativa (japonica cultivar-group)] >gi|37535776|ref|NP_922190.1| putative leaf protein [Oryza sativa
  misc_feature: GI Number: 57899052; NR Description: putative DNA-binding
  misc_feature: GI Number: 34905490; NR Description: P0682B08.20 [Oryza sativa (japonica cultivar-group)] >gi|14495231|dbj|BAB60950.1|
MASSSLFAAGRRLLHLGRGRLLQGRVRPHNPTPLLLPVRAASSPPSNSAERPPRRPPGLQSTLWPLGHPDTLLVPEIERWAEKPRNRLRPVELERIVKELRKRRRHRQALEVSEWMSAKGHVRFLPKDHAVHLDLIGQVRGIGAAEAYFNQLPDKDKTEKPYGALLNCYTRELMVDESLAHFQKMKELGFVFCSLPYNNLMGLYTNIGQHEKVPSVIAEMKRSGIMPDNFSYRICINSYGTRADFFGMENTLEDMECEPQIVVDWNTYAVAASNYIKGNLREKAISALKKAEAKIDIKDSDTYNHLMSLYGQLGDKSEVKRLWALQMSNCKRHINKDYTTMLAMLVRLDEIEEAEALLKEWESSENTFDFHVPNVLITGYRQKDMLDKAEALLDDFLKKGKMPPSSSWAIVAIGYAEKGDAAKAYELTKNALCVYAPRSGWIPRPAMIEMILKYLGDEGDLKDVETFIQLLQAAMPMNLDMTDVLSRARMREEKKAGDAEKEALSSTKASG

SEQ ID NO: 3563 - DNA, 1377 bp, Glycine max
  misc_feature (1)..(1377): Ceres cDNA ID no. 21665787
  misc_feature (1)..(1377): Ceres CLONE  ID no. 657436
  misc_feature (1)..(1377): Also known as  Ceres CDNA ID no. 23705106
agtttatcaagaactcttgttccaccaaccccaaaattgtgaacctttcaaagagacgaagccttcgaatctctctgaaacttttctcttctctttgattcttctctatcagttaaacattagaatgagccgttcacaggatccacacccttcccgatctttcttcccttttggaaatccttttcggatgatatcacctaaaggctctcgcatgtctccacaacttcttgcagtgttgcaagcttttgaggcaacattggcagagaggctgaaaaatcttatgcctaaaagcaaggatgaaatcctcaccttgtcttggatgactttagctatgaagtcactttgtgaaagtcacaatgacatacggacccttatgactgcccttgagcttcctgtgagtgattgggaggacaaatggattgatatgtacttggacataagttcaaagttgctagacatttgcaatgcattcagctctgagctttcacgtctgaaccagggaaaccttcctcttaagtgtgcactgcacaatttagactctgcctcttcaaagcagtatcttcgggcatgttccctacttgatgattggaggcagcatgttagttctaggaaccctagaattgagaaatgtagttctatgttagataatcttgtgggctcacttgatcttcctaaggttaaaaattctgccaaaggaaaggttttgatgcaagctatgtatggagttaaggtggagactgtatttatttgcagggtgtttactgcagcattctctggctcgtcaaagaagttatcagacttgaatgtggccgacatacattcatgggctccagattttagaaggttgcaggatcttgtaaatgaggaaattagagttagattttctggtggtaaatttactgtattgaatgagttggaagcggttgatgcctctgtgaagatattatatcctactatccaagctggtgtagataccgttgagacagaatggcttgtgaagactgttgaggaattacgtgcgggtgccgagaagctttcgcaaggaattgatcttcttgcaaagggagtagatgggtttttttcaagccgttatgactagtcgcgatactttgctcagctctgtgaggtttgataaaactgtaaatgatcgttccccaggccgtaacagagacatgcaggtagttcactaattatgcagtagcctaactctggtaggttttgggggggtgttcctttgtaggattagtagtattttcggtcttataggtgataatagtatttagccgaaatgtatatgagtggggatgttatgtgtaatgtcaaacaattacaaaatgcagatctttgttaaaaaaaaaaagaaaaaaaaaaaaaaaa

SEQ ID NO: 3564 - protein, 324 aa, Glycine max
  misc_feature: GI Number: 16604342; NR Description: At2g46080/T3F17.27
MSRSQDPHPSRSFFPFGNPFRMISPKGSRMSPQLLAVLQAFEATLAERLKNLMPKSKDEILTLSWMTLAMKSLCESHNDIRTLMTALELPVSDWEDKWIDMYLDISSKLLDICNAFSSELSRLNQGNLPLKCALHNLDSASSKQYLRACSLLDDWRQHVSSRNPRIEKCSSMLDNLVGSLDLPKVKNSAKGKVLMQAMYGVKVETVFICRVFTAAFSGSSKKLSDLNVADIHSWAPDFRRLQDLVNEEIRVRFSGGKFTVLNELEAVDASVKILYPTIQAGVDTVETEWLVKTVEELRAGAEKLSQGIDLLAKGVDGFFSSRYD

SEQ ID NO: 3565 - DNA, 1169 bp, Glycine max
  misc_feature (1)..(1169): Ceres cDNA ID no. 21665788
  misc_feature (1)..(1169): Ceres CLONE  ID no. 671686
  misc_feature (1)..(1169): Also known as  Ceres CDNA ID no. 24361139
atcagcatttaatagccgaaagataaaatatcttttgctcgacgttgctattagtcagaagccagaaattcgtgtaggtgagtgaggaagagagaaaagaaaaccggtgctgttgaggcagagattcaagagaatggaaggtgtgagccctgagcccttgagatcagaattggattccaaatccaaacaagacacagcgaaagaagaagatgacgacacattcaaagaaagcactgacgccgaggtcactaaaattcgtctcatgagagcctttgttgaaagccgagatccctcttccaaggaagtagatgatttgatgattagaagattcttgcgggctcgtagtttagatgtggagaaggcttcggcaatgttccttaagtacttgaaatggaagcgttcatttgttccaaatggttacatatcaccgtcagagattgccgaagatattgcacaggacaaggtgtttacgcaaggcctcgacaagaaaggtcgacctatagttgttgcctttgctgcaaaacattttcaaagcaaaaatggtgccgatggtttcaaacggtacgtagtctttgttcttgagaagctttgttcaaggatgccaccaggacaagaaaagtttcttgccattgcagacattaaaggatgggcatacgcaaacagtgaccttcgtggataccttaatgctctatccattttgcaggattgctaccctgaaagattggggaagatggttattgtacatgcaccttatatgtttatgaaaatttggaaaatgatttaccctttcattgatgataataccaagaaaaagatagtattcgtggagaacaaaaagctgaaatcaacattgctagaagagatagaggagagtcaactcccagatatatacggaggccaaatgccattagttcctatccagaatagctgattaaattcatttaaagcctttttttccaatttaaatttttccaaataatttcaacttctgtatcaagagttaaatgcagattggagttctgtagttggtcacgttatcttagcagattcatgcatataaacttgattatgcattgcttaatgcttatagcaggctattatgcaaaatatttttgagaattccaatgcacattctcaaatcccaaaacacaagaaaaaaaaaaaaaaaa

SEQ ID NO: 3566 - protein, 265 aa, Glycine max
  misc_feature: PFam Name: CRAL_TRIO; PFam Description: CRAL/TRIO domain
  misc_feature: PFam Name: CRAL_TRIO_N; PFam Description: CRAL/TRIO, N-terminus
  misc_feature: GI Number: 2739046; NR Description: polyphosphoinositide binding protein Ssh2p [Glycine max] >gi|7488696|pir||T05953
  misc_feature: GI Number: 19347976; NR Description: putative
  misc_feature: GI Number: 50904393; NR Description: sec14 like protein [Oryza sativa (japonica cultivar-group)] >gi|20160730|dbj|BAB89672.1| sec14 like protein [Oryza sativa (japonica cultivar-group)] >gi|20805228|dbj|BAB92895.1| sec14 like
  misc_feature: GI Number: 2286121; NR Description: sec14 like protein [Oryza
  misc_feature: GI Number: 50920105; NR Description: putative phosphatidylinositol/phosphatidylcholine transfer protein [Oryza sativa (japonica cultivar-group)] >gi|27573358|gb|AAO20076.1| putative phosphatidylinositol/phosphatidylcholine transfer
MEGVSPEPLRSELDSKSKQDTAKEEDDDTFKESTDAEVTKIRLMRAFVESRDPSSKEVDDLMIRRFLRARSLDVEKASAMFLKYLKWKRSFVPNGYISPSEIAEDIAQDKVFTQGLDKKGRPIVVAFAAKHFQSKNGADGFKRYVVFVLEKLCSRMPPGQEKFLAIADIKGWAYANSDLRGYLNALSILQDCYPERLGKMVIVHAPYMFMKIWKMIYPFIDDNTKKKIVFVENKKLKSTLLEEIEESQLPDIYGGQMPLVPIQNS

SEQ ID NO: 3567 - DNA, 850 bp, Zea mays
  misc_feature (1)..(850): Ceres cDNA ID no. 21665790
  misc_feature (1)..(850): Ceres CLONE  ID no. 679528
  misc_feature (1)..(850): Also known as  Ceres CDNA ID no. 24362704
atcgaacagtggtattttttatttcttctaatgaaaatggttaccatttcagtcccttttatttcttttctactagaaatatttttcttgtaaggacctttaattgtataagtttttgttcacagtggattgcagatatctgaagccctcaaactgcagatggaggtccaaaagcggctgcacgaacagttagaagtacaaaggcagctgcagttacgaattgaggctcagggaaagtacctccagaagatcatcgaagagcagcagcgcttaacaggtgtgaaatctgaaactcctgctggaggtgcttctgtcactgtatcaagtgatcaattcccagactcggagcggactgagccctccacacctgcaccagcatccgagtctccaactcaagttggtgcttccaatagggacactggagaccgaactgaagcaaccaagagcacctgtcatggtgattctctttcccgcaacgagccactaacccctgattccaactgccagaacggttctcctgtcgctagtccaaaccatgaaagggcagccaagaggcagcgaggcagtggtactgaattcttagattctgaggctgagttttcccttccgcgccacatcttcgagtcgagttcaggctcagagttccaacaatactcaatgtcctactcaggacagtagcttctgatgttcacatcatctctgcaccgttgctagcttgttcagcacgatgcgcatggtccgtaggtctgggtaggttgatgtctcaaggagcgtgttgttggtaaacaaagctgtaggtgttcagtgattgtctacatggtaaaaataaaagaaaaaaaaaaaaaaaaaa

SEQ ID NO: 3568 - protein, 172 aa, Zea mays
  misc_feature: GI Number: 50725048; NR Description: putative transfactor [Oryza sativa (japonica cultivar-group)] >gi|50725525|dbj|BAD32994.1| putative transfactor [Oryza sativa
  misc_feature: GI Number: 50944577; NR Description: putative transfactor [Oryza sativa (japonica cultivar-group)] >gi|29647445|dbj|BAC75447.1| putative transfactor [Oryza sativa (japonica cultivar-group)] >gi|38636888|dbj|BAD03152.1| putative
  misc_feature: GI Number: 51091946; NR Description: putative transfactor [Oryza sativa (japonica cultivar-group)] >gi|51090371|dbj|BAD35632.1| putative transfactor [Oryza sativa
  misc_feature: GI Number: 42570623; NR Description: myb family transcription
  misc_feature: GI Number: 23197610; NR Description: transfactor-like protein [Arabidopsis thaliana] >gi|21536958|gb|AAM61299.1| transfactor-like protein [Arabidopsis thaliana] >gi|6598621|gb|AAF18654.1| transfactor-like protein [Arabidopsis
MEVQKRLHEQLEVQRQLQLRIEAQGKYLQKIIEEQQRLTGVKSETPAGGASVTVSSDQFPDSERTEPSTPAPASESPTQVGASNRDTGDRTEATKSTCHGDSLSRNEPLTPDSNCQNGSPVASPNHERAAKRQRGSGTEFLDSEAEFSLPRHIFESSSGSEFQQYSMSYSGQ

SEQ ID NO: 3569 - DNA, 1513 bp, Triticum aestivum
  misc_feature (1)..(1513): Ceres cDNA ID no. 21665791
  misc_feature (1)..(1513): Ceres CLONE  ID no. 684172
  misc_feature (1)..(1513): Also known as  Ceres CDNA ID no. 24361387
gaaaccccagcacgagcacccgcaatggacaggcttatctcttcgccgctccacctcacccgcgcgcccgcctcctcctccgcctccaggccccgcgccggcggccaccaccacctcctccccgccaccgccgcgccaaggtccttcgcgcccctccacggactcaggctgcatcctctggcgccgctcctccccaggccgcccccgtccctcctcgccgcggcctccgccttctcccgcgccgacgccgtcaatcccgcgccaccggaaccagatgacgaggccgccgacgcctctgcgcaggctccggccaccggagtcacccgcttcttccagaaggtcgcctcggccgcggcagtcgccttggtggcggcgctggtggtggcggcagtcgggccgtcgtccatggtgccgccggcgctggcctcggcgctgcacaaccactcccactcggcggccgtcacggcgggccggagcatcttcaagtcggagctgctgggcagcgcgtggacggggttcctggccggctgcctgcacacgctctcgggcccggaccacctggccgcgctggcgccgctctccatcgggcggtcgccggtggagagcgcggcggtgggcgcgctctggggctgcggccacgacgccggccaggtcatgttcggcctgctcttcctcggcctcaaggaccggctccacatcgaggtgctccgcacctggggcacccgcgtcgtcggcctcaccctgctcgtcatcggcgccatcggcatccgggaggcgacgcaggcggcgccctgcgtggccgccgcgctggagggcggcaccagcgcgcaccagcacggcggcaacaacagcaacgcgctggagaaggcgctgctgggcgccggcggcaagaagaaggagatcagcttcgcgacgttcgcgacggggatcgtgcacgggctgcagccggacgcgctcatgatcatcctgccggcgctggccatgccgtcgcgcgccgcggggggcgccttcctcggcatgttcctcgtgggcaccgtgctgtccatggccagctacaccgtgctcatcggcacctgcaccgaggcgctcaaggagagggtgccccggatcacggagaagctcacctgggcggcctccctcgtcgccatctccatgggggtcgccatcatcgtcagcgagtccttcggggtgagcttgtactgaactactactgatcatcatcatcatcatcccctgcgcctgcaacaacaacaacgacgacgatattgccttgcttcgaatcgaacgaatgaacccgccatggaaattttgctacgtcacgtccttcctcttgagatcgagcagcagcaactaggatgtagtttacgattcaagaaaggaaatcttatattagaatttgcttagctgctgttgagacgagtggcaatttgccgccattgttgttatgatgatctggaattctggatgcactaccaactttacttgagcgattggccgaaaaaaaaaaaaaaaa

SEQ ID NO: 3570 - protein, 392 aa, Triticum aestivum
  misc_feature: PFam Name: NicO; PFam Description: High-affinity
  misc_feature: PFam Name: Pyr_redox_2; PFam Description: Pyridine
  misc_feature: PFam Name: Transferase; PFam Description: Transferase family
  misc_feature: PFam Name: Pkinase; PFam Description: Protein kinase domain
  misc_feature: PFam Name: FH2; PFam Description: Formin Homology 2 Domain
  misc_feature: GI Number: 20856414; NR Description: At2g16800/T24I21.21 [Arabidopsis thaliana] >gi|15724154|gb|AAL06469.1|
  misc_feature: GI Number: 21592431; NR Description: unknown [Arabidopsis thaliana]
  misc_feature: GI Number: 19699142; NR Description: AT4g35080/M4E13_135 [Arabidopsis thaliana] >gi|15146230|gb|AAK83598.1| AT4g35080/M4E13_135 [Arabidopsis thaliana] >gi|18418571|ref|NP_567976.1| high-affinity nickel-transport
  misc_feature: GI Number: 42573177; NR Description: high-affinity
  misc_feature: GI Number: 33862611; NR Description: marine cyanobacterial conserved hypothetical [Prochlorococcus marinus str. MIT 9313] >gi|33634527|emb|CAE20513.1| marine cyanobacterial conserved
MDRLISSPLHLTRAPASSSASRPRAGGHHHLLPATAAPRSFAPLHGLRLHPLAPLLPRPPPSLLAAASAFSRADAVNPAPPEPDDEAADASAQAPATGVTRFFQKVASAAAVALVAALVVAAVGPSSMVPPALASALHNHSHSAAVTAGRSIFKSELLGSAWTGFLAGCLHTLSGPDHLAALAPLSIGRSPVESAAVGALWGCGHDAGQVMFGLLFLGLKDRLHIEVLRTWGTRVVGLTLLVIGAIGIREATQAAPCVAAALEGGTSAHQHGGNNSNALEKALLGAGGKKKEISFATFATGIVHGLQPDALMIILPALAMPSRAAGGAFLGMFLVGTVLSMASYTVLIGTCTEALKERVPRITEKLTWAASLVAISMGVAIIVSESFGVSLY

SEQ ID NO: 3571 - DNA, 1370 bp, Triticum aestivum
  misc_feature (1)..(1370): Ceres cDNA ID no. 21665792
  misc_feature (1)..(1370): Ceres CLONE  ID no. 686231
  misc_feature (1)..(1370): Also known as  Ceres CDNA ID no. 23475345
aacctatcaccagtcaccaccattataaaccaacggccagctaggtagctaaagtgacctcctgtgagcaagaaaagctcgccaagatcagtagtgctaagcgacaggtagtgagccaagccagagcaacgaaggatggcgtccgagacgagcgtcgccgacgagaaggcgcccgctgggctgagccgctacgaggcggacgcggaggacgggcaggagggcggcggcgacgaaaagtcccggctgtccggcctgctgtggcacggcgggtcggcgtacgacgcgtggttcagctgcgcgtcgaaccaggtcgcgcaggtcctgctgacgctgccctactcgttcgcgcagctgggcatggtgagcggcatcctgttccagctcttctacggcctcctcggcagctggaccgcctacctcatcagcatcctctacctcgagtaccgcacccgcaaggagaaggacaaggtcgacttccgcaaccacgtcatccagtggttcgaggtgctggacgggctgctggggcggcactggcggaacgtggggctggccttcaactgcacgttcctgctgttcgggtcggtgatccagctcatcggctgcgctagcaacatctactacgtgaacgaccacctggacaagcggacgtggacctacatcttcggcgcctgctgcgccaccaccgtcttcatcccctccttccacaactaccgcgtctggtccttcctcggcctcctcatgaccacctacaccgcctggtacatcgccgtcgcctccctcatgcacggccaggccgacgccgtcaagcactccggccccaccaccatcatgctctacttcaccggcgccaccaacatcctctacaccttcggggggcacgctgtcaccgtgtaagccgacacgccccaccccgccccatcgtcccacctgctcacttttcacttgcatgccctaatctttttccaaagctgatcatctagtttatccgtcgtatatatacaatgttgtaacggtcactggtcacggagcgtgcacgctactactgcccagctcggggtcacgtgcaacgggaatgtcgtctgacatgcggggccgtcctgtgtataagcaacgggcgtcacctggggaccacctagacctagacatgcacgcacggtgcccatatgcgtacatgcagtatatcccaagagcacacacgtgctacccacacatcaaccgagcacaatgctcgtggatgctggagcggaacatatacgtttctgaattttcaacataaacaaagttgaaacctgagctagcaggataatatatctatctacgattttcgttaccctcaaaaaagaatttagggtccaaaaaaaaaaaaaaaa

SEQ ID NO: 3572 - protein, 252 aa, Triticum aestivum
  misc_feature: PFam Name: Aa_trans; PFam Description: Transmembrane amino
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: LMBR1; PFam Description: LMBR1-like membrane protein
  misc_feature: GI Number: 6689614; NR Description: AUX1 protein [Zea mays]
  misc_feature: GI Number: 31430161; NR Description: putative AUX1-like permease [Oryza sativa (japonica cultivar-group)] gi|37531048|ref|NP_919826.1| putative AUX1-like permease [Oryza sativa (japonica cultivar-group)] gi|15209143|gb|AAK91876.1|
  misc_feature: GI Number: 22136072; NR Description: AUX1-like amino acid permease [Arabidopsis thaliana] >gi|5139337|emb|CAB45643.1| putative AUX1-like permease [Arabidopsis thaliana] >gi|4803938|gb|AAD29811.1| AUX1-like amino acid permease
  misc_feature: GI Number: 28624760; NR Description: auxin influx carrier protein [Medicago truncatula] >gi|10800922|emb|CAC12997.1| putative
  misc_feature: GI Number: 21586474; NR Description: auxin influx carrier
MASETSVADEKAPAGLSRYEADAEDGQEGGGDEKSRLSGLLWHGGSAYDAWFSCASNQVAQVLLTLPYSFAQLGMVSGILFQLFYGLLGSWTAYLISILYLEYRTRKEKDKVDFRNHVIQWFEVLDGLLGRHWRNVGLAFNCTFLLFGSVIQLIGCASNIYYVNDHLDKRTWTYIFGACCATTVFIPSFHNYRVWSFLGLLMTTYTAWYIAVASLMHGQADAVKHSGPTTIMLYFTGATNILYTFGGHAVTV

SEQ ID NO: 3573 - DNA, 1513 bp, Triticum aestivum
  misc_feature (1)..(1513): Ceres cDNA ID no. 21665793
  misc_feature (1)..(1513): Ceres CLONE  ID no. 686537
  misc_feature (1)..(1513): Also known as  Ceres CDNA ID no. 23475603
ccccaatccccaaatcctccatggacgaacacgccggcggccgccgccgcgccgatccgcctccgtggtctcccccgcttcagcttcccccagacgacatgctcctggagatcctcctccgcctcccgccggagcccatccacctgttccgcgcctccttcgtctccaagcactggcgcggcctcgtccacgacgcccgcttccgccgccgcttccgcgagttccacggggggacgcctcccatgctcggcttcttcaacagctgcccaggggctcccatcttcgtccccacctccggcggcttcgcgctctccaccgccaacatgtccctcgattggcgggccctcgattgccgccacggccgcgccctcctgcacaactacggtaccaggacgctcctcgtctgggaccccatgaccggcgacgagcgctacctaccgttccccacgcgagcccatctggagaacgtccattacaatggcgcggttctctgcgcggctggccacacgggccacggggactgccattcctgcccgttcctcgtggcattcgtgttcagcagctacagatattgcatcacctctgcctgcgtctactcgtccgtgaccggcgtctggggtgagatcacttcgattcatacaccagattcattagttgatgcaaagccgacagctctggttggaaacacactctactgcctgttgagtaatgaggatagcatcattgagtttaatttggataagaatagcttggatttaattgaggttccatacggcggaaattttatcatcacactggcacaggatggtcccctaggtttcgccagtgttgatcgattcagcctacatttgtggtcaagggtagctagcatcgatggggtggcatcatgggaacatatcagggtcattgatctggagaagctttttgcgccacaagtattggcagcgtgtatggatcgaatgtggcctgttggctatgctgaagatgcgaatgtgatcttcattcatgtgtatcctcgcacctacatgatccatctcaagtccatgcagattgaggggattttagaggaagcaactggctggtccatttttccttatgcaagtttctacactccaggaccaggaatcaccactggtggtggagatgatcaagttgaactgttaaatggcacttgagatgattgggctttcacatcttctgtcatgcttttttggcctaagaggtacctaggattattggttgccgtgatcctgcaactacatgcagaaacaatttactcatgctggttcttcagtattttgtaaacgtcgacagctcaatgtggctgtaaagaaattcgtacaagttgccgaatgtggtgctaatcttacaaaatgtgctgaattttgaatgttatctttgccaattactatatgtggtaacaaaccggcagcacttggtaaaaattatttcatacttctgaatattgctgttgagaatatgacatttgtttggcccaaaaaaaaaaaaaaaa

SEQ ID NO: 3574 - protein, 384 aa, Triticum aestivum
  misc_feature: PFam Name: F-box; PFam Description: F-box domain
  misc_feature: PFam Name: BTB; PFam Description: BTB/POZ domain
  misc_feature: GI Number: 62733148; NR Description: F-box domain, putative
  misc_feature: GI Number: 11359723; NR Description: proteophosphoglycan, membrane-associated [imported] - Leishmania major (fragment)
  misc_feature: GI Number: 13592175; NR Description: ppg3 [Leishmania major]
  misc_feature: GI Number: 5420387; NR Description: proteophosphoglycan
  misc_feature: GI Number: 34914028; NR Description: OJ1014_G12.29 [Oryza sativa (japonica cultivar-group)] >gi|20146312|dbj|BAB89094.1| OJ1014_G12.29 [Oryza sativa (japonica cultivar-group)] >gi|21328077|dbj|BAC00661.1| B1144D11.8 [Oryza sativa (japonica
MDEHAGGRRRADPPPWSPPLQLPPDDMLLEILLRLPPEPIHLFRASFVSKHWRGLVHDARFRRRFREFHGGTPPMLGFFNSCPGAPIFVPTSGGFALSTANMSLDWRALDCRHGRALLHNYGTRTLLVWDPMTGDERYLPFPTRAHLENVHYNGAVLCAAGHTGHGDCHSCPFLVAFVFSSYRYCITSACVYSSVTGVWGEITSIHTPDSLVDAKPTALVGNTLYCLLSNEDSIIEFNLDKNSLDLIEVPYGGNFIITLAQDGPLGFASVDRFSLHLWSRVASIDGVASWEHIRVIDLEKLFAPQVLAACMDRMWPVGYAEDANVIFIHVYPRTYMIHLKSMQIEGILEEATGWSIFPYASFYTPGPGITTGGGDDQVELLNGT

SEQ ID NO: 3575 - DNA, 1058 bp, Triticum aestivum
  misc_feature (1)..(1058): Ceres cDNA ID no. 21665794
  misc_feature (1)..(1058): Ceres CLONE  ID no. 686555
  misc_feature (1)..(1058): Also known as  Ceres CDNA ID no. 23465688
cctaccattctcctcattccccttccgcttctcctcctgtcccgatctctccctctctcgctcgctcgctcgttcgaggctcggccatggcggactaccacttcgtgtacaaggacgtggagggggcgaccacgcagtgggacgacatccagcgcaagctcgggaacctgcccgagaagccggcgcccttcaagccgccgcccttcgcccccagggccgacgccgacgagcagcccaggtccaaggagtggctcgacgcgcgcgaccccgacgagctcgaggagctcgaggacgacctcgacgatgaccgcttcctcgagcagtacaggaggatgaggcttgcagagttcaaggaggcagcaaaaactgccagatttggcacaatacaacccatcacaggctctgattttgtgcgtgaggtttcgcaggctccaccggatgtctgggttgtggtcttcctctacaaggatgcgataccagaatgtgggctgcttgagacttgcctggaggaactggcgacaaaatatgcagaaaccaagttcgttaaaattatttccacggactgtattcccaactacccagataggaatgtccctacaatactggtgtacaacaacagtgctgtcaaagggacttatgttggtctacagaagttcggtggaaagaaatgcacacctgaatctgttgcattggcgctttgccactcagacccagtactgaatgatggacaaggtggtaacaatgtcatggaaggcgttcgcaggaagttcatagaaaaggttgtctcccagcttgaaacgcgagaagacgaagatgatagcgactaaaatttacacctttctgctagttttgttttggttcagtgatatcatttggatctacggatagtcttgcctttcctgatcttatttggttgtttgtgtgtgaaaaacctgaaagctgttttgacgaggttctgtataaactttgttccagtaacttatatgatacacgtggttgtaatgtatcttggtgttctggttctgagagatgattatggaacaaaaaaaaaaaaaaaa

SEQ ID NO: 3576 - protein, 246 aa, Triticum aestivum
  misc_feature: PFam Name: Phosducin; PFam Description: Phosducin
  misc_feature: GI Number: 21593265; NR Description: unknown [Arabidopsis thaliana]
  misc_feature: GI Number: 31205037; NR Description: ENSANGP00000023564 [Anopheles gambiae] >gi|30177667|gb|EAA45004.1| ENSANGP00000023564
  misc_feature: GI Number: 61830136; NR Description: PREDICTED: similar to
  misc_feature: GI Number: 13542796; NR Description: IAP-associated factor
  misc_feature: GI Number: 9957067; NR Description: IAP-associated factor
MADYHFVYKDVEGATTQWDDIQRKLGNLPEKPAPFKPPPFAPRADADEQPRSKEWLDARDPDELEELEDDLDDDRFLEQYRRMRLAEFKEAAKTARFGTIQPITGSDFVREVSQAPPDVWVVVFLYKDAIPECGLLETCLEELATKYAETKFVKIISTDCIPNYPDRNVPTILVYNNSAVKGTYVGLQKFGGKKCTPESVALALCHSDPVLNDGQGGNNVMEGVRRKFIEKVVSQLETREDEDDSD

SEQ ID NO: 3577 - DNA, 1038 bp, Zea mays
  misc_feature (1)..(1038): Ceres cDNA ID no. 21665795
  misc_feature (1)..(1038): Ceres CLONE  ID no. 689194
  misc_feature (1)..(1038): Also known as  Ceres CDNA ID no. 24364806
gcgtgcggtcgtgtggaactgtagtgctggacatcctcgccttccagccttctcgaaaatcgaaaccctagaccgcgcgccccctcgccctccggccttccacgtccgatccgatccaaaatgcataagctaggcagaggaagccgggacaaggtgcaacagttcatggcaattaccggcgcaagtgagaaagctgcccttcaggctcttaaagctagtgattggcacttggaaggagcttttgatgttttctacagccagccacaaattgctgttgctaatactcgacatctggaagagctctacaacagatataaagaaccagatgctgatatgataatggtggaaggcatatcacagatctgcaatgatttacaggtggatcctcaggatattgttatgcttgtcatatcgtggcatatgaaagcttccactatgtgtgaattcactcgccaggagttcattggtggactgcagtcaataggagtggattcaatagagaagcttcaggcgaagttaccttcattgcgagctgagcttaaagatgatcagaagttccatgaaatatacaactttgcatttgcctgggcaagggagaagggccagaaatctctcgcattggagactgctattggcatgtggcagttgctatttgctgaaaggagctggcctctcattgactactggtgccaatttctacaggtaaggcataataaagcaatctccagggatacatgggcacagttattggagtttgttaagacaattgatcctcagctaaccaactatgacgaagaaggtgcttggccctacctaatcgatgaatttgtggactacttgaaagagaacggtcttgcctagcatagaaggtgtacggaattgggctgtaggggggagaatttgtcacccacaaggccaccatcattgtataacttaatggtcggatgcttgtattcattgcactaccaatagctaatgcggctcgtgcgtctggggatggagtttatcctctatatagacaaaaaaaaaaaaaaaaaa

SEQ ID NO: 3578 - protein, 246 aa, Zea mays
  misc_feature: PFam Name: UBA; PFam Description: UBA/TS-N domain
  misc_feature: GI Number: 51535194; NR Description: putative leucine zipper
  misc_feature: GI Number: 34784818; NR Description: C13orf17 protein [Homo
  misc_feature: GI Number: 62643615; NR Description: PREDICTED: similar to
  misc_feature: GI Number: 45387523; NR Description: Unknown (protein for MGC:77887) [Danio rerio] >gi|41389078|gb|AAH65884.1| Unknown
  misc_feature: GI Number: 46329559; NR Description: Unknown (protein for
MHKLGRGSRDKVQQFMAITGASEKAALQALKASDWHLEGAFDVFYSQPQIAVANTRHLEELYNRYKEPDADMIMVEGISQICNDLQVDPQDIVMLVISWHMKASTMCEFTRQEFIGGLQSIGVDSIEKLQAKLPSLRAELKDDQKFHEIYNFAFAWAREKGQKSLALETAIGMWQLLFAERSWPLIDYWCQFLQVRHNKAISRDTWAQLLEFVKTIDPQLTNYDEEGAWPYLIDEFVDYLKENGLA

SEQ ID NO: 3579 - DNA, 1210 bp, Glycine max
  misc_feature (1)..(1210): Ceres cDNA ID no. 21665796
  misc_feature (1)..(1210): Ceres CLONE  ID no. 691120
  misc_feature (1)..(1210): Also known as  Ceres CDNA ID no. 25088285
attgtttcggccagacaaatagcaatagcagcaatgtcaatgttgagatcagtttgtcagttgagagtgggagtggcaactccaaaaccttgcctccatccctcaatcttcttattctccctttctctctctcacaacactcacactctcacctctttccccagaaccttccgtttccacccactttcactccctctttcaccctttgtgctcttcatgcctcccaaagcaacagcttcgtatggcactggggctagtggtgctgctgaaggtgataggccaagggagatattggtgcagcatttgttggtaaaagaagatgaccagaagcttctgttgtatcttcagcagaaaatctcttcaggtgaagatttgagtgatcttgctgtggaatattcactatgcccatccaaagaagaaggagggatgcttgggtgggtcagaaaggggcaaatggttcctgaatttgaagaggctgcatttactgcacctttaaaccaagttgtaaggtgcaaaacgaaatttggatggcacctgctgcaggttttatctgaaagggaagaatcaattcttcaagacattcaacctgatgagctgcatatgaaaattcaagatcccagctttttggatgaggcacaattaattgatgtgcgagagcctgatgaagtggccaaagcatctttgccaggatttactgttcttcccctccgacaatttggaagctgggggcctgaaataactaccaaatttgaccctcaaaaggatacatatgtcatgtgtcatcatggcatgcggtcattacaagttgctaagtggttgcagtcacagggttttaggaaagtatacaatctttctgggggaatccatgcctatgctgtccaggttgatccatcagtccccacatattgatttacattattctgccataaatgtagtcctttacttttctactttccatctttgtacatgagagcaagattttgtgggatgtccatgttacctttaggaattggaattctcttggtatgaacatgtatttattttggatcaagagtatgaggctacatatcaagtgctagtttttgtgaagcttgcctcggctgtgaggtgatttatgattttcttagcaagtaattgctacttggttttatcggtttctttcccaataattatttgtctgtgtaattccctttcaaaaaaaaaaaaaaaa

SEQ ID NO: 3580 - protein, 291 aa, Glycine max
  misc_feature: PFam Name: Rhodanese; PFam Description: Rhodanese-like domain
  misc_feature: PFam Name: Rotamase; PFam Description: PPIC-type PPIASE domain
  misc_feature: GI Number: 50509156; NR Description: peptidyl-prolyl cis-trans isomerase-like protein [Oryza sativa (japonica
  misc_feature: GI Number: 16323478; NR Description: putative peptidyl-prolyl cis-trans isomerase [Arabidopsis thaliana] >gi|13877805|gb|AAK43980.1| putative peptidyl-prolyl cis-trans isomerase [Arabidopsis thaliana] >gi|18419898|ref|NP_568372.1|
  misc_feature: GI Number: 21554407; NR Description: peptidyl-prolyl
  misc_feature: GI Number: 2246380; NR Description: peptidyl-prolyl cis-trans isomerase [Arabidopsis thaliana] >gi|25456107|pir||T52622 probable peptidylprolyl isomerase (EC 5.2.1.8) [imported] - Arabidopsis
  misc_feature: GI Number: 51849615; NR Description: trypsin [Nannochloris
MSMLRSVCQLRVGVATPKPCLHPSIFLFSLSLSHNTHTLTSFPRTFRFHPLSLPLSPFVLFMPPKATASYGTGASGAAEGDRPREILVQHLLVKEDDQKLLLYLQQKISSGEDLSDLAVEYSLCPSKEEGGMLGWVRKGQMVPEFEEAAFTAPLNQVVRCKTKFGWHLLQVLSEREESILQDIQPDELHMKIQDPSFLDEAQLIDVREPDEVAKASLPGFTVLPLRQFGSWGPEITTKFDPQKDTYVMCHHGMRSLQVAKWLQSQGFRKVYNLSGGIHAYAVQVDPSVPTY

SEQ ID NO: 3581 - DNA, 1516 bp, Glycine max
  misc_feature (1)..(1516): Ceres cDNA ID no. 21665797
  misc_feature (1)..(1516): Ceres CLONE  ID no. 693717
  misc_feature (1)..(1516): Also known as  Ceres CDNA ID no. 24360112
gtcccatttaagggtataacgccttccgtctaaccagcgaaggaaatcggtggacacaggtctaagttttctgaatttgtttaaagcggcggtgccgccgtgccggctctcactgtgaactgcacgtatctcttctctctcaggcctgcaccttcgtctccgccaacagttgttcaccaccacgcaaccaaagatggcagattcgatttgcagaacactgagggatggagcgttggagggagagcttgcgcctactctcacaatcaaggactccctcgcttcacctttcgcctttcatgtattctctcacattctacttcaactctcgtcacacgtcatagcacaaaaatctcagtcacagggtatagtaattgttgcactttctcggagtccatcgtcttacacttctttgttaaagatgaatgggatggatgttgcttcttctaataaatggattcacattttggattgttatactgatcctcttggttggaaggataaggcaaggaaatctgcgaatgttacggatccttctcagcaaatttcgcttgctactagttcttataaaaccgtgaaggacgtggataagttgtttttggtaattgctgaacttggcagaggattggttggagaaaataaagcccgcttctgtgttgccatagactcgctaagtgaacttttgaggcatgcatctatgcagtcagttgcaggccttctaagcaatctgcgtagccatgatcaaatttcaagtatgtttggattattgcattctgaccttcatgaggagagggctgtggcagttcttgagtacatgtcctccatggtggccagtgtagacccgtatcatcattctgcagatggtcagaaaaggtgtttagagagttccttatatgatcaaaactttaccaagggaaaatttaatgtcaggttcaaacgcagaaatgggcgagttagagtaacgtgtgaagaatttaaagttgagcctggaggaatcagcttctcacctgtttcatcagtagatggaaccgtcattgcaggcatagtgccaaaggtgcagttcaatctccagctgtcagagaaggagcgaattgataggtcaaatgttgtgcttccttttgaacaccagggaaatggtaaaccaatacaaatttatgatggtagaagatcccttgaagagagcaacagtgaggcaaatcccatttcaagtggtaaaaaggaggattctgccatgggtgaaattatatattttcgtgattcagatgatgagatgccagattctgatgaggacccggatgatgatttagatatatgaatatactcttgttggtaacttttgtatccctaggtgacatgaaaggatagattaggtttatgactgaacaaaatgggaaaaaaataatctgatactgtttaattgcttagaagtgaaatgcagtgtgcatcacattccaaaatattgtacaacctactgaggaacctgacttagtttggacgattttgaaaaaaaaaaaaaaaa

SEQ ID NO: 3582 - protein, 372 aa, Glycine max
MADSICRTLRDGALEGELAPTLTIKDSLASPFAFHVFSHILLQLSSHVIAQKSQSQGIVIVALSRSPSSYTSLLKMNGMDVASSNKWIHILDCYTDPLGWKDKARKSANVTDPSQQISLATSSYKTVKDVDKLFLVIAELGRGLVGENKARFCVAIDSLSELLRHASMQSVAGLLSNLRSHDQISSMFGLLHSDLHEERAVAVLEYMSSMVASVDPYHHSADGQKRCLESSLYDQNFTKGKFNVRFKRRNGRVRVTCEEFKVEPGGISFSPVSSVDGTVIAGIVPKVQFNLQLSEKERIDRSNVVLPFEHQGNGKPIQIYDGRRSLEESNSEANPISSGKKEDSAMGEIIYFRDSDDEMPDSDEDPDDDLDI

SEQ ID NO: 3583 - DNA, 1360 bp, Glycine max
  misc_feature (1)..(1360): Ceres cDNA ID no. 21665798
  misc_feature (1)..(1360): Ceres CLONE  ID no. 694656
  misc_feature (1)..(1360): Also known as  Ceres CDNA ID no. 23428902
ataaattgacgcgaaactacggcatgagaagctttttgattctgaaatctgagctttgtagttttcctatgatccagtctctttagttagctcctgttccttttctgccagaagtttcaaggaaaaacaaagaaatgagacttggatttgcttcttggagattcatcccatgcaccctggttgcctttttgattctacaagacagtggagctagaaagatagctacaacatctgggaaagaaattcaactgaaggaagaagtatcctatgatttgcaaaagcttgcaacagagggtcttgtacttgacagtattattcagctcgaaggcgctgatatagaaaagaagaagcatgtccataaagatgatgatgaggacgaggacgatagagtgaagaaaggaatgggatttgacaaagaagaagatgaggaggaggataaagatgaacacaaaaagatggttggaaaggatgtgcatggttataagccatctcacaaacacatggaccttgaactgaatgtgttcttcaccccaaatgatttaaaggttgggaaaataatgcccgtctatttttccaagaaaaactcctcaacatctccaaaatttctgaccagagaagaagctgaccagattcctttctcatgcaaacacctaccatcccttctcaaattcttctccatcccacaacactctccccaagccaaggcaatgaaatataccctcaaacaatgtgaatttgaacccatggaaggagagaccaagttctgtgccacttcgttggagtccttgtttgattttgcgcactatctgtttgggtccaatgcacaattcaaagttctgaccactgtccatctcacaaattcaacagccctgctacagaactacacaatctcagaagtgaaagtgatttcagttccaaatgttatagggtgtcaccccatgccttacccttatgcagttttttactgccacagtcagcatagtgacaccaatctctatgaggtgatggtagaaggtgagaatggagggagagttcaagctgcagctatttgccacatggacacctctaagtgggaccgggaccacgtgtcctttcgtgtgctcaaagttcagccgggaacctcacctgtgtgtcacttcttccctcctgataatctagtctgggtgcctttgcctctgcctccataactatatatatagtttcatgttcttcatcaaagtttcttatatatgttccagtatatcaaactgtgtcaggtacaacataagttctagtatagacctggtgtactagctaggaagcttgatgaaaaactatatatgtatctatgttaataaagatgttaaaaaaaaaaaaaaaa

SEQ ID NO: 3584 - protein, 350 aa, Glycine max
  misc_feature: PFam Name: BURP; PFam Description: BURP domain
  misc_feature: GI Number: 5430766; NR Description: Putative BURP domain containing protein [Arabidopsis thaliana] >gi|30102636|gb|AAP21236.1| At1g49320 [Arabidopsis thaliana] >gi|25372775|pir||D96529 probable RAB7 GTP-binding Protein BURP
  misc_feature: GI Number: 62732949; NR Description: BURP domain, putative
  misc_feature: GI Number: 24416618; NR Description: resistant specific
  misc_feature: GI Number: 16588826; NR Description: dehydration-responsive
  misc_feature: GI Number: 54645911; NR Description: RD22-like protein [Vitis
MRLGFASWRFIPCTLVAFLILQDSGARKIATTSGKEIQLKEEVSYDLQKLATEGLVLDSIIQLEGADIEKKKHVHKDDDEDEDDRVKKGMGFDKEEDEEEDKDEHKKMVGKDVHGYKPSHKHMDLELNVFFTPNDLKVGKIMPVYFSKKNSSTSPKFLTREEADQIPFSCKHLPSLLKFFSIPQHSPQAKAMKYTLKQCEFEPMEGETKFCATSLESLFDFAHYLFGSNAQFKVLTTVHLTNSTALLQNYTISEVKVISVPNVIGCHPMPYPYAVFYCHSQHSDTNLYEVMVEGENGGRVQAAAICHMDTSKWDRDHVSFRVLKVQPGTSPVCHFFPPDNLVWVPLPLPP

SEQ ID NO: 3585 - DNA, 1359 bp, Triticum aestivum
  misc_feature (1)..(1359): Ceres cDNA ID no. 21665799
  misc_feature (1)..(1359): Ceres CLONE  ID no. 696287
  misc_feature (1)..(1359): Also known as  Ceres CDNA ID no. 13656079
caagaagaaggaacgaatttgtcagccgacctagaggaagaggaagagaagagcgcaacgcaagcagaggcaagaatggcgatggcgaggaggagggccctcgcgctcgtgtcccagatcctacagaggcgggttctccccgcgccgcgcttcctctcgtcggcggccggcggcgctctagaccgcctcaattcgccgcccttcgcgcgccaggccgcgcacaggaaccccgctcctccttccccatgggatcggctcggagggcagaagaggaccatgttcatccagacgcagtcgacccccaacccgcagtcgctcatgttccatcctggaaagccggttatggaagttgggagctctgatttccctcatgctcggaccgccatgacatctcctttggcgaaggcgctgtttgcgatagaaggcgttacgagagtattctttggatctgattttgtaactgtgacaaaatctgacgagacttcatgggattatcttaagcctgaggtatttgctgcgataatggatttctactcatctggacagccacttttcctggactcaaataccgcagctgctatggacacagcaattcatgaggatgattcagaaatagttgctatgataaaagaactattggagacccgcattcgtccggctgttcaagatgatggtggtgacattgaataccgaggatttgagccagaaacagggatagtgaagctaaaaatgcaaggtgcctgcagtggctgcccgagttcatcagtcacgttgaaatctggcatagagaacatgctcatgcactatgtgcccgaggtgaaaggagtggagcaagagtttgatggtgatgaggaagctgaactggctggccagatggaatgagtttttacatttaaatcgcaaccatgtgacatgctgttcagggaaaccatgctacgcatgaaacgtcccggagaatttaaaccactcttaaaaccataggttaccactatattttgtgagataaaccaggagtagcctggagtttttgtgatgattagatggttgtaattttgatcagatgtgtgcaagaagcagactatcgtacatgctagagaggcagcagtagcctaaaccaacatcgactgcagtagggctgaataaagtgatagttggattgatctttccttttgtccaacactttatatgctgagcttgctaatagcaaaggtcatcactttggcatgacaggtgtaatttcatggtggttatttctgctatgtatatgtactttgtaagttttgcatttgcctctgcaagaatggttatggctgcaaataaaaaaaaaaaaaaaaaaaaaaaaaaaaaaaaaaaaaaaaa

SEQ ID NO: 3586 - protein, 1359 aa, Triticum aestivum
  misc_feature: PFam Name: NifU; PFam Description: NifU-like domain
  misc_feature: GI Number: 4836948; NR Description: Similar to human CGI-33
  misc_feature: GI Number: 34500321; NR Description: NifU-like protein HIRIP5
  misc_feature: GI Number: 66543732; NR Description: PREDICTED: similar to
  misc_feature: GI Number: 34856373; NR Description: similar to
  misc_feature: GI Number: 57228115; NR Description: iron ion homeostasis-related protein, putative [Cryptococcus neoformans var. neoformans JEC21] gi|58269446|ref|XP_571879.1| iron ion homeostasis-related protein, putative [Cryptococcus neoformans var.
CAAGAAGAAGGAACGAATTTGTCAGCCGACCTAGAGGAAGAGGAAGAGAAGAGCGCAACGCAAGCAGAGGCAAGAATGGCGATGGCGAGGAGGAGGGCCCTCGCGCTCGTGTCCCAGATCCTACAGAGGCGGGTTCTCCCCGCGCCGCGCTTCCTCTCGTCGGCGGCCGGCGGCGCTCTAGACCGCCTCAATTCGCCGCCCTTCGCGCGCCAGGCCGCGCACAGGAACCCCGCTCCTCCTTCCCCATGGGATCGGCTCGGAGGGCAGAAGAGGACCATGTTCATCCAGACGCAGTCGACCCCCAACCCGCAGTCGCTCATGTTCCATCCTGGAAAGCCGGTTATGGAAGTTGGGAGCTCTGATTTCCCTCATGCTCGGACCGCCATGACATCTCCTTTGGCGAAGGCGCTGTTTGCGATAGAAGGCGTTACGAGAGTATTCTTTGGATCTGATTTTGTAACTGTGACAAAATCTGACGAGACTTCATGGGATTATCTTAAGCCTGAGGTATTTGCTGCGATAATGGATTTCTACTCATCTGGACAGCCACTTTTCCTGGACTCAAATACCGCAGCTGCTATGGACACAGCAATTCATGAGGATGATTCAGAAATAGTTGCTATGATAAAAGAACTATTGGAGACCCGCATTCGTCCGGCTGTTCAAGATGATGGTGGTGACATTGAATACCGAGGATTTGAGCCAGAAACAGGGATAGTGAAGCTAAAAATGCAAGGTGCCTGCAGTGGCTGCCCGAGTTCATCAGTCACGTTGAAATCTGGCATAGAGAACATGCTCATGCACTATGTGCCCGAGGTGAAAGGAGTGGAGCAAGAGTTTGATGGTGATGAGGAAGCTGAACTGGCTGGCCAGATGGAATGAGTTTTTACATTTAAATCGCAACCATGTGACATGCTGTTCAGGGAAACCATGCTACGCATGAAACGTCCCGGAGAATTTAAACCACTCTTAAAACCATAGGTTACCACTATATTTTGTGAGATAAACCAGGAGTAGCCTGGAGTTTTTGTGATGATTAGATGGTTGTAATTTTGATCAGATGTGTGCAAGAAGCAGACTATCGTACATGCTAGAGAGGCAGCAGTAGCCTAAACCAACATCGACTGCAGTAGGGCTGAATAAAGTGATAGTTGGATTGATCTTTCCTTTTGTCCAACACTTTATATGCTGAGCTTGCTAATAGCAAAGGTCATCACTTTGGCATGACAGGTGTAATTTCATGGTGGTTATTTCTGCTATGTATATGTACTTTGTAAGTTTTGCATTTGCCTCTGCAAGAATGGTTATGGCTGCAAATAAAAAAAAAAAAAAAAAAAAAAAAAAAAAAAAAAAAAAAAA

SEQ ID NO: 3587 - DNA, 1241 bp, Triticum aestivum
  misc_feature (1)..(1241): Ceres cDNA ID no. 21665800
  misc_feature (1)..(1241): Ceres CLONE  ID no. 701028
  misc_feature (1)..(1241): Also known as  Ceres CDNA ID no. 23477288
acaaaattgcaagcgattgctgccaaacaggtcgatttcgaccgatctcctccgcatatgtggttctctgctgcccttgccgcttctcctcccacccaccttgtcctcgcgcgcacggggaaacgacgccggtgagatggctcctccccgcacggtgatctgcgtgggtgacgtccacggctacatctccaagctggagagcctgtgggcgaacctccagtccgcgctccccgccgacgccttcgccgccgcgctcgtcatcttcctcggggactacaacgaccgcggcccggacacccgccgcgtcctcgacttcctcctcgcgctcccggcccgccacccggctcagcgccacgtcttcctctgcggcaaccacgacctcgccttcgccgccttcgtcggagcgctgccgccgccccccgacggttcccctttcgccgccacctgggaccaatacatcgacaatgaggcccacgagggctggttccgcgggccggggcacgaggatatgcacgtgcaggggaggagatggggcggcgtcatcaaggagaggtggaaccccaagaagggcctcccgtacaagggctctatctacgatgcgcagcccaccttcgagtcctacggcgtcgcccatggatcaccagatctcatgaaagctgtgcctgaggagcacaagaagtttctgcatgacttggtttgggtccatgaagaggaagacgttcgtattgatacagatggaggccagattctatgcaaactgatcgcggttcatgccggcctggaaaagtccttggatttgaatgagcagcttagagttttgagaactagagacacaagggtgccaaaagttcaaatgcttagcgggaggcaggatgtttggaacataccacaggatctggccggcaagcagaccatcgttgtaagtgggcatcatgggaagctccacgtggacggtctcaggttcatcatcgacgaaggtggcgggtacgcagataaacctatagcggccgttgttttcccttcaaagtgatcaggagcacagagggaacggcctcccagaattaatctagacaccatcggaaatgcaagatatttttttttgttactgtcgtaacatgagcaattggacgactggtatgtacatctgccaaaatggagtataatatttcaaaaaacacagaattggggttttaatgtataatgtcgaggaaataagtcaaaaaaaaaaaaaaaaaaaaaaa

SEQ ID NO: 3588 - protein, 297 aa, Triticum aestivum
  misc_feature: PFam Name: Metallophos; PFam Description: Calcineurin-like
  misc_feature: PFam Name: BTB; PFam Description: BTB/POZ domain
  misc_feature: PFam Name: Mucin; PFam Description: Mucin-like glycoprotein
  misc_feature: GI Number: 38347604; NR Description: OSJNBa0042I15.17 [Oryza
  misc_feature: GI Number: 21618122; NR Description: unknown [Arabidopsis thaliana]
  misc_feature: GI Number: 21553642; NR Description: unknown [Arabidopsis thaliana] >gi|18398696|ref|NP_566363.1| calcineurin-like
  misc_feature: GI Number: 13475753; NR Description: serine/threonine protein phosphatase [Mesorhizobium loti MAFF303099] >gi|14026509|dbj|BAB53106.1| serine/threonine protein phosphatase
  misc_feature: GI Number: 31231947; NR Description: ENSANGP00000020885 [Anopheles gambiae] >gi|21302266|gb|EAA14411.1| ENSANGP00000020885
MAPPRTVICVGDVHGYISKLESLWANLQSALPADAFAAALVIFLGDYNDRGPDTRRVLDFLLALPARHPAQRHVFLCGNHDLAFAAFVGALPPPPDGSPFAATWDQYIDNEAHEGWFRGPGHEDMHVQGRRWGGVIKERWNPKKGLPYKGSIYDAQPTFESYGVAHGSPDLMKAVPEEHKKFLHDLVWVHEEEDVRIDTDGGQILCKLIAVHAGLEKSLDLNEQLRVLRTRDTRVPKVQMLSGRQDVWNIPQDLAGKQTIVVSGHHGKLHVDGLRFIIDEGGGYADKPIAAVVFPSK

SEQ ID NO: 3589 - DNA, 1475 bp, Triticum aestivum
  misc_feature (1)..(1475): Ceres cDNA ID no. 21665801
  misc_feature (1)..(1475): Ceres CLONE  ID no. 704949
  misc_feature (1)..(1475): Also known as  Ceres CDNA ID no. 23725220
atccgtccatatatcgcttcttccgccgctccgcttcccttccacgcgcaccaaccgccgcctgctcttcgattcccccgaggccccagcaggagcagcaaccccttcttctgcttcttgttcttggtgcggtgcgcgggcatggccatcgaccacgagtcgcccttcaaggagctccgcctcaagaacaggaggatcatgggaggcggcgcccctgagccggacgaagaggaggcggaggcgcaggtggcggcggcggcgggggaggaggagcagtggccgcagtggctgcgcccgctgctgtccgcgcgcttcttcgcgcaatgcaagacgcacaccgagtcgcaccggagcggcgagtgcaacatgttctgcctcgactgcgccgccggggcggccgccggcgcggcggcgctctgctcgctgtgcctcgcgcacgcgcaccgcggccaccacaccatccagatccgccgctcctcctaccacgacgtcatccgggtgtcggacatccagcgcttcatggacatcgccggcgtgcagacctacgtcatcaacagcgcgcgcgtcgtcttcctcaacgagcgcccccagcagaagcagcccggcaaggccggcggcggcgccggcggcgccaacctctgcgaggtctgcagccgcagcctcctcgacaacttccgcttctgctccctcggctgcaaggtcgccggctgctcctccgacgggggcggcaacgacaaggcgaggatgatgcgggccagcaggcccggccgcgccaagggctcgtcggactccgaggcggcctcctcctcctctcctctgcgcaatgccgccaggcagagcttcacgccgtccacgccgccgccgcctccgcctccagcggccaagcggcgcaagggcatcccgcaccgcgcgccgttcggcaacctcatcatcgactgctaggcgcgcaccaccccgccattgacaaagctgcgacccacacgcccagttgcagagtgaatggagcgagaaagcggccaccacttcggtgcccgccattgccttcggttgtgcttctcgatgtggattccaccattagcttttcagggagaaagcaggcaggcaagaaagggaggtggatggatggaaacacagctgaaaaagcaccagccttttcttactgcttataatcatcatcatcatcactaggacagaaaccaaaaattaccacaccacagagagattactgtatatgattatggccctgctctactatttctaccacactagacttgagttttgtgataaatgttttgaggtaataccaggcaatgcgccagtggtcagctagctagagtaataagcaattgccacttgttaatcaggttttgtgatagcttgtgctttcttcatctgtaaatatggagtgctgggagaggatgactgcttgttagaaaatatggtgttgctcaaccttcagaaaaaaaaaaaaaaaa

SEQ ID NO: 3590 - protein, 266 aa, Triticum aestivum
  misc_feature: PFam Name: APC_basic; PFam Description: APC basic domain
  misc_feature: PFam Name: MARCKS; PFam Description: MARCKS family
  misc_feature: PFam Name: Cation_efflux; PFam Description: Cation efflux family
  misc_feature: PFam Name: Pkinase; PFam Description: Protein kinase domain
  misc_feature: PFam Name: FH2; PFam Description: Formin Homology 2 Domain
  misc_feature: GI Number: 50911681; NR Description: putative zinc-binding protein [Oryza sativa (japonica cultivar-group)] gi|51964230|ref|XP_506899.1| PREDICTED OJ1148_D05.19 gene product [Oryza sativa (japonica cultivar-group)]
  misc_feature: GI Number: 6714272; NR Description: F6N18.8 [Arabidopsis thaliana]
  misc_feature: GI Number: 18398555; NR Description: zinc-binding family
  misc_feature: GI Number: 21554139; NR Description: unknown [Arabidopsis thaliana]
  misc_feature: GI Number: 42566916; NR Description: zinc-binding family
MAIDHESPFKELRLKNRRIMGGGAPEPDEEEAEAQVAAAAGEEEQWPQWLRPLLSARFFAQCKTHTESHRSGECNMFCLDCAAGAAAGAAALCSLCLAHAHRGHHTIQIRRSSYHDVIRVSDIQRFMDIAGVQTYVINSARVVFLNERPQQKQPGKAGGGAGGANLCEVCSRSLLDNFRFCSLGCKVAGCSSDGGGNDKARMMRASRPGRAKGSSDSEAASSSSPLRNAARQSFTPSTPPPPPPPAAKRRKGIPHRAPFGNLIIDC

SEQ ID NO: 3591 - DNA, 1212 bp, Triticum aestivum
  misc_feature (1)..(1212): Ceres cDNA ID no. 21665802
  misc_feature (1)..(1212): Ceres CLONE  ID no. 705114
  misc_feature (1)..(1212): Also known as  Ceres CDNA ID no. 25088297
aaagctgattaatcgagagaacatggtaagaatgcttcgagggctcgtgatcctcgccgccgccgtcgtcgccctgcagtgctgtgagctcccacgcagggcggatggcaggtgcgtcctgttcaacttcggcgactccaactccgacacgggctccctccctgccgcctacggcttctacctcggcccgcccgccggccgccgcttcttcaaccggaccaccggccgctggtcggacggccgcctctacatcgacttcattgccgagagcctggggatcaggtacctgagcccgtacctggagtcgtcgggttccaacttcgccgacggagtgaacttcgcggtggccggggcggcggcggcgagcaaccagagcgccatcccgttcaccatggccacgcaggtgaaccagtttttgcatttcaagaaccggacccgggagctccggccgctggggcagggctcgatgctcccggaggaggacttccggggagccgtgtactcgatcgacgtcgggcagaacgacatcacgctcgccttccttgcgaacctcacgctgccggagatcgtcgcggacggcggcccgctcgccgcggtcgccgccaaggtcgaggaggccgtccgggcgctgtacggcagcggcgcgcgcaagttctgggtgtacaacacggggcccatcgggtgcctgccgcagacgctggcgctgcggcagaggcccggcgacgagctcgaccccgccggctgcctcgcccgctacaacgccgccgcccgggcgctcaacgccggcctcgccgcggcgtgccgccggctcgcggacgagtactgcgggagcgcgaccgtggtgtgcaccgacatgtacgccgtcaagtacgacctgttcgccaaccacgaccagtacggcatcgagcggccgctgatggcgtgctgcggccacggcgggccgccgtacaactacgtgaacctcaagacgtgtgggcagccgacggcgacggcgtgcccggagggggagaggcacgtgagctgggacggcgtgcactacaccgaggacgccaacgctatcgtcgcctccaagatactctccggcgacttctcccagccgcgcaccaagctacaggcactgtgcaaataagaacacgaccacttgtgttttttttttttgaaactcacttcaaaactttatttaaactttccaaaaaaaaaaaaaaaaaaaaa

SEQ ID NO: 3592 - protein, 368 aa, Triticum aestivum
  misc_feature: PFam Name: Lipase_GDSL; PFam Description: GDSL-like
  misc_feature: PFam Name: Peptidase_S8; PFam Description: Subtilase family
  misc_feature: PFam Name: Cation_efflux; PFam Description: Cation efflux family
  misc_feature: PFam Name: Cupin_1; PFam Description: Cupin
  misc_feature: PFam Name: Protamine_P1; PFam Description: Protamine P1
  misc_feature: GI Number: 53791335; NR Description: putative early nodule-specific protein ENOD8 [Oryza sativa (japonica
  misc_feature: GI Number: 34894866; NR Description: putative lipase homolog
  misc_feature: GI Number: 34894838; NR Description: putative lipase homolog
  misc_feature: GI Number: 3482914; NR Description: Similar to nodulins and lipase [Arabidopsis thaliana] >gi|28393967|gb|AAO42391.1| putative lipase [Arabidopsis thaliana] >gi|27754509|gb|AAO22702.1| putative lipase [Arabidopsis
  misc_feature: GI Number: 53791598; NR Description: putative lipase homolog
MVRMLRGLVILAAAVVALQCCELPRRADGRCVLFNFGDSNSDTGSLPAAYGFYLGPPAGRRFFNRTTGRWSDGRLYIDFIAESLGIRYLSPYLESSGSNFADGVNFAVAGAAAASNQSAIPFTMATQVNQFLHFKNRTRELRPLGQGSMLPEEDFRGAVYSIDVGQNDITLAFLANLTLPEIVADGGPLAAVAAKVEEAVRALYGSGARKFWVYNTGPIGCLPQTLALRQRPGDELDPAGCLARYNAAARALNAGLAAACRRLADEYCGSATVVCTDMYAVKYDLFANHDQYGIERPLMACCGHGGPPYNYVNLKTCGQPTATACPEGERHVSWDGVHYTEDANAIVASKILSGDFSQPRTKLQALCK

SEQ ID NO: 3593 - DNA, 2009 bp, Triticum aestivum
  misc_feature (1)..(2009): Ceres cDNA ID no. 21665803
  misc_feature (1)..(2009): Ceres CLONE  ID no. 705477
  misc_feature (1)..(2009): Also known as  Ceres CDNA ID no. 23466773
ttcagactcctccctctttcggtctctacgacacgtttctttctctctccctctcccctcggctaccaaggcgtctctctcttctccaaggaggctctcgatttgcatggacaagggccacctcggtggtggcggaggaggaggaggactgctagccctggacgcctcgccgcggcagctcggcttcttgaacttgctgtcgccggcgccgttccataggagcatggaggcggacgacggcggaggcggtggcggcggcggcagggggaggaggtccatcgaggttgacttcttttccgacgagaagaagaacatgaagaagagccgggcttcgtccggggccgacgcggaggaccacaaggatcaagcctccgccgccggactcgccatcaagaaggaggacctcaccattaacctccttcccgggaacaacacgaggagcgaccggtccatggtggtcgacgacgacggagcgtcccgggccgaccaagacaggaacggcaggaacaccggcgagctggcggtgatacaggccgagctgagccgcatgaacgaggagaaccagcggctgcgagggatgttgacccaggtcaacaacagctaccatgcgctgcagatgcatctcgtcgcgctcatgcagcaaaggacccagatgcctccggtccagccgcaacaacctccgacccacgaggatggcaagaacgagagtgccatcgtgccgaggcagttcctgggtctgggcccgtcgggagccagcgctgacgtggcggaagagccctccaactcgtccacggaggtcgggagcccgcggcggtcgtcgtccaacggaaacgaggaccctgagcgcggcgaaaaccctgacggcccgtccaccgcggggtggttgcccggacgcgggatgagccagcagcagcagcagcagctgggggcggcggcgaagggccacgaccagcaagcgcaggaggccaccatgaggaaggcccgtgtctccgttcgcgcccgatccgaagccccgattatcgccgatggatgccaatggaggaagtacggtcagaagatggccaagggaaacccttgcccacccgcctactaccggtgcaccatggccaccggctgcccggtgcgcaagcaggtgcaacgatgcgccgaggaccggaccatcctcatcaccacgtacgagggcacgcacaaccacccgctcccgccggccgccatggccatggcgtctaccacgtcggccgctgcgtccatgctgctctccggctccatgcccagcgccgacggcgcggggctcatgagctccaacttcctcgcgcgcaccgtgcttccgtgctcgtccagcatggccaccatctcggcgtccgcgccgttcccgacggtcacgctcgacctcacccacgccccgcccggggcgcccaacgccatgccgctaaacgtcgcccgaccgcatgcaccggggcagttccatgttccgatgcccggcggtgggatggccccggccttcgcgatgccgccgcacatgctgtacaaccagtccaagttctctgggctgcagatgtcctccgactcggtggacgccgggcagttcgcgcagcctaggccgccgatgggcctgccaggccagctgtcagacaccgtcagcgcagcggcggctgcgatcaccgcggacccgaacttcaccgtggcgctcgcggcggccatctcgtcgatcatggccggccagcacgccgccggcaacagcaacgctaacaacagcaataataacaccagtaacaacaacgtgacgacgaccagtaacaacacgacgagcaacaacaccaacagcgagactcaatgaacggcttcgtcaagttcggaaagagttgagaaaccagatagctaggttgcaagttatacacggatggtgttccattcttctttggtcaggattagcttctcgagacgtttctttggttttgataccaagcattatatacgatcaccctttttctttaaaaaaaaaaaaaaaa

SEQ ID NO: 3594 - protein, 576 aa, Triticum aestivum
  misc_feature: PFam Name: WRKY; PFam Description: WRKY DNA -binding domain
  misc_feature: GI Number: 46394256; NR Description: TPA: WRKY transcription
  misc_feature: GI Number: 5042446; NR Description: putative WRKY DNA binding
  misc_feature: GI Number: 34904618; NR Description: putative WRKY DNA binding protein [Oryza sativa (japonica cultivar-group)] >gi|11320830|dbj|BAB18313.1| putative WRKY DNA binding protein [Oryza sativa (japonica cultivar-group)]
  misc_feature: GI Number: 56784015; NR Description: putative WRKY
  misc_feature: GI Number: 50843962; NR Description: transcription factor
MDKGHLGGGGGGGGLLALDASPRQLGFLNLLSPAPFHRSMEADDGGGGGGGGRGRRSIEVDFFSDEKKNMKKSRASSGADAEDHKDQASAAGLAIKKEDLTINLLPGNNTRSDRSMVVDDDGASRADQDRNGRNTGELAVIQAELSRMNEENQRLRGMLTQVNNSYHALQMHLVALMQQRTQMPPVQPQQPPTHEDGKNESAIVPRQFLGLGPSGASADVAEEPSNSSTEVGSPRRSSSNGNEDPERGENPDGPSTAGWLPGRGMSQQQQQQLGAAAKGHDQQAQEATMRKARVSVRARSEAPIIADGCQWRKYGQKMAKGNPCPPAYYRCTMATGCPVRKQVQRCAEDRTILITTYEGTHNHPLPPAAMAMASTTSAAASMLLSGSMPSADGAGLMSSNFLARTVLPCSSSMATISASAPFPTVTLDLTHAPPGAPNAMPLNVARPHAPGQFHVPMPGGGMAPAFAMPPHMLYNQSKFSGLQMSSDSVDAGQFAQPRPPMGLPGQLSDTVSAAAAAITADPNFTVALAAAISSIMAGQHAAGNSNANNSNNNTSNNNVTTTSNNTTSNNTNSETQ

SEQ ID NO: 3595 - DNA, 1418 bp, Triticum aestivum
  misc_feature (1)..(1418): Ceres cDNA ID no. 21665804
  misc_feature (1)..(1418): Ceres CLONE  ID no. 705513
  misc_feature (1)..(1418): Also known as  Ceres CDNA ID no. 24360284
atccttcttctcactctcaggtctcagcgcgcccatcctctgccccttgggcgtctggtctggatccaagagccggccgccaactgcaatgccgtccctcctggagatcttcctgggatcctgttcctcctcggcgccgccggtggactgggaggcggaggcctacccggagtacgccgactacgccgtcctccccctgctcctcgccttcttccccgccctgcgcctcctcctcaaccagttcctcttcgaggtgttagcaagacgacttatatttggaaagggatatgacaagcttgctgaaacagatgaaaggagaaagaaaatcaataaatttaaggaatcggcatggaaatttgtttattatctttctgcagaactcttttcactatctgtaacatacaatgaatcgtggtttacaaatacaagatacttttgggtagggcctggcgagcagctgtggcccgaccaaaagatgaagctgaagcttaaggctgtatacatgtatgccgctggattttacgtatattctatctttgatcttctgttctgggaaacaagacgcaaggacttcggagtcatgatgtctcaccatgtggcaactattgttctgattgttgtgtcctatatttgcagattatctcgtcctggctcggtcattttacccctccatgatgcaagtgatatattcctagagattggaaagatggccaagtacagtagctgtgagtggctagctgttgtagcatttctactttttgtggcttcatggatccttcttcggctaatagtgtttcctttctggatcctaagaagcacaagttatgaaatagctatgatcgtggacaacgagaacagaaaaatctacagaacttcgtactactatcttttcaacactctcttgttttcacttctggtctttcacatatattggtgggtactgatttatcggatgctcgtcaaacaaattcaatccagaggtcatgttggtgaggatgtccgatccgattctgaaggcgaaaacaaccatgaagattaagctgaaggttgttggatgcttaactgaagaactgtatagttcgcagttgggaatgagaatggtgcaagcgggttgtataaagaatgagaatgtcaaggaggagctagttagcatatccattagtaggaaattcaggcacaaaacgaaaactgaaaaggctcgaatctcggtgccactggaacaagcctccttgatatgtatcttttttgtatattgaatgtataaggtgaggctatcattcagggtcttgaggcatcaatcatacatcgtgatattaatctccatatgtatgtgaagatgtcttttcagaaatactgagcctccgagttataaaaattctcttttatatatgtggtttgcttgaaaaaaaaaaaaaaaa

SEQ ID NO: 3596 - protein, 316 aa, Triticum aestivum
  misc_feature: PFam Name: LAG1; PFam Description: Longevity-assurance
  misc_feature: GI Number: 50251718; NR Description: putative ASC1 [Oryza
  misc_feature: GI Number: 16974114; NR Description: putative resistance
  misc_feature: GI Number: 62899859; NR Description: ASC1-like protein 2
  misc_feature: GI Number: 50912363; NR Description: putative alternaria stem canker resistance protein [Oryza sativa (japonica cultivar-group)] >gi|46390613|dbj|BAD16097.1| putative alternaria stem canker
  misc_feature: GI Number: 7688742; NR Description: ASC1 [Lycopersicon esculentum] >gi|16974106|emb|CAC85301.1| alternaria stem canker
MPSLLEIFLGSCSSSAPPVDWEAEAYPEYADYAVLPLLLAFFPALRLLLNQFLFEVLARRLIFGKGYDKLAETDERRKKINKFKESAWKFVYYLSAELFSLSVTYNESWFTNTRYFWVGPGEQLWPDQKMKLKLKAVYMYAAGFYVYSIFDLLFWETRRKDFGVMMSHHVATIVLIVVSYICRLSRPGSVILPLHDASDIFLEIGKMAKYSSCEWLAVVAFLLFVASWILLRLIVFPFWILRSTSYEIAMIVDNENRKIYRTSYYYLFNTLLFSLLVFHIYWWVLIYRMLVKQIQSRGHVGEDVRSDSEGENNHED

SEQ ID NO: 3597 - DNA, 1683 bp, Triticum aestivum
  misc_feature (1)..(1683): Ceres cDNA ID no. 21665805
  misc_feature (1)..(1683): Ceres CLONE  ID no. 706088
  misc_feature (1)..(1683): Also known as  Ceres CDNA ID no. 23722567
gacaaccgcaccgcaccgcgcccacacacgccacgcagcgcctcggtaccatcgcgttcctgctcgtagcttcgtgtcccgtcccacccccggcggcccgcaggatccgtccggctgcggtgatttgatttgatttgtgatttcggttcgtgcggcggcgatggggatgctgtcgcggccggaggaggtgccggcgctgctcaggctcaagctggcggcggggcggatcaggcgccagatcccgccgcaggagcactgggccttcgcctacgacatgctgcagcgggtctcccgcagcttcgcgctcctcatccagcagctaggccccgagctccgcaatgccgtctgcgtcttctacctcgtgctccgggccctggacaccgtcgaggacgacaccgccatccctaacgaggtcaagctgcccatccttcgggacttctaccgccacatctacaacccggactggctcttttcatgtggagcaaacgactacagagtgctcatggataattttaggcaagtctccacggctttcctggagctaggcgaaggataccaaaaggctattgaagaaatcactaggcgaatgggagaaggaatggctaaatttatatgcacggaggttgaaaccattgatgactatgatgagtactgccactatgtagcagggctagtaggctatggactttctaggctctttcatgctactggcacagaagatctggctccggatcatctttcaaattcaatgggtttatttctacagaaaaccaatataataagggattatttggaggacataaatgagataccaaggtgccgtatgttctggcctcgggaaatatggagtaaatatgtcgataaacttgaggatttaaaatatgaggaaaattcagaaaaggccgtgcagtgcttgaatgatatggtgaccaatgctttgatccatgcccaagattgccttcaatacatgtcagcattgaaggacaactccaattttcgattttgtgcaatacctcagataatggcaattgggacatgtgctatttgctacaataatgtgaaagtctttagaggagttgttaagatgaggcgtgggctcactgcacgggtgattgatgagacaaaatcgatatctgatgtctattctgctttctatgagttctcttcattgctagagtcgaagattgatgataacgacccaaatgctgcgctgacacggaggcgtgtggatgcaataaagaaaacttgcaagtcatccggcctgctgaagagaaggggttacgatctggagaaatcaaagtacagaatgcctatgctgatcatgatcatgcttctgttggtggctattatcttgggtgtactgtatggcaagtgatccggtcaagatggtcctcttatgttcttagtggcaccgcctcccctatgtggttttgcacgtgtacttcctgactgcagatggatggctggtttgcatgtagtattgtgctatgtaccctgctggtgccatgcatgctagttctttttgttctttgtttctgtcgtcccgtatgttgtttcagcttgtaatttgtttgaatctaggagagacttccttagtgacatgtatcctatgaatttggcgtggcgccttggttgtcaatgattctacattttgtttatttgtgactaaaaaaaaaaaaaaaa

SEQ ID NO: 3598 - protein, 404 aa, Triticum aestivum
  misc_feature: PFam Name: SQS_PSY; PFam Description: Squalene/phytoene synthase
  misc_feature: GI Number: 7434086; NR Description: farnesyl-diphosphate farnesyltransferase (EC 2.5.1.21) - maize
  misc_feature: GI Number: 7434084; NR Description: farnesyl-diphosphate farnesyltransferase (EC 2.5.1.21) - soybean
  misc_feature: GI Number: 2144186; NR Description: farnesyl-diphosphate farnesyltransferase (EC 2.5.1.21) 1 - Glycyrrhiza glabra L
  misc_feature: GI Number: 2144187; NR Description: farnesyl-diphosphate farnesyltransferase (EC 2.5.1.21) 2 - Glycyrrhiza glabra L
  misc_feature: GI Number: 27475614; NR Description: farnesyl-diphosphate
MGMLSRPEEVPALLRLKLAAGRIRRQIPPQEHWAFAYDMLQRVSRSFALLIQQLGPELRNAVCVFYLVLRALDTVEDDTAIPNEVKLPILRDFYRHIYNPDWLFSCGANDYRVLMDNFRQVSTAFLELGEGYQKAIEEITRRMGEGMAKFICTEVETIDDYDEYCHYVAGLVGYGLSRLFHATGTEDLAPDHLSNSMGLFLQKTNIIRDYLEDINEIPRCRMFWPREIWSKYVDKLEDLKYEENSEKAVQCLNDMVTNALIHAQDCLQYMSALKDNSNFRFCAIPQIMAIGTCAICYNNVKVFRGVVKMRRGLTARVIDETKSISDVYSAFYEFSSLLESKIDDNDPNAALTRRRVDAIKKTCKSSGLLKRRGYDLEKSKYRMPMLIMIMLLLVAIILGVLYGK

SEQ ID NO: 3599 - DNA, 1404 bp, Glycine max
  misc_feature (1)..(1404): Ceres cDNA ID no. 21665807
  misc_feature (1)..(1404): Ceres CLONE  ID no. 708314
  misc_feature (1)..(1404): Also known as  Ceres CDNA ID no. 23694771
gtcactcactacttcagcagtgtaggtttgtttaatttgtgtattttttttccatgctcatagtcatggctgcttcaagctctcttttgaggatggaacaaatacctggcaaaggaagaggtcttgttgcatcacagcctctaaaagcaggtcaaatagtcctcactgaatcccctctcattctctactcagcttctcctctcctcacaccctcttcttcaccttacacttactgtgaccattgtttcagaatcttacctctcactcacaatagtactactgtcacgtgcccttcttgctcaaaccacagtttttgttcccagaagtgcttctcccttgcactcaaatcctcacactccacttgggtatgcaaagcactcatgtctcttcaacaacaccccaattcaacacttcttcaacaacacccccaagaacgccaagtccaagcccgtttaattgttgcttctcacaagctcttccttcacaatcacaccccttctgagctagacacttttctttctcttcatggcaccccagatgatgctattcttgatgctgctaactttcttcactcgctaatctcaccacttttcccacctcaggctcaactctctgtggatctcattgcacaacttcttgcaaaggacagactcaactcctttggcttaatggacccttattcccctgatggccctcagagatctattaaggcttatgctatttaccccaaagccacgttcttcaaccatgactgtgttcccaatgcatgcaggtttgactatgtggacagtactaatgatgattatgaacacaacagtactgacattgttattaggttgattgaggatgttgatgaggggaaagaggtttgcatcagctatttcaggattggtagggactattgtacaaggaaaaggatcttgatggaggattatgggtttacttgtggatgtgataggtgcaagattgaagctaattgggatggtgaagaaaacaacagtgaccttccacacgtgcggtttcttagcaagtatgtttgtgagaggaagaattgtgcgggaactatggctcctctgcctccaaaagatgatgtgccatctaatgttctggaatgtaacttctgtggtaattttaagattgatgctgcttaattggcctttaacacctatcagttattatatttcatctttggtagaaatatatatgttgaggttgctcttgtcttttagcattgcctagagaaagtgatattgcaattctgtattttactttgactctgagagtggagtccttgcatgttctcattcacacctcagtttggtggattttgcgtgcaatatggaagatgaattcatgttttttcagcaacaagctcagtttctgagtccaaaaaaaaaaaaaaaa

SEQ ID NO: 3600 - protein, 365 aa, Glycine max
  misc_feature: PFam Name: SET; PFam Description: SET domain
  misc_feature: GI Number: 28393236; NR Description: putative SET-domain transcriptional regulator [Arabidopsis thaliana] >gi|25411919|pir||C84579 probable SET-domain transcription regulator [imported] - Arabidopsis thaliana
  misc_feature: GI Number: 17979109; NR Description: putative SET-domain transcriptional regulator protein [Arabidopsis thaliana] >gi|14334524|gb|AAK59459.1| putative SET-domain transcriptional regulator protein [Arabidopsis thaliana] domain-containing
  misc_feature: GI Number: 50942153; NR Description: SET-domain transcriptional regulator-like protein [Oryza sativa (japonica cultivar-group)] >gi|40253402|dbj|BAD05332.1| SET-domain transcriptional regulator-like protein [Oryza sativa (japonica
  misc_feature: GI Number: 50942151; NR Description: SET-domain transcriptional regulator-like protein [Oryza sativa (japonica cultivar-group)] >gi|40253403|dbj|BAD05333.1| SET-domain transcriptional regulator-like protein [Oryza sativa (japonica
  misc_feature: GI Number: 46435271; NR Description: potential protein lysine methyltransferase [Candida albicans SC5314] >gi|46435236|gb|EAK94622.1| potential protein lysine
MLIVMAASSSLLRMEQIPGKGRGLVASQPLKAGQIVLTESPLILYSASPLLTPSSSPYTYCDHCFRILPLTHNSTTVTCPSCSNHSFCSQKCFSLALKSSHSTWVCKALMSLQQHPNSTLLQQHPQERQVQARLIVASHKLFLHNHTPSELDTFLSLHGTPDDAILDAANFLHSLISPLFPPQAQLSVDLIAQLLAKDRLNSFGLMDPYSPDGPQRSIKAYAIYPKATFFNHDCVPNACRFDYVDSTNDDYEHNSTDIVIRLIEDVDEGKEVCISYFRIGRDYCTRKRILMEDYGFTCGCDRCKIEANWDGEENNSDLPHVRFLSKYVCERKNCAGTMAPLPPKDDVPSNVLECNFCGNFKIDAA

SEQ ID NO: 3601 - DNA, 1077 bp, Glycine max
  misc_feature (1)..(1077): Ceres cDNA ID no. 21665809
  misc_feature (1)..(1077): Ceres CLONE  ID no. 708795
  misc_feature (1)..(1077): Also known as  Ceres CDNA ID no. 23559404
ctcctcagggtgaatatccactacacgcaaagcaaaacacacctccacattcacccttagtcctcactcaacaaacaaattagccatgagcaccaaggagtgctgccaccacgacgaggagcggcgtcagctcccccgccgcgtattcgccgcgatcctcggcttcatcctcctcatcctcctggtgatcttcctcatctggatcatcctccgccccaccaaaccccgcttcatcctccaagacgccaccgtctacgccttcaacctctcctccaccggcgacaccccttcccccattaccccaacccccaacaccctcaccctcaccatgcaggtcaccctcgccgccttcaaccccaaccaccgcatcggagtttactacaccaaactcgacgcctacgccgcctaccgcggccagcaggtctccgtcgccacctccctccccgccacctaccagggccaccgcgacacctccgtctggtccccctacctctacgccaccgccgtccccgtctcccccttcacgctccagatcctccagcaggacaaaacctccggaggaattctggtcaacgtaaaagtcaacggaagagtcaagtggaaggtcggaacttgggtttccggaatttaccatattaatgtcaactgtccggcgtacctcaggctcgccggcgaccgggacgacgccatcggatttgccggtccggccgtgaagtttcagctcttccaaacatgcattgttgatgtctagtttagtaattatattctccatataccaacaactgagaagttctaaagtcagagacagactcaagaaatttcagcaatgcatgaagccatgaacagtgatatctatgtgtaaaccaagtagtttgcttgcattgctatagttgttatagttcttactttctttctcttaattattctcaaccaccctcttcatacataatgctctcttttttctttttatgtttttaatttcttttttcggaagtattttggataaagtcgatatccttcagtttatatatatgaaaatgtttttgttatttttgttcctcaaaaaaaaaaaaaaaa

SEQ ID NO: 3602 - protein, 221 aa, Glycine max
  misc_feature: PFam Name: Hin1; PFam Description: Harpin-induced protein 1 (Hin1)
  misc_feature: PFam Name: Pyr_redox_2; PFam Description: Pyridine
  misc_feature: PFam Name: FH2; PFam Description: Formin Homology 2 Domain
  misc_feature: PFam Name: LMBR1; PFam Description: LMBR1-like membrane protein
  misc_feature: PFam Name: GATase_2; PFam Description: Glutamine
  misc_feature: GI Number: 28392929; NR Description: putative VAMP protein
  misc_feature: GI Number: 21554028; NR Description: putative harpin-induced protein [Arabidopsis thaliana] >gi|4510373|gb|AAD21461.1| putative harpin-induced protein [Arabidopsis thaliana] >gi|51969900|dbj|BAD43642.1| putative harpin-induced protein
  misc_feature: GI Number: 13374879; NR Description: NDR1/HIN1-like protein [Arabidopsis thaliana] >gi|22326984|ref|NP_680206.1| harpin-induced family protein / HIN1 family protein / harpin-responsive family
  misc_feature: GI Number: 4510372; NR Description: putative harpin-induced protein [Arabidopsis thaliana] >gi|25354576|pir||C84775 probable harpin-induced protein [imported] - Arabidopsis thaliana >gi|15227540|ref|NP_181141.1| harpin-induced protein [Arabidopsis
  misc_feature: GI Number: 38603936; NR Description: At5g06330 [Arabidopsis thaliana] >gi|9758413|dbj|BAB08955.1| harpin-induced protein-like [Arabidopsis thaliana] >gi|44681420|gb|AAS47650.1| At5g06330 [Arabidopsis thaliana] >gi|15240001|ref|NP_196251.1|
MSTKECCHHDEERRQLPRRVFAAILGFILLILLVIFLIWIILRPTKPRFILQDATVYAFNLSSTGDTPSPITPTPNTLTLTMQVTLAAFNPNHRIGVYYTKLDAYAAYRGQQVSVATSLPATYQGHRDTSVWSPYLYATAVPVSPFTLQILQQDKTSGGILVNVKVNGRVKWKVGTWVSGIYHINVNCPAYLRLAGDRDDAIGFAGPAVKFQLFQTCIVDV

SEQ ID NO: 3603 - DNA, 1313 bp, Glycine max
  misc_feature (1)..(1313): Ceres cDNA ID no. 21665810
  misc_feature (1)..(1313): Ceres CLONE  ID no. 709222
  misc_feature (1)..(1313): Also known as  Ceres CDNA ID no. 24361147
gctactaacccaagaaacaaaaaaatcacaaaccaagcttaattacccaagagagaaattaagaagctagtttgcttgtttttcggtgaactcagggagtcagatagataatactgatccctcgagatattgagattcatctaagagattaatatcatcctacccaaccacaagcttagattgaaacaagatggaagtggtggtacaaagtcctagtagtccaaccatggataatttcgattttggtggcaacatgggttcgatctatcaaagtgttccttcttcaccaaaaggttttggtaattactacctaagcgcacccgcgagtccatctaggatgtctgaattattcagcgaatttgaatattattcttcagcttcaccctcttcattcgaagccgccaacataattgatgatgatgacgacgacgaaaacaaggactacagtttcgcgttttatgttaatcgcgatcaatccgacaagtcctctcgctcggccgaagagctcttccacggtggcaaaatcaagcccttgaacgagccacgttcttcttctaaggactcttctgttgctgaacaaaaaagaggcagagaaagagagagaacttcttcttcaacaacaacgttgtcatcttcgaactcgggtggtcgtagggtgacacgatcacactctccttatagaaaatcatgggaagttgaacaacaacaacaacaacaacctcaacctcggagcagcaaagaggaatcaagtgcaagtgttttgtcctcgagtacttcttccaagggttcgaagaggtggtggctgaaggactttttgttgttccgtagtgcctccgaagggagaggttcaagcaaagatgcattgaagaagtactacaagaagaatagtaacgaagaggttaaagggtcgtcgagttttagatcctcggattcgtcgagatcaagaaaggaaccgctttcggcgcatgagttgcactacgccatgaagagacaagagtccgaggatatgaagaagagaaccttcttgccttacagacaagggattctgggaaggttggctggtttcggaatctagttttaattaccagatcatggtgatgatgatgaggtttccttgatgaattttcgtgtatacccggttgttgtttttgttttttagtgaaaaagaaaatgttgtattcttttgttaaattgtaatttctctcaagtgggtttaagctgtgtatgttgacccaatcatttgtcctttatgtaaaggccaggtaattatatattatgatgcgagttgcaatttgccaaaaaaaaaaaaaaaa

SEQ ID NO: 3604 - protein, 294 aa, Glycine max
  misc_feature: GI Number: 33111961; NR Description: pheromone receptor-like
  misc_feature: GI Number: 21592890; NR Description: AR781, similar to yeast
  misc_feature: GI Number: 15293109; NR Description: putative yeast pheromone
  misc_feature: GI Number: 1669593; NR Description: AR781 [Arabidopsis thaliana]
MEVVVQSPSSPTMDNFDFGGNMGSIYQSVPSSPKGFGNYYLSAPASPSRMSELFSEFEYYSSASPSSFEAANIIDDDDDDENKDYSFAFYVNRDQSDKSSRSAEELFHGGKIKPLNEPRSSSKDSSVAEQKRGRERERTSSSTTTLSSSNSGGRRVTRSHSPYRKSWEVEQQQQQQPQPRSSKEESSASVLSSSTSSKGSKRWWLKDFLLFRSASEGRGSSKDALKKYYKKNSNEEVKGSSSFRSSDSSRSRKEPLSAHELHYAMKRQESEDMKKRTFLPYRQGILGRLAGFGI

SEQ ID NO: 3605 - DNA, 1062 bp, Glycine max
  misc_feature (1)..(1062): Ceres cDNA ID no. 21665811
  misc_feature (1)..(1062): Ceres CLONE  ID no. 710271
  misc_feature (1)..(1062): Also known as  Ceres CDNA ID no. 23706663
acacccaacccaacctcacgcacccactccaataatattaacaacaaccacaaccctttgtttttgttccttacacaccacacaccttcctcatcaatcaatggcgacccccccaaacgacgccgcatcgacaaagaagccccagcccataccatggacccaccaggagaccgtgcacctcatccgcgcctaccaggagaagtggtatgcccttaagcggggcccactccgccacaaccagtgggaggaggtcgccgtcgttgtcgccgcccgctgcggctatgacctcgcccaccccgctaagtccgccctccagtgccgccacaagatggaaaagctccgccagcgccaccgtgccgagaagaagcaacaacacaccgcggccgccctccgccctggcgcgtggcagtacaacaccctcatggacgacctcgagcgcggccccctccccatctccgccctcgcccctctcgacacctttgaagaagaagacgaaaacaacgacgacaccattgacgatcgaaacgactatgatggcgacgggagttttattaacatcaagtcgaagagtattaactgtatcctcagcgagaggcctgtgagaatgagaagcaacaaaagagggtttttgagagagcacgttgttgttaaagaagaagaggagaatgaaaacgaagacgacgacgttttggggttgtcgacggagatgagggctttcgcggagaggtttattgggatggagagtttgaagatggagatgatgaaggagacggagaggtgtaggttggagatggagaagaagcggatccagatgattctggaaacgcaaaggaggatcgttgattccattgggagggcgtttgggtctaacaagaggatcaagattactcaacaaaactgaaaagggtttcatttcttttcttttctaaattgtaattttgattgagtttaatttctatgcattgtgtaagaagttttaatcaagaggtaccacttatacatgacagaatgtgatgggatgacaatgaatacatgcactatttactaaaaaaaaaaaaaaaa

SEQ ID NO: 3606 - protein, 266 aa, Glycine max
  misc_feature: PFam Name: Pyr_redox_2; PFam Description: Pyridine
  misc_feature: PFam Name: FH2; PFam Description: Formin Homology 2 Domain
  misc_feature: GI Number: 50947001; NR Description: proline-rich protein family-like [Oryza sativa (japonica cultivar-group)] >gi|42409399|dbj|BAD10712.1| proline-rich protein family-like
  misc_feature: GI Number: 188864; NR Description: mucin
  misc_feature: GI Number: 186396; NR Description: mucin
  misc_feature: GI Number: 46226738; NR Description: uncharacterized secreted protein with thr rich regions, possible mucin [Cryptosporidium
  misc_feature: GI Number: 31231947; NR Description: ENSANGP00000020885 [Anopheles gambiae] >gi|21302266|gb|EAA14411.1| ENSANGP00000020885
MATPPNDAASTKKPQPIPWTHQETVHLIRAYQEKWYALKRGPLRHNQWEEVAVVVAARCGYDLAHPAKSALQCRHKMEKLRQRHRAEKKQQHTAAALRPGAWQYNTLMDDLERGPLPISALAPLDTFEEEDENNDDTIDDRNDYDGDGSFINIKSKSINCILSERPVRMRSNKRGFLREHVVVKEEEENENEDDDVLGLSTEMRAFAERFIGMESLKMEMMKETERCRLEMEKKRIQMILETQRRIVDSIGRAFGSNKRIKITQQN

SEQ ID NO: 3607 - DNA, 1580 bp, Glycine max
  misc_feature (1)..(1580): Ceres cDNA ID no. 21665812
  misc_feature (1)..(1580): Ceres CLONE  ID no. 719962
  misc_feature (1)..(1580): Also known as  Ceres CDNA ID no. 25088307
attaagcgcattcccatgttcggtcactatcgcagggcattgctctgcttcaagcacaacccaaactccatcactgcaatctccacacccttctctattcttctccgatcattctccacttcctcttccgaccataaacagcaacactcattcaccttaaactacctcctcaacaccttcggcttctccccagaaaccgcctcaaaactctccacccgaatccgcctcgaaacctcccacgatcctgactcaatcctctccctcttcaaatcccacggcttctccgactcccatatccgccgcatcatccaaacatacccttacttcctctcctacaacgcccgcaaaaccatcctccccaaactcaccttcctcctctccaaaggcgcctccacctccgacctcgttcgcatcgtcaccaaaaaccctagaatcctccacttcgatctccacaacgccatcaccccgcgctacgacttcatcaaaaaattcatgctttccgatgattccaccctccgctccatcaaatcatgccccagcatcatcttttcgaacacccccctcctcaacattcaatttctcctccacaacgatgtcccggaatccaaggttgttatgttgcttcgctactgggcctgctcgctcgttgccaatgcccccacgtttcaggatgcggttcgggaggttatggaattgggcttcaggcccaacaaaacgttgttcttggtggcacttcgtgctaagcttgtgaggaaatcgttgtgggagaggaaggttgaggtgtataggaaatggggctggtctgaggagattctgctttccacgtttctgaggaacccctggtgtatgctggtctctgagaagaaaattgaggccatgatggagttttttattactcatttgggtttggattctttgtgttttgctaagcatcccgtgcttattgcgttgagcttggagaaaagggttgttcccagggcttctgtgttgcagtttcttttggcgaaaggtttgcttaaggatgttaattgggcgtccgcgtttatagttactgataagattttcttgcagaaatttgtggtttcctatgagaaggaagccgatcagctgttgaagctctatgaagagaagagagatgttcctagagaagagagatgttgaagctctctgaagccgatcagctgtcaaagggaactttgtaactggaatggaaccatatggattggtgtgatcatagagacttgttcatgatcatgactcttctaccatgttttgtcaggattcctgactttagtggtagactggtagtagaaggtttctctctatcattagctgaaattatatggtgaaacttgaggtatattatatcttgccttttcagttactattgctgaaataattggtatttcagtttaaacttaataaattctgttacttgattcagtagaattcccttaattgtttaaatccagggttgtggaaaccactattttcattttacaattaaagctatttctggctgtgatgccatcatcaatagtttgttctcaaccagttgatgtaaaaaaaaaaaaaaaaaa

SEQ ID NO: 3608 - protein, 381 aa, Glycine max
  misc_feature: PFam Name: mTERF; PFam Description: mTERF
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Mucin; PFam Description: Mucin-like glycoprotein
  misc_feature: GI Number: 15218140; NR Description: mitochondrial transcription termination factor family protein / mTERF family
  misc_feature: GI Number: 25511650; NR Description: T22I11.2 protein - Arabidopsis thaliana >gi|8886986|gb|AAF80646.1| Contains similarity to F28O16.19 a putative translation initiation factor IF-2 gi|6143896 from Arabidopsis thaliana gb|AC010718. It is a
  misc_feature: GI Number: 3367528; NR Description: Strong similarity to gi|2160138 F19K23.6 gene product from A. thaliana BAC gb|AC000375. [Arabidopsis thaliana] >gi|15220664|ref|NP_176389.1| mitochondrial transcription termination factor-related /
  misc_feature: GI Number: 21553423; NR Description: unknown [Arabidopsis thaliana]
  misc_feature: GI Number: 53850523; NR Description: At1g62120 [Arabidopsis thaliana] >gi|50253494|gb|AAT71949.1| At1g62120 [Arabidopsis thaliana] >gi|15220713|ref|NP_176403.1| mitochondrial transcription
MFGHYRRALLCFKHNPNSITAISTPFSILLRSFSTSSSDHKQQHSFTLNYLLNTFGFSPETASKLSTRIRLETSHDPDSILSLFKSHGFSDSHIRRIIQTYPYFLSYNARKTILPKLTFLLSKGASTSDLVRIVTKNPRILHFDLHNAITPRYDFIKKFMLSDDSTLRSIKSCPSIIFSNTPLLNIQFLLHNDVPESKVVMLLRYWACSLVANAPTFQDAVREVMELGFRPNKTLFLVALRAKLVRKSLWERKVEVYRKWGWSEEILLSTFLRNPWCMLVSEKKIEAMMEFFITHLGLDSLCFAKHPVLIALSLEKRVVPRASVLQFLLAKGLLKDVNWASAFIVTDKIFLQKFVVSYEKEADQLLKLYEEKRDVPREERC

SEQ ID NO: 3609 - DNA, 1393 bp, Glycine max
  misc_feature (1)..(1393): Ceres cDNA ID no. 21665813
  misc_feature (1)..(1393): Ceres CLONE  ID no. 722310
  misc_feature (1)..(1393): Also known as  Ceres CDNA ID no. 24361120
tttttacccgttactctctctctctccatcttcattctcttcttcttcttcactattttctcagttatcgtgaccttatcccaacccttttctgttgcgaaggtgcttctgggctgttgtcagatcaatccacaaccctcaattgttggtgttttggctcttcctgtatcatggatggtattcatgggggtgattctcggatacacataactgatggacagcatcctatacacgtgccatatgtgcaagaacacgagcatcatggactccaccatataagcaatgggaatgggatagatgatgatcataatgatggtggtgatactaactgtggtggaagtgagagtatggaaggtgaagtcccctccaaccatggaaatctccctgacaatcatgctgtaatgatggatcaagggggtgattctggggatcagcttacgttgtcttttcagggccaggtttatgtctttgactccgtgtcaccagaaaaggttcaagctgtactactgttactgggaggccgcgaaatacctccaactatgcctgccatgccagtatctcctaaccataataaccggggatatactggtactccgcaaaaattcagtgtccctcagagattagcttcattgattaggtttcgtgaaaagcggaaggaacgaaattatgacaaaaaaattcgctatactgttcgtaaagaagtagcattaaggatgcaaagaaataaaggtcagtttacatcttccaagtccaataatgatgaatctgcatcaaatgccacaaattgggggatggatgaaaactggacagcagacaatagtggatcccagcagcaagatattgtttgtaggcactgtggcatcagtgagaagagtacaccaatgatgcgacgcgggcctgaagggccaaggaccctctgcaatgcttgtggtcttatgtgggcaaataagggaatcctgagggacctatcaagggcggcacccttatctgggactatcaagaatgagaataaaagtttagaggccaaccagatagtccatagagttgcaggagaagctgatgattcatcatgatgaactttatattttggtgagaatggagagcgattccacgaaataatggtgatgggagagtttgcccctagataagaaattgcagaagggggggctttttctactaagtttttagtgaaaatgtttaaatgagcattctgtattttgttttgaatatatgaagaaagtcattattgccttgtgacagctagttctttttggggaattttatttattttgggtatgctgaacagcttcaagccttcgatgcacttcctgatgttgtattacgttgtatttaaaaaaaatggtctcttttataattaaaaaaaaaaaaaaaa

SEQ ID NO: 3610 - protein, 300 aa, Glycine max
  misc_feature: PFam Name: GATA; PFam Description: GATA zinc finger
  misc_feature: PFam Name: CCT; PFam Description: CCT motif
  misc_feature: PFam Name: Zim; PFam Description: ZIM motif
  misc_feature: GI Number: 23297318; NR Description: putative flowering protein CONSTANS [Arabidopsis thaliana] >gi|38603660|dbj|BAD02931.1| GATA-type zinc finger protein [Arabidopsis thaliana] >gi|42571823|ref|NP_974002.1| zinc finger
  misc_feature: GI Number: 15028099; NR Description: putative flowering
  misc_feature: GI Number: 21537322; NR Description: flowering protein
  misc_feature: GI Number: 47174868; NR Description: male-specific
  misc_feature: GI Number: 53792087; NR Description: putative zinc-finger protein [Oryza sativa (japonica cultivar-group)] >gi|53791868|dbj|BAD53990.1| putative zinc-finger protein [Oryza
MDGIHGGDSRIHITDGQHPIHVPYVQEHEHHGLHHISNGNGIDDDHNDGGDTNCGGSESMEGEVPSNHGNLPDNHAVMMDQGGDSGDQLTLSFQGQVYVFDSVSPEKVQAVLLLLGGREIPPTMPAMPVSPNHNNRGYTGTPQKFSVPQRLASLIRFREKRKERNYDKKIRYTVRKEVALRMQRNKGQFTSSKSNNDESASNATNWGMDENWTADNSGSQQQDIVCRHCGISEKSTPMMRRGPEGPRTLCNACGLMWANKGILRDLSRAAPLSGTIKNENKSLEANQIVHRVAGEADDSS

SEQ ID NO: 3611 - DNA, 829 bp, Triticum aestivum
  misc_feature (1)..(829): Ceres cDNA ID no. 21665814
  misc_feature (1)..(829): Ceres CLONE  ID no. 731034
  misc_feature (1)..(829): Also known as  Ceres CDNA ID no. 24360478
acaaaagccctccctaaaagcctctccctcatttttcttagctgccaaagctttcttctgttgctatttcttcactccattgctgtcttctcagcagctcaatttgctcatcacactcaaaaacaagctagctaagcgagccaggtccatttcccgcgctcatggggttgcaagagatggcgaagctgcagctgcaccgccatggcggcatgcgagtggaagcccacgcccccgtcgacgacgaccaggcggcggtccgcgggaggaggaagaaggcgacggcggcagcggtctggattgcagtgccgctcaggcccgtcaaggtcggccgccgaagacacggcggcggcgacagcagcggcgaggcaggggaggtggaggagaaggaagtggaagaggaggaggaggtgacgacgccgagaggggaagggtgcaggataccctgggaggcggcgacgtgcccgccggcgcccaagaaggcgaggacggcggtggcgatcttcgccgaccgccggtgcaaccgcgacgacggggaggcgacggagtacttccgcgtgccggcggacctggactccgtgttcgccgtcagccgggtcgccgaggccaactgaatgattcgtccatgctcgcgcgcgtgtagagctgcaagtgcgagcgatcaagtccagttaaaagacaagagacagaggagatgatccaataatgcagctgtaaaaatttcgcattgtcgatgcaatggatttatcttagttaattacttctctttcagtgtaaatgtaaattaatcgaggtcgaggagtgcatctgtactacaaaaaaaaaaaaaaaa

SEQ ID NO: 3612 - protein, 149 aa, Triticum aestivum
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MGLQEMAKLQLHRHGGMRVEAHAPVDDDQAAVRGRRKKATAAAVWIAVPLRPVKVGRRRHGGGDSSGEAGEVEEKEVEEEEEVTTPRGEGCRIPWEAATCPPAPKKARTAVAIFADRRCNRDDGEATEYFRVPADLDSVFAVSRVAEAN

SEQ ID NO: 3613 - DNA, 1931 bp, Triticum aestivum
  misc_feature (1)..(1931): Ceres cDNA ID no. 21665815
  misc_feature (1)..(1931): Ceres CLONE  ID no. 735495
  misc_feature (1)..(1931): Also known as  Ceres CDNA ID no. 24360307
acacaacccgctctcgacccaaatcctcacccttcccctccccctcccccgtgctctttcgctcccgtcaaaaccctcgcccccacctctccggcggcggcggcggccgtgcttcctctccggcgagggctgcctccacgtccgtacaagagaatatggatgggcctgctgaggctcctgctgttacggagcatgagatgagcgagatccctaatcctacctgcggtgagcaagccgatgctagcattgaggagcaagccaatcctgagagtgatgtggcagagcagatcaaggaagaagcagaaaatacatctgatgaggaacccaaaggcacaaacaacgaagaatctggtaacccgagcgatgaagcgcaggtgactgtgaaagatgacgatatgggggatcagaatagcgaggaccaggctatccgttcacttgaagagccagctgaggcagagcaactggccaatgtggagacggaggacacgaaatggcctgggtggcctggagaaagtgtgttccgtgtactggtttctgcccaaaaggtgggtgctctcattggccgcaaaggggagtttatcaaaagaatgtgtgatgaatccaaagcccgcataaagattcttgatggcccaccaggtgttccagaaagagctgtaatgatttcagcaaaggatgagccagatgcactcgttccgccagccattgatggtctgctcagagtacataatagaataacaaatggtttagacagtgaaaccgaccaggctcagcgaggtgctggtcctgcagggccaacacggctacttgtgccagcttcccaagctggcagcctgattggcaagcaaggagcaaccattaaatcaatacaggatgcttcaaagtgtgccctccgcattcttgagaatgtgccacctgtagcattaaatgatgacagagttgtcgagatacaaggtgaacctcatgatgttcacaaagcagtggaactgattgcaaaccatttgagaaaatttcttgttgaccgtagtgttctccctttattcgaaatgcagatgaaagtgcacagtgcgcccagagagcaacctatgcctgctcctcagcaatggggtcctcctccgccctggagtcatccaccaaacattcctcccagtggcccaggttatggtgggaatccacattttatgccgccacggccacaagacaactattatcctcctcctgatgtgcaccatgtggagaagcaaccgcactatggaatttcttcatatggacgtgatgcaaatccaactgctgctcctacctcagggaatcaacacctatcgcatgggtcttctcaaatttcccaaaaaatgcaagttcctctttcctacgctgatgctgtgattgggtctgctggtgccaatattagctatatccgcaagcatagtggtgcgacaataagtattcaagaaggtgttcctggggagatgacggtcgagatcgcaggaagtgcctcacaagttcaaactgctcagcagctgatcaagaatttcatggccgaagcttctccccaagttcctccaccaggtcccgctcctccctctcaaccagttgactcgggctacaactcatacccgccgtatggaggactgtcgtatgcaacccctccaggcggcgcaggtcctacccctcacaatggaggaggctatggggcacactaccctccgaactacgggtactagctggatatgaaacactaggatgtagtgacgaattcggttttgttgttcggcctgttaatctgttgagcacgtgagaccattattaggatttccaaacttttggtggtgtaaactgtggagcacagctgttctctgatgtgctgtttagttaccttttggtgctgtaaacttgatcagtaatctatgggctctttcataaaaaaaaaaaaaaaa

SEQ ID NO: 3614 - protein, 520 aa, Triticum aestivum
  misc_feature: PFam Name: KH_1; PFam Description: KH domain
  misc_feature: PFam Name: Extensin_2; PFam Description: Extensin-like region
  misc_feature: PFam Name: FH2; PFam Description: Formin Homology 2 Domain
  misc_feature: PFam Name: Drf_FH1; PFam Description: Formin Homology Region 1
  misc_feature: GI Number: 50901642; NR Description: putative RNA binding protein [Oryza sativa] >gi|16924113|gb|AAL31692.1| putative RNA
  misc_feature: GI Number: 6175183; NR Description: putative RNA-binding protein [Arabidopsis thaliana] >gi|17979249|gb|AAL49941.1| AT3g04610/F7O18_9 [Arabidopsis thaliana] >gi|15229321|ref|NP_187112.1| KH domain-containing protein
  misc_feature: GI Number: 61661326; NR Description: FLK [Arabidopsis
  misc_feature: GI Number: 21280915; NR Description: putative nucleic acid binding protein [Arabidopsis thaliana] >gi|15810499|gb|AAL07137.1| putative nucleic acid binding protein [Arabidopsis thaliana] >gi|4538929|emb|CAB39665.1| putative
  misc_feature: GI Number: 37536904; NR Description: putative nucleic acid binding protein [Oryza sativa (japonica cultivar-group)] >gi|12597878|gb|AAG60186.1| putative nucleic acid binding protein [Oryza sativa] >gi|31433543|gb|AAP55041.1| putative
MDGPAEAPAVTEHEMSEIPNPTCGEQADASIEEQANPESDVAEQIKEEAENTSDEEPKGTNNEESGNPSDEAQVTVKDDDMGDQNSEDQAIRSLEEPAEAEQLANVETEDTKWPGWPGESVFRVLVSAQKVGALIGRKGEFIKRMCDESKARIKILDGPPGVPERAVMISAKDEPDALVPPAIDGLLRVHNRITNGLDSETDQAQRGAGPAGPTRLLVPASQAGSLIGKQGATIKSIQDASKCALRILENVPPVALNDDRVVEIQGEPHDVHKAVELIANHLRKFLVDRSVLPLFEMQMKVHSAPREQPMPAPQQWGPPPPWSHPPNIPPSGPGYGGNPHFMPPRPQDNYYPPPDVHHVEKQPHYGISSYGRDANPTAAPTSGNQHLSHGSSQISQKMQVPLSYADAVIGSAGANISYIRKHSGATISIQEGVPGEMTVEIAGSASQVQTAQQLIKNFMAEASPQVPPPGPAPPSQPVDSGYNSYPPYGGLSYATPPGGAGPTPHNGGGYGAHYPPNYGY

SEQ ID NO: 3615 - DNA, 877 bp, Triticum aestivum
  misc_feature (1)..(877): Ceres cDNA ID no. 21665816
  misc_feature (1)..(877): Ceres CLONE  ID no. 735597
  misc_feature (1)..(877): Also known as  Ceres CDNA ID no. 24368885
attctcttcttcctcaacacacacaaaatatctcttccaatttcaatttctcgtcgtccctcatcatggctcgtctcgcgatcgctgtcgccgccgtgctcctcgtggccctctccgcctccaccgcgacggcgcgtccctgcaggaccttcataatctcctcctactcgttccgcaaccctaactccaacaccttcgccaccatcaccgagatccgatccttcacccctctctacatcaccgacaaacccaccggcaaaccctcctcctcctacgacctcttcttcccccacgcgactcacctccctgagcccgagcgcgtgaacccacgcgctcccctagggttcgcctccgcgtacgatttctcctccctccgcgaccgcaccaaggacatcctcagcgtcgccctcgccctcctcttcggtgtcggctgcggcgccctcaccgccgccaccatgtacctcgtctggtccgtcttctccacgcgccaccccaccgccgccttcgacgacttctcctccgacgaagacgagatcgagagccccaagaagctaggctacgtcaagattcctgccaccgagaccaccgctgctgtctccaccgctccggcgccggccaagggctcggtataagaatgtgtcctccgtaaccgtatggttttctatgttgattgttaataattattataggtgaattgaatagtgaaagtgtcaaatggtgcaaactttggccctgtatctgcgtttatgtttactttttaatttgatgtatttgcgttttttagttctaattggcaactcttggtgtttattatggtgttggtttcctgtgttgattgtttgcaatgctgaaaccttggataaaaaaaaaaaaaaaa

SEQ ID NO: 3616 - protein, 188 aa, Triticum aestivum
  misc_feature: GI Number: 53370700; NR Description: CCAAT-box transcription
MARLAIAVAAVLLVALSASTATARPCRTFIISSYSFRNPNSNTFATITEIRSFTPLYITDKPTGKPSSSYDLFFPHATHLPEPERVNPRAPLGFASAYDFSSLRDRTKDILSVALALLFGVGCGALTAATMYLVWSVFSTRHPTAAFDDFSSDEDEIESPKKLGYVKIPATETTAAVSTAPAPAKGSV

SEQ ID NO: 3617 - DNA, 1356 bp, Glycine max
  misc_feature (1)..(1356): Ceres cDNA ID no. 21665817
  misc_feature (1)..(1356): Ceres CLONE  ID no. 745881
  misc_feature (1)..(1356): Also known as  Ceres CDNA ID no. 24359942
ttttttcctccaatacctcctccacccctttctttctctctctctctctctctctctctctcgattatttccctttgatgagtgttgaacggccaagatggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgccaccaccaccaccacgccgccatatctaaggctactgctacaagtggatacactggcaactctgcttctaccaagaggtgcagaagaaaaaagacctttgcagaattaaaggaagaggagagctcccttctaaaggaaagcatatatctgaaaaaggaaatagcaactgtaaatgcaaattttgaggcacagagagctaaaaatgagagtctgaagagaatgaagcttgatgtgggattaaaatatcatcagaacaatccaagttcaacatctgttgaaccgcagtgtgtgcttgctggtcaaccccatcagagaatagtagtatcttcggaggccctcatacgtcccattcaagatgatactcattcacatgcatcagaatctaggccaaacaagatagaatcaaccaccgggaaaagttttttcttgataccagatctaaatatgatgccgtccgaggatgtttcttgcactgacaatctatgtggaatgagttgagacgacctttctctcttactatatgtgttggggatacaaatctgaacaatgtacaggccaagagagcattttgaaggctctgtccaatagaaaacctatggaaaacgtgttgggtgcactattaacgtttcttggtgtgactactaattcttatgaatggaaaagaaattggtagtcatatatatgggaaaattttcttgggtagttctagccattatgctgtagagtagagagatatgctaaggttgcaggttccttcgattccgaaatttcttaaaaacctttccgatttcggaattcttcaatcatgtcaggtgtaccattcttttgtaggttaaaagctcttggattcccttagaaggtatcttaaatctaaatattcatcgatttccatctgttacttcttcatttctttttatctacaagcaagtcgtgtgtcacctcttcgatataatgtatatgatgtttttcttggtttaaaaaaaaaaaaaaaa

SEQ ID NO: 3618 - protein, 254 aa, Glycine max
MVNEDEWVRAAMADDTVVVELLLRLKQGTVSHKSHHQLIPFSWGVKQPRSRSRLSAAVSRCDAAVSTRCSPTTPLSWSAGTDSYEDSSRHHHHHAAISKATATSGYTGNSASTKRCRRKKTFAELKEEESSLLKESIYLKKEIATVNANFEAQRAKNESLKRMKLDVGLKYHQNNPSSTSVEPQCVLAGQPHQRIVVSSEALIRPIQDDTHSHASESRPNKIESTTGKSFFLIPDLNMMPSEDVSCTDNLCGMS

SEQ ID NO: 3619 - DNA, 1121 bp, Glycine max
  misc_feature (1)..(1121): Ceres cDNA ID no. 21665818
  misc_feature (1)..(1121): Ceres CLONE  ID no. 745883
  misc_feature (1)..(1121): Also known as  Ceres CDNA ID no. 24359944
gaaccttccgtaacacccaactgtctcggatagcttcctgagcaactccgatgggccagggccatgaaccccccaaatcccctgcggctgcgccaccgttgctccgccgcatccacaacctcgacaacgcaatctccctctacatccacaccctgacccgccccatcgctccacgtcccctcctccgcttcctagagcttttggcggacttccgcttcttcttccccgtctccctctccctctaccttgccgctccctcctcctcccctctccgccgcaacctcctcctccccctcatcctctgctccctcctcgacctcctcttcatcgccctcctcaaattcctcgtccgccgatcccgcccctcctactccaaccactcccaatacagcgccgtcgtttcggtcgacaacttctccttccccagcggccactcctcccgcgtctgcttcgtcgcttccgtcttctccctctcccgctcctccctcctagcggatctcagccgtccacgtgtcgccatcctcgttcgtcgctggtttgcaggagacgacgctcttgccgttgatatgctcctcgccgccatttgggcctgggccgtgatcaccgtggtttcgagagtcgctctcgggaggcatcacgtcatcgacgtcttctttggcgcttgcttcggcgttctcgaagcgatggtcacctttcgcgttctcgaataccgagggttgatttgaggttctcatggagcacatttagcatatgcttccgacgggaaagaatgcttttaattgggtttccaacggatgatgaagtcatgaaggttttagtgcattggctgcttggtcctcaccagataattttttagacctttaatactaccatcttgaaaatattgccttgtctcaactctgaactctgattcaattgttaaaaatgcttcggagctgcattgctgtcagtaatttattccttggcatttaactatctgtctccctttactcccctacataaatgtagacatgtgatatagcatacatggtacagcaaagttgtatatcatttatttgaagctttttgtcttatgttctattcagaactataagatgcatgatttaaaaaaaaaaaaaaaa

SEQ ID NO: 3620 - protein, 224 aa, Glycine max
MGQGHEPPKSPAAAPPLLRRIHNLDNAISLYIHTLTRPIAPRPLLRFLELLADFRFFFPVSLSLYLAAPSSSPLRRNLLLPLILCSLLDLLFIALLKFLVRRSRPSYSNHSQYSAVVSVDNFSFPSGHSSRVCFVASVFSLSRSSLLADLSRPRVAILVRRWFAGDDALAVDMLLAAIWAWAVITVVSRVALGRHHVIDVFFGACFGVLEAMVTFRVLEYRGLI

SEQ ID NO: 3621 - DNA, 813 bp, Triticum aestivum
  misc_feature (1)..(813): Ceres cDNA ID no. 21665819
  misc_feature (1)..(813): Ceres CLONE  ID no. 746535
  misc_feature (1)..(813): Also known as  Ceres CDNA ID no. 23720624
tccgcttgtatttctatttccccgtcccttccttccttctagacaccaatccttcttcctcacccgactgcccaacttccggagcaagcgaattgcatcatgcccgcagtgatgaaagctctcgccgccgcctcgccggtctcggcgccgccatcgccccgtcggagggtcgcaggctcgtcaggcgcgccgtgccaaagcctgcagtcctccttccgcggcatctccctgcggtgctgtcccaggaaaccggcccaccgctcgccgccgctacgcagctctcgggcggcggcgcaggtggtggcgatgaagccggcgatccagttcatccagggcacggacgagcagacgatcccggacgtgcggctgaccaagtcccgcgacggcaccaacggggtggccatcttcgagttcgaccagccgtcggtgttcgactcgtcggcggagctcggggacatcacggggttctacatgatcgacgaggagggcgtgctgcagacggcggacgtgagcgccaagttcgtcaacgggaagccggccagggtggaggccaagtacgtgatgcgcacggccggggactgggaccgcttcatgaggttcatggagaggtactcgcaggccaacggcctccagttcgtcaagaactaagtcacatctcctcgatgggccttgtgtgttgcccatgttcagttcagtataactgtcgagctggtaacgaaggtgaatgattgtactgaggtgtcatgtgtatctcttatgtaactttgacattgtgtgaaattttgtatacaccagccaaaaaaaaaaaaaaaa

SEQ ID NO: 3622 - protein, 182 aa, Triticum aestivum
  misc_feature: PFam Name: PsbW; PFam Description: Photosystem II reaction
  misc_feature: GI Number: 57899200; NR Description: putative photosystem II
  misc_feature: GI Number: 34907246; NR Description: photosystem II protein W-like protein [Oryza sativa (japonica cultivar-group)] >gi|20160776|dbj|BAB89717.1| photosystem II protein W-like protein
  misc_feature: GI Number: 21592461; NR Description: photosystem II protein W-like [Arabidopsis thaliana] >gi|21360421|gb|AAM47326.1| AT4g28660/T5F17_110 [Arabidopsis thaliana] >gi|18087645|gb|AAL58951.1| AT4g28660/T5F17_110 [Arabidopsis
  misc_feature: GI Number: 7269721; NR Description: photosystem II protein W-like [Arabidopsis thaliana] >gi|7488014|pir||T10660 photosystem
  misc_feature: GI Number: 19880501; NR Description: saline responsive OSSRII
MPAVMKALAAASPVSAPPSPRRRVAGSSGAPCQSLQSSFRGISLRCCPRKPAHRSPPLRSSRAAAQVVAMKPAIQFIQGTDEQTIPDVRLTKSRDGTNGVAIFEFDQPSVFDSSAELGDITGFYMIDEEGVLQTADVSAKFVNGKPARVEAKYVMRTAGDWDRFMRFMERYSQANGLQFVKN

SEQ ID NO: 3623 - DNA, 2018 bp, Triticum aestivum
  misc_feature (1)..(2018): Ceres cDNA ID no. 21665820
  misc_feature (1)..(2018): Ceres CLONE  ID no. 746642
  misc_feature (1)..(2018): Also known as  Ceres CDNA ID no. 24361262
accacatctcaacactagctagtagctgcctgcctcaacatttgtggtggcacgcaccgccggctgccgccatgtccaaagcattcaccaagtccctcctcttgtacaacaagatcctcgtccggcggctcaagtccctcatcacccgtgcgccacccgcgccgacgtcggccaccgagaagctgccaccgtcacacatgcgcaagtcgtcgacggcaccgctggacgcgctcccggcgccagggacgacggacgacggcaacaacaatgatggcggtactggcggcggcaccatcgtgtgcgaagtggagggtggcctgctgatgtccgcctccaccttcccctacttcatgctcgtggccctcgaggccggcgggctcctccgcggcctcctcctgctgctgctctaccctctcttccgcctcctcacggacgagctcgccacgaaggccatggtgatggtgagcttcgcggggctccggaaggacgagtttggccggctgggcatggccgtcatgcccaagctgttcctgcaggacgtgagcgccgagttgttccacgcggccacgtctgctccagcgacggcaggggccgcgcggcggcgaaggcgctgcgtgtgcgtgagcagcatgccgagggcgatggtggagccgttcttgaaggagtacctcgctgtcgacgccgtcgtcgcgccggagctgagggagctcggagggtactacctgggtctcgtggaggacgaaggcgaggtggcgaggaggacggacgtggaggagatcattggggccaagggcggcgccgtcgtcggcattggtggacaggggtgctcgtttcagcacatcttccaaaagtactgcaaggaggtgtatgtgccgacggagtcgacgcggcgccggcgaggggtgctgcacccgcggcggtacccgaagcccctggttttccacgacggccgcaccgcgttccggccgacgcccgccgccacgctcgccatgttcgtgtggctcccgctcggcgcgccgctcgccgtgctccgcaccgccgtatttctgcttctcccgttctcactctctgtgccgctcctcgccgccctcggcatgcacaaccgcatgatcgcgtcgtcgtcgccgtctgcccccggggacaggagcaagggcaacctcttcgcgtgcaaccaccggtcgctgctggacccgctctgcgtgtccgcggccgccggccggcgcgacctcgccgcggccacctacagcatcagccgcctgtcggagatgctcgcgccgatccccacgttccgcctcacccgcgaccgcgccgccgaccgcgcggccatgcaggcacagctcgcccgccgcggcggccgcggcgggctggtggtgtgcccggaggggacgacgtgcagggagccgttcctgctgcggttcagcccgctgttcgcggagctggcggccggcggcgtggacgtggtgcccgtggcgctgcacctggcggtggacatgttccatggcacgacggcggggggaaggaagatgctggacccgctgtacctgctgatgaaccccgtgccgtcgtacctggtgcagatcctcgcccccgtggagtgcggcggccaggaggcgcgcgccgtggccaatgaggtgcagcggcgggtggcggaggcgctcgggtacgagcgcaccgggctgacgaggagggacaagtacctcatcctcgccggcaacgaaggggtcgtcggcgccgccgccgccgcccacgacggcggcccgaaaaattagctgcagctgatgccggcgcagtctactattgacgactagcagtgcaatacagtactacaactacgaagctagccgcttgtggtcactgctgacggtgtacagtgcgtgcatacgcgtgtcctggctcgtcagggattatctgtgttgtccgggggtgctttgtgaaaatatcacactaatacagtgtgcaatttgtttatttttgcaatcataatatacagaggttttgcttgaaaaaaaaaaaaaaaa

SEQ ID NO: 3624 - protein, 565 aa, Triticum aestivum
  misc_feature: PFam Name: Acyltransferase; PFam Description: Acyltransferase
  misc_feature: PFam Name: Peptidase_S8; PFam Description: Subtilase family
  misc_feature: GI Number: 34894812; NR Description: P0554D10.9 [Oryza sativa
  misc_feature: GI Number: 53791327; NR Description: phospholipid/glycerol acyltransferase -like protein [Oryza sativa (japonica
  misc_feature: GI Number: 23506183; NR Description: At4g01950/T7B11_21 [Arabidopsis thaliana] >gi|7268579|emb|CAB80688.1| predicted protein of unknown function [Arabidopsis thaliana] >gi|20453058|gb|AAM19774.1| AT4g01950/T7B11_21 [Arabidopsis
  misc_feature: GI Number: 50933501; NR Description: putative phospholipid/glycerol acyltransferase [Oryza sativa (japonica cultivar-group)] >gi|46485884|gb|AAS98509.1| putative phospholipid/glycerol acyltransferase [Oryza sativa (japonica
  misc_feature: GI Number: 34905450; NR Description: P0487H02.19 [Oryza sativa (japonica cultivar-group)] >gi|15623799|dbj|BAB67859.1|
MSKAFTKSLLLYNKILVRRLKSLITRAPPAPTSATEKLPPSHMRKSSTAPLDALPAPGTTDDGNNNDGGTGGGTIVCEVEGGLLMSASTFPYFMLVALEAGGLLRGLLLLLLYPLFRLLTDELATKAMVMVSFAGLRKDEFGRLGMAVMPKLFLQDVSAELFHAATSAPATAGAARRRRRCVCVSSMPRAMVEPFLKEYLAVDAVVAPELRELGGYYLGLVEDEGEVARRTDVEEIIGAKGGAVVGIGGQGCSFQHIFQKYCKEVYVPTESTRRRRGVLHPRRYPKPLVFHDGRTAFRPTPAATLAMFVWLPLGAPLAVLRTAVFLLLPFSLSVPLLAALGMHNRMIASSSPSAPGDRSKGNLFACNHRSLLDPLCVSAAAGRRDLAAATYSISRLSEMLAPIPTFRLTRDRAADRAAMQAQLARRGGRGGLVVCPEGTTCREPFLLRFSPLFAELAAGGVDVVPVALHLAVDMFHGTTAGGRKMLDPLYLLMNPVPSYLVQILAPVECGGQEARAVANEVQRRVAEALGYERTGLTRRDKYLILAGNEGVVGAAAAAHDGGPKN

SEQ ID NO: 3625 - DNA, 1743 bp, Triticum aestivum
  misc_feature (1)..(1743): Ceres cDNA ID no. 21665821
  misc_feature (1)..(1743): Ceres CLONE  ID no. 747466
  misc_feature (1)..(1743): Also known as  Ceres CDNA ID no. 24361243
gaggttgtttatgcaaggcgtttcccccgaccttcgtctcgaaaccctctctgccggctgcttctccggtctaccgacaagcacgccgcctctcagtcgaaggagtattctaggttgaaatggcatatgcgtacaggtggcggagaaacctctgcacactcatgaggttcttaccgcaggtggagcgccccgaccagcctgtttctctccatgacaagtatttttacacggctgcttcggttttcatcttcatggctgccagccagctccctctatatggcttcaaaccaggcatggggattgatccattttactgggtcggcatggcttttgcatcaaactggggaactctcaccacttttgggatcctccctgtttttgtacctgagtttttagtgccagtctgtatctcgaggattctaaaagtgagcagcaggactcctgagggtcgaatgcttctggatggagctcacaaggtggttgggatatgcactaacattgtgatggttattatctttatgctagtgtatgccattcttgtcaaagttgacacgtgcactgctgttgtaatgatgctccaacttttcttctctggtgttgttgtcctctatctcgatgaggtgctgaagaaaggatatggattgttgccaagtatctcgttattcactgccaccaatatttgtgtaagtgttctttggaaggcctttagcccctcttatgttacttattatcatgagcaaggtgctcaatttgagggagctgttattgcctgggtccatcttttggttactggaacggacaagttctctgcaacctgtcaagccttttgccgccaaaacctcccgaatgtcaccaacctgctggttacttgcttgttttgtctaattgccttattctttcagagcttttatgttgcgctgccagtgaagttacttgattgcgctcagttcacctaccgcctcaagttctcctatatctcctacgccgctattatcttgcaacaggttgtggttacgtatctattagtcatctcagaggtactgtacgtgatattttgtgcattggtggacctgcatggcaggtcgaatgggtctagtaagactattgggatttgtcgccgaggcgatgggattttctactacctaacagcacctccaactttgattgatctgcagagagacccggtccatgtatttctctacatcgtcattgtgcttagtgcatgtgcttatttctcagtaatttggaccagatgctgtatgacatccagaagatttttacatgacatgctaggggaagatgtgcagcttcctggccctgacacgatgtctgacgacgaattccagagttgcatagccaagggggcttgtcttggtggcatttgtgtgggcttgttgatagttttgtccgattttgctggtctatgtggttctggtatggggattctgcttgctgttgcagcggtgtatccctactttgagggggtgagagctgaagacataggtgtctttggcctctgaccggttgcattcctctcagcgtagatttgggtgaattgaatgctattctcacttgtattcagaatttaagcaacatcgttcgggaatctatgcaagcgagttgagaaaatctagtctgtacggtccttttgctgcgaacgctgtgtaatgactatttatttgggtttattaaatactttgatggatgaggaggaacttgaaatgttcaaaaaaaaaaaaaaaa

SEQ ID NO: 3626 - protein, 466 aa, Triticum aestivum
  misc_feature: PFam Name: SecY; PFam Description: eubacterial secY protein
  misc_feature: GI Number: 50252374; NR Description: putative Sec61 alpha form 2 [Oryza sativa (japonica cultivar-group)] gi|50252404|dbj|BAD28559.1| putative Sec61 alpha form 2 [Oryza
  misc_feature: GI Number: 8886324; NR Description: Sec61p [Triticum aestivum]
  misc_feature: GI Number: 15375074; NR Description: Sec61 alpha subunit
  misc_feature: GI Number: 6581004; NR Description: putative integral
  misc_feature: GI Number: 3834321; NR Description: Strong similarity to F13P17.9 gi|3337356 transport protein SEC61 alpha subunit homolog from Arabidopsis thaliana BAC gb|AC004481
MAYAYRWRRNLCTLMRFLPQVERPDQPVSLHDKYFYTAASVFIFMAASQLPLYGFKPGMGIDPFYWVGMAFASNWGTLTTFGILPVFVPEFLVPVCISRILKVSSRTPEGRMLLDGAHKVVGICTNIVMVIIFMLVYAILVKVDTCTAVVMMLQLFFSGVVVLYLDEVLKKGYGLLPSISLFTATNICVSVLWKAFSPSYVTYYHEQGAQFEGAVIAWVHLLVTGTDKFSATCQAFCRQNLPNVTNLLVTCLFCLIALFFQSFYVALPVKLLDCAQFTYRLKFSYISYAAIILQQVVVTYLLVISEVLYVIFCALVDLHGRSNGSSKTIGICRRGDGIFYYLTAPPTLIDLQRDPVHVFLYIVIVLSACAYFSVIWTRCCMTSRRFLHDMLGEDVQLPGPDTMSDDEFQSCIAKGACLGGICVGLLIVLSDFAGLCGSGMGILLAVAAVYPYFEGVRAEDIGVFGL

SEQ ID NO: 3627 - DNA, 2092 bp, Triticum aestivum
  misc_feature (1)..(2092): Ceres cDNA ID no. 21665822
  misc_feature (1)..(2092): Ceres CLONE  ID no. 747972
  misc_feature (1)..(2092): Also known as  Ceres CDNA ID no. 23483269
gctggttaggttgtctcgcgttgagggctttgccgacgcaacacgcacccaaaaatcctaatcctcatcgccgccggcgaccatggtgtcgcagcacgacatcctcctcgccgcgggcctcatatccgaccacttcggccccctcgtagcgaaggtgtgcgactgcctcctccgccacggggcgctgcagctgacggagattgtgcgccgtctcaagctcccgcaggggcaagtgaagaactctctcctcgtcctcatccagcacaactgcgttcaggccttctcatcgcccagaggcgataggaccatcacgctctacttggccatcttcgacaatgtcctgcatcggctgcgcttctcaaagttcatctctattatccgcgcggacattccagagtcagaagctcttattgagggattgcttcagaatggtaggctaacatttgaccaacttgtgggacgcacaatctctaaagtgccagaaggcaccatccgaccagcaagggaagaaatacgaatgaacttcaacagacttgtgtatgcacgttatgtggaacgttgcccaaaagctgaaccctatttcaatccacaggaagatgaacaatctacaggtgcaaggagaagagttccaaaaactgccgaggaggttctttcacttgagcagaaagttgtcaatactgcaaccctttctgatccagaaaggttttctgagatcccatacagcatggaggatgcatcaaaaacgaatgattgtcctcataacgctgttgcgggtgctaagcggaaacacggagcctttgaggtagatgaagagctcaactcaacaattgcagagaatgaagtactttggcgggtaaattttgagaaatttatattttgtctaaagaagaagttttgtgcagaccgaaagaagccaaagctgaaggttggcacacatcctatctgggagtcattttttgaagctaacttacctgacaaagatacaaactctgtgacatcatcaataaatggtattttggagaaactaggacaaaaggaaggaggtgcggcaatgtcaattggtgacataaaaccagtcctgctggatttacagtgtactacttccgatggggaagaatttacttttgatttacgcaaaatggttgaagcatgtagaaatgaggagatagagtcgcttgtgaaaaagaaatacgggcaagaagcttttacaatctttaggctattggtcacacaaggttgtgcagttgagacagatcaaattattgacacaacaattctggacaagcagattgttcattcaactttgtacaaactatggaacgacggctacatagatacagagaaaatcgcttccgcagcaggaacagggtacgcacagttttttgtatggagagccaaaaatacatttcgtgagcagttcatcgataatctctaccatgctgctttgaacttgcgccagatggtgaattacattgctgaacttctactcgagggttcgaaggacgaaacaaagctgcggaacagaaagaacattttgatcctggccctcactagacatgatgactctctcatgctgttccatgatttttgagaatacaggctatccattcggttcgtctggccaaatgccactcgtaccggcaggcaggcaggccaccgatgattggaagcggataatcacaataattcgcaagttgcgggggcgcagatgctgcgccacttggagcggctaccattatctatctatcaatccgcgcgcgagaggtagaggtcgcaagcgcgtcgtcatgcacgtatgaccatggacttttgcgagccgtatcgcacccatgtgcgcacacacatgcatgaagcaaccctacaactaatgcgcgcgcatacggccaggtcaactgctgcagttagctggagacaaataacgattctttctttccggaagttgtagatgaaagctaaatcaaaccctgaactttgaatcccggaaattgacactctgaacttgtaatcccggtctattttggaccctatacctgtttggcacatcgggaatacaacaatcccggttgggattaaaaaaaaaaaaaaaaaaaaa

SEQ ID NO: 3628 - protein, 502 aa, Triticum aestivum
  misc_feature: PFam Name: RNA_pol_Rpc82; PFam Description: RNA polymerase
  misc_feature: GI Number: 34911154; NR Description: putative RNA polymerase III subunit [Oryza sativa (japonica cultivar-group)] >gi|20161103|dbj|BAB90033.1| putative RNA polymerase III subunit
  misc_feature: GI Number: 34098883; NR Description: At3g49000 [Arabidopsis thaliana] >gi|20466336|gb|AAM20485.1| RNA polymerase III subunit-like protein [Arabidopsis thaliana] >gi|18408755|ref|NP_566914.1| RNA polymerase III subunit RPC82
  misc_feature: GI Number: 21553700; NR Description: RNA polymerase III
  misc_feature: GI Number: 6522566; NR Description: RNA polymerase III subunit-like protein [Arabidopsis thaliana] >gi|11358814|pir||T46130 RNA polymerase III subunit-like protein -
  misc_feature: GI Number: 49670421; NR Description: Polr3c-prov protein
MVSQHDILLAAGLISDHFGPLVAKVCDCLLRHGALQLTEIVRRLKLPQGQVKNSLLVLIQHNCVQAFSSPRGDRTITLYLAIFDNVLHRLRFSKFISIIRADIPESEALIEGLLQNGRLTFDQLVGRTISKVPEGTIRPAREEIRMNFNRLVYARYVERCPKAEPYFNPQEDEQSTGARRRVPKTAEEVLSLEQKVVNTATLSDPERFSEIPYSMEDASKTNDCPHNAVAGAKRKHGAFEVDEELNSTIAENEVLWRVNFEKFIFCLKKKFCADRKKPKLKVGTHPIWESFFEANLPDKDTNSVTSSINGILEKLGQKEGGAAMSIGDIKPVLLDLQCTTSDGEEFTFDLRKMVEACRNEEIESLVKKKYGQEAFTIFRLLVTQGCAVETDQIIDTTILDKQIVHSTLYKLWNDGYIDTEKIASAAGTGYAQFFVWRAKNTFREQFIDNLYHAALNLRQMVNYIAELLLEGSKDETKLRNRKNILILALTRHDDSLMLFHDF

SEQ ID NO: 3629 - DNA, 1655 bp, Triticum aestivum
  misc_feature (1)..(1655): Ceres cDNA ID no. 21665823
  misc_feature (1)..(1655): Ceres CLONE  ID no. 748127
  misc_feature (1)..(1655): Also known as  Ceres CDNA ID no. 24360242
agtttaggagtataaaccccggcgcacaccccctgcgcaggaggaaatcccatgcccgcagccaatcccgcgccccacctccacttggcagagctcaacagcttcccccctccccgctcctgccttcccttcctcgtgaggcgggccgggatcccttccgaaacggctctgaggcgacgcgcacactgtcattcatcccgcagatccacgcacaaccacctgaataatttacagatcccggagcggatttcgcacgggaacccgccgcagcccacccgccgcctcatcctcctcctcctcgtcgtcgtcgtcctaggggccatggggaacagtatttacaagttcctgtgcggggtgtgctcggacctgtccgacgccgccttccagccgcatggcgcggacgcctccgtcgccgcgctcggccgcgacatcctcgagttccagcgcaccaagcaggtccccgagggcctcggccgccacgtcgtctcctccgccgccgcgcaggccaactggtacaagaagctgcaagtggcatggaagaaggcgaggccggccccgacgacgccggaggaagccggccgcctcgtggtgctgacgctcaagaaccaccagaaggcggacgtcgacggcctcctcgccttctacggcctcccgcacccgaacgaggcgggatcggcgccaccgccggccgccggtcaccacgctcctccggcccagcacagcgcccccgcgcacaagccccagggcgtcaagttcgagctgcacacgctcccggtggacgccaaggcggtggccgacggcgacacggtgacggtgtacgtggacacgaatgacgcccccagcgagatcaagaaggccgcggcggagcgcaccaaggcgcgcgccgccaggaactaccccacggccgacgcgctccagaagaccatcgccgacgccgggtacaggatggttcccaacgccaagggcgccgaggtgctcgccaagaagtacaggatcaggttaagtgggatcgacgcgccggagagcgcgatgccgtacgggaaggaggccaaggaggcgctgctgaagctggtggagggcaagtgcctgacggtgcacgtctacaacaccgaccgctacggccggtccgtcggggatctccacgtcggcggggtcttcgtgcaggagcaaatgctgaagaaaggcttcgcgtggcactacaccgcctacgacaaacgcccggagcttgccaagtggcagagccaggcgcaggccgcccgcaagggcctgtgggcggcgtccaagccgcaggagccgtgggagtacaggaaggccaagcgcaacggcaacgcgtgatccgtttccacaggccgcaagcctcgagacatatgttgtaactgttgtgtgcatgtgctgtgaccatggacggctgattgattgattcgtggcctgctgcgctgcagatccgtagcccagagcagcgctcgcaccactgtactttttacaagttaggtgtagtgaaaggactagctaagctagaacagggtcgtgaagcagaggaggccggggcacattgagattggttggtgttgtgttgttgttgttgtacctcgtgattgatttgtgtgattgtgttgtacaactcttacttggattggacaaaaaaaaaaaaaaaa

SEQ ID NO: 3630 - protein, 1655 aa, Triticum aestivum
  misc_feature: PFam Name: SNase; PFam Description: Staphylococcal nuclease
  misc_feature: PFam Name: Pyr_redox_2; PFam Description: Pyridine
  misc_feature: GI Number: 34896124; NR Description: putative nuclease [Oryza sativa (japonica cultivar-group)] >gi|15528760|dbj|BAB64802.1|
  misc_feature: GI Number: 18410440; NR Description: Ca(2+)-dependent
  misc_feature: GI Number: 7684292; NR Description: Ca(2+)-dependent nuclease [Arabidopsis thaliana] >gi|25455848|pir||T52640 nuclease (EC
  misc_feature: GI Number: 14030876; NR Description: nuclease [Nicotiana tabacum]
  misc_feature: GI Number: 42571151; NR Description: Ca(2+)-dependent
AGTTTAGGAGTATAAACCCCGGCGCACACCCCCTGCGCAGGAGGAAATCCCATGCCCGCAGCCAATCCCGCGCCCCACCTCCACTTGGCAGAGCTCAACAGCTTCCCCCCTCCCCGCTCCTGCCTTCCCTTCCTCGTGAGGCGGGCCGGGATCCCTTCCGAAACGGCTCTGAGGCGACGCGCACACTGTCATTCATCCCGCAGATCCACGCACAACCACCTGAATAATTTACAGATCCCGGAGCGGATTTCGCACGGGAACCCGCCGCAGCCCACCCGCCGCCTCATCCTCCTCCTCCTCGTCGTCGTCGTCCTAGGGGCCATGGGGAACAGTATTTACAAGTTCCTGTGCGGGGTGTGCTCGGACCTGTCCGACGCCGCCTTCCAGCCGCATGGCGCGGACGCCTCCGTCGCCGCGCTCGGCCGCGACATCCTCGAGTTCCAGCGCACCAAGCAGGTCCCCGAGGGCCTCGGCCGCCACGTCGTCTCCTCCGCCGCCGCGCAGGCCAACTGGTACAAGAAGCTGCAAGTGGCATGGAAGAAGGCGAGGCCGGCCCCGACGACGCCGGAGGAAGCCGGCCGCCTCGTGGTGCTGACGCTCAAGAACCACCAGAAGGCGGACGTCGACGGCCTCCTCGCCTTCTACGGCCTCCCGCACCCGAACGAGGCGGGATCGGCGCCACCGCCGGCCGCCGGTCACCACGCTCCTCCGGCCCAGCACAGCGCCCCCGCGCACAAGCCCCAGGGCGTCAAGTTCGAGCTGCACACGCTCCCGGTGGACGCCAAGGCGGTGGCCGACGGCGACACGGTGACGGTGTACGTGGACACGAATGACGCCCCCAGCGAGATCAAGAAGGCCGCGGCGGAGCGCACCAAGGCGCGCGCCGCCAGGAACTACCCCACGGCCGACGCGCTCCAGAAGACCATCGCCGACGCCGGGTACAGGATGGTTCCCAACGCCAAGGGCGCCGAGGTGCTCGCCAAGAAGTACAGGATCAGGTTAAGTGGGATCGACGCGCCGGAGAGCGCGATGCCGTACGGGAAGGAGGCCAAGGAGGCGCTGCTGAAGCTGGTGGAGGGCAAGTGCCTGACGGTGCACGTCTACAACACCGACCGCTACGGCCGGTCCGTCGGGGATCTCCACGTCGGCGGGGTCTTCGTGCAGGAGCAAATGCTGAAGAAAGGCTTCGCGTGGCACTACACCGCCTACGACAAACGCCCGGAGCTTGCCAAGTGGCAGAGCCAGGCGCAGGCCGCCCGCAAGGGCCTGTGGGCGGCGTCCAAGCCGCAGGAGCCGTGGGAGTACAGGAAGGCCAAGCGCAACGGCAACGCGTGATCCGTTTCCACAGGCCGCAAGCCTCGAGACATATGTTGTAACTGTTGTGTGCATGTGCTGTGACCATGGACGGCTGATTGATTGATTCGTGGCCTGCTGCGCTGCAGATCCGTAGCCCAGAGCAGCGCTCGCACCACTGTACTTTTTACAAGTTAGGTGTAGTGAAAGGACTAGCTAAGCTAGAACAGGGTCGTGAAGCAGAGGAGGCCGGGGCACATTGAGATTGGTTGGTGTTGTGTTGTTGTTGTTGTACCTCGTGATTGATTTGTGTGATTGTGTTGTACAACTCTTACTTGGATTGGACAAAAAAAAAAAAAAAA

SEQ ID NO: 3631 - DNA, 1515 bp, Triticum aestivum
  misc_feature (1)..(1515): Ceres cDNA ID no. 21665824
  misc_feature (1)..(1515): Ceres CLONE  ID no. 748244
  misc_feature (1)..(1515): Also known as  Ceres CDNA ID no. 23483372
gtaccatctgggctggggaggggaaggagcagaggggatgagcggcggcggcggcggcggagtgctgggcgccggctcgtcgtaccagagcttcgtccgcaccgcgctggaacagacccgcctccgcaccgccctcacgccccacccctcgcaggaaaagttcaggctcatacgagccaacgacgatgctgctgttttggacgctctctcattcagcacccccaagatcagactgcttcgcagcttgacggttgagaagaaaaactcggttcaggttcttgactttgctgctttctctgaacctgaatatgatcttcctatattttgcgccaacgcttttacgactcctgcacagagtatcgttgtcttggacctcaatccgctatacgatataactgaagacaaggattacaaagataaatactacaggaatttgatgcctcttatacacaagtatagtgaggtgcttggatcttatccttcaccccaaatatattaccccagtcttcttctattagctttatacatagagtgctatctttatttagagaaaatgcagcttctgccatggggtggcaagattacgagcgaatctctgagattcttctctccaatcgtgatctggactatatttgagcccactgaacgtaaccatcatgttctgtattcagctttgatggattactataaggtttggcttcagttaacggatcaagcaactgaagaaaatgacacaacgaaagttgttcgtaacagagaagcgcaacatagatatctcacatggagggctgaaaaggatcctgggtttccacttctgaagaagttgattggtgaaagccatgccaaggatttggtgactgagttcctgttcgaaggagtgcattctcttggaactaaatctttcctggactattttcgcgagtacgcatgtgacgacgggacagtaaacaagaagaggagtatgatcgggaaatctttcgaagataggccttgggatgctacgggagaattcattggtggcaaggatgcaggatgagatcttttgatgcaggatgatatcttttgcagtaggatccacatgggcattcttagggttttgctgagctcctagcgattcacggcactcttgcttctcaggtttcattttaacgttcttcgttacacgctgtccgggctaatttgcatccatgtaatttcatctgagttctctgtgtagcttagaaaacatgtgtaatatttgattgaccctgataagtttttatggcaagtttagcgacgcgagaatggcaactttagttgtcaagcaagtcaacttcttttcggatggtacgttttagttttttttcgggtttgtttttttcaatttggatagcaactttaattgtaaaaaaaatatcagggccggagtgcttcgtgctacacgtgtggcacttatcatttgggtatattaaattgagtgcattatcaataataccttgcagtgatattatacactggccaaaaaaaaaaaaaaaa

SEQ ID NO: 3632 - protein, 332 aa, Triticum aestivum
  misc_feature: PFam Name: Fe_bilin_red; PFam Description:
  misc_feature: GI Number: 57900463; NR Description: putative
  misc_feature: GI Number: 49472889; NR Description: phytochromobilin
  misc_feature: GI Number: 50904485; NR Description: B1147A04.9 [Oryza sativa (japonica cultivar-group)] >gi|19386814|dbj|BAB86192.1| B1147A04.9
  misc_feature: GI Number: 62149358; NR Description: phytochromobilin synthase [Lycopersicon esculentum] >>gi|62149356|dbj|BAD93478.1|
  misc_feature: GI Number: 30680787; NR Description: phytochromobilin:ferredoxin oxidoreductase, chloroplast /
MSGGGGGGVLGAGSSYQSFVRTALEQTRLRTALTPHPSQEKFRLIRANDDAAVLDALSFSTPKIRLLRSLTVEKKNSVQVLDFAAFSEPEYDLPIFCANAFTTPAQSIVVLDLNPLYDITEDKDYKDKYYRNLMPLIHKYSEVLGSYPSPQIYYPSLLLLALYIECYLYLEKMQLLPWGGKITSESLRFFSPIVIWTIFEPTERNHHVLYSALMDYYKVWLQLTDQATEENDTTKVVRNREAQHRYLTWRAEKDPGFPLLKKLIGESHAKDLVTEFLFEGVHSLGTKSFLDYFREYACDDGTVNKKRSMIGKSFEDRPWDATGEFIGGKDAG

SEQ ID NO: 3633 - DNA, 1565 bp, Triticum aestivum
  misc_feature (1)..(1565): Ceres cDNA ID no. 21665825
  misc_feature (1)..(1565): Ceres CLONE  ID no. 748603
  misc_feature (1)..(1565): Also known as  Ceres CDNA ID no. 24361239
acccctcccctctctctcctccactccgctccccctccctccccgattaaaccctactctctctctccgcctcgcgtcttttcttttccgcccccacccgagaaaaaataattccgggggcgacggccgccggaaacccgtagaattcgtccggggaggaggaggaggagggatttcgtttcgttttggtctgtttgtttgtttggatttggatatggaggcggcggccgagtgcgcgggcggcggcggcggcggcctaagggaggtcaagaaggaggccggcgccggcgacgtgttcctcgtcgacgacctcctcgacctgccctgcgacgacgacgaggaggaggacgacgccgcggcggcggggttcgccgacggggccgcggactgcagcgccggcgaggccggcgccggcgacgtcgggaacgcgtcggccgactcgtccacggtcacagccgtcgacagctgcagcaactccctctccggcggcctcgccgacggcgacttctccggcggcctctgcgagccgtacgaccagttggcggagctggaatggctgtccaactacatgggcgacgacaacttccccaccgaggacctccgcaagctgcagctcatctccggcatcccctcggcctcgtcccagacggccccgcgcgcgcccgccgccgcgccggtgcagccctgtggcggtggtggcgccgtcggtacggccttgtggcgctcggaggcgcacgccgggcaggtgtccgtgccgggcaaggcgcgcagcaagcggtcccgcgtcgcgccctgcaactggtcctcccgcctgctcgtgctcccgccggcgccggcctcgccgccctccgcggcgtcggccgtcatctcgccgtccgagtccgggacggcgttcccgctcttcccgaacaagaagcccgccaagtcgtccaagaagaaggaggcgccggccgcgcccgccatgaccgccgccgaggccgcggccgcggaggggcggcggtgcctgcactgcgagaccgagaagacgccgcagtggaggacggggccgctgggccccaagacgctgtgcaacgcgtgcggggtgcggtacaagtcggggcggctggtgccggagtaccggccggcggcgagcccgacgtttgtgccgtccaagcactccaactcgcaccgcaaggtggtggagctgcggcgccagaaggacgccccgccccagcagctgctgcaccagccgcagcagcagcagctggggccgggcctggggttccacgtgccgagcccgctgctgttcgacgggccggcggcgccgcaccttggcggcggcgcggacgagttcctcatccgcaaccgcatagggcccgaccaccggcagctcatctagcttagctagccagccagcgccgcccagctcgcctaggaggaggatcgttccgttagccccagcagcaataattcagcaagaagaagagccagccagcccagcccagctaaaacttttttttcctaggagttgttgtttctccggattttaatttacctttttccagagaaaaaaaaaaaaaaaaaaa

SEQ ID NO: 3634 - protein, 387 aa, Triticum aestivum
  misc_feature: PFam Name: GATA; PFam Description: GATA zinc finger
  misc_feature: PFam Name: Pyr_redox_2; PFam Description: Pyridine
  misc_feature: PFam Name: MCPVI; PFam Description: Minor capsid protein VI
  misc_feature: PFam Name: FH2; PFam Description: Formin Homology 2 Domain
  misc_feature: PFam Name: Extensin_2; PFam Description: Extensin-like region
  misc_feature: GI Number: 15239503; NR Description: zinc finger (GATA type)
  misc_feature: GI Number: 34909448; NR Description: OSJNBa0014K08.18 [Oryza sativa (japonica cultivar-group)] >gi|21902044|dbj|BAC05593.1|
  misc_feature: GI Number: 37572447; NR Description: AG-motif binding
  misc_feature: GI Number: 50911202; NR Description: putative AG-motif binding protein-4 [Oryza sativa (japonica cultivar-group)] >gi|49387618|dbj|BAD25814.1| putative AG-motif binding protein-4 [Oryza sativa (japonica cultivar-group)] [Oryza sativa (japonica
  misc_feature: GI Number: 37536778; NR Description: putative transcription factor [Oryza sativa (japonica cultivar-group)] >gi|14165317|gb|AAK55449.1| putative transcription factor [Oryza sativa (japonica cultivar-group)] >gi|31433473|gb|AAP54978.1|
MEAAAECAGGGGGGLREVKKEAGAGDVFLVDDLLDLPCDDDEEEDDAAAAGFADGAADCSAGEAGAGDVGNASADSSTVTAVDSCSNSLSGGLADGDFSGGLCEPYDQLAELEWLSNYMGDDNFPTEDLRKLQLISGIPSASSQTAPRAPAAAPVQPCGGGGAVGTALWRSEAHAGQVSVPGKARSKRSRVAPCNWSSRLLVLPPAPASPPSAASAVISPSESGTAFPLFPNKKPAKSSKKKEAPAAPAMTAAEAAAAEGRRCLHCETEKTPQWRTGPLGPKTLCNACGVRYKSGRLVPEYRPAASPTFVPSKHSNSHRKVVELRRQKDAPPQQLLHQPQQQQLGPGLGFHVPSPLLFDGPAAPHLGGGADEFLIRNRIGPDHRQLI

SEQ ID NO: 3635 - DNA, 1355 bp, Triticum aestivum
  misc_feature (1)..(1355): Ceres cDNA ID no. 21665826
  misc_feature (1)..(1355): Ceres CLONE  ID no. 752604
  misc_feature (1)..(1355): Also known as  Ceres CDNA ID no. 24360238
aaccccgatccaatgtccatccccatcccagctctcgacgacggccgacgacaatatggacgtcgccgtcgccgccgccctggttcccacccggaccccaaccctccgtctcccctcatcccgcccctcctccgtgaggcccctcaccccgaccgccggccgtccagctcggatcctctcgctcgcccgccgcgcgcctgtcgccgccgccgccctcggggtatcccaagatacagggttcgcgatgcccggtgccgacattgttacccagaacgacttactcatcatcggcccaggtgtgcttgggcgactggtagccgagaagtggctaaaggaacacccaggatgcaaagtttatggccagaccgcaagcacagaccatcacagcgagctaaccaatattggcatcattccctccttgaagggatccactatctctcaaaaggctccatatgttattttctgcgctcctccatcccgttctgatgattaccccggcgatttgagagtggctgcctcaaattggaacggagaaggttctttcctgtttacgtcgagtactgctctttatgactgtagtgacaacagattgtgcaatgaggattgtccatctattccagtgggcaggggtcctcgtactgatgttcttcttagagcagaaaatgttgtcctggaggcaggaggctgtgttctcaggctagcaggactttataaaatagataggggtgctcattatttctggttgaggaagggaacactggactcgcgaccagatcatattatcaatcagatccattatgaggatgcggcatcccttgcaattgccataatgaaaaagagacctcgggctcgtatatttttgggctgtgacaataagcctctttccaggcaagaaataatggacgctgttaacaaaagtgggaagttcgacacggaattccaaggtttcactggtaccggcggtccgttggggaagaggatggagaattccaaaacccgggccgatatcgggtgggagccccaatacccaagcttcacagagttcctcggcgtcgacagttagtacccggtcgcatatgttgagcaaattttctttgttaccctgagtgagtagcagcatcaaggggattgtagggatgtgttgtcataccactggttttgtttgccccagcacagcagtagtagatgctttgcagacactgcacaatagtgttgcaacggtgtatatttgttctgctatttgttctggtcaccttctgttcggttttctcaccacgtacgtagttctgaacatagcccgaatgaatttcaccgaaaatatactgtctgtttcggtttgaaaaaaaaaaaaaaaa

SEQ ID NO: 3636 - protein, 335 aa, Triticum aestivum
  misc_feature: GI Number: 34914690; NR Description: P0560B06.4 [Oryza sativa (japonica cultivar-group)] >gi|15528677|dbj|BAB64743.1| P0560B06.4
MDVAVAAALVPTRTPTLRLPSSRPSSVRPLTPTAGRPARILSLARRAPVAAAALGVSQDTGFAMPGADIVTQNDLLIIGPGVLGRLVAEKWLKEHPGCKVYGQTASTDHHSELTNIGIIPSLKGSTISQKAPYVIFCAPPSRSDDYPGDLRVAASNWNGEGSFLFTSSTALYDCSDNRLCNEDCPSIPVGRGPRTDVLLRAENVVLEAGGCVLRLAGLYKIDRGAHYFWLRKGTLDSRPDHIINQIHYEDAASLAIAIMKKRPRARIFLGCDNKPLSRQEIMDAVNKSGKFDTEFQGFTGTGGPLGKRMENSKTRADIGWEPQYPSFTEFLGVDS

SEQ ID NO: 3637 - DNA, 1386 bp, Triticum aestivum
  misc_feature (1)..(1386): Ceres cDNA ID no. 21665827
  misc_feature (1)..(1386): Ceres CLONE  ID no. 756794
  misc_feature (1)..(1386): Also known as  Ceres CDNA ID no. 0
caaggaaagcgattcttctgacaagcctcatccccgtttcgttgctctcttcacagctgctcgagagaatcacccccaagtgttcgatcttctccagaaatggcgactagcgctggcggaggtcagccgagcgttctgagcacattaccgaagaatctgccgttagactttctgaaaaccatcaccgaccagttctcagaggcgcgtaaaatcggtacaggcgcatttggaaccgtttatatgggacatatgccggatggccaaataattaccgtgaagaaactcgcggacaatttgccaatcgcgcgcgacaaagcatttgctaacgaggttcagaatattatggctctccaccatgaaaatgtactgaagttggtcggctactgccatgaaggtcaaaagaaagtggtgctgaacaacggaagatatattgtggctgacattgttgagagtttactttgccatgagtacttaccactgggaagccttcagaaacatctttttgaagtacatacaaaaatggactggaacatacgcttcaacataattaaggggatttgcaatggtttgcactttgtacacagcattcctattgtccatatggatctcaagccggaaaacatactgttggatgataacatggtgccgaaaatcgccgatttcggtctctccagactctttggtcaagaacaaacacggatgaacacacagaatgttgttgggtcatatggatacatagctccggaatatctatacaaaggtgaaatctccacgaagtcagacatatacagtttaggcctactaatcatggagactaccacgggagagaagaattgtccaggcaaagaaccgtcggcagtgcagttcataaaaaatgtacgtgaaaattggaaagagcagcgcatcgcatccgagtacccattgttagatgcggatggcctccaacaagtaaaaaaatgcatcgaaataggactggaatgtgttgagattgatcggctgaagagaccatccatagaaacaattctcgacaagctaaacggacgatgtgcatccatcagaaactaaaatgtcatgccaggtctccaatctccatccagcatgaaatttgggttttgatcagcagacatgtgcaagatggaatggacgctctctattactgctataatgaattattttaaaacagtatgctatgatatgtacgtcactgtgaagcctattaaattgtatttctccttgtaactgctacgtactccacatatctctttgggtttagttcagacaaatttatgtgatggaatgtagcaagggaaagcaaaaactttgtgtcttgatgtgttgatagaaaaataaagtctagcccgagaagggccaaaaaaaaaaaaaaaa

SEQ ID NO: 3638 - protein, 321 aa, Triticum aestivum
MATSAGGGQPSVLSTLPKNLPLDFLKTITDQFSEARKIGTGAFGTVYMGHMPDGQIITVKKLADNLPIARDKAFANEVQNIMALHHENVLKLVGYCHEGQKKVVLNNGRYIVADIVESLLCHEYLPLGSLQKHLFEVHTKMDWNIRFNIIKGICNGLHFVHSIPIVHMDLKPENILLDDNMVPKIADFGLSRLFGQEQTRMNTQNVVGSYGYIAPEYLYKGEISTKSDIYSLGLLIMETTTGEKNCPGKEPSAVQFIKNVRENWKEQRIASEYPLLDADGLQQVKKCIEIGLECVEIDRLKRPSIETILDKLNGRCASIRN

SEQ ID NO: 3639 - DNA, 1840 bp, Triticum aestivum
  misc_feature (1)..(1840): Ceres cDNA ID no. 21665828
  misc_feature (1)..(1840): Ceres CLONE  ID no. 756951
  misc_feature (1)..(1840): Also known as  Ceres CDNA ID no. 0
atccccttccttccttgcctccaccgctccctccctggagcaaggaagcaggcgggcaggcaccggctgccgtccacgcccacaattccgccgcccccaacttctccggccacgcaggaccaacgagggcagcaggggaaggaaggacaagtagataacagacaccagctccccctcctcctactcattggcagaatctgattgattgattgctgagaggcaccaaaagggatatggcatccttccaccggcccctctccgccatggcggtggccgccttcgccgccgtctcctccatcgagctgcccgacaaattctcccaccaccacaggctccccgaagacgtactctcgctccctgccaacaaaccagaggccaccacagctccttcagccccgccgctgtccggtctgcagttcttcccacggaacctccaggccttctacccggctaaggcgcccgttgcgtccctgccggtcatccagaccgtctaccagtacgccaagttcgccaagacctcaccggaacaagaggcggcgttaccggccatcccttcctcctcctcggatgttctgtaccgctggcacctgccggacccgagggcgtgcggcggctcgcctgacaggtcccagacggtggtggttttgctcggctggctgggctcgaagcagaagcatctgaagagatatgccgattggtacacctccagggggttccacgccgtcaccttcaccctccccatgtccgacattgtcagctacaatgtcggagggaaggctgagaagaatgtggagatgctctcggaacatcttggtgattgggtcagggaggaggatgggaagaagattgttttccacactttcagtaacactggctggctttgctatggtgtgatactggagaacctgcagcggcaggatccttcagcagtggagaaaatcaagggttccataatcgattcagcgcctgttgctgtcccggactctcaagtgtgggctctaggtttctcagctgctatcatgaagaaacacagtgtggcgacgaaaggagctgcaccaaatacaaggtctgacgtcgtagttgtggagtctcagaaagatatcagaccagcagctaccgaggcggttctactatctgcattggagaagttttttgatcttgttctgaactatccggccgtaaataggaggctgtctggtgttatggagcttctgtcctcaaaccaaccaaactgccctcagctgtacatatacagctctgccgaccgggtcatcccggcaaagtcagtggagtcatttgtggagaggcaacgaaaagcagggtgtgaggtgaggtcgtgtgactttgtgtcgtcccctcacgttgaccattaccgcagcaatccggggctctacacctctcagctgaccaacttcttggaggactgtgtgctggcccgccgtgatgatttgtcgtcaccgtcaccgtctgcatagggtgtttctgcatgaataccaccatattttttcctggtgatccattgaaatgtaccaggattatacatcggctaattatacatctgacccaatttactcgttccttgttggttcgcttgtgggtttatgttaggaggcacaactgtaaaaaaacgtgagaagaaaagcaaaacaaaattgtggttggcttgctgttggttccagtgcacagacggtttatttgtgtggatgggagatgtgctggtttctttgtgcatactctgacgactggttactgtctctctgtgtggggttcgggctgtgatcatgcaaatttcttgtggctactgaacaaagctatgttcacatggcaaaaaaaaaaaaaa

SEQ ID NO: 3640 - protein, 413 aa, Triticum aestivum
MASFHRPLSAMAVAAFAAVSSIELPDKFSHHHRLPEDVLSLPANKPEATTAPSAPPLSGLQFFPRNLQAFYPAKAPVASLPVIQTVYQYAKFAKTSPEQEAALPAIPSSSSDVLYRWHLPDPRACGGSPDRSQTVVVLLGWLGSKQKHLKRYADWYTSRGFHAVTFTLPMSDIVSYNVGGKAEKNVEMLSEHLGDWVREEDGKKIVFHTFSNTGWLCYGVILENLQRQDPSAVEKIKGSIIDSAPVAVPDSQVWALGFSAAIMKKHSVATKGAAPNTRSDVVVVESQKDIRPAATEAVLLSALEKFFDLVLNYPAVNRRLSGVMELLSSNQPNCPQLYIYSSADRVIPAKSVESFVERQRKAGCEVRSCDFVSSPHVDHYRSNPGLYTSQLTNFLEDCVLARRDDLSSPSPSA

SEQ ID NO: 3641 - DNA, 1529 bp, Triticum aestivum
  misc_feature (1)..(1529): Ceres cDNA ID no. 21665829
  misc_feature (1)..(1529): Ceres CLONE  ID no. 757452
  misc_feature (1)..(1529): Also known as  Ceres CDNA ID no. 23414320
aacaggagtcaacccccatttcctttccgtccccctctacgcgccgcgccgccatggatcccgccgccgacgacggccgctcaccttcacccgtcccggacccagacgacggcgaaggcggcagcgggtgggggagcgacaagccgccgcccacgcgcgcggaggaggggcgcgtcgtcgggaaggccgccatggaaccctcgccgtcgccgccggactccaccgtctccgaccaagacgacgacgacctgacgcgcgccgtgtccctgctgtcgctcgcggaggccgggaaggccgggtccgccccccgcgccgtggatccgtcgccgccgtcctccgccgtctcctcccacggtcacaaagatgatgatgatctcgccggcgtgaacaagcggacgcacgcgaggttcctcgtcacccacgcccaggccgggctcatcatcgggatgggtggctccactgtcgccgctgtcgaggcccgctccggcgcccgggtcaagctctcccgccacgaccagctcctccccggcaccgaccgcagggtcgtgctcgtccatggcctcctcagccaggtcatggacgccatggagctactgctccaaaggctcttgctctaccaggttcagggtgaccaggcggtcgactctgagcccacgctagtgctcgtcgtgcctcagccctgctgcggcgtgctcatcggcaaaggaggatctgttatcaagtcattcactgaagcttcggaaactgcaattcagatctcaccacacaacatctcctatggcttcaacgacaggctggtcaccatcacagggcccttggataatctattgcgagcagtgtttctgataatatttgagctgttagaggacattcgttatttgtttccatgtgcagctgctacgccaaacattccaatgagatcacctgttaataaggatgcccaagaatctgtcactattgctgttgctgatgagcatatgggttctgttattggtcgtggtggaaggattgtcaatgagatcagcaaggttagtggagcatggattgacatctcaggcaagggggagttcatgcccgggactcgcgacagggaggtgattatgaggggaacatcagaggcgatccgcgcagccgaggcgatgatcatgcaccgtgtctccgtggccagcggcaacttgatggggcggagggtggagggaacaagcgtcaagggtctgcttaccaggctggacgaggaggaggaggatgatgatgcagtcgtgcagatgcatcggctgaagttgagtgatcggacagagtagatagtcacggacggacagcacaggaaggaatcgaaccatttttagagttttgcgtctctctctggtagagatagataatcaaatcaatcgctagtaaaaaggattagtcaggtaaatggatgatgggatcactgatgatgattcaccaattttcctgttagcattgggattttgcatgttttgcctggtcaatgatactagaatattatctcaaaaaaaaaaaaaaaa

SEQ ID NO: 3642 - protein, 415 aa, Triticum aestivum
  misc_feature: PFam Name: KH_1; PFam Description: KH domain
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: Pkinase; PFam Description: Protein kinase domain
  misc_feature: GI Number: 50915982; NR Description: KH domain-containing protein NOVA-like [Oryza sativa (japonica cultivar-group)] >gi|48716278|dbj|BAD22893.1| KH domain-containing protein NOVA-like [Oryza sativa (japonica cultivar-group)] [Oryza sativa
  misc_feature: GI Number: 23507775; NR Description: At5g04430/T32M21_30 [Arabidopsis thaliana] >gi|21554568|gb|AAM63617.1| putative RNA-binding protein [Arabidopsis thaliana] >gi|7406447|emb|CAB85549.1| putative RNA-binding protein
  misc_feature: GI Number: 30680512; NR Description: KH domain-containing
  misc_feature: GI Number: 34855285; NR Description: similar to astrocytic
  misc_feature: GI Number: 30230625; NR Description: neuro-oncological ventral antigen 1-like protein [Rattus norvegicus] >gi|33516919|sp|Q80WA4|NOA1_RAT RNA-binding protein Nova-1
MDPAADDGRSPSPVPDPDDGEGGSGWGSDKPPPTRAEEGRVVGKAAMEPSPSPPDSTVSDQDDDDLTRAVSLLSLAEAGKAGSAPRAVDPSPPSSAVSSHGHKDDDDLAGVNKRTHARFLVTHAQAGLIIGMGGSTVAAVEARSGARVKLSRHDQLLPGTDRRVVLVHGLLSQVMDAMELLLQRLLLYQVQGDQAVDSEPTLVLVVPQPCCGVLIGKGGSVIKSFTEASETAIQISPHNISYGFNDRLVTITGPLDNLLRAVFLIIFELLEDIRYLFPCAAATPNIPMRSPVNKDAQESVTIAVADEHMGSVIGRGGRIVNEISKVSGAWIDISGKGEFMPGTRDREVIMRGTSEAIRAAEAMIMHRVSVASGNLMGRRVEGTSVKGLLTRLDEEEEDDDAVVQMHRLKLSDRTE

SEQ ID NO: 3643 - DNA, 1758 bp, Triticum aestivum
  misc_feature (1)..(1758): Ceres cDNA ID no. 21665830
  misc_feature (1)..(1758): Ceres CLONE  ID no. 758187
  misc_feature (1)..(1758): Also known as  Ceres CDNA ID no. 24356792
ctttagccgcaccagaattgaaggaaacacacacgcacaagcaggggcgtagctacgtacagctacccggtgtcactggcaccgggtccaatctacacttgcttaagataatccattgatttagtgtgtaggttattgattttttgatgtgttcttctatgtggacaccgggtaatcttcagtctgggttcgcccctgcgcacaaggccggccggcagctgcacaaagcaaggagaagacaagagcttgccaaaccctagctagcacaaggctcactttctcctgataacatcaccacccacccacccccacaccatgatcttccccccttcattcctggattcctcgagctggaatgataaccagttggattttgagcagcatgctcaccaccagcaggtcgcggccgcaagttgtggtggtggcgccggcgacggcggctgcaacaaccatgagctcctgcagccatcaatcatgcagcaggggacgcttgctgaaggtggggacggaggcggcggcggcgggcaggtggtggggccggcgaagcccatgtccatgtcggagcgtgcgcggctggctcgggtgccgctgccggagcaggggctcaagtgcccgcgctgcgactccgccaacaccaagttctgctacttcaacaactactccctctcgcagccgcgccacttctgccgtgcctgccgccgctactggacccgcggcggagcgctccgcaacgtccccgtcggcggcggctaccgccgccacgccaagcgcgccaaacccaagcaggcggccgcggccgcggcagcgggggcaccggcggccagtggcgccgcttcgggtgggtcgaccacgtcatcgacgacttccgcttgcacgaccatgtccaacccggctcccgtgctcccggcgatgctgcagaacggcggtggtggcaacctgtccggcctcctgccaccgctgctccgcctcgccgactttgatgccatgagcctcggctccaccttctccggcatggggaagccgtccccggtcgactcgccagcgggctactacctgggaggcggcggcggcggtgccgtgcccgggctggagcagtggagagtgcagcagatgcaaggcttcccgttcttccaagcaatggccgaccagcagcacacactggccccagctgcagcgcctgcaatggccatgccggggatgttccactacctaggcttgggcaacggtggtgatggccgcggcgtccatgaagacgacggaggagaccaacagtttcatcacgcgatgccgtcaaagagagaatgctacccgagatcaggcagcatcgccatgtacggtggtgatcaccacctcactgctggtgctggctacacaagctcctactccaatgctgccacaggtaaccatctcttgtgatgaatgagctaagctaatggcgagctcagattaatcctacaactagcggtagcatggacttggagggtgttgtgagatatagaaaaagctttgcatttgttgtgcattgtgttgatggaagaactagacaaggtcgatcatggagatggataaggatgcatggtgttgtgtgcttgcttaatgatcatggacaactattattgttaattagctagttcagctagcatgatcacttgcggtgtttcttctacttcttcttattttagggctctttttttcgcattcagggtgaagttaattgtgtgtgtattgtaccacttttgtacaaaaaaaaaaaaaaaa

SEQ ID NO: 3644 - protein, 366 aa, Triticum aestivum
  misc_feature: PFam Name: zf-Dof; PFam Description: Dof domain, zinc finger
  misc_feature: PFam Name: GATA-N; PFam Description: GATA-type transcription
  misc_feature: GI Number: 52353646; NR Description: putative dof-type zinc finger domain-containing protein [Oryza sativa (japonica
  misc_feature: GI Number: 21538785; NR Description: dof zinc finger protein
  misc_feature: GI Number: 1061308; NR Description: Dof3 gene [Zea mays]
  misc_feature: GI Number: 7688355; NR Description: Dof zinc finger protein
  misc_feature: GI Number: 3236241; NR Description: putative DOF zinc finger protein [Arabidopsis thaliana] >gi|7485442|pir||T02525 probable DOF zinc finger protein [imported] - Arabidopsis thaliana
MIFPPSFLDSSSWNDNQLDFEQHAHHQQVAAASCGGGAGDGGCNNHELLQPSIMQQGTLAEGGDGGGGGGQVVGPAKPMSMSERARLARVPLPEQGLKCPRCDSANTKFCYFNNYSLSQPRHFCRACRRYWTRGGALRNVPVGGGYRRHAKRAKPKQAAAAAAAGAPAASGAASGGSTTSSTTSACTTMSNPAPVLPAMLQNGGGGNLSGLLPPLLRLADFDAMSLGSTFSGMGKPSPVDSPAGYYLGGGGGGAVPGLEQWRVQQMQGFPFFQAMADQQHTLAPAAAPAMAMPGMFHYLGLGNGGDGRGVHEDDGGDQQFHHAMPSKRECYPRSGSIAMYGGDHHLTAGAGYTSSYSNAATGNHLL

SEQ ID NO: 3645 - DNA, 1447 bp, Triticum aestivum
  misc_feature (1)..(1447): Ceres cDNA ID no. 21665832
  misc_feature (1)..(1447): Ceres CLONE  ID no. 758875
  misc_feature (1)..(1447): Also known as  Ceres CDNA ID no. 23561053
ccatgctctcacagttcttcctaagtattagttccatcaaatatgaccatgataaaatgccccaaatcaaccgtgccgtggctcatgtaactgatagcatcttgggcacgaggaacccggaaatcaccatccgcaatctcaaaatcagattcattttgatggatcgtgactctctcaccattggaagatctgtcgcccacgccatgtcaacccagaaggttgaagcagctgagtttgagattataacggagaaggcttataggaactgcactcctgccgatctccgccagaatgctaagctgttcaataattttgttggtgcttgtccggatgcatttgctggcctcaggcgcctgtggctgcgtaatatgaggttcggtgaacaggacatcccaaacatcctcagcacttgcaagctcttggagtctttgcgtttaatccattgcgactcagggatccattctgtgctgcaagtagaacatgctcaacttattgagctcgaggttgaccttgggaaatttgagagagttgagttgatatgtctacccaaactccaacgggtgagctataataattggtgctcttctgaacatcctgtgtattttggtcttgtaccacagctttcaagactgagcctcactaaagttggcgtcagttctgataagattcttgagttaagtcagcttcttgctaatgttcattccataagtgatctgcatatggattttcaaagtgaaaagatttgggttgtaccagaatgcccgaaaatgctcaagcctgtgctcagcaaactacagcatgtgaatctggacaaccttcctgaaggatgtgatttagcttggacaatgtttattattgaagctgcaccctccctaaaagagctgtgcattacagtatgggatcattggtgcataatgatgacaaacaaagagttccggaagaaatatggttactgcgaaaaggcagacgtgaagtggaagccatatgctcctgatttcaagcacaagaatctggctaagctcaccatctacggcttccaacccaacgacaattttaagcgatacatcaggtgtgttgtggaacatgcggttaatataacagagatatctctgtacgacaggaagctgtgtgggcgctgtggtgacaaggtttatcaatcaagatatccacggactgccgaggagaggaaacgaacggctgaagggttgggtttgacttcacctgctgtgattcacttccggtcctaactgaaaaatgatttgcatgatattcttatatgtagtttggaaatcacctcctatcatctttagtcggaaggagttcctgaactccataattctgtagttaccaagtctgtactcttgctttcccttcaatgaagtttgtactgttacctaattgaggaaatatgtattaagtttgaaaaaaaaaaaaaaaaaaaaaaaaa

SEQ ID NO: 3646 - protein, 1447 aa, Triticum aestivum
CCATGCTCTCACAGTTCTTCCTAAGTATTAGTTCCATCAAATATGACCATGATAAAATGCCCCAAATCAACCGTGCCGTGGCTCATGTAACTGATAGCATCTTGGGCACGAGGAACCCGGAAATCACCATCCGCAATCTCAAAATCAGATTCATTTTGATGGATCGTGACTCTCTCACCATTGGAAGATCTGTCGCCCACGCCATGTCAACCCAGAAGGTTGAAGCAGCTGAGTTTGAGATTATAACGGAGAAGGCTTATAGGAACTGCACTCCTGCCGATCTCCGCCAGAATGCTAAGCTGTTCAATAATTTTGTTGGTGCTTGTCCGGATGCATTTGCTGGCCTCAGGCGCCTGTGGCTGCGTAATATGAGGTTCGGTGAACAGGACATCCCAAACATCCTCAGCACTTGCAAGCTCTTGGAGTCTTTGCGTTTAATCCATTGCGACTCAGGGATCCATTCTGTGCTGCAAGTAGAACATGCTCAACTTATTGAGCTCGAGGTTGACCTTGGGAAATTTGAGAGAGTTGAGTTGATATGTCTACCCAAACTCCAACGGGTGAGCTATAATAATTGGTGCTCTTCTGAACATCCTGTGTATTTTGGTCTTGTACCACAGCTTTCAAGACTGAGCCTCACTAAAGTTGGCGTCAGTTCTGATAAGATTCTTGAGTTAAGTCAGCTTCTTGCTAATGTTCATTCCATAAGTGATCTGCATATGGATTTTCAAAGTGAAAAGATTTGGGTTGTACCAGAATGCCCGAAAATGCTCAAGCCTGTGCTCAGCAAACTACAGCATGTGAATCTGGACAACCTTCCTGAAGGATGTGATTTAGCTTGGACAATGTTTATTATTGAAGCTGCACCCTCCCTAAAAGAGCTGTGCATTACAGTATGGGATCATTGGTGCATAATGATGACAAACAAAGAGTTCCGGAAGAAATATGGTTACTGCGAAAAGGCAGACGTGAAGTGGAAGCCATATGCTCCTGATTTCAAGCACAAGAATCTGGCTAAGCTCACCATCTACGGCTTCCAACCCAACGACAATTTTAAGCGATACATCAGGTGTGTTGTGGAACATGCGGTTAATATAACAGAGATATCTCTGTACGACAGGAAGCTGTGTGGGCGCTGTGGTGACAAGGTTTATCAATCAAGATATCCACGGACTGCCGAGGAGAGGAAACGAACGGCTGAAGGGTTGGGTTTGACTTCACCTGCTGTGATTCACTTCCGGTCCTAACTGAAAAATGATTTGCATGATATTCTTATATGTAGTTTGGAAATCACCTCCTATCATCTTTAGTCGGAAGGAGTTCCTGAACTCCATAATTCTGTAGTTACCAAGTCTGTACTCTTGCTTTCCCTTCAATGAAGTTTGTACTGTTACCTAATTGAGGAAATATGTATTAAGTTTGAAAAAAAAAAAAAAAAAAAAAAAAA

SEQ ID NO: 3647 - DNA, 1542 bp, Triticum aestivum
  misc_feature (1)..(1542): Ceres cDNA ID no. 21665833
  misc_feature (1)..(1542): Ceres CLONE  ID no. 759190
  misc_feature (1)..(1542): Also known as  Ceres CDNA ID no. 24356641
acccttcgctgtcgcctcccgccttccttccacctgcgccgcggcgccgccatggagcccacccacgcacgagcccacgcaagctccatccatctccacgcacatatataaccagctccacttagctaagctcaggccagacacacgaactactactccacatcagttcaccgccggcaaaagcagcgaaacagagtccacgtccccatgatgtgcagctccgatcatttcgccagtaataatcacttgtaccttcagcacaatcaccagaggttaccggggactggggtcgtggaggcctgcgatctcgagaggatccggcacgagcagagccggcatggccaggaggcggaggagcaccggtcggacccgagcgcggcgctgacgacgtacctgaccttcctggagcacaaggtcgggcagctccgcgggatcctctgctccgcgccgcgccacccgcagcagcagcgcgccatcgtctccgccgagctccgctgcatcatcgtgcagctctcctccatcgccaacgacctcgcatccgactccggcgccggggcggcggacgtggccccgtacgagcccagcgaggagaggtcgccgtcgctctcggacgccacgcacgacgactccgacgaccacgccggggctgacgacggcggggaggaggagggggaggggccgtacgaggtggtgcagatcgagaaggaggcgatcctggcgccgcacgcgcactgctgcaaggtgtgcggcaaggggttcaagcgcgacgccaacctgcgcatgcacatgcgaggccacggcgaccagtacaaggcgcccggcgcgctcgccaggcccggctcgccggcgccgggggcggggacggagaggcgcttcttctactcgtgcccctacgccgggtgcaagcgcaacagggagcaccgggacttccagccgctcaagacccccgtctgcgtcaagaaccactaccgccggagccactgcgacaagagccacgtctgctgccgctgcggcgtcaagcgcttctccgtgctcgccgacctccgcacccacgagaagcactgcggccgcgaccgctgggtctgctcctgcggcgtctccttctccaggaaggacaagctcttcgcccacgttgccatcttcgacggcggccacacgcccgctctgccgcccagcgacgacgaagccaccggccactgcaccgccgccactgccactgccactgccattaacagtgtccttgtgcccggctccggtgggttgctcccgaccggtggcgaggaagcagtgaacctgatggaacagagcttctccggtcaaatgctcgacggtctcaactgctccggcgccaaagtgggcattgacgacgtcagagcaaagctctcctccccagtcggcattgacttctgtgacttcgatggcttcgacctcttgggagcagttgcaatggacttcaatttctgatactctctcatcctgatgaaaaactagatctttttttttctttggataaggaggttaatgttaaaaaaaaaaaaaaaa

SEQ ID NO: 3648 - protein, 418 aa, Triticum aestivum
  misc_feature: PFam Name: zf-C2H2; PFam Description: Zinc finger, C2H2 type
  misc_feature: GI Number: 50920001; NR Description: putative zinc finger protein [Oryza sativa (japonica cultivar-group)] >gi|28376689|gb|AAO41119.1| putative zinc finger protein [Oryza
  misc_feature: GI Number: 34908682; NR Description: putative zinc finger protein [Oryza sativa (japonica cultivar-group)] >gi|15408708|dbj|BAB64114.1| putative zinc finger protein [Oryza sativa (japonica cultivar-group)] >gi|19571114|dbj|BAB86538.1|
  misc_feature: GI Number: 21593564; NR Description: zinc finger protein,
  misc_feature: GI Number: 50948539; NR Description: putative transparent testa 1 [Oryza sativa (japonica cultivar-group)] >gi|42408431|dbj|BAD09613.1| putative transparent testa 1 [Oryza sativa (japonica cultivar-group)] >gi|45736182|dbj|BAD13228.1|
  misc_feature: GI Number: 10241636; NR Description: putative zinc finger
MMCSSDHFASNNHLYLQHNHQRLPGTGVVEACDLERIRHEQSRHGQEAEEHRSDPSAALTTYLTFLEHKVGQLRGILCSAPRHPQQQRAIVSAELRCIIVQLSSIANDLASDSGAGAADVAPYEPSEERSPSLSDATHDDSDDHAGADDGGEEEGEGPYEVVQIEKEAILAPHAHCCKVCGKGFKRDANLRMHMRGHGDQYKAPGALARPGSPAPGAGTERRFFYSCPYAGCKRNREHRDFQPLKTPVCVKNHYRRSHCDKSHVCCRCGVKRFSVLADLRTHEKHCGRDRWVCSCGVSFSRKDKLFAHVAIFDGGHTPALPPSDDEATGHCTAATATATAINSVLVPGSGGLLPTGGEEAVNLMEQSFSGQMLDGLNCSGAKVGIDDVRAKLSSPVGIDFCDFDGFDLLGAVAMDFNF

SEQ ID NO: 3649 - DNA, 1755 bp, Triticum aestivum
  misc_feature (1)..(1755): Ceres cDNA ID no. 21665835
  misc_feature (1)..(1755): Ceres CLONE  ID no. 760412
  misc_feature (1)..(1755): Also known as  Ceres CDNA ID no. 24356621
attttcaaatctcgtccccccttcagctccgcctcctcttctcccccctgccgcactctttccatttccgacaatccctccccgggatcccgccgcaccaatccccaaaccctcgaccgcggcggcggcggcgacccagcgcgctcgcgccaggattctctcggccacgccatgggctgcttcctctcctgcttccgcggccgccccgacccggccgtccgggccctccacgatccgctcgtgcgcaagacccggctcggggatgccttcctggacgaccaccacgacgacggcacggcgaagcttgaggagagcgggacgcccaaggagggtcccggtaacgacggaggggtcgacgacgacctcaggcgagaggcaaattatcttaaatcttgtggcgcaatatcagaaacccctcccgaaattctgaaagcatcaaaccaagtcgaagagcaagaaattaatgagtgcaatgagacgtccaacaatgcacaggagactaaagaggccctggtgtctgaaaataaggattacttgtctgaagggttcaactccgacgggcacgatggagctttgaagcatgaccaggacaccgacgaaggcactgacgaccatgtcacggaggttgaatcagcgccgagatcatcgtcgcaggaaaggtcttcagcccagatcatcaggaaccagaatcctgatcctagcgactcgcctttccccactcctctggtccttagagacgatatccagactcctggattcaccacacaccaggggaacttcaagcccgggaagcgcgggagggccagcaagcaatttgtataccccgtcctgagacccatcgagaacaagctgcagtggacggagctgagagacgagtcctcccccatggtcgcctctcaccctcccaaaagaaggtacctgtccgcagattccaccgagaagcctcagcagcacacccttccaggctcagtgaatgaaagcacagagctgtcatcagagtctgcgccatttctgttccattccggcaggaaagagcagcaggctcaagaggatgagaatgtcaaccagcagcagcttgtgggtggcggtggcgtcggagagctgctgaacaagagctcggagaacgggaagcatggcgtggccagcctgtcgtgctggctcaagacctcgtgcgcggatggtgagggtgagactggacggcagctgggcttcgggagcgtcgatctcagcgacgtgcccatctttgtggcctctggactgaactgggacaacgagaacaaccctaccccgatgctgcccaaggcctgggacggcaatgggatccccaacaccaccaccaagtacaaagaggaccagagagtgaactggcatgccacgccgttcgaggagaggctgatgaaagttttgtccgatgagaaaccacaccatcagaggaagatcagtggaaagctgatccacctggaggaggacgcgatagagagcccggcaagtgcgactgcttcctcgtgatcggcagtacgagagggtccagtgtttggccaatccggcccgagccacctctagctgcatcagtgtctgaagctctctgaaactgaactagtgctactacattcttgtccgctgaagcattttgcttgcgcctcagtgcaacttttgcacatcacctgctggttgatgtgatgctgggtatattcatcaataatgaaaataagagactctgcttcggtttactccttcccaaaaaaaaaaaaaaaa

SEQ ID NO: 3650 - protein, 445 aa, Triticum aestivum
  misc_feature: GI Number: 50905537; NR Description: dentin sialophosphoprotein precursor-like [Oryza sativa (japonica cultivar-group)] >gi|49387762|dbj|BAD26250.1| dentin sialophosphoprotein precursor-like [Oryza sativa (japonica
  misc_feature: GI Number: 52075844; NR Description: dentin sialophosphoprotein precursor-like [Oryza sativa (japonica
MGCFLSCFRGRPDPAVRALHDPLVRKTRLGDAFLDDHHDDGTAKLEESGTPKEGPGNDGGVDDDLRREANYLKSCGAISETPPEILKASNQVEEQEINECNETSNNAQETKEALVSENKDYLSEGFNSDGHDGALKHDQDTDEGTDDHVTEVESAPRSSSQERSSAQIIRNQNPDPSDSPFPTPLVLRDDIQTPGFTTHQGNFKPGKRGRASKQFVYPVLRPIENKLQWTELRDESSPMVASHPPKRRYLSADSTEKPQQHTLPGSVNESTELSSESAPFLFHSGRKEQQAQEDENVNQQQLVGGGGVGELLNKSSENGKHGVASLSCWLKTSCADGEGETGRQLGFGSVDLSDVPIFVASGLNWDNENNPTPMLPKAWDGNGIPNTTTKYKEDQRVNWHATPFEERLMKVLSDEKPHHQRKISGKLIHLEEDAIESPASATASS

SEQ ID NO: 3651 - DNA, 1376 bp, Triticum aestivum
  misc_feature (1)..(1376): Ceres cDNA ID no. 21665836
  misc_feature (1)..(1376): Ceres CLONE  ID no. 760496
  misc_feature (1)..(1376): Also known as  Ceres CDNA ID no. 24357709
atgactcccccctccatccctgtcgcggccgctgctgccgaacagcacacggcccgtgcaccccccgcgcccactgtccggtaggccccacgcgcgggcgatctcgcggagccgtccgcggcgagatggacggccgggggcgcgtcacgcggggtcacaaaacacgcggccccgaagcacgggaaaggaaaggggagagggatcgagattccagcggcgacggcaggcagaaaaggcgttgccgaacagaagcgtcgcgttgggcgggcgagcgagcgagccaagcatccatggcggagcgcaaggaggagtcggtgatggacaagatcacggagaagttccacggggggtcctcctcctcgtcgtcgtccgacgacgaggggaggtcggggtcctcgtcgtccgtcaaggccaagatctaccgcctcttcggccgcgagaagcccgtccactccgtcctcggcggcggcaagcctgccgacctcttcctgtggaggaacaagaagatctctggcggggtgctcgccggcgccaccgccatctggctgctgtttgaggtcctggagtaccacctcctcaccctcctctgccacggcttcatcctcaccctgggcatcctcttcctctggtccaacgcctctgccttcgtcaacaagtgccctcccaacattccagaggtgaagatccctgaggacctggctgtcaatgttgcccgctcgctgcgatacgagatcaacaggggctttgctagcctgagggcgattggtcaaggccgtgacctgaagaaattcttgattgtggttgcaggcctgtggatcctctcttttcttggcagctgctgcaatttcctgaccttgttctacatagtcttcatggtgctttacaccgtgcctgttctgtacgagaagtatgaggacaagatcgatgcttttggagagaaggccatggttgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtccgtagttgatagtagataccactatcttgtcaaaaacctctggcacggtcagtagtcgtgacgtgcaacttctacgaacttaaaaagtcatgccagcttttgctgaatatcctctttccaatgctatggttaacgtagcatcctcacttgcaagttgtgttggtgtaatatggcagtgatgtttgtgaccttagtagacttgctacaatgaatgaagtggctctttttggtgttatgtcaaaaaaaaaaaaaaaa

SEQ ID NO: 3652 - protein, 1376 aa, Triticum aestivum
  misc_feature: PFam Name: Reticulon; PFam Description: Reticulon
  misc_feature: GI Number: 34909318; NR Description: OSJNBb0021A09.5 [Oryza sativa (japonica cultivar-group)] >gi|20160502|dbj|BAB89453.1|
  misc_feature: GI Number: 34904202; NR Description: P0492F05.25 [Oryza sativa (japonica cultivar-group)] >gi|13027362|dbj|BAB32723.1| P0492F05.25 [Oryza sativa (japonica cultivar-group)] >gi|20804416|dbj|BAB92114.1| P0443E07.17 [Oryza sativa (japonica
  misc_feature: GI Number: 50251960; NR Description: putative 24 kDa seed
  misc_feature: GI Number: 52076447; NR Description: putative 24 kDa seed
  misc_feature: GI Number: 4102690; NR Description: 24 kDa seed maturation
ATGACTCCCCCCTCCATCCCTGTCGCGGCCGCTGCTGCCGAACAGCACACGGCCCGTGCACCCCCCGCGCCCACTGTCCGGTAGGCCCCACGCGCGGGCGATCTCGCGGAGCCGTCCGCGGCGAGATGGACGGCCGGGGGCGCGTCACGCGGGGTCACAAAACACGCGGCCCCGAAGCACGGGAAAGGAAAGGGGAGAGGGATCGAGATTCCAGCGGCGACGGCAGGCAGAAAAGGCGTTGCCGAACAGAAGCGTCGCGTTGGGCGGGCGAGCGAGCGAGCCAAGCATCCATGGCGGAGCGCAAGGAGGAGTCGGTGATGGACAAGATCACGGAGAAGTTCCACGGGGGGTCCTCCTCCTCGTCGTCGTCCGACGACGAGGGGAGGTCGGGGTCCTCGTCGTCCGTCAAGGCCAAGATCTACCGCCTCTTCGGCCGCGAGAAGCCCGTCCACTCCGTCCTCGGCGGCGGCAAGCCTGCCGACCTCTTCCTGTGGAGGAACAAGAAGATCTCTGGCGGGGTGCTCGCCGGCGCCACCGCCATCTGGCTGCTGTTTGAGGTCCTGGAGTACCACCTCCTCACCCTCCTCTGCCACGGCTTCATCCTCACCCTGGGCATCCTCTTCCTCTGGTCCAACGCCTCTGCCTTCGTCAACAAGTGCCCTCCCAACATTCCAGAGGTGAAGATCCCTGAGGACCTGGCTGTCAATGTTGCCCGCTCGCTGCGATACGAGATCAACAGGGGCTTTGCTAGCCTGAGGGCGATTGGTCAAGGCCGTGACCTGAAGAAATTCTTGATTGTGGTTGCAGGCCTGTGGATCCTCTCTTTTCTTGGCAGCTGCTGCAATTTCCTGACCTTGTTCTACATAGTCTTCATGGTGCTTTACACCGTGCCTGTTCTGTACGAGAAGTATGAGGACAAGATCGATGCTTTTGGAGAGAAGGCCATGGTTGAGCTGAAGAAGTACTACGCCATCTTCGATGAGAAGTGCCTGTCCAAGATTCCCAAGGGCCCGTCCAAGGATAAGAAGCAGCATTAGAACGGTAGAGAGTACCCTGCGCAGATTTATCTTCAAAGTTGATCACTACTCGTCGGTTTTCAAGGATGGTTGTGATTCCATGTCCGTAGTTGATAGTAGATACCACTATCTTGTCAAAAACCTCTGGCACGGTCAGTAGTCGTGACGTGCAACTTCTACGAACTTAAAAAGTCATGCCAGCTTTTGCTGAATATCCTCTTTCCAATGCTATGGTTAACGTAGCATCCTCACTTGCAAGTTGTGTTGGTGTAATATGGCAGTGATGTTTGTGACCTTAGTAGACTTGCTACAATGAATGAAGTGGCTCTTTTTGGTGTTATGTCAAAAAAAAAAAAAAAA

SEQ ID NO: 3653 - DNA, 936 bp, Triticum aestivum
  misc_feature (1)..(936): Ceres cDNA ID no. 21665837
  misc_feature (1)..(936): Ceres CLONE  ID no. 760900
  misc_feature (1)..(936): Also known as  Ceres CDNA ID no. 25088316
acataaccgccgcttccaacgcgatgccgccgccgagcatcacagtgaaccgcgccacggagtccccggtcacccacctccgtccgatggacacgggacgccggctggagacgttcacggcggcgccggttgccgggtcgatcagtatccagctcagcctcagatcgcctggcgtgatcggcgacggcgacgtgaagccctcctggacgagcgcgtccacgcggaacggtgaccccaggaaccacgccgacgaggcgtccgtctcgacgacgcgcgacatgatgcaaacgccgttgtggtgcaggtcaacggccgagacgagccgcgccgggagggagctcgacaccgcgggtgacgcggccgggaacgggaacgcgtcagcgtagagcgcccggtagccgccgtcgccgccgcagctgacgacttggcgtagcgacggccacatctggaggcagagcgcgcgccacgcgtcggggtcgttggcgagctcccggaatcccgcgctcgcgcacccagctgctgccagggacgcgccgtcgagacagcggagcacgatgcccaggacgtccacggggaggtcgtcgatgacggtctcaatgccgccgtcgtggtcgcacgccggcgaacaaccccccgtggtctcatcaacgcgagttcccgccatgatcgcagggttgatcgatcgcagaggttggcacgcagcaccgcacgcaggccgaaccgcggtgcaacttttgatggtcgcgctgcgatcgaccggcgaaagcgtgacgtttctcaaaatcttgtgtaggttgtgatgtctggctcctgcaagctcctgacgcttcttatcttcagataagatcccgtgtacgatgcttttgggggtttgattgggtttgaagctaataataacttggttatataaaaaaaaaaaaaaaaaaaaaaaaaaaa

SEQ ID NO: 3654 - protein, 120 aa, Triticum aestivum
  misc_feature: GI Number: 5821145; NR Description: RNA binding protein [Homo
  misc_feature: GI Number: 47124032; NR Description: SRRM2 protein [Homo sapiens]
  misc_feature: GI Number: 5821143; NR Description: RNA binding protein [Homo
  misc_feature: GI Number: 6649242; NR Description: splicing coactivator
  misc_feature: GI Number: 19923466; NR Description: splicing coactivator subunit SRm300 [Homo sapiens] >gi|5821153|dbj|BAA83718.1| RNA
MPPPSITVNRATESPVTHLRPMDTGRRLETFTAAPVAGSISIQLSLRSPGVIGDGDVKPSWTSASTRNGDPRNHADEASVSTTRDMMQTPLWCRSTAETSRAGRELDTAGDAAGNGNASA

SEQ ID NO: 3655 - DNA, 1700 bp, Triticum aestivum
  misc_feature (1)..(1700): Ceres cDNA ID no. 21665838
  misc_feature (1)..(1700): Ceres CLONE  ID no. 762162
  misc_feature (1)..(1700): Also known as  Ceres CDNA ID no. 0
aaaaaaggagttcagcattcacattcgccgtcgtgaagagtcgattttcctgagccgctgtcctccgagaagcgaggcgccgccggctgcatctccgtcgcccgtcgccgcctaaaccaagatccaccagatcttacctgtcccctgcctgggctctcccgcttccgatccatggagatggaggaggcggataaaggggaggtcttcgagaggaacaacaagtcgaggctggatagccatccgggggcggcggcggggacggcctgccggctcacggacgacctcatcctggagatcctctcccgcatcccggccagatccctccaccgcttcaagtgcgtctccgtgcgctggcgcgacctcatcgccgaccccgccaaccgcaagaagctgccccagaccctcgccggcttcctctacacgaccaccgccggccggaatcgccaccacttcgccagcgtctcccgcggcgcagccccgttcgacccttccctcccttacctgcagcctagcaagtacaaggacatggctcaggtggacgcctgcaatggcctccttctctacctaagctccagcaagaacatggtgaacccttgggctttggcagaggacgatttccgttttgttgtgtgcaatccggccactgggaggtgggtggagctgccccctcaaccgcaggcgccggcagacagatttagatataactgtatggcaagcctagcttttgatccggcagtctcgtcccatttccacgttttttgttttgaggagaccactgtggaaacgtacatgacaggagtgaacgtctacttgtcgcgaacaggagcctggagtcgcggagatggtgggattgttgagaaagtggcgctgttcttctatagtaagggtgtctttgtcggcggtatgatgtacgtgattggcaacccgaagggcatcagcaacgagcatgtgctcctggggattgacatgcaaggtaaagtgcggaggactatccctatgccgtacggtcgaagatttggtacgattggatcgtcgcaggggtgcttactctatgctgtatcttccgtcgatgataacaataaaatcctatattctgagatagaactctggtgcctcaaggattgtgacagtaaagaattggttctgaagcatactgccagcatcgatgagcttatgagcatgactggggagaagtacagggtggttgggattcatccagattgcgacaccattttcctagtttcacatggaggtgataccttggtagggtatgatatgcaacatcagaaagttggttgtatcattaatcttgagaagaatacacaacgatttctaccttatgttcctctgttctcagagtcattagcagatggagatgggtggtagtgttaccttcaaaccaggcttgtgcttcctccaagaattggctcttctgccggctgaagtacctgtttgtgtacctctgaatctgcttgaatcatgccgctcaatttgctggtgcttacactcctgcttggttgattttcggttcagagcaatgcctggtaaacctagcacaggttgttacccctgttcttgtttacctagcacaggttgttgttctggacatgtgttagttccatgtcgctaaattatactgtaatcgctcttcctttccataacaatcagttattatggttatccgaaaaaaaaaaaaaaaa

SEQ ID NO: 3656 - protein, 404 aa, Triticum aestivum
MEMEEADKGEVFERNNKSRLDSHPGAAAGTACRLTDDLILEILSRIPARSLHRFKCVSVRWRDLIADPANRKKLPQTLAGFLYTTTAGRNRHHFASVSRGAAPFDPSLPYLQPSKYKDMAQVDACNGLLLYLSSSKNMVNPWALAEDDFRFVVCNPATGRWVELPPQPQAPADRFRYNCMASLAFDPAVSSHFHVFCFEETTVETYMTGVNVYLSRTGAWSRGDGGIVEKVALFFYSKGVFVGGMMYVIGNPKGISNEHVLLGIDMQGKVRRTIPMPYGRRFGTIGSSQGCLLYAVSSVDDNNKILYSEIELWCLKDCDSKELVLKHTASIDELMSMTGEKYRVVGIHPDCDTIFLVSHGGDTLVGYDMQHQKVGCIINLEKNTQRFLPYVPLFSESLADGDGW

SEQ ID NO: 3657 - DNA, 1402 bp, Triticum aestivum
  misc_feature (1)..(1402): Ceres cDNA ID no. 21665839
  misc_feature (1)..(1402): Ceres CLONE  ID no. 763218
  misc_feature (1)..(1402): Also known as  Ceres CDNA ID no. 24356734
gaaacggacaagggtgggaggaaatctcctgccggacggaagagggtgtgaaagtgtgatggcctcaccgtacaatccccaccggcggcagctgggcggggggcagtccgcctggccggatctcccgccggagctcctggagagcgtcctagggcggctcgccccgctcgaccgtgtcgccgtccgcctcgtctgctcctcctggcgctcgtgcgcgcgagcttcgatctcggctgacctccccttcgaggccccgcgcctcctgctccggcgccccggctcctgcggcggcctcgccttcttcagcctccaccgccgcgagatcctgcctttcgccctccccgaccgcctcagctccggccggtgctgcggccagatcggcggctggctcgccatggccttcgacgaggagcgggcgatcgagctccgcaacctcttctccggccaatccgtgcccctgccgcggtcccccgtgttcccggtggccaagatcgtgctgtccgcgccgcccacctcgcttggctgggtggccgccgtgctgggccgcgccggcacggtggcgctgctccagccggacgtgtctggcggcgcctggatcacgatcgccgccggggggccgcacggcgggttccgggacgtggcgttgtggcgggggcggctgtgcgcgctgggcgacgacggcacggtcctggcgtaccgtgtcgacctccgcgcgcgcgtggcggccgtgtcggagctgcgcgggaaggacgccaaccctctgaaccggctggagcggcgggtgcggtacctgctggagtcggacggggagctcctgctggtgaagaagctgtacagcgtggtgcgggactcggcggacgtggaggtggaggtgagccggttccggccggaggggtgcaagtgggagtcggtgacggagctccccgggagggcggtgttcctggggtcggtggcgtcggcggcggcgccggcgacggcgggggtccgggagaactgcgtctacttcgcgcggcgggacgtggagctgatggtgccgcacgccatcggcgtgtactcgctgggggaccgggagacggcggtggtggccatcgcgggcgggcactccgtggaggtggagcccgtgtggatcctcccctcggtcgcctgatctgaccgactccacgcacccaccggcgttcaagaacaaataaaccgagcccatgagttttagaacgctttattcggatgttttggaactgtggattgctgtgcgtgttgttttctctgctttgttcatggggttaattggcgatttgggtttctactagagaggcaaagaccgatctgtctgaattgctgtgcatgttcttctctttgccttgttcagttcatcagaagttcaaaaagaaaaaaaaaaaaaaaa

SEQ ID NO: 3658 - protein, 362 aa, Triticum aestivum
  misc_feature: PFam Name: F-box; PFam Description: F-box domain
  misc_feature: PFam Name: Atrophin-1; PFam Description: Atrophin-1 family
  misc_feature: PFam Name: GRP; PFam Description: Glycine rich protein family
  misc_feature: PFam Name: FH2; PFam Description: Formin Homology 2 Domain
  misc_feature: GI Number: 66776103; NR Description: LigA [Anaeromyxobacter dehalogenans 2CP-C] >gi|66858140|ref|ZP_00402169.1| LigA
  misc_feature: GI Number: 46226797; NR Description: domain similar to KOG0260, KOG1984, KOG1999, repeats; identical to cryptosporidium
  misc_feature: GI Number: 66776896; NR Description: LigA [Anaeromyxobacter dehalogenans 2CP-C] >gi|66857361|ref|ZP_00401413.1| LigA
  misc_feature: GI Number: 32141270; NR Description: probable translational initiation factor [Streptomyces coelicolor A3(2)] >gi|39931282|sp|Q8CJQ8|IF2_STRCO Translation initiation factor IF-2 >gi|24413891|emb|CAD55362.1| probable translational
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MASPYNPHRRQLGGGQSAWPDLPPELLESVLGRLAPLDRVAVRLVCSSWRSCARASISADLPFEAPRLLLRRPGSCGGLAFFSLHRREILPFALPDRLSSGRCCGQIGGWLAMAFDEERAIELRNLFSGQSVPLPRSPVFPVAKIVLSAPPTSLGWVAAVLGRAGTVALLQPDVSGGAWITIAAGGPHGGFRDVALWRGRLCALGDDGTVLAYRVDLRARVAAVSELRGKDANPLNRLERRVRYLLESDGELLLVKKLYSVVRDSADVEVEVSRFRPEGCKWESVTELPGRAVFLGSVASAAAPATAGVRENCVYFARRDVELMVPHAIGVYSLGDRETAVVAIAGGHSVEVEPVWILPSVA

SEQ ID NO: 3659 - DNA, 2322 bp, Triticum aestivum
  misc_feature (1)..(2322): Ceres cDNA ID no. 21665841
  misc_feature (1)..(2322): Ceres CLONE  ID no. 766537
  misc_feature (1)..(2322): Also known as  Ceres CDNA ID no. 0
cccctccggagtcgccgccgtctcgctctgcccctccccctctcccgggaagtccttcctctcgtgcccggcgtctccagagtccggggacgagacggcgtgagtggcagcgagaaggccggctcctaccgcgcattccaccgggggctccgccggccggtgagcgccgtcgaggtttggttacttgtctgctgtaaacaaatgaaggtgctgctgatttagttcgcccattcgacgactcatcagatggatcatctcactcttatgagaagccctttccgtcttctgctctcactgcatttgttactatccttattcaaccccctggcagaagcagacttggcgtctgagagccaagcccttcttgacttcgcctctgcagtctaccgcggcaacaagcttaactggggtcaaggtacaccatcgtgttcatggcatggtgtcaaatgctcaggagaccagtcacacatatctgagctgaggttgccaggtgctgggctcatcggaacaatccctccaaaaactattggcaagctcgattctctccaagttctgagcctgcggtctaatcttttatctggaagccttccatctgatgtggcctcacttccttctttgcgttcgatataccttcagcacaataaactttcaggaggtctgccttcctttttcagtcctaaccttagtgtagtggagctctcctacaattccttcactggagagattcctacaagcttagaaaaccttactcagttatatctcctgaatttacaagaaaattctctttccggactcattcctgacctgaagcttccaagcctgagactgttaaacctgagcaacaatgagttgaaaggctcaattcctcgctcgctccaaacattcccagatagttcattcttggggaaccctgaattatgcgggccgccactagataattgctcatttccaacaccaacaccctccccagaattgccttcaacaccgtcatctccatcgcctgtgcatcatgacaggaaactgagcatagggttcataatcgcggttgctgtcgggggatttgcagtactgatgctaattgtggttgtgttgtgtgtgtgcctttcaaagaggaagggcaagaaagaggccggtgtcgactacaagggaactggtgtcaggagtgataagccgaagcaggaattcagtagcggtgtccagactgctgagaagaacaagttggttttcttggacggttgcacctacaactttgacttggaggatctactaagagcttctgcagaagtccttggcaaggggagctatgggactgcctacaaggctatactcgaggacggcactgttgtggttgtcaagagactaaaggatgtcgtggcagggaagagggagtttgagcagcagatggagcttgttgggaggttgggtaaacattcaaacctagtcccgcttcgtgcttactactattccaaggatgagaagcttgtcgtctacgattacattgccaccggcagcttttctggcatgttgcacggtatcagaggtgttgctgagaagacgccattagactggaataccagggtgaagatcatactaggaacagcatatggcatcgcacacatccattcagaaggcggcgcaaagctcacccacggcaacatcaagtcgaccaacgtcctcgtcggtcaggatcaaaatgcgtacgtctcagactacggcctcagctctctgatgaacgcgcctgtcagcgcgtcccgcgtcgtggtcggctaccgtgccccggagaccatcgagaaccggaagagcatgcagaagtcggacgtgtactgcttcggcgtcctcttcatggagatgctgacggggaaggcgccgctccagtcgcaagggaacgacgacgtggtggacctcccgaggtgggtgcactcggtggtccgggaggagtggacggcggaggtgttcgacatcgagctgatgaagcaccagaacattgaggaggagctggtccagatgctccaggtggcgatggcgtgcacggcggggccgccggagcggcgcccggcgatggaggaggtgatcaggatgatcgaggggctccggcactccgcctcggagagccgcgcctcctccgacgagaggttcagggagtccaaccccccgtcggtctaggccgttgttcccttgccggcttcctgtcaggagatcattggattcatttagctaatttgtaatttgaggatgcatgccagcatggctgacatcaggtgccacctcactggattgaacaatttgcatcgagactgtatcttgacaaaaaaaaaaaaaaaa

SEQ ID NO: 3660 - protein, 638 aa, Triticum aestivum
MDHLTLMRSPFRLLLSLHLLLSLFNPLAEADLASESQALLDFASAVYRGNKLNWGQGTPSCSWHGVKCSGDQSHISELRLPGAGLIGTIPPKTIGKLDSLQVLSLRSNLLSGSLPSDVASLPSLRSIYLQHNKLSGGLPSFFSPNLSVVELSYNSFTGEIPTSLENLTQLYLLNLQENSLSGLIPDLKLPSLRLLNLSNNELKGSIPRSLQTFPDSSFLGNPELCGPPLDNCSFPTPTPSPELPSTPSSPSPVHHDRKLSIGFIIAVAVGGFAVLMLIVVVLCVCLSKRKGKKEAGVDYKGTGVRSDKPKQEFSSGVQTAEKNKLVFLDGCTYNFDLEDLLRASAEVLGKGSYGTAYKAILEDGTVVVVKRLKDVVAGKREFEQQMELVGRLGKHSNLVPLRAYYYSKDEKLVVYDYIATGSFSGMLHGIRGVAEKTPLDWNTRVKIILGTAYGIAHIHSEGGAKLTHGNIKSTNVLVGQDQNAYVSDYGLSSLMNAPVSASRVVVGYRAPETIENRKSMQKSDVYCFGVLFMEMLTGKAPLQSQGNDDVVDLPRWVHSVVREEWTAEVFDIELMKHQNIEEELVQMLQVAMACTAGPPERRPAMEEVIRMIEGLRHSASESRASSDERFRESNPPSV

SEQ ID NO: 3661 - DNA, 562 bp, Glycine max
  misc_feature (1)..(562): Ceres cDNA ID no. 21665842
  misc_feature (1)..(562): Ceres CLONE  ID no. 768122
  misc_feature (1)..(562): Also known as  Ceres CDNA ID no. 24366484
aaaaaaacaaagcagggataggaagaaggaaaaatggaaaagtatttcggaaacgcttatcgtggcgacccgggagtgccccattcggacccggatcgcttcgtcaacatatgggtcggatccgctgccttcgctgttctcacatatttcaatccctacatgtggcagctctctaatcagttcaattggcatgacaaagcaatgctatatgagcaatatcactggaaacaggcaaggaagaagaatcagccatatgagttcatgtggaacaagacctgggacaagaaccaccgggaacattactactacaactggcctatttactttccttaggccacttctatttttcttgcatactttgtcctatctttattttggttgcaaacctggatcaattgatgccccctcccccctacccggatcacatgcttttctctgatcacttgaaaaacaaatacaaggattcaattgttgtgatgaaacgagtaactatgtgtttggaaatgatttggtgacacagttttaaatcaagtatttaaatttgtcaaaaaaaaaaaaaaaa

SEQ ID NO: 3662 - protein, 562 aa, Glycine max
AAAAAAACAAAGCAGGGATAGGAAGAAGGAAAAATGGAAAAGTATTTCGGAAACGCTTATCGTGGCGACCCGGGAGTGCCCCATTCGGACCCGGATCGCTTCGTCAACATATGGGTCGGATCCGCTGCCTTCGCTGTTCTCACATATTTCAATCCCTACATGTGGCAGCTCTCTAATCAGTTCAATTGGCATGACAAAGCAATGCTATATGAGCAATATCACTGGAAACAGGCAAGGAAGAAGAATCAGCCATATGAGTTCATGTGGAACAAGACCTGGGACAAGAACCACCGGGAACATTACTACTACAACTGGCCTATTTACTTTCCTTAGGCCACTTCTATTTTTCTTGCATACTTTGTCCTATCTTTATTTTGGTTGCAAACCTGGATCAATTGATGCCCCCTCCCCCCTACCCGGATCACATGCTTTTCTCTGATCACTTGAAAAACAAATACAAGGATTCAATTGTTGTGATGAAACGAGTAACTATGTGTTTGGAAATGATTTGGTGACACAGTTTTAAATCAAGTATTTAAATTTGTCAAAAAAAAAAAAAAAA

SEQ ID NO: 3663 - DNA, 1426 bp, Triticum aestivum
  misc_feature (1)..(1426): Ceres cDNA ID no. 21665843
  misc_feature (1)..(1426): Ceres CLONE  ID no. 769358
  misc_feature (1)..(1426): Also known as  Ceres CDNA ID no. 24727152
gcattcttcagttctctcgtacacaaagcagaaaaatcaacttgtgcctcgagttcttacttcttactttcttagtagccatgaagatggaacatgacctccatatgaccaaaggagaagaagagaccagctacttcaagaactcaagacttcaggaaaaagctttggttcagactaagccggttctccagaagattgtgatggaaatgtgcgtggatctcctccatccaacaatgacaattgttgacttaggctgctcttcaagtgacaacacactcttctttgtctccaatgtgatcgaagcggtcagccaccaccttgagaaattcagtcgccatcccattgagcttcagttctttctcaacgatttaccaggcaacgacttcaaccatgtcttccaatcacttcaacgattcaacaactcgattgatatggatcacaagggagagccaatacctgctttctacatcgctgggttgcccagctcctactatacaagacttttgcctcgccggagtgttcatctctttcactcatcatactgcctgcattggcgatctcgggctacatgttatacacagcttcctgatggattagagggcaagaaaagatcatatcccaatgaaggaaacatcggcattggagcgactaccccaccctgtgtggtgaaaatgtacaaagagcagtttcagaaggacatgttgttgttcctccagctgcgccatgaagaactagttgccaatggacaaatggttctcacatttcttgggaggaaacacgatgatgtctacagagcaagtctcaaccgtttatatgggttactttcacagtctgtacaatctcttgttgaggaggggctcgtggagaaagaaaagctggactcctttaatctagctgtgtatgggccatcgatggatgaagttagggcagtggtcgaccagagccagcagtttgaattgacttacatcaaactgtttgaaaccaattgggatccttatgacgactcggagggcaatgatgtgcacgacagtgtccagagtgggattaacgtcgcaaactgcttgagagcagtgatggagcccctgtttacaagccattttggagaatccgtgctcgatgagctcttcaagaagtttgcatataacgtcgctttgcaccttgtcaaggagaagaccaagtactctgtcattactctatcactgaaaagaagatgaggcgtagacgatctgtggtcttgcaatttatgtatttatcagtcgcctcctaaaatatatgcatgagtcatgggttgtgttatgttgttgttgtatattaatactaggagagttctttccactacaactgggtataataataagttcctcaaatactaatctgtattgcgttttaacagtaatatgttgatcaagtcaaaaaaaaaaaaaaa

SEQ ID NO: 3664 - protein, 377 aa, Triticum aestivum
  misc_feature: PFam Name: Methyltransf_7; PFam Description: SAM dependent
  misc_feature: GI Number: 51535788; NR Description: putative benzothiadiazole-induced S-adenosyl-L-methionine:salicylic acid carboxyl methyltransferase 1 [Oryza sativa (japonica
  misc_feature: GI Number: 52076856; NR Description: putative benzothiadiazole-induced S-adenosyl-L-methionine:salicylic acid carboxyl methyltransferase 1 [Oryza sativa (japonica
  misc_feature: GI Number: 50912193; NR Description: putative S-adenosyl-L-methionine:salicylic acid carboxyl methyltransferase [Oryza sativa (japonica cultivar-group)] >gi|45735832|dbj|BAD12867.1| putative
  misc_feature: GI Number: 51535785; NR Description: putative benzothiadiazole-induced S-adenosyl-L-methionine:salicylic acid carboxyl methyltransferase 1 [Oryza sativa (japonica
  misc_feature: GI Number: 51535791; NR Description: putative benzothiadiazole-induced S-adenosyl-L-methionine:salicylic acid carboxyl methyltransferase 1 [Oryza sativa (japonica
MKMEHDLHMTKGEEETSYFKNSRLQEKALVQTKPVLQKIVMEMCVDLLHPTMTIVDLGCSSSDNTLFFVSNVIEAVSHHLEKFSRHPIELQFFLNDLPGNDFNHVFQSLQRFNNSIDMDHKGEPIPAFYIAGLPSSYYTRLLPRRSVHLFHSSYCLHWRSRATCYTQLPDGLEGKKRSYPNEGNIGIGATTPPCVVKMYKEQFQKDMLLFLQLRHEELVANGQMVLTFLGRKHDDVYRASLNRLYGLLSQSVQSLVEEGLVEKEKLDSFNLAVYGPSMDEVRAVVDQSQQFELTYIKLFETNWDPYDDSEGNDVHDSVQSGINVANCLRAVMEPLFTSHFGESVLDELFKKFAYNVALHLVKEKTKYSVITLSLKRR

SEQ ID NO: 3665 - DNA, 1724 bp, Triticum aestivum
  misc_feature (1)..(1724): Ceres cDNA ID no. 21665844
  misc_feature (1)..(1724): Ceres CLONE  ID no. 771000
  misc_feature (1)..(1724): Also known as  Ceres CDNA ID no. 24356845
gcacggtatacatgtgcccgcccccgcccccgccgcccgccccgatgctctgttgaggaggtagcggcgaggtggtggtagccagccgaaagaaacagagcacagctgagccgagagcctgcccgcggcctgcgacaaggaaggaaggaaggaaggaaggaagatggactcctccaccgcggtggcggcgccgctgctggaggccggcggcaaggagatgcggcacctgggccgcaccgcgcacaacatgtcctcctcctccctccgcaagaagtccgacacctcgctcgtccgcaaggtgccctgcgccgcgctccgaggcttcctctccaccctccaggaggtgctcttcggcaccaagctcttcgtcctcttccccgccgtcgtcctcgccgtcgtcgccagatacatgcgcttcggccaggtgtggctcttcgtgcttagcttaattgggctaattcctcttgcagagcgactcagtttcttgacggaacagatcgctttctacacaggtcccactgttggtggactgttgaatgcgacgttcggcaacgtcaccgaggttatcatcgcgctattcgccctgagggaaggcaagataacggtggtgaaatgctccctgctcggctccatcttgtccaacttgctgcttgtcctcggcacctccctcttttttggtgggctggcaaacctcggtgtcgagcagccatacgacagaaagcaagcagatgtcagcacagggcttctaattcttggtgtgctatgccaatcaatgccgctgatgctgaggtatgcagtaagcgccggtgagcatgcagtaaactccgacgattcaggattggtgctatcccgggcgtgcagcgttctcatgatcctggcctatggagcctacctttacttccaactgaagacgcatcgccagctctttgagccccaggaggttgaagatgatggtgatgatttggtctctgaagatgaggcggtactgggatttacaagtgcgatggtttggctagcagtcatgactgtgataaccgccttactgtcagagtatgtcgttagcacaattgaggcggcctcagaatcctgggaactatcagtgagcttcattagcatcatcttgattccgattgtcgggaatgcagcagagcatgctggggcaatcatatttgcttttaagaacaagctggacatcaccctcggagtatctctggggtcagctacgcagatttccatgtttgtggtgccactgagtgtccttgtggcttgggtcatgggggttccaatggatcttgatttcaacctgctagagactggttctttgttcctcgcaatattggtcacaagcttcaccctccaggacgggtcgtcgcattatctgaagggactgcttctcctcctttgctacgccgtgatcggcgtgtgcttttttgtcctgagacgacgttcagctgatggaagcaactaatcgggttcagcctagcagatcggcttagttcagggttccccgaaaaccggacggtgattaagctgaagatggtgaagagaagaaggtagtagagtacctccctggggcagatgagcgtgcagccaagccaagcagtagggcctgcctgcgtgtaagattgtagatcgagactgaatcaggtgtttatggtcatcgcagtcctgtaaattaatcgagtttaatgtatccattagtgcacctaaaaaaaaaaaaaaaa

SEQ ID NO: 3666 - protein, 434 aa, Triticum aestivum
  misc_feature: PFam Name: Na_Ca_ex; PFam Description: Sodium/calcium
  misc_feature: PFam Name: Vitellogenin_N; PFam Description: Lipoprotein
  misc_feature: GI Number: 41059089; NR Description: CAX [Suaeda maritima
  misc_feature: GI Number: 7488876; NR Description: Ca2+/H+-exchanging protein - mung bean >gi|3063392|dbj|BAA25753.1| Ca2+/H+ exchanger
  misc_feature: GI Number: 42571113; NR Description: calcium exchanger (CAX1)
  misc_feature: GI Number: 9651993; NR Description: calcium/proton exchanger
  misc_feature: GI Number: 9651995; NR Description: calcium/proton exchanger
MDSSTAVAAPLLEAGGKEMRHLGRTAHNMSSSSLRKKSDTSLVRKVPCAALRGFLSTLQEVLFGTKLFVLFPAVVLAVVARYMRFGQVWLFVLSLIGLIPLAERLSFLTEQIAFYTGPTVGGLLNATFGNVTEVIIALFALREGKITVVKCSLLGSILSNLLLVLGTSLFFGGLANLGVEQPYDRKQADVSTGLLILGVLCQSMPLMLRYAVSAGEHAVNSDDSGLVLSRACSVLMILAYGAYLYFQLKTHRQLFEPQEVEDDGDDLVSEDEAVLGFTSAMVWLAVMTVITALLSEYVVSTIEAASESWELSVSFISIILIPIVGNAAEHAGAIIFAFKNKLDITLGVSLGSATQISMFVVPLSVLVAWVMGVPMDLDFNLLETGSLFLAILVTSFTLQDGSSHYLKGLLLLLCYAVIGVCFFVLRRRSADGSN

SEQ ID NO: 3667 - DNA, 2572 bp, Triticum aestivum
  misc_feature (1)..(2572): Ceres cDNA ID no. 21665845
  misc_feature (1)..(2572): Ceres CLONE  ID no. 774194
  misc_feature (1)..(2572): Also known as  Ceres CDNA ID no. 24356841
acttctgtaaggttttgtgctcgtctgctgggccgacatgagcacaagcgaacgtttccctttctcctttatattcagagagaagaaggggtcaccgggtgataacccttacccaccagctcgtgctttacttggccttcacttctgtaaggttctgtgctcgtctgctcgacagacatgaggctgctcaggggactccaagaagttggtgtccttgagcttcagacagctcaacgcagctcactgtcacgtgcccaccaattcgtcaatgagtgggagcttaagggcatggtggtggccagcttctccctgcaactcttcctcctcttcttctccggcttccgcaagcgctactcttcccgagtactcagtgtgctgctgtggctcgcctacctatcggccgactccctcgccgtctacatcctcggccgcctcaccctccgcggcggcagcggcaacaaccacctggccctcttctgggcgccattcctgctgctccatctcggcgggcaagagaccatgacagccttctccatggaggacaacgcgctgtggaagcgccaccttctcagcctcgtcacgcaggtgcccatggccacctacgtcgtcagcaagcagctcagagtagacaatgatgccgatcagtggctcgtggcgcccatggtgctcgtgttcgttgccgggacggggaagtacgccgaaaggatttgggcactccggagagctggctcagtggcgcctggaacgagccgctctacctcaaaactcgtttcccgtgcgtccaacgatgctgtctgggacacacaggggttctacggtcagctgcgctttgtgatttccaagaagcaggagaggaatttcgaggtcatcctagatgtggcagctcaggccttcaaactgagcctccactttctcatggacatgaccccttcaatctctctgcttcctgaagatgccaaggacatcaagcaggccgtagaggtcttgcaatcttcagaggacagagtccacatggcgtacaagctggctgagatcaacctctccttgatctatgactatttgtacacaaagtttggcacgcgccatttccacatgctcccgttctgtaacgtcttccaccggatcgtcgctcttgtgctgccatcggtggcgcttgggttgttcgtgagggggatgacgaccggtggtcgaaaggggcatgtccatgacacagatgacgtcatcatatgttacatgctgcttgtcggggccgtcgtattggagacatgctcaatcttcatgtcatttatctcttcatgctgggcatacaagaccatcatttcgtgttcgctaacatgcccgctgtgccgagatattcccggcgcaatcgcggggctgctctgggtagccaggcgtctccatccaggaaacaaaggagagtggtcggcgaaaatggcacagtacaacatgatccgaggatgcatcaaggagaaacaagacactggcttgttgcggcgggccatgcgttgggttggtatcatcggtgagccccgggccatcacgcataccagcgtctctcctgagctcaagaagctcatccttgataaattgctggacatagcagccaccccacgcgtgcaggaatgggacattggagttggcaagttccgtggccagtgggcgcaatgggtggttgagacgaagcaagaccgggcaaatcatgatcaggtgttgcagatctgtaacatccaaggtttggagttcgtgtcgagtgtgcttctctggcacgttgtgacggacatatgcttgctcgccaccgacgatgttgccgtagacggcgacgacgaggagcgcttagaagacggcggttcatcccaccatgaggatgtacaaggcagcttgtcggagctgagaggccctatcagagagctgtcagactacgtcatgtacctcgttgcagattgcggcgccatggccggcagtgaaggtcattacgtggtgactaagggccagaaagaggtgtcacgctggctgcttgagaagcacggaggaggatctgatgatcgtaagaaggtgatcgaggagattcgtgacgaggacagctccttcttccacgaaaactactaccccgtgctggatcgagctcgccgggtcgcctcggacctgcttcaggttggagaagcgggcgatcgttgggagctcatctccgcggtgtggttagagatgctttgttacgttgcgtacaactgtggggctgcgttccacgccaagcatctggccaccggtggcgagtttgtcacgcatatcaagatgcttctgtttatggtaggcgtgccttttctgagggatgtgaaagaatccttgtttcctgaagctgggaatatctattcataacgtttttaatttctgtgatttttcgactttccaatttgatctttatccaggggactccatattttggactgtacgagttaatttcctatttgaacttttactccatacgattcggattgtacctaactgtgtcttagaatcggtggctcaatcttatgatgagcgggccggttgcaatttaataaaaaaaaaaaaaaaa

SEQ ID NO: 3668 - protein, 731 aa, Triticum aestivum
  misc_feature: GI Number: 34908910; NR Description: P0691E06.5 [Oryza sativa (japonica cultivar-group)] >gi|20804723|dbj|BAB92409.1| P0691E06.5
  misc_feature: GI Number: 34906636; NR Description: P0431G06.13 [Oryza sativa (japonica cultivar-group)] >gi|15528807|dbj|BAB64702.1|
  misc_feature: GI Number: 38346298; NR Description: OSJNBa0029C04.11 [Oryza
  misc_feature: GI Number: 4680182; NR Description: unknown [Oryza sativa
  misc_feature: GI Number: 4680181; NR Description: unknown [Oryza sativa
MRLLRGLQEVGVLELQTAQRSSLSRAHQFVNEWELKGMVVASFSLQLFLLFFSGFRKRYSSRVLSVLLWLAYLSADSLAVYILGRLTLRGGSGNNHLALFWAPFLLLHLGGQETMTAFSMEDNALWKRHLLSLVTQVPMATYVVSKQLRVDNDADQWLVAPMVLVFVAGTGKYAERIWALRRAGSVAPGTSRSTSKLVSRASNDAVWDTQGFYGQLRFVISKKQERNFEVILDVAAQAFKLSLHFLMDMTPSISLLPEDAKDIKQAVEVLQSSEDRVHMAYKLAEINLSLIYDYLYTKFGTRHFHMLPFCNVFHRIVALVLPSVALGLFVRGMTTGGRKGHVHDTDDVIICYMLLVGAVVLETCSIFMSFISSCWAYKTIISCSLTCPLCRDIPGAIAGLLWVARRLHPGNKGEWSAKMAQYNMIRGCIKEKQDTGLLRRAMRWVGIIGEPRAITHTSVSPELKKLILDKLLDIAATPRVQEWDIGVGKFRGQWAQWVVETKQDRANHDQVLQICNIQGLEFVSSVLLWHVVTDICLLATDDVAVDGDDEERLEDGGSSHHEDVQGSLSELRGPIRELSDYVMYLVADCGAMAGSEGHYVVTKGQKEVSRWLLEKHGGGSDDRKKVIEEIRDEDSSFFHENYYPVLDRARRVASDLLQVGEAGDRWELISAVWLEMLCYVAYNCGAAFHAKHLATGGEFVTHIKMLLFMVGVPFLRDVKESLFPEAGNIYS

SEQ ID NO: 3669 - DNA, 1710 bp, Triticum aestivum
  misc_feature (1)..(1710): Ceres cDNA ID no. 21665846
  misc_feature (1)..(1710): Ceres CLONE  ID no. 774203
  misc_feature (1)..(1710): Also known as  Ceres CDNA ID no. 23726916
ctttgcagcagaggaggagcgggccggccggggagaggggctttccgctttgcttgcttcctctttctccctccccccctctctctctttccagcctttctcctcctcgctaagcaactcatcagctcaactcacatcatccgtggtggtgccacaccaccactagttaaaccgcagccttcagctggtgtagccaagtgagcgagtgcgcggccacaaggtagcggcagcagtacgaggaagcgggcagaagggacaagaagagctcggtcgaccacgcggccggagcggcgatgccgcggcctctgctggttgccctcctcctcctggggctcttgctgctcgtccacgtcccgtatgctgcgccgcagtccttcatcggcatcaactacggcgacatcgccgacaacctgccgccgccggcgtcgacggcgcggctgctgaagtccaccaccatcggcaaggtgcgcctctacaggaccgacccggccgtggtggccgccttcgccgggacgagcatctcgctgctcctcggcgccgccaacgccgacatcccctccttcgcatcctcgccgtcggccgccgccgcctgggtcgccgcgcacctcccgtcgtcctcctcgcccgccgtgaacggcatctccgtcggcaacgaggtgctctactcgggcgacgccgcgctcatctcgcagctggtcccggcgctgcagaacatctacgacgcgctgccggccagctccggcatcaaggtgtccacggtgaacgccatggacgtgctggcgtcgtcggacccgccgtcgtcgggggcgttcaagccggagctgtcggccgcgctggacccgctgctggccttcctcagcaagaccggctcgccgttcctggtgaacccgtacccctacttcgcgtaccaggacgaccccaggccggacacgctggccttctgcctcttccagcccaacgccgggcggccggacgccgggtccgggctcacctacaccagcatgttcgacgcgcaggtggacgccgtgcgcgccgcgctggacgccaaggggtacaaggacgtggaggtggtggtggccgagaccgggtggccgcacagcggcggcgccgacgaggccggcgcctccgtggagaacgcgcgcgccttcgtctccaacctcgtctcccacctccggtccatggtcggcacgccgcggatgcccggcaagtccgtcgacacctacctcttcgccgtgtacgacgaggacctcaagcccgggaaggcgtcggagaagtccttcggcctctttcagaccacgctcaccgagacgtacccgacggggctgatgaggaacggcaccgcgggcctggcgccggctccggcaccgacgctgcggccggcgagccccccgccggcgacaccgcaggtgacgccggtgcagccgcagccaagcgcgtcggcagcggcgacgtcgccgcctcggcatgctcgtagtgctgctgaatcgcctcgcaccgtgcctgccctccatgtgtttgcttgtttcttgttcatgtctctgctggcctgaccttccttttctgtctgcaatctctgtaatgtgtgttgaggcaagcaacttgtgttctgctcatatgtggttttgcactgtccaactctgatacgatgtgaacaaatatatttgtttcataatcagttgggaaccctagttcgtaaaaaaaaaaaaaaaa

SEQ ID NO: 3670 - protein, 418 aa, Triticum aestivum
  misc_feature: PFam Name: Glyco_hydro_17; PFam Description: Glycosyl
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: GI Number: 62733577; NR Description: Glycosyl hydrolases
  misc_feature: GI Number: 50400015; NR Description: putative beta
  misc_feature: GI Number: 23297709; NR Description: putative beta-1,3-glucanase [Arabidopsis thaliana] >gi|18377670|gb|AAL66985.1| putative beta-1,3-glucanase [Arabidopsis thaliana] >gi|22327528|ref|NP_199086.2| glycosyl
  misc_feature: GI Number: 14279169; NR Description: beta-1,3-glucanase-like
  misc_feature: GI Number: 4544403; NR Description: putative beta-1,3-glucanase [Arabidopsis thaliana] >gi|15226720|ref|NP_179219.1| glycosyl hydrolase family 17 protein [Arabidopsis thaliana] >gi|25316441|pir||B84538 probable
MPRPLLVALLLLGLLLLVHVPYAAPQSFIGINYGDIADNLPPPASTARLLKSTTIGKVRLYRTDPAVVAAFAGTSISLLLGAANADIPSFASSPSAAAAWVAAHLPSSSSPAVNGISVGNEVLYSGDAALISQLVPALQNIYDALPASSGIKVSTVNAMDVLASSDPPSSGAFKPELSAALDPLLAFLSKTGSPFLVNPYPYFAYQDDPRPDTLAFCLFQPNAGRPDAGSGLTYTSMFDAQVDAVRAALDAKGYKDVEVVVAETGWPHSGGADEAGASVENARAFVSNLVSHLRSMVGTPRMPGKSVDTYLFAVYDEDLKPGKASEKSFGLFQTTLTETYPTGLMRNGTAGLAPAPAPTLRPASPPPATPQVTPVQPQPSASAAATSPPRHARSAAESPRTVPALHVFACFLFMSLLA

SEQ ID NO: 3671 - DNA, 1935 bp, Triticum aestivum
  misc_feature (1)..(1935): Ceres cDNA ID no. 21665847
  misc_feature (1)..(1935): Ceres CLONE  ID no. 776504
  misc_feature (1)..(1935): Also known as  Ceres CDNA ID no. 24361237
cccatttcgacacaccacgaggcacgcactagagcctacagcatacatcgtccgatcggccatcgatggaggagctcaagccggagttcacaaaggacggctccgtcgacctccgcggccggccggtcgtcgccgcccggaccggccgctggaaggcctgctccttcctagtcgggtacgaggcgttcgagcggatggcgttctacggggtggcgtcgaacctggtggtgtacctgacgacgcagatgcggcaggagacggtgccgtcggtgcgcagcgtcaacaactggacgggcacggtgtggatgacgcccatcgccggagcctacgtcgccgacgccttcctcggccgcttctggaccttcaccgtctcctccctcgtctacctctcgggcatggttctgataaccctggccgtctccctgaagccgctgcacccgcagtgcacggcgggcggcgactgcgccccggcgacgcggcagcaggtcgccttcctgtacgcggcgctctacaccatggccgtcggcgcgggtgggaccaagcccaacatctcgacgttcggcgcagaccagttcgacgacttcgacgcccgggagcgcgaggtcaaggcctccttcttcaactggtggctgttcagctccttcgccggcggcctcgtcgccgtgctcgtcctcgtctacgtgcaggaggaggtcggctggggcgtcgggtacacgatccccacggtcggcctcgccctgtccctcgtgctcttctacgtgggcacgccgttctaccggcacaagccggtcacgcggagcacggcggccggcccggcgaggctgatcggcagggtgctcagggcggcgtacgcgaaccggggatgcccgctcaccggcgagctgcacgagcatgacaaggcgtggtacgccgcggccgggaagcggcttctgctccacacggagggtaacttcaggttcttggacaaggcggcgatccgtgagcgtgaggcgtgcacggtgaccgaggtcgaggaggtgaagctgatcgccggcatgatcgtggtgtggctggttaccctggtgccatgcaccatctgggcgcaggtgaacaccctgttcgtgaagcaagggacgacgctggaccgctccgtcggcggcgtgcgcatcccggccgcgtccctcggcagcttcgtcaccatctccatgctcatctcgatcccgatctacgaccgcgtgctggtgccgctggcccggcggcgcacgggcaacccgcgcggcatcaccctcctgcagcgcctcggcgtcggctgcgcgctgcaggtgctcgtcgtggcctgcgcctgcctggtggaggtccggcgcatgcgcgtgatccgggagcgcgccgcccgcggcccccacgacacgatgccgatgagcgtcttctggatgctgccgcagtacgtgctgctgggcgtcggcgacgtgttcaactccgtgggcatcctcgagttcttctacgaccagtcgccggaggggatgcggagcctcggcaccaccttcttcaccagcgggctcggcgtcgggaacttcctcaacagcctgctcgtgacgctcgtcgaccgggccaccgccaccactaccggggggagctggatcggcgacaacctcaatgactcgcacctcgactactactacgcgttcctgctgctcctcaccgtggccaacatggcgctcttcgtgtgggtggccatgcggtacaggtacaagagagagttcttggaggacagcggcgcaatggagaccgagaatgagatggtggccggcggcaaggtaaaggcggacctgcctgcgcgtctgcctgacaacacaacaagggacagagcatatgtactggagtagcagtatattgtacagagtactttttttaggggttataaaccaacctttatggatcggaaaaaaaaaaaaaaaa

SEQ ID NO: 3672 - protein, 598 aa, Triticum aestivum
  misc_feature: PFam Name: PTR2; PFam Description: POT family
  misc_feature: PFam Name: MFS_1; PFam Description: Major Facilitator Superfamily
  misc_feature: PFam Name: Peptidase_S8; PFam Description: Subtilase family
  misc_feature: GI Number: 9757724; NR Description: peptide transporter [Arabidopsis thaliana] >gi|15237369|ref|NP_199416.1| proton-dependent oligopeptide transport (POT) family protein
  misc_feature: GI Number: 23297791; NR Description: peptide transporter [Arabidopsis thaliana] >gi|9757725|dbj|BAB08250.1| peptide transporter [Arabidopsis thaliana] >gi|15237370|ref|NP_199417.1| proton-dependent oligopeptide transport (POT) family protein
  misc_feature: GI Number: 2367418; NR Description: peptide transporter
  misc_feature: GI Number: 23297804; NR Description: putative PTR2 family peptide transporter [Arabidopsis thaliana] >gi|20453068|gb|AAM19779.1| At2g40460/T2P4.19 [Arabidopsis
  misc_feature: GI Number: 17380882; NR Description: putative PTR2 family
  misc_feature: Utility: Useful for making plants tolerant to low nitrogen
  misc_feature: Utility: Useful for making plants with enhanced tolerance to
MEELKPEFTKDGSVDLRGRPVVAARTGRWKACSFLVGYEAFERMAFYGVASNLVVYLTTQMRQETVPSVRSVNNWTGTVWMTPIAGAYVADAFLGRFWTFTVSSLVYLSGMVLITLAVSLKPLHPQCTAGGDCAPATRQQVAFLYAALYTMAVGAGGTKPNISTFGADQFDDFDAREREVKASFFNWWLFSSFAGGLVAVLVLVYVQEEVGWGVGYTIPTVGLALSLVLFYVGTPFYRHKPVTRSTAAGPARLIGRVLRAAYANRGCPLTGELHEHDKAWYAAAGKRLLLHTEGNFRFLDKAAIREREACTVTEVEEVKLIAGMIVVWLVTLVPCTIWAQVNTLFVKQGTTLDRSVGGVRIPAASLGSFVTISMLISIPIYDRVLVPLARRRTGNPRGITLLQRLGVGCALQVLVVACACLVEVRRMRVIRERAARGPHDTMPMSVFWMLPQYVLLGVGDVFNSVGILEFFYDQSPEGMRSLGTTFFTSGLGVGNFLNSLLVTLVDRATATTTGGSWIGDNLNDSHLDYYYAFLLLLTVANMALFVWVAMRYRYKREFLEDSGAMETENEMVAGGKVKADLPARLPDNTTRDRAYVLE

SEQ ID NO: 3673 - DNA, 2237 bp, Triticum aestivum
  misc_feature (1)..(2237): Ceres cDNA ID no. 21665848
  misc_feature (1)..(2237): Ceres CLONE  ID no. 776595
  misc_feature (1)..(2237): Also known as  Ceres CDNA ID no. 24368375
aggtacaacaaccgtgcgccgtgcgtgccgaagactccccgccgccaccgcccccgcctgcctccccaggccatgtcatgacggcggtccgacggtgcaccgacctctcctctctcccctcccccgctcccctcctctcccgcctcagctccgccgcctcgcgtctcctccagatgaggaagtacggctcgaggaaggaaggcggcggcggtctgcggaacgggcggtccagctccgcttcaaggccaggatccatcgatccttcctcgtggaaatattttgactcgagagccgttggaatccccgcgggcgctatacctcgcaattgtatggctgttctacaaatgctgaaacgaaaaggatttgaagcttatcttgttgggggatgtgtgagagacttgctactcaaaagggcgcctaaagattttgatgtgatcaccactgcaagtctcaaagagattaaagaacatgttttctcacgttgtttcatcgttggcaatcgctttccaatatgccttgttagatggcgtggttcattatttgaggtttcaagcttcaaaacaaatacgactcaagtgaaaggaaatgaaaatgtaaactgctcagaagatacagatggccgtgatgggggggatattcttcgctggaaggattcattgagaagagactttacagtaaacagcctattctttaatccattcaatcacagagtttatgattatgtgaatggagtaaaggatctaagaaaaaacaaggtgtgtacagtgattgctgcccatgtttctttcaaggaggatcctgccagaattttgcgtggcttgagagttgctgctcgccttggctttcagttttccagcgaaacttctactgcaatacgtgatctttctccatccatcatggatatcgacaagccaaggttggctatggaaatgaaatatatgctatcttatggggcggcagagtcttcgattagattacttagaaaatatggacttctcgatattttgctgccttttcaggcagcatatttgtcagatcagttaaagggcaaatctagtgacagagggctgatgctcatgaatctattggccaatcttgacaagttcttctccgctgaccgcccatgccactgctctttgtggctagcactgttggcatttcacaatgcattggtaaattctccacaagatgcccaggtaatcaaggctttcgctgcactgatgcattttggaacatgggacagcgccatcgagttcctgaacgaagatgttggagcaccagttacatatgtcccagaagcttttgggctttctggggccaaagtggataatcttatggaacagacatcacatctagcgtcactagtcaaatcttcggttgatacattgacatgtttaaatactctcaaacaatcagtgatcagatatccaggggcatcacaattttcaggacttgtttttgtatcagccagggagaagggcagagtgttggggatatttaacggccttgactctgacctaacttcatatgacaagagaagagggatgcatgggattgactataagttgctggaagacggagttactgccgaggtccgatttgttctcggaaaagtgatcatggacaccatgagtgctgagtcaccgtgtgcatccaccgatgctgctgctgctttgccaaggccagcggcggatgttactgatgcagaccatcgtccactgtccacgttatttcatagtggtgaatcagagtgaagcagcaacaccccatctgttttcatcaatgctggtaagcacattgaagccctcagatttgatggcgtgaagttcaggatggccaatacgaacacaatgctacgattctgtcggtcactgaacttaccttgggaggatgccctcctggttgtgcagaagatcaagcgtaggctgtagacaagatacatgtaaggtttatcttgtttaatttcttccgtttactaggcatgtaagtgacgtgagctagagttagagtgctgtcagcatgtgtggttgcatttgcaaagattcaataagaaagtgggctgagcttagggaaaatggagctctccatttttatcaattgcttctatgttcatgcaaaaaatgaaaggaaaggcagcctactgcttcagttgtgttctaaggacaaattatgcttcccagtgaacttccctccatttcaaattataagatgttctactcctaaaaaaaaaaaaaaaa

SEQ ID NO: 3674 - protein, 558 aa, Triticum aestivum
  misc_feature: PFam Name: RVT_1; PFam Description: Reverse transcriptase
  misc_feature: GI Number: 52353620; NR Description: putative polyprotein
  misc_feature: GI Number: 38347073; NR Description: OSJNBa0006A01.14 [Oryza
  misc_feature: GI Number: 34902074; NR Description: putative reverse transcriptase [Oryza sativa (japonica cultivar-group)] >gi|29893671|gb|AAP06925.1| putative reverse transcriptase [Oryza
  misc_feature: GI Number: 58532025; NR Description: OSJNBa0006A01.18 [Oryza
  misc_feature: GI Number: 22208464; NR Description: putative reverse
MTAVRRCTDLSSLPSPAPLLSRLSSAASRLLQMRKYGSRKEGGGGLRNGRSSSASRPGSIDPSSWKYFDSRAVGIPAGAIPRNCMAVLQMLKRKGFEAYLVGGCVRDLLLKRAPKDFDVITTASLKEIKEHVFSRCFIVGNRFPICLVRWRGSLFEVSSFKTNTTQVKGNENVNCSEDTDGRDGGDILRWKDSLRRDFTVNSLFFNPFNHRVYDYVNGVKDLRKNKVCTVIAAHVSFKEDPARILRGLRVAARLGFQFSSETSTAIRDLSPSIMDIDKPRLAMEMKYMLSYGAAESSIRLLRKYGLLDILLPFQAAYLSDQLKGKSSDRGLMLMNLLANLDKFFSADRPCHCSLWLALLAFHNALVNSPQDAQVIKAFAALMHFGTWDSAIEFLNEDVGAPVTYVPEAFGLSGAKVDNLMEQTSHLASLVKSSVDTLTCLNTLKQSVIRYPGASQFSGLVFVSAREKGRVLGIFNGLDSDLTSYDKRRGMHGIDYKLLEDGVTAEVRFVLGKVIMDTMSAESPCASTDAAAALPRPAADVTDADHRPLSTLFHSGESE

SEQ ID NO: 3675 - DNA, 1720 bp, Triticum aestivum
  misc_feature (1)..(1720): Ceres cDNA ID no. 21665849
  misc_feature (1)..(1720): Ceres CLONE  ID no. 776656
  misc_feature (1)..(1720): Also known as  Ceres CDNA ID no. 23727005
acacgttaattaaggaaaacaaatggtattgttttttacgggaactaaacattttgagaccaaccgacggtagaaaaaacactcagccgttgactacatgggcgatatgatgtgtcccgctccagccaccgctcggagcacgacgacgcctcgcatcccactcctcccctacgtcctcctcggccttgcttccaccgtcatgtcgctggagccggacgcggaggaggaatgggcagcggtggagcggcgaggcgctcacctggtaacgagggcggcggagcgccccttcatcatccacgggttcaacacctactggctcatgtccttcgccgccgacgaggccacgcggccgcgcgtgaccgcggccattgccgaggctgccggggcggggctcaacgtgtgccgcacctgggcgttcgctgacggagggtaccacgcgctgcagaccgcgccattctgctacgacgaggtggtgttccaggcactagatttcgtggtcagcgaggcaagaaggtataagatgcggttaatactgtcactttgtaataactgggaagattatggagggaaggcacagtatgtaagatggggtaaggaggctggcgtagatcttacttctgacgacgacttcttctctggtccaacacttaaagggtactacaaagcttttgttgaggctgttttgtcaagaataaacacaatcacaaatgaggcctacaaagatgatcctactattcttgcctgggagctgattaacgagccgcgctgcccttcagatccatcaggcgatacgctgcaggcatggatagaagagatggcttcttacgtgaagtctatagatactatgcacctcgtggagattggtattgaagggtattatggtccgtctactccagaacttttgctcgtcaacccagatgattattcagggcatgttggaacggacttcatcaggaaccatcaagcaatgggaattgatttagcttcagttcatatttattcagacacttggttgcctgactcaacagaggaaagccacgttcagtttgttaacacttggatgcaacaacatattgatgatgcagcaaacttgctgggcatgcccattgtgatcggggagtttggattatcactgaaggatggcaagtttgaaaacgagttccgcgaaactttcatgcagacagtgtacaacaatttcttgggctcttgggagagtggaatgattggaggaggctgccttctatggcagctcttccctgaaggcgcagaacacatggacgatggttatgcagttatttttgcaaaatcaccatccacattcaacctacttgcaaatcactcaaggaagctagaatgttgagagtccccttcccctgctacatggtttttcaagccaagaatttcattgtaaagttgaatgccttatgtatatcatgtaccctaatagtgataccatgaaaaaaggtagagattgaattgtgcaataaacttttgcccctccatcctgcacataatatatttcaaaaatatctttaatatgctgtcattttgattccatttacgtatttgtttgccatatatgtatatgcaaacaaaattgcattggatgctactattcatcccgagaacgttgggtaaatgtaatatgggcatttgatattgtgatagaatcgttaaggtttaataaagagggtggatttgctgaaaaaaaaaaaaaaaa

SEQ ID NO: 3676 - protein, 1720 aa, Triticum aestivum
  misc_feature: PFam Name: Cellulase; PFam Description: Cellulase (glycosyl
  misc_feature: GI Number: 29028774; NR Description: At5g01930 [Arabidopsis thaliana] >gi|7329666|emb|CAB82763.1| (1-4)-beta-mannan endohydrolase-like protein [Arabidopsis thaliana]
  misc_feature: GI Number: 23477717; NR Description: endo-beta-mannanase
  misc_feature: GI Number: 31376369; NR Description: At5g66460 [Arabidopsis thaliana] >gi|23306404|gb|AAN17429.1| mannan endo-1,4-beta-mannosidase [Arabidopsis thaliana] >gi|10177527|dbj|BAB10922.1| mannan endo-1,4-beta-mannosidase
  misc_feature: GI Number: 34912090; NR Description: putative mannan endo-1,4-beta-mannosidase [Oryza sativa (japonica cultivar-group)] >gi|20521230|dbj|BAB91747.1| putative mannan
  misc_feature: GI Number: 10180974; NR Description: endo-beta-mannanase
ACACGTTAATTAAGGAAAACAAATGGTATTGTTTTTTACGGGAACTAAACATTTTGAGACCAACCGACGGTAGAAAAAACACTCAGCCGTTGACTACATGGGCGATATGATGTGTCCCGCTCCAGCCACCGCTCGGAGCACGACGACGCCTCGCATCCCACTCCTCCCCTACGTCCTCCTCGGCCTTGCTTCCACCGTCATGTCGCTGGAGCCGGACGCGGAGGAGGAATGGGCAGCGGTGGAGCGGCGAGGCGCTCACCTGGTAACGAGGGCGGCGGAGCGCCCCTTCATCATCCACGGGTTCAACACCTACTGGCTCATGTCCTTCGCCGCCGACGAGGCCACGCGGCCGCGCGTGACCGCGGCCATTGCCGAGGCTGCCGGGGCGGGGCTCAACGTGTGCCGCACCTGGGCGTTCGCTGACGGAGGGTACCACGCGCTGCAGACCGCGCCATTCTGCTACGACGAGGTGGTGTTCCAGGCACTAGATTTCGTGGTCAGCGAGGCAAGAAGGTATAAGATGCGGTTAATACTGTCACTTTGTAATAACTGGGAAGATTATGGAGGGAAGGCACAGTATGTAAGATGGGGTAAGGAGGCTGGCGTAGATCTTACTTCTGACGACGACTTCTTCTCTGGTCCAACACTTAAAGGGTACTACAAAGCTTTTGTTGAGGCTGTTTTGTCAAGAATAAACACAATCACAAATGAGGCCTACAAAGATGATCCTACTATTCTTGCCTGGGAGCTGATTAACGAGCCGCGCTGCCCTTCAGATCCATCAGGCGATACGCTGCAGGCATGGATAGAAGAGATGGCTTCTTACGTGAAGTCTATAGATACTATGCACCTCGTGGAGATTGGTATTGAAGGGTATTATGGTCCGTCTACTCCAGAACTTTTGCTCGTCAACCCAGATGATTATTCAGGGCATGTTGGAACGGACTTCATCAGGAACCATCAAGCAATGGGAATTGATTTAGCTTCAGTTCATATTTATTCAGACACTTGGTTGCCTGACTCAACAGAGGAAAGCCACGTTCAGTTTGTTAACACTTGGATGCAACAACATATTGATGATGCAGCAAACTTGCTGGGCATGCCCATTGTGATCGGGGAGTTTGGATTATCACTGAAGGATGGCAAGTTTGAAAACGAGTTCCGCGAAACTTTCATGCAGACAGTGTACAACAATTTCTTGGGCTCTTGGGAGAGTGGAATGATTGGAGGAGGCTGCCTTCTATGGCAGCTCTTCCCTGAAGGCGCAGAACACATGGACGATGGTTATGCAGTTATTTTTGCAAAATCACCATCCACATTCAACCTACTTGCAAATCACTCAAGGAAGCTAGAATGTTGAGAGTCCCCTTCCCCTGCTACATGGTTTTTCAAGCCAAGAATTTCATTGTAAAGTTGAATGCCTTATGTATATCATGTACCCTAATAGTGATACCATGAAAAAAGGTAGAGATTGAATTGTGCAATAAACTTTTGCCCCTCCATCCTGCACATAATATATTTCAAAAATATCTTTAATATGCTGTCATTTTGATTCCATTTACGTATTTGTTTGCCATATATGTATATGCAAACAAAATTGCATTGGATGCTACTATTCATCCCGAGAACGTTGGGTAAATGTAATATGGGCATTTGATATTGTGATAGAATCGTTAAGGTTTAATAAAGAGGGTGGATTTGCTGAAAAAAAAAAAAAAAA

SEQ ID NO: 3677 - DNA, 1667 bp, Triticum aestivum
  misc_feature (1)..(1667): Ceres cDNA ID no. 21665850
  misc_feature (1)..(1667): Ceres CLONE  ID no. 776882
  misc_feature (1)..(1667): Also known as  Ceres CDNA ID no. 24361270
attgaatggattacgagatatcttgcaccaagtaggcagtactccagtccagtctccagcatcagactcctcgcagacctgctagtgctcgcccgatggctcgcctcctgcgcacctccctcgtcgcgccctcgccggccggcgccgcgctccacgagcgctctctcccgctcacctacctagacgcgctgtggctccacgccacgcccgtcgagcgcgtcttcttctaccccaacgccaccagcgacgtcctctccaacctcacggactccttgtccaatgcactcgccgcattttaccctcttgccggccgcctccgcctcacccccggcgcgcacaaccgctacgagctccactgccagccgggcgacggcgtcaccttcaccgtcgccgagtaccaccacgtcggcttcgacgagcttgccacggacgaacctacggaggttgccaagatcgtgccgcttgtgccgccgctgcccgaaggcggcgcggtgctcgctgtgcaggccaccgtgctgcgcggcggcctcgctatcggcgtgaccgttcaccacgccgcgtgcgacggggtgtcctcgacgcacttcctccgcacctgggcctgggctgcggcagcctgcagcggagcgagcgcgcctgtgccgcccttcgtcgaccgctccatcatccgcgcacgagacgacctgtacgacgctttcacagcgcccaggctgtccagcaacgacgacgacgacggtgggaaaccccccgattcgcccgtcgtccagcagctcctcgccacgttcacgctgtccaaggagcacctgcagagcatcaaagaagcggtcgccggcgaggcggaacgccgtggcgtgccgctgcctcgcgccacatcgatcatcgcggcgttcggcttcatctggcaatgctacgtccgagctaaaccgggcaccgacggcaaggcagggtcgtcctgcggcggccgtgcctacttcctcttgcccgcggaccaccggacgcggctggagccgcccgtcccggacgagtacctcgggaactgcctcggtccgtgcatcgctttagcgcccaggagggatgtcgctgccgccggcgcggacggtctgttcaccgcgtgcgcggcgatcgccacggccatcgacggagtggtgcgcagcgggcccggctgctgggacgggtggatggagcgcatcatcgaggcgtacaccgcgggcgacttaccgctaacagtcgcagggtcgccgaggttccgcgtgtacgacacagactttgggttcggacggccggcaaaggtggatgtcgtgtcggtggcgaggaccggcgcgatgtccgtggcagaggcacgcagcggcggcggcggggtggaggtgggcatctctttgtcggcgggtgccatggagcgtttcaacgagtgctttgccgatgccatcgcgtccctttcgtcgtaggagtatgtataagatgtttggttatgttctgtaataactgctgcttacaaagtgaatcagtgatgtttctgtgatggcatggtttgacagcgaaacgagtcatggggaatgagcagagtggttgcttccatcgcatggtctatgctgtgtctagagcagaaagtcactttgccaataagcactttattttgaatagtttgaaaatcaaaaaaaaaaaaaaaa

SEQ ID NO: 3678 - protein, 449 aa, Triticum aestivum
  misc_feature: PFam Name: Transferase; PFam Description: Transferase family
  misc_feature: PFam Name: Pyr_redox_2; PFam Description: Pyridine
  misc_feature: PFam Name: Mucin; PFam Description: Mucin-like glycoprotein
  misc_feature: PFam Name: MSA_2; PFam Description: Merozoite Surface
  misc_feature: PFam Name: Podocalyxin; PFam Description: Podocalyxin
  misc_feature: GI Number: 50908429; NR Description: putative quercetin 3-O-glucoside-6''-O-malonyltransferase [Oryza sativa (japonica cultivar-group)] >gi|47847577|dbj|BAD21964.1| putative quercetin 3-O-glucoside-6''-O-malonyltransferase [Oryza sativa (japonica
  misc_feature: GI Number: 50908391; NR Description: putative quercetin 3-O-glucoside-6''-O-malonyltransferase [Oryza sativa (japonica cultivar-group)] >gi|47847996|dbj|BAD21783.1| putative quercetin 3-O-glucoside-6''-O-malonyltransferase [Oryza sativa (japonica
  misc_feature: GI Number: 50908421; NR Description: putative quercetin 3-O-glucoside-6''-O-malonyltransferase [Oryza sativa (japonica cultivar-group)] >gi|47847573|dbj|BAD21960.1| putative quercetin 3-O-glucoside-6''-O-malonyltransferase [Oryza sativa (japonica
  misc_feature: GI Number: 50908397; NR Description: putative anthocyanidin 3-O-glucoside-3'',6''-O-dimalonyltransferase [Oryza sativa (japonica cultivar-group)] >gi|47847999|dbj|BAD21786.1| putative
  misc_feature: GI Number: 50908435; NR Description: putative quercetin 3-O-glucoside-6''-O-malonyltransferase [Oryza sativa (japonica cultivar-group)] >gi|47847580|dbj|BAD21967.1| putative quercetin 3-O-glucoside-6''-O-malonyltransferase [Oryza sativa (japonica
MARLLRTSLVAPSPAGAALHERSLPLTYLDALWLHATPVERVFFYPNATSDVLSNLTDSLSNALAAFYPLAGRLRLTPGAHNRYELHCQPGDGVTFTVAEYHHVGFDELATDEPTEVAKIVPLVPPLPEGGAVLAVQATVLRGGLAIGVTVHHAACDGVSSTHFLRTWAWAAAACSGASAPVPPFVDRSIIRARDDLYDAFTAPRLSSNDDDDGGKPPDSPVVQQLLATFTLSKEHLQSIKEAVAGEAERRGVPLPRATSIIAAFGFIWQCYVRAKPGTDGKAGSSCGGRAYFLLPADHRTRLEPPVPDEYLGNCLGPCIALAPRRDVAAAGADGLFTACAAIATAIDGVVRSGPGCWDGWMERIIEAYTAGDLPLTVAGSPRFRVYDTDFGFGRPAKVDVVSVARTGAMSVAEARSGGGGVEVGISLSAGAMERFNECFADAIASLSS

SEQ ID NO: 3679 - DNA, 2256 bp, Triticum aestivum
  misc_feature (1)..(2256): Ceres cDNA ID no. 21665851
  misc_feature (1)..(2256): Ceres CLONE  ID no. 776999
  misc_feature (1)..(2256): Also known as  Ceres CDNA ID no. 24356885
atccagagcaagagcaagcgcaagcgcaagtggtgaaatccatttcccaacacagcacacacagttagagagagcgagcgagggagcgagcggcctagcgcacacgtgtgcagccggcggccatgggcggcagcgcggcggctgggaagagcgtggacggcgggggcagggcggcgcagaggatgccggtgccggaggcgcggccgttcctggacacgttccgggccaacctcaaggagaccttcttcccggacgacccgttccgcgcggtggtgcgggagcggggcttcggccggcgcgcggcggccgcgctccgctacttcttcccgttcctcgagtgggcgccggcatacaggctcggcaccttcaagtcggacctcatcgccggcatcaccattgccagcctcgccatcccgcagggcatcagctacgccaagctcgccaacctgccgcccatcctcggcctctactcgagcttcgtgccgccgctggtgtacgcgatgatggggagctccaaggacctggcggtggggacggtggcggtggcgtcgctgctcatcgcctccatgctgggcgccgaggtgtcggccacggagaacccggcgctctacctccacctggccttcacggcgaccttcttcgccggcgtcatccaggcctcgctcggcatcctcaggctggggttcatcgtggacttcctgtcgcacgcggcgatcgtggggttcatgggcggcgcggcgacggtggtgtgcctgcagcagctcaagggcatgctggggctggagcacttcaccacctccaccgacctcgtctccgtcatgcgctccgtcttctcccagacacaccagtggcgatgggagagcgtggtgctcggctgcggcttcctcttcttcctcctcgtcacccgcttcttcagcaagaggcagcctaggttcttctgggtatccgccgccgcgccattgacgtcggtcatccttgggagcctcctggtctacttcacccatgctgaaaaccatggcgttcaaattatcggtaatctgaagaaaggcctgaacccaatctccgtcacaaacctccagttcacgccgccgtacatgatgctcgccctcaagaccggcctcatcaccggcgtcatcgccctcgccgaagggatcgccgtcggccggagcttcgccatgttcaagaactaccacatcgacggcaacaaggagatgatcgccatcgggacgatgaacatcctggggtccttcacctcctgctacctcaccacggggcccttctcccggtccgccgtgaactacaacgccgggtgcaagacggccatgtccaacgtggtcatgtcgctggcggtgatggtgacgctcctcttcctcacgccgctcttccactacacgccgctggtggtgctgtcggcgatcatcatgtcggcgatgctggggctcatcgacttcccggccgccgtgcacctctggcacgtcgacaaggtggacttctgcgtctgcgcgggggcctacctcggcgtcgtcttcggcagcgtcgagatggggctggtggtcgccgtggccatctccgtgctccgggtgctgctcttcgtggcccggccgaggacgaccgtgctcggcaacgtgccggacaccaacgtctaccggaggatggaccagtacacgacggcgcgggcggtgcccggcgtgctcgtgctgcgcgtggactcgcccatctacttcgccaactccggctacctgcgcgagaggttcacccggtggatcgacgaggacgatgaacgcaccagcgccaagggcgagaccggcgtgcagtacgtcgtcctcgacatgggtgctgtgggcagcatcgacaccagcgggacgagcatgctggacgagctcaagaagaccctggacaggagggggattcagatcgtgctggcgaacccggggagcgagatcatgaagaagctggacagctccaaggtgctggagctcatcggccacgagtggatcttcccgacggtgggcgaggccgtggcggagtgcgacttcgtgctgcactcccacaagccgggcatggtggtggacggtgcctcgcatgagaacatggtctgattgggcctgacctgacctgagttgagttgttaacaggcaatgcgagccgagatcggtataagcatctcgagctattgtactcctacgttttggatgaaatccgcatgaaatgaatatcaccgtttttgttggtgttgaagcaaaaaaaaaaaaaaaa

SEQ ID NO: 3680 - protein, 658 aa, Triticum aestivum
  misc_feature: PFam Name: Sulfate_transp; PFam Description: Sulfate
  misc_feature: PFam Name: STAS; PFam Description: STAS domain
  misc_feature: GI Number: 22773265; NR Description: Putative sulfate
  misc_feature: GI Number: 23270390; NR Description: putative sulfate
  misc_feature: GI Number: 7488356; NR Description: sulfate transport protein - Arabidopsis thaliana >gi|1498120|dbj|BAA12811.1| sulfate
  misc_feature: GI Number: 15231069; NR Description: sulfate transporter
  misc_feature: GI Number: 2967454; NR Description: sulfate transporter
MGGSAAAGKSVDGGGRAAQRMPVPEARPFLDTFRANLKETFFPDDPFRAVVRERGFGRRAAAALRYFFPFLEWAPAYRLGTFKSDLIAGITIASLAIPQGISYAKLANLPPILGLYSSFVPPLVYAMMGSSKDLAVGTVAVASLLIASMLGAEVSATENPALYLHLAFTATFFAGVIQASLGILRLGFIVDFLSHAAIVGFMGGAATVVCLQQLKGMLGLEHFTTSTDLVSVMRSVFSQTHQWRWESVVLGCGFLFFLLVTRFFSKRQPRFFWVSAAAPLTSVILGSLLVYFTHAENHGVQIIGNLKKGLNPISVTNLQFTPPYMMLALKTGLITGVIALAEGIAVGRSFAMFKNYHIDGNKEMIAIGTMNILGSFTSCYLTTGPFSRSAVNYNAGCKTAMSNVVMSLAVMVTLLFLTPLFHYTPLVVLSAIIMSAMLGLIDFPAAVHLWHVDKVDFCVCAGAYLGVVFGSVEMGLVVAVAISVLRVLLFVARPRTTVLGNVPDTNVYRRMDQYTTARAVPGVLVLRVDSPIYFANSGYLRERFTRWIDEDDERTSAKGETGVQYVVLDMGAVGSIDTSGTSMLDELKKTLDRRGIQIVLANPGSEIMKKLDSSKVLELIGHEWIFPTVGEAVAECDFVLHSHKPGMVVDGASHENMV

SEQ ID NO: 3681 - DNA, 2030 bp, Triticum aestivum
  misc_feature (1)..(2030): Ceres cDNA ID no. 21665852
  misc_feature (1)..(2030): Ceres CLONE  ID no. 777537
  misc_feature (1)..(2030): Also known as  Ceres CDNA ID no. 24361266
atacgtagacgcagacgcaggcgcagagagaaagaaagagagaggaagctgtagccccctccttgtgtgtgcgtgtgtgtcgtccgccgtcggcgtctgtctccctcgagatgatgatgagcgaaggccagggacagcaggagatcatcagccagcagcatcagcaacagcaacagcaacagccgctggagatggacatcaccttcgggatgagcagccatcaacatcaccatgcccctccttcctcgtcctcctcctcctccatgcacgccgccgccgcgagcttcatgagcagcaaggaggcatcaggcgtgtatgaccatctgggggagctggaccaggcactgttcatgtacctcgaccacggccacgcctccacgcagcaagagcagcgccagaccctcaacatcttcccctcccagccgatgcatgtggagccatcaccaaagggggagcttggtctagtcctgtcgccagcgcccgtggggtcgaagatgccgtcgccggaccaccatcaccaccaccaccagcagcaggcagccgccgcggccatggaggagttggcggcggggagcaggaggcagcagcaggagcaccacctccacctgcagcaccagcagcaacaacccgccttcgccaccgccgagtccgcaggggtcagcaacaacaaggatgtcaagccgctgacaaagaaggagcacaagaggggcttatccaccggcgaacgcgacccaaaaacgctaaggaggctagcccagaacagggaggcggcgaggaagagcaggttgaggaagaaggcttacatccagcagctcgagtccagcaggatcaggctggctcagatcgagcaagaactccacagcgcaagagctcagggagtgctctaccccggcagcagcctcctcgccgagcaaggcatcgccggaaaaggtctcggcggcatcgatggcctcagctcagaggcggcgatgttcgacgtggagtacgcgcggtggcaggaggagcacaaccggctcatgtacgagctgcgggcggcgctgcagcagcacctgccggagggggagctgcagatgtacgtggagagctgcctggcgcaccacgacgaggtgctggccatcaaggacgccgtcatcaagggcgacgtcttccacctcatctccggcgtctggaggagccccgccgagcgctgcttcctctggctcggcggcttccgcccctccgaggtcatcaagatggtgctttcgcacgtggacccgctgacggagcagcagatcgtggcggtgtacgggctgcagcaatcggcggtgcagacggaggaggcgctgagccagggcctggacaccctctaccaggcgctctccgacaccgtcgtctccgacgcgctcacctgctgctccacccccaacgtctccaactacatgggccagatgggcctcgccgtccacaagctcaccaccctcgaaggcttcgtcagacaggcggagaagctgaggcagcagatgctccaccggctgcaccaggtgctgacggcgcggcagatggcgcggtcgctgctcgccgtctccgactacttccaccgcctccgcgtgctcagctccttctgggtcaaccgcaacaggatggcgccccaggaccagcagctggaggccggccctcacacctagctctcaatcttatcgatccaccaccatgcgtgcctgcgtgcgtgcgtgcatctcgctcatcctatgcatatgcatgcatgcatgcgccggcatgcatgtctctgagaaagttgaaggcagcgcgcggtgaccgtgcaagcttatattagcagtgcagagggggagacaagggaccgtatctgaatgataaccctctaacaaagaatgtcctaccgttgtgtcttggatttggatttattagtagtagcagctagatagtatggtccatcgactcatgtactcctggctgatcgacctgaactgattagcttgtcttgcctccggatgaatgtgattcgactctccatcacaaaaaaaaaaaaaaaa

SEQ ID NO: 3682 - protein, 2030 aa, Triticum aestivum
  misc_feature: PFam Name: bZIP_1; PFam Description: bZIP transcription factor
  misc_feature: PFam Name: FH2; PFam Description: Formin Homology 2 Domain
  misc_feature: GI Number: 62822992; NR Description: TGA10 transcription
  misc_feature: GI Number: 30681632; NR Description: bZIP family
  misc_feature: GI Number: 14329655; NR Description: bZIP transcription
  misc_feature: GI Number: 50899406; NR Description: putative bZIP transcription factor [Oryza sativa (japonica cultivar-group)] >gi|49387850|dbj|BAD26515.1| putative bZIP transcription factor
  misc_feature: GI Number: 9759540; NR Description: bZIP transcription
ATACGTAGACGCAGACGCAGGCGCAGAGAGAAAGAAAGAGAGAGGAAGCTGTAGCCCCCTCCTTGTGTGTGCGTGTGTGTCGTCCGCCGTCGGCGTCTGTCTCCCTCGAGATGATGATGAGCGAAGGCCAGGGACAGCAGGAGATCATCAGCCAGCAGCATCAGCAACAGCAACAGCAACAGCCGCTGGAGATGGACATCACCTTCGGGATGAGCAGCCATCAACATCACCATGCCCCTCCTTCCTCGTCCTCCTCCTCCTCCATGCACGCCGCCGCCGCGAGCTTCATGAGCAGCAAGGAGGCATCAGGCGTGTATGACCATCTGGGGGAGCTGGACCAGGCACTGTTCATGTACCTCGACCACGGCCACGCCTCCACGCAGCAAGAGCAGCGCCAGACCCTCAACATCTTCCCCTCCCAGCCGATGCATGTGGAGCCATCACCAAAGGGGGAGCTTGGTCTAGTCCTGTCGCCAGCGCCCGTGGGGTCGAAGATGCCGTCGCCGGACCACCATCACCACCACCACCAGCAGCAGGCAGCCGCCGCGGCCATGGAGGAGTTGGCGGCGGGGAGCAGGAGGCAGCAGCAGGAGCACCACCTCCACCTGCAGCACCAGCAGCAACAACCCGCCTTCGCCACCGCCGAGTCCGCAGGGGTCAGCAACAACAAGGATGTCAAGCCGCTGACAAAGAAGGAGCACAAGAGGGGCTTATCCACCGGCGAACGCGACCCAAAAACGCTAAGGAGGCTAGCCCAGAACAGGGAGGCGGCGAGGAAGAGCAGGTTGAGGAAGAAGGCTTACATCCAGCAGCTCGAGTCCAGCAGGATCAGGCTGGCTCAGATCGAGCAAGAACTCCACAGCGCAAGAGCTCAGGGAGTGCTCTACCCCGGCAGCAGCCTCCTCGCCGAGCAAGGCATCGCCGGAAAAGGTCTCGGCGGCATCGATGGCCTCAGCTCAGAGGCGGCGATGTTCGACGTGGAGTACGCGCGGTGGCAGGAGGAGCACAACCGGCTCATGTACGAGCTGCGGGCGGCGCTGCAGCAGCACCTGCCGGAGGGGGAGCTGCAGATGTACGTGGAGAGCTGCCTGGCGCACCACGACGAGGTGCTGGCCATCAAGGACGCCGTCATCAAGGGCGACGTCTTCCACCTCATCTCCGGCGTCTGGAGGAGCCCCGCCGAGCGCTGCTTCCTCTGGCTCGGCGGCTTCCGCCCCTCCGAGGTCATCAAGATGGTGCTTTCGCACGTGGACCCGCTGACGGAGCAGCAGATCGTGGCGGTGTACGGGCTGCAGCAATCGGCGGTGCAGACGGAGGAGGCGCTGAGCCAGGGCCTGGACACCCTCTACCAGGCGCTCTCCGACACCGTCGTCTCCGACGCGCTCACCTGCTGCTCCACCCCCAACGTCTCCAACTACATGGGCCAGATGGGCCTCGCCGTCCACAAGCTCACCACCCTCGAAGGCTTCGTCAGACAGGCGGAGAAGCTGAGGCAGCAGATGCTCCACCGGCTGCACCAGGTGCTGACGGCGCGGCAGATGGCGCGGTCGCTGCTCGCCGTCTCCGACTACTTCCACCGCCTCCGCGTGCTCAGCTCCTTCTGGGTCAACCGCAACAGGATGGCGCCCCAGGACCAGCAGCTGGAGGCCGGCCCTCACACCTAGCTCTCAATCTTATCGATCCACCACCATGCGTGCCTGCGTGCGTGCGTGCATCTCGCTCATCCTATGCATATGCATGCATGCATGCGCCGGCATGCATGTCTCTGAGAAAGTTGAAGGCAGCGCGCGGTGACCGTGCAAGCTTATATTAGCAGTGCAGAGGGGGAGACAAGGGACCGTATCTGAATGATAACCCTCTAACAAAGAATGTCCTACCGTTGTGTCTTGGATTTGGATTTATTAGTAGTAGCAGCTAGATAGTATGGTCCATCGACTCATGTACTCCTGGCTGATCGACCTGAACTGATTAGCTTGTCTTGCCTCCGGATGAATGTGATTCGACTCTCCATCACAAAAAAAAAAAAAAAA

SEQ ID NO: 3683 - DNA, 1230 bp, Triticum aestivum
  misc_feature (1)..(1230): Ceres cDNA ID no. 21665853
  misc_feature (1)..(1230): Ceres CLONE  ID no. 777725
  misc_feature (1)..(1230): Also known as  Ceres CDNA ID no. 24360344
ctactcctcccccacttttgacccagctccagagttccccacgaagcgagcgtgcgcgacctgaccgaattccccctcccccgccccaccccaaaccctagcccgcccgcccgcccgccgggcccccggcgccgatgccgaggcggctcctggagggcgccatggcgctggcggtgacgccggacgccgccaactcgtcgggctccggcgccgcccccgggtcggggcccctgtggtgggtgtccgactgccacggggcctggtacagcctggcggtgatgctgccgtcgctggccttcgtcgggttcctggcgtggcaggcccgccgcagcttccgccggctcagctacggccgctcccacgtcgtcgtcgtcgcctactacgcgctcctctgggccgtcgccctcctcaacctcctctggtgcttcctccaggcgtggcagtgtatgcctgatagggccttctcatggaatgtgctttcattgtttaccaaatctggaatgttattcttggaagttagtcttatagcatttctacttcaaggaaatgaagccagtggttatgagtctctgggacgtacctttgttatctctggtgctgtagttagtgctgatgtattgctcaagaccatatatgtattcggatttggtgttcctttgtttatcgatgctgaccaaggaactggtgggaaatggggcctatggattatccacaaattggtgcttactggagtctatggcttgattgttttcatgcatcactcaaggtggaaagacaggctacctgcaaaaccagcatattaccagtatgtgtgtgcaatgctggcacttaacggcctatcgctgtttggctgtttcctcattgcatgtggagctggatttggtttatggctgtataacctcacaactgtctgttaccatgcgctttaccttccacttctgtatgtgactttcttagcagactttttccaggaggaagatatgcttctagagaatgtatactactccgagatgaaagacgccgggttctttgatgctgactgggattaaacctgcctgcagattccgttccacgctgtatgacttattcgtatgtgaatttgcacggagtagcttcatcctggaaactgaatgaatcttagaacagagattgtaccctaacaagcaacaaccattataattaatgaaaatgtgtaaatttattgatacacacacaaaaaaaaaaaaaaaa

SEQ ID NO: 3684 - protein, 304 aa, Triticum aestivum
MPRRLLEGAMALAVTPDAANSSGSGAAPGSGPLWWVSDCHGAWYSLAVMLPSLAFVGFLAWQARRSFRRLSYGRSHVVVVAYYALLWAVALLNLLWCFLQAWQCMPDRAFSWNVLSLFTKSGMLFLEVSLIAFLLQGNEASGYESLGRTFVISGAVVSADVLLKTIYVFGFGVPLFIDADQGTGGKWGLWIIHKLVLTGVYGLIVFMHHSRWKDRLPAKPAYYQYVCAMLALNGLSLFGCFLIACGAGFGLWLYNLTTVCYHALYLPLLYVTFLADFFQEEDMLLENVYYSEMKDAGFFDADWD

SEQ ID NO: 3685 - DNA, 2194 bp, Triticum aestivum
  misc_feature (1)..(2194): Ceres cDNA ID no. 21665854
  misc_feature (1)..(2194): Ceres CLONE  ID no. 777959
  misc_feature (1)..(2194): Also known as  Ceres CDNA ID no. 24356861
acaacggccaccgtgctcttcgcctcatcccgatctactccgcgccttcgaccccgccccgtcccgtgtaccgcgtagcctctccccaatggcgagcgccgcctcctcatcctcctcctcctcgcagccagtgcgcgtcgtgctgcgggtgcgcccgctcctcccctcggaggccagctcggcagcggtgcccccctgcgtctccctcatcggcgaccaccccggcggcgaggtcaccgtccagctcaaggatcagcacaccagccggagcgagtgctacaaggtggacgcctacttcggcaaggaggacagggtctccgacgtattcgaccaggaggtcagcgccctgatcccgggcatcttcgagggcatcaacgcgaccgtgtttgcctatggggcaacgggcagcggcaagacctacaccatgcagggcagcgaagatctgccgggtctcatccccttgtcggtcgcgacgatcctggcgcgctgtaccggcacgtggtgctccgtcgagatctcatactacgaggtgtacatggaacggtgctatgacttgctcgagcccaaggcgaaggagatcatggcactggatgacaaatttggtaacctgcagctcaagggcttggcttgggtccccgtgcgatccatggaggagtttcaggaagtctactcgataggtgtgcagaggaggaaagccgcccacacaggcctgaacgatgtttcaagtagaagccacgctgtggtttctataagggtcagtaatgatactgtcaaagggaagcttaacctcatcgaccttgctggaaatgaggacaatagaagggcttgcaatgaagggatccgccttcaagaaagctctaaaatcaattcatcgctgtttgcattgtctaatgtcatttcatctctcaaaaacaatgagtcacgggtaccttatagagagagtagattgacccgcattctgcaagattctctaggaggcaatagccgtgctgtgatgatagcttgcctgaatcctgtggtataccaggaggcagtccacacaataggtatggctgctcgttcaggacatatggtgaccaacatggcttcagcaagcaaggaacacactccaaaagtaaaggtggacatggaagcaaaattgcagttgtggctggaatcaagggggaaaactaagagcacccaaagaatgaatggacttttctccccaaccggatggaggactccttcttccatgagccatgtgaaacaaccgctatctgcccgggtgtctggaagagctaaagcaacggaccaagacggtgctaagataaaaaaggtgctttttgattcagcagtccatacagcagttgaaaacacaccaaagccaagctcacgagatgaagcaaagacaactaagaaagaggtacccccttcgttaacaccttgcaaagaggacaagtctgaatctccttttaggaaagctctttctcccattcctccaaacatgatgactccttgtaatgtcaattaccctccattggagcccaaaactccaataggagcatgtcacatagttgagaagaatccagatggtacacctcttgataagtttaatgcacttggatctaacctaaaggaatctcttattcaacaatatctcgagttcttaaatgttgcgaacaaggaagagctacagcaactaaaaggaattggtgaaaagagagcggagtacattcttgagctccgggaggattcgcccagaccattccaatctctttcggacttggggaatataggtctatcaacgaaacaaatccaagacatcctgcggaaaacagccacaggaatcttcaaatgatcactggaatggactcttgcctgaaaacacagaatggactgccgtttctaccaccttggagatgctgggtcatattgttcaccatctgtgacccaatggatggggttgtacctgtactgtgaactgtcagcctgtcgttgacatagttgtagttgtactattaacagtcggcctgctgctgatgctattgctagggcaatgggtcttgttgcaattttctcttgtaattttccctttgcaaattttctcttgtaatttgtcttcctgaatggtttgtcttcttgatgtgatgcaaattttctctggaatctgatatattgaatggcttgcatattagcttcaaaaaaaaaaaaaaaa

SEQ ID NO: 3686 - protein, 582 aa, Triticum aestivum
  misc_feature: PFam Name: Kinesin; PFam Description: Kinesin motor domain
  misc_feature: GI Number: 30679610; NR Description: kinesin motor
  misc_feature: GI Number: 22531028; NR Description: kinesin-like protein
  misc_feature: GI Number: 50931669; NR Description: putative kinesin-like DNA binding protein [Oryza sativa (japonica cultivar-group)] >gi|47900315|gb|AAT39162.1| putative kinesin-like DNA binding
  misc_feature: GI Number: 7406433; NR Description: kinesin-like protein [Arabidopsis thaliana] >gi|11358476|pir||T48258 kinesin-like
  misc_feature: GI Number: 9049953; NR Description: chromokinesin Xkid
MASAASSSSSSSQPVRVVLRVRPLLPSEASSAAVPPCVSLIGDHPGGEVTVQLKDQHTSRSECYKVDAYFGKEDRVSDVFDQEVSALIPGIFEGINATVFAYGATGSGKTYTMQGSEDLPGLIPLSVATILARCTGTWCSVEISYYEVYMERCYDLLEPKAKEIMALDDKFGNLQLKGLAWVPVRSMEEFQEVYSIGVQRRKAAHTGLNDVSSRSHAVVSIRVSNDTVKGKLNLIDLAGNEDNRRACNEGIRLQESSKINSSLFALSNVISSLKNNESRVPYRESRLTRILQDSLGGNSRAVMIACLNPVVYQEAVHTIGMAARSGHMVTNMASASKEHTPKVKVDMEAKLQLWLESRGKTKSTQRMNGLFSPTGWRTPSSMSHVKQPLSARVSGRAKATDQDGAKIKKVLFDSAVHTAVENTPKPSSRDEAKTTKKEVPPSLTPCKEDKSESPFRKALSPIPPNMMTPCNVNYPPLEPKTPIGACHIVEKNPDGTPLDKFNALGSNLKESLIQQYLEFLNVANKEELQQLKGIGEKRAEYILELREDSPRPFQSLSDLGNIGLSTKQIQDILRKTATGIFK

SEQ ID NO: 3687 - DNA, 1710 bp, Triticum aestivum
  misc_feature (1)..(1710): Ceres cDNA ID no. 21665855
  misc_feature (1)..(1710): Ceres CLONE  ID no. 778163
  misc_feature (1)..(1710): Also known as  Ceres CDNA ID no. 0
aaaagttttgactttgttcaatacaaattagctgccccggttgcttcttctcgttagtttccagatcgcctcagcagcagcagcagtagctagcgatgaagcccttctcggggagcacggagagatgcgcccggacattctacgtcgcggtgctcctctccgtcgtcctttgggccctcatattctactccaccagcttgctgcaatccggcgatgctctcagcaagccgccggccttcttctcgccccgctctggccgtccggacccgtcgtgcgccggccggtacgtgtacatgtacgacctgccgccccggttcaacgccgacctcgcccgcgactgccgcaggctctcggcgtccaccgacatgtgcaggcacgtggtcaacgacgggttcggctcgtcgttcaccgacggagccggcggctcgctccccgagagcggagcctacgccaccgaccagtacatgctggagttgatcttccacgcccggatgaggcagtacgagtgcctcacgtccgaccccgccgccgccgccgcggtctacgtcccgttctacgccgagttcgacctggcgatgcgcatcgacaacagcaacatgtcggcgcggaacgcgctgccgcgggacatggcggactggctggtgcggcggcccgagtggcgcgccatggggggccgcgaccacttcatggtagccagccggcccacatgggacttgctctgcgaccccaaccatggcggatatggcaactccctcatgacctacccggccatccgcaacatgacggtgctcgccttcgaggccagcccgtggcagggcaacgacttcgccgtgccgtacccgtcgcacttccacccttcctccgacgcccaggtcgtggcctggcagagccgcatgcgcgggctggagcgccggcggctatggtgcttcgccggcgggtcccgccatgagagcaggaagaccgggcgcaaccagatcatcgagcagtgcggcaggtcgagccgctgcgccttgctcggcaaagcagcggtgaccaagagcccgggggagtacacccagggggagtactcgccgagccatgccatgcggctgctggagagcgccgagttctgcatacagccgcgcggagactcgtacacgcgcaagtccatcttcgacaccatcctcgccggctgcatcccggtcttcctccacccgatctcggcgtacgtccagtacacgtggtacctgcccagggactacagggcctactcggtgttcatcccccagcgcgacgtgatcggccggaacgcgagcatcgaggaggtgctgaggaagataccgccggcgaaggtggcgcggatgcgggaggaggtcatccggctcataccggccgtgatgtacagggagccggcggcaaagggcgtccagttcaaggacgcgttcgacgtcgccgtggaacgggtcgtcgaccgggtggccaagcgccgacgcgccgcggccgagggccgggagtgccgggacagcgtcgacgggtacgatagctggaagtacaacttgcttgaggatggccagacagaaataggtccgcacgagtttgatccatacatgtccatgtaaactactggagattacttgtccgcacgagtttgatccatctgtctggaaaatacccgaaagttcagctagaaagctacggagtgtatttttccagctaaaaaaaaaaaaaaaa

SEQ ID NO: 3688 - protein, 500 aa, Triticum aestivum
MKPFSGSTERCARTFYVAVLLSVVLWALIFYSTSLLQSGDALSKPPAFFSPRSGRPDPSCAGRYVYMYDLPPRFNADLARDCRRLSASTDMCRHVVNDGFGSSFTDGAGGSLPESGAYATDQYMLELIFHARMRQYECLTSDPAAAAAVYVPFYAEFDLAMRIDNSNMSARNALPRDMADWLVRRPEWRAMGGRDHFMVASRPTWDLLCDPNHGGYGNSLMTYPAIRNMTVLAFEASPWQGNDFAVPYPSHFHPSSDAQVVAWQSRMRGLERRRLWCFAGGSRHESRKTGRNQIIEQCGRSSRCALLGKAAVTKSPGEYTQGEYSPSHAMRLLESAEFCIQPRGDSYTRKSIFDTILAGCIPVFLHPISAYVQYTWYLPRDYRAYSVFIPQRDVIGRNASIEEVLRKIPPAKVARMREEVIRLIPAVMYREPAAKGVQFKDAFDVAVERVVDRVAKRRRAAAEGRECRDSVDGYDSWKYNLLEDGQTEIGPHEFDPYMSM

SEQ ID NO: 3689 - DNA, 1423 bp, Triticum aestivum
  misc_feature (1)..(1423): Ceres cDNA ID no. 21665856
  misc_feature (1)..(1423): Ceres CLONE  ID no. 778173
  misc_feature (1)..(1423): Also known as  Ceres CDNA ID no. 24357147
aaagtgttcccgtctcgggtctcaaccccagtaggcagagcgccagagccaccgcgccatggaggacggggcttcggatttcagcgactgggaggtgctatctgcatcctcgggggtcggaggcgatgacgccgtccttgtgtccggggaaggcggcgacgtcctccacgaccacttcgccctcgactcctcttcctccactggcttctccggcgagggctcgtggtcggaggctgcctccgacgacgtggaaattgaatccgggttaggatcagtggacagatttggttctgctatgcaagagcagacggatcttattggggtggtggattccagcgcacagttgcaattaggctggattgatgtgactgcacaagcctcgccggtttttggagcctccgtggcatgtggtggggacgcacatgagaagcaaactgcggggttaagttgtggtgagcttgattggattccgcaagccgcgcttcaagggttggagggaattttggactccgatgcaactgcggtcgccggtgtaagactccagatagaaatatcagagaagtctagtttgcaattggaagatggaggggctgatgcccttagcgaaagctctgttcttcaagatgctgcaacaagcgatgcaatgcagactctgcaggaagagccggagcaagggaaggatgctagtgccgcttctggttgtgctgaacctggtggcgatgacaaggatggttcttcccctctggttgcagctgcagctccggtcaccggtgatggagagaggcaagtggttgtatggtggaggctgccgttcaggttcatccattattgtgcttggaaagtgagtccggtttggccgatttccatcgctgcagcgttgctggggatagttgtgctcgggaggaggatgtataggatgaggcgcaagacccagggccttccccagattaagatcgcatttgatgataagagggcctcccagtttgcagaccgcgcagcacgtctcaacgaggccttcttgatcgcaaaacgtgtacccgctctgagaactttgtctggtgctgcactcccctggtcaatgatgcaagagagatgagccagccttcttgaagcttcataagaagatatccctgttggattagccaacaggaatgtatgataaaacaaaattttaataagaacatcaatctggattgggcatatcttggtggtgttttcctggtgaagcatcgaggatgttgatgtctatgtcgatgcctaatcagatatatttactattagcctactgcacaacagtttttgtcttatgtttttctattcatgtttggtaggttttataaatctgtatgagtcctaaatgtgccattactctggacatatgttttatctacgtgggtgctttaaaataaaaaaaaaaaaaaaa

SEQ ID NO: 3690 - protein, 345 aa, Triticum aestivum
  misc_feature: GI Number: 21536807; NR Description: unknown [Arabidopsis thaliana]
MEDGASDFSDWEVLSASSGVGGDDAVLVSGEGGDVLHDHFALDSSSSTGFSGEGSWSEAASDDVEIESGLGSVDRFGSAMQEQTDLIGVVDSSAQLQLGWIDVTAQASPVFGASVACGGDAHEKQTAGLSCGELDWIPQAALQGLEGILDSDATAVAGVRLQIEISEKSSLQLEDGGADALSESSVLQDAATSDAMQTLQEEPEQGKDASAASGCAEPGGDDKDGSSPLVAAAAPVTGDGERQVVVWWRLPFRFIHYCAWKVSPVWPISIAAALLGIVVLGRRMYRMRRKTQGLPQIKIAFDDKRASQFADRAARLNEAFLIAKRVPALRTLSGAALPWSMMQER

SEQ ID NO: 3691 - DNA, 1732 bp, Triticum aestivum
  misc_feature (1)..(1732): Ceres cDNA ID no. 21665857
  misc_feature (1)..(1732): Ceres CLONE  ID no. 778590
  misc_feature (1)..(1732): Also known as  Ceres CDNA ID no. 24356877
atcccatccctcgcccggccgcccagttcacactcctgcgcctcgagcgcgactcgcctcagcgctcagctcagatcgccgcaccaatcctcggcgaaggagcttttcgtgtgatatttgcggtatgtgctgcgcaatcttcgtttacacgctgtggtgaagcaccaaatttgtgcttgctgtgcttataatagacagagaaaatcccaacggtttcctcgggccaccgaagcttccgatttcgtctgttggagatatctttgagccaaaaactcttcagatatcttggaatacctacaatggcagcaacataccctatgcctgatccaccggtgctgaacaactatgctattactcaaagattcgacaactctgctacagagacagccggcagagacaagtccataggctacctggacatctttgtccaccaggcgcgcgacatccacaatgtttgcatctaccaaaagcaggacgtttatgcaaagctgagcctcacaagcgacccacaggtgtcgtgctcgaccaaggtgatcaatgggggtggccagaacccgttgttcgacgagggtctacggctagacgtgcgcagcgtggaggcatcgctgaggtgcgaggtgtggatgctgagcagggtgaggaactacctggaggaccagcttctcggcttcaccctcgttcctctgtcagacatccttctggccgatggaaatctggcccaggagttctccatgtcgtcctccgatctgctccactcgccggccggttttgtgcgcctgtccctgtcttatgtcggtagctctccggacgtcatcgagatctcatcgctcaataaatcggcgtcggcggtcaccgactgtggaaatggcagcctggatccttgtgagatcgaaaagatggagttcccagacctgaacatggtgaacgagaatgaaatgatggtctccaagtatttcgagatggactgtgacagtgcagcaaaggctgagacctgcaagttaccacagcatgatgcagatgagcctggtcctgaggtctctaagatcactcccaaggactatcctgacgaaagccctgtgagctgtgtctcgaccacaggctcctccccggagctgtcccccatgacgcaatcggtctctgagccgtccgagaccgccgtcgcggcggcatcctccaccggaagccagagggagaagagccagggtgttactaccgatggcgaggccgattcttctgaggcgccatccaaggatgaggttgcccagcctgcagtgatcaccgtgaacctccagcccagggaatcagttgtccagcaggacatagttgacatgtacatgaagagcatgcagcagttcactgactcccttgcgaagatgaagctcccgctggatgtcgagaacggtagcccctcggttgataacatcgactcgagtacaactgagaaaccgtcgccatcgccgtcgtccaagggtcctagggtcttctatggaagcagagccttcttctaagttgctgctactgctgctagctaggctggctcatacatactctgtttgcctcactaaggaggctagactctcactgtaaacttgtattgctaatggtgttatgcttagttaaaaagatggatatttttcataataattccagagctgtagattcagcttgtgtaacatagtatactactgcatggaagtaacttgatgatactttctgaaaaaaaaaaaaaaaa

SEQ ID NO: 3692 - protein, 402 aa, Triticum aestivum
  misc_feature: PFam Name: C2; PFam Description: C2 domain
  misc_feature: GI Number: 42573680; NR Description: C2 domain-containing protein [Arabidopsis thaliana] >gi|30696612|ref|NP_200364.2| C2 domain-containing protein [Arabidopsis thaliana] >gi|42573678|ref|NP_974935.1| C2 domain-containing protein
  misc_feature: GI Number: 21593485; NR Description: unknown [Arabidopsis thaliana]
  misc_feature: GI Number: 34906644; NR Description: P0431G06.18 [Oryza sativa (japonica cultivar-group)] >gi|15528811|dbj|BAB64706.1|
MAATYPMPDPPVLNNYAITQRFDNSATETAGRDKSIGYLDIFVHQARDIHNVCIYQKQDVYAKLSLTSDPQVSCSTKVINGGGQNPLFDEGLRLDVRSVEASLRCEVWMLSRVRNYLEDQLLGFTLVPLSDILLADGNLAQEFSMSSSDLLHSPAGFVRLSLSYVGSSPDVIEISSLNKSASAVTDCGNGSLDPCEIEKMEFPDLNMVNENEMMVSKYFEMDCDSAAKAETCKLPQHDADEPGPEVSKITPKDYPDESPVSCVSTTGSSPELSPMTQSVSEPSETAVAAASSTGSQREKSQGVTTDGEADSSEAPSKDEVAQPAVITVNLQPRESVVQQDIVDMYMKSMQQFTDSLAKMKLPLDVENGSPSVDNIDSSTTEKPSPSPSSKGPRVFYGSRAFF

SEQ ID NO: 3693 - DNA, 1726 bp, Triticum aestivum
  misc_feature (1)..(1726): Ceres cDNA ID no. 21665858
  misc_feature (1)..(1726): Ceres CLONE  ID no. 778988
  misc_feature (1)..(1726): Also known as  Ceres CDNA ID no. 23482522
gtgttccactaaaaaaaaaaaggcagagcagaccctaccttaacttccacacagcagcggcggcggcggcggcggtacgattagcttcctcgccggcgcgatcgacgccgactccgccaccagcctatgacatctggtgcccacctctgagatccggaccgatggcggagacgcagccgcgctcgccgccgccgtcgtggtcggccatcccgctggacctggcgagcctggtgctccgcctcctccccgcgtacgccgaccgcgcccgcttcgccgccgtgtgcccgcagtggcgcgacgtcgcgcaacagttcctccgcctgcacccgccgctgccgctgctcgcgctcccggacggcaccttctacagcctcccctacgccaagcccttccgcttcccgggattcggcttcgccgggtaccagggcgtctgcggcagctggctcgtcttcccgcgcgacgacgagtgcttcctgcatgacccgttcgccagggccaccgtcaggctacctcctctctcccgcgtccggctgcgtccttcaaacgcagtccagaaatggacaaaatgggaagacggggagcgctcccccgacccttacaccacatggatgcatatagaggacatggaagggaagctgcgcatgagcaagataatattgtgctcccccaaccttgttgctgcgctggtcggtgttggaagaccctgtcaccttccaatatgccatccaggaggccccagtcagattctaatgtgccagccgggggcctcgtcgtggtcagtacgcgcctacgacaagtgtaggctttatgaagacatggcgttctaccagggcaagctctatgccattgccaatgatgagaacctctttgtggtgaacatcagccaggaccaatgcaccggggatccacaggtttctcgagttggacaggtcatcaagggtgatccctggcagacagttgcgtctgaagacgacaacacgcccggcaagaagctctacctggttgaatcacgcggtaaattgctgatggtatgcaggaagatttgggttcctgaacttgaagacggagatttttctttcgggaatgagtttgaggtattcgaggctgactttgagcattcacggtgggtgaaggtgacaactgtgggggatgaccaggttctgtttcttgggagaaggtgctccagggctgtctctgtgtctcagtatgggttgccgggtgatcgcatctttttcttggatgatgacgaagtgaatcgtgtgaaatacggctatgatgagaacaccttttgcagtgcctataacatgagagacggcaaggtctcttcccctcatccaatgatctcctggaaacgttgtgatgagatgtgtcttgcagcatggctcttccctcaggactgaatcactgaagtgaagatgttattgctgttccagctgcttccaacttggtatggtgatcagtagttaccaagcaaataaattgccttagtatgtatccagtttgaccaccttatttatctgaacttacatggtggttactatggtgcaagttgttagcttaattggtttaccgtgcctgggaaagatcctaaactgcatgactgtttatctgtcaattgtcttagcagggtgatctctgaccttttgtagtggctgtagagttgattgttcatactgaagtttggtgaacctactgctgccttttgcgactaaaaaaaaaaaaaaaa

SEQ ID NO: 3694 - protein, 412 aa, Triticum aestivum
  misc_feature: PFam Name: F-box; PFam Description: F-box domain
  misc_feature: PFam Name: Cupin_1; PFam Description: Cupin
  misc_feature: GI Number: 62701659; NR Description: F-box domain, putative
  misc_feature: GI Number: 62701660; NR Description: F-box domain, putative
  misc_feature: GI Number: 22287; NR Description: vicilin-like embryo storage protein [Zea mays] >gi|100935|pir||S21825 vicilin-like storage
MAETQPRSPPPSWSAIPLDLASLVLRLLPAYADRARFAAVCPQWRDVAQQFLRLHPPLPLLALPDGTFYSLPYAKPFRFPGFGFAGYQGVCGSWLVFPRDDECFLHDPFARATVRLPPLSRVRLRPSNAVQKWTKWEDGERSPDPYTTWMHIEDMEGKLRMSKIILCSPNLVAALVGVGRPCHLPICHPGGPSQILMCQPGASSWSVRAYDKCRLYEDMAFYQGKLYAIANDENLFVVNISQDQCTGDPQVSRVGQVIKGDPWQTVASEDDNTPGKKLYLVESRGKLLMVCRKIWVPELEDGDFSFGNEFEVFEADFEHSRWVKVTTVGDDQVLFLGRRCSRAVSVSQYGLPGDRIFFLDDDEVNRVKYGYDENTFCSAYNMRDGKVSSPHPMISWKRCDEMCLAAWLFPQD

SEQ ID NO: 3695 - DNA, 2290 bp, Triticum aestivum
  misc_feature (1)..(2290): Ceres cDNA ID no. 21665859
  misc_feature (1)..(2290): Ceres CLONE  ID no. 779032
  misc_feature (1)..(2290): Also known as  Ceres CDNA ID no. 24361395
cccgattccaattccaccacctctccggcgcggggccgggcggaccggagcgggcgaggcggccagggtttcccacgccccaccgccgccgccgccgcattccgtcgaccgcatggctctcgtgcccagcggcgacgaccaggccgcggcctgcaaggccaccatcccctggtccgagatgttccgctccgcctccgtccgccgcccaaagcaggcggaggacccgcccaagcccgcgcccacgccaacggggaagaaggcggcgccgccggccgaggccgaggggctgtccctcgagccggacgcgcggctggcgctctacatcgccatggcgcacgcggggctcgccacggcgctgctcgtgctctacggcctctacatgctgctcgccgacttcctccgcccgctgcagtgggcgctgctctgctccgtcccgctccgcgagacgcagcacgcgctcgtcgccttctgggagccgccgctccgcggcgggttcagcgccaccgtgctcgcgctcccgctcgcagctctgcgctcctgcgcggccaccctcgccgacgcgcgcgccgcgctgctacgccgcccgctgccgccgtcgccgtccttcccgcgcctgctgcgctggctcgcctcatccttcttcttcctcctcctgctcgagcgcctcggcaccgccgcggcgctgctcctcctcggcttctccctcgccttctacgccgcctctcccaagccctcctctttcatcccccgtgccgcctcctcccgcatctccggtcgaacaccatcatcccgcggactcctcctcaccggcggcatcctccgccaccttaggaccctcgtcgccgttggcctcatgcttggcatgattgctggcttcctagggggcagcgtcttcttctcctacaagatcggcctcgagggcaaggatgccgtcatgtccctcaagtcccatgtcgaaaatggcaactactccgaaaagattggcctcaagaagttgcttgacgacaatgacatcccgggcttggtggagcagtactcagggaagctcgtcgaaaccgtttgggagcaggtagaccaattggctgtacaatacaaccttactgatttcactagtggattcaagcacttcttgatcagccaatcagtcccatctggtgccaagagcaaggagctcatcacttctagaccgcacccgtactcgctaaagctgcaggccattacgctgcgtgtgaagaacagggagtggttggagatctacagggagctggactcattcttcagggagctgttaatcacaagggaggatctagtggtgaaggccaaggacctggctttgcagggcacagagattgcaaagagtctgctatctagcggcacctctgtgctcggtggtagtgccaatttgatgctatccattgctctccgcattctctccggtgcagcagaggtgctcaattttgtgtcacagctgatggtctttatgtgggtgctgtactacctcatcactgttgagggtagcggggcaacggagcaggtcattgacctcttaccggtgtccaaacaagtaaaggagcgttgcgtcgaggttatagaccatgccattagcagtgtcttgttagccactgccaagattgctatattccaaggatgcctgacatggctgttgctcaagttcttcaaggtgcattttgtgtacacagcaactgtgtttacaatcatcagtgcactttttccaatactaccagcatggctgtcctcggtatttgccgcagcacaactgctgacggaagggagatatgtccttgcggttatggttacagtgatacacctcgtgatcatggattatggaaccacggtcattcaggaggatatacctggctacaatgggtatctgactggccttagcataatcggtggcatgacattatttcccaatgctctcgagggtgcaatattaggcccccttattatgacggttgtgatagcattgaagaacctgtacacagagtttgtgcttgctgatacagaggagatgagcagctagcattggatggaaggcaacatgttcgaagagaatacatgcgtaggacctttactctgcatttccatgttgccttttcccttgtaacatacccgggtatacaagatattgcatcagctgtgattcattcctccttgttgtaatttgccctctttgtagtgcaacttaatgtctatcggattttccgatagatctggttttgatatgcatgggattggccctctgtttgattgaaaaaaaaaaaaaaaa

SEQ ID NO: 3696 - protein, 643 aa, Triticum aestivum
  misc_feature: PFam Name: UPF0118; PFam Description: Domain of unknown
  misc_feature: PFam Name: Pyr_redox_2; PFam Description: Pyridine
  misc_feature: GI Number: 40225713; NR Description: C9orf5 protein [Homo sapiens]
  misc_feature: GI Number: 31205487; NR Description: ENSANGP00000014910 [Anopheles gambiae] >gi|21295259|gb|EAA07404.1| ENSANGP00000014910
  misc_feature: GI Number: 50736085; NR Description: PREDICTED: similar to
  misc_feature: GI Number: 34868418; NR Description: similar to chromosome 9
  misc_feature: GI Number: 62649012; NR Description: PREDICTED: similar to
MALVPSGDDQAAACKATIPWSEMFRSASVRRPKQAEDPPKPAPTPTGKKAAPPAEAEGLSLEPDARLALYIAMAHAGLATALLVLYGLYMLLADFLRPLQWALLCSVPLRETQHALVAFWEPPLRGGFSATVLALPLAALRSCAATLADARAALLRRPLPPSPSFPRLLRWLASSFFFLLLLERLGTAAALLLLGFSLAFYAASPKPSSFIPRAASSRISGRTPSSRGLLLTGGILRHLRTLVAVGLMLGMIAGFLGGSVFFSYKIGLEGKDAVMSLKSHVENGNYSEKIGLKKLLDDNDIPGLVEQYSGKLVETVWEQVDQLAVQYNLTDFTSGFKHFLISQSVPSGAKSKELITSRPHPYSLKLQAITLRVKNREWLEIYRELDSFFRELLITREDLVVKAKDLALQGTEIAKSLLSSGTSVLGGSANLMLSIALRILSGAAEVLNFVSQLMVFMWVLYYLITVEGSGATEQVIDLLPVSKQVKERCVEVIDHAISSVLLATAKIAIFQGCLTWLLLKFFKVHFVYTATVFTIISALFPILPAWLSSVFAAAQLLTEGRYVLAVMVTVIHLVIMDYGTTVIQEDIPGYNGYLTGLSIIGGMTLFPNALEGAILGPLIMTVVIALKNLYTEFVLADTEEMSS

SEQ ID NO: 3697 - DNA, 1978 bp, Triticum aestivum
  misc_feature (1)..(1978): Ceres cDNA ID no. 21665860
  misc_feature (1)..(1978): Ceres CLONE  ID no. 779076
  misc_feature (1)..(1978): Also known as  Ceres CDNA ID no. 24357040
aatttggattccgtcaaaaagaaaacatcgccgccgccgccgccgccgacgacgccgacgccggtacgtgctcgtgcctgtccgcctcctccgcccctcgcagagccccctgtccccttctccccgcacggctcgccaggcgcaccgacacgcctccagtcccctcccctcccccggcgcaggccggagcagcccgccgcctcccatcttctccggctggaacagcgataatccaggacggccaccaaggttgatgcggagatgatctcgtcgtgccccatctgcggccaccaagtcctgacggccgagctcgaacggcacgcgaacagccacttcgatgatgatgaggttcagagggacatggagttggcgcagctagcgatggcagcagaattgagcactagtactgtcgtggatgtacctcaacatagcaagcggccgttccctaatgacgattctcttgctcaaggggcctcatcaagcatcgtcagaggcccatctccttatgaaaatgtactgtatgaacaaatttcttgcttggtcggagcacaggttagaagcaaaattcaacgaattgaagctggcgttatgaacttgttgaggagctgccttgaatctgaaggcggctcatcaacaagtataatatcaggccatgttgaccatcatcagagtctttcatcagaagacaagggatggggatgtgggtggagaaatatccagatgatgagctctcatttgttgaggcaaagaccagaaacgagggaggttctgtttggcggctgtggatttgttcctgacatcccttcacttcagagatggcttgagattgcttgggataaaggttttgatgctgttggtgcacgtcatttcgatagcaaaatttatggtgtcaagaagtggataggaacatcagaatgtgttaccctcttgcgctcttttggtgtgcgtgcaaggattgtagattttgatagcaccgaatcatcgagcctgcaaggtaagagcgggaaacgagtatgtgggcccatggataagtatttgatcaagactaatcctcttccaagatcatcgtctcttgaacttagtcaagaggatgctgaaaacatgagaggccagcaggtccttgtcgactgggtatggaactacttttcaagcaagcgtgctgatgtgttacacaattcaaagaatgtcatcatcagcgataaaaccccattgtatttccaacatcaaggtcattcgaggactatagttgggattcaaaagcaaaagggtaaccgtggatctcaagaccgatataaccttttggttttagaccctggccatagaaccgctgatttggagaggtctcttacaaccaaaaaaggatggccgaggcttttgaaaagaggtgttcacactctcaggaaaccacaatatcagttgtgctacgtggatcctggaattgctaattcagaagaaacagagcagctcaagactattgacagtatcctgatcaggttctagaacgctcgtatgtgcaacggagtaggtggatcagaatcgacgatctacatgaaaaaaagagcctttgtccatgtattatgaatctgctggtgatctgttgcattggtgttctgtctcaaggcgttttcttgtcacttctgatggctccgtggcaacctccctggtgctcaaagggatgccctagctcccctcttgctccggattgttcagctggccgtcgatcaacttgttcttcgatgtatattacacagggtcccttggcgcctctacaaagaaactctgcttcaatgtggcttgccgcagttcgtgcaaaaaattagagcgatgattcggctagccctatatatagctcccatcacctgctgtatctccaacacaatttgtttgggatgtaacagtgacagtcttgtgttggttttacacacatgattttgcacatccattggaatttgttgcgccgctaaaaaaaaaaaaaaaa

SEQ ID NO: 3698 - protein, 412 aa, Triticum aestivum
  misc_feature: PFam Name: Extensin_2; PFam Description: Extensin-like region
  misc_feature: GI Number: 62857679; NR Description: LOC549978 [Xenopus tropicalis]
  misc_feature: GI Number: 58476193; NR Description: Unknown (protein for
  misc_feature: GI Number: 31232034; NR Description: ENSANGP00000021020 [Anopheles gambiae] >gi|21302347|gb|EAA14492.1| ENSANGP00000021020
  misc_feature: GI Number: 50744550; NR Description: PREDICTED: similar to
  misc_feature: GI Number: 49899777; NR Description: MGC83919 protein
MISSCPICGHQVLTAELERHANSHFDDDEVQRDMELAQLAMAAELSTSTVVDVPQHSKRPFPNDDSLAQGASSSIVRGPSPYENVLYEQISCLVGAQVRSKIQRIEAGVMNLLRSCLESEGGSSTSIISGHVDHHQSLSSEDKGWGCGWRNIQMMSSHLLRQRPETREVLFGGCGFVPDIPSLQRWLEIAWDKGFDAVGARHFDSKIYGVKKWIGTSECVTLLRSFGVRARIVDFDSTESSSLQGKSGKRVCGPMDKYLIKTNPLPRSSSLELSQEDAENMRGQQVLVDWVWNYFSSKRADVLHNSKNVIISDKTPLYFQHQGHSRTIVGIQKQKGNRGSQDRYNLLVLDPGHRTADLERSLTTKKGWPRLLKRGVHTLRKPQYQLCYVDPGIANSEETEQLKTIDSILIRF

SEQ ID NO: 3699 - DNA, 1628 bp, Triticum aestivum
  misc_feature (1)..(1628): Ceres cDNA ID no. 21665861
  misc_feature (1)..(1628): Ceres CLONE  ID no. 779094
  misc_feature (1)..(1628): Also known as  Ceres CDNA ID no. 24357029
aacatcggcgttcggcgacctccattgtcgcgtggagctggacaagtcaagcctgtacctaaaagggttttcctcgtgcggtacatccaacaagcgcaggcatggaggagagaccaatggcctcttccacttcctgcaaaggctctgaccacgacgacaagagcaaggagcacaagtgcgagctgatcggctatgaggcgctgccggagtggctcaaggacaacgagtacatccacggctactaccggtgcgagtggccgttgaaggagaccatcctcagcatcttctccatccacaacgagaccctcaacgtctggtcgcatttggtaggattcctgctgttcctgtgcttgacgatcctcacggcaatggtgatcccacgggactgcagcattagcggtggcgggaacacgtttgacgacgcgccattgacgaggagctactggggagatctgatggcgatggccaacatgacaggggcgctgaagcatgaggcagccgcctgcctcctcctgcctccagctgccgcagatttgtctggaaacgaggaggagatcccgaacagctgtccacccaacacatcctcctcgccctctcatcaccatgttgcgctgatccaggacgcgagcgcggcgccacgggccgcggacgctgcctccgccgatccgatcacgcggtggccgatgttcgcgtacctgtgcggagccatggtgtgcctgcttacgagcagcgcgtgccacctggtgctgtgccactcggagagaatggcgtacgtgacgctccggctggactacgccggcatcgccgccctcatcgtcacctccttctacccggtcgtctactactccttcctctgccacccggggctccagcggctctacataggcttcatcaccgccttcggcgccgcggcggtcacggtgtcgctggtgccggtgttccaggcgcccgagttccgcccgctccgcgccgggctcttctcgtgcatgggcgtgtcggggctcatccccgtcgcgcacaagctcgtgctgtacggcggccggcgggaggccgccgtgacggcgtgctacgaggcgctcatgggcgcgctctacgggctcggcgccgccgtctacgcggcgcgcgtgccggagcggtggttccccgggcggttcgacctcgtcgggcacagccaccagctgttccatctcttcgtcattgccggcgcgtacgcgcactacctcggtggcgtcgagtacctcaagtggagggacgccgacaggtgctggtgaccggcggcatggcatggctacagttgtacagctacatctccggctgaaggtgcttccattaatccaactgaagaagatgatgggatctggcgtccagaaattgtgcattttgtagtgaaagagtgctgaggtatacataaataggggattgtttgattgctgaaatggatgtgaggcgtaatttgtatgaagagattaagagcggctagccccggacaagggacaatcttgtgtataattgattggaacctctcctttatggtctcgaaagaaaatgagtgcaactaatgctgtaacaaacatatgtagataaacttggattcagggataattatattcgtcaaaaaaaaaaaaaaa

SEQ ID NO: 3700 - protein, 389 aa, Triticum aestivum
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 51593696; NR Description: MGC85478 protein
  misc_feature: GI Number: 51261528; NR Description: MGC84736 protein
  misc_feature: GI Number: 50761224; NR Description: PREDICTED: similar to
  misc_feature: GI Number: 34858379; NR Description: similar to adiponectin
MEERPMASSTSCKGSDHDDKSKEHKCELIGYEALPEWLKDNEYIHGYYRCEWPLKETILSIFSIHNETLNVWSHLVGFLLFLCLTILTAMVIPRDCSISGGGNTFDDAPLTRSYWGDLMAMANMTGALKHEAAACLLLPPAAADLSGNEEEIPNSCPPNTSSSPSHHHVALIQDASAAPRAADAASADPITRWPMFAYLCGAMVCLLTSSACHLVLCHSERMAYVTLRLDYAGIAALIVTSFYPVVYYSFLCHPGLQRLYIGFITAFGAAAVTVSLVPVFQAPEFRPLRAGLFSCMGVSGLIPVAHKLVLYGGRREAAVTACYEALMGALYGLGAAVYAARVPERWFPGRFDLVGHSHQLFHLFVIAGAYAHYLGGVEYLKWRDADRCW

SEQ ID NO: 3701 - DNA, 2125 bp, Triticum aestivum
  misc_feature (1)..(2125): Ceres cDNA ID no. 21665862
  misc_feature (1)..(2125): Ceres CLONE  ID no. 779234
  misc_feature (1)..(2125): Also known as  Ceres CDNA ID no. 23727984
aaaactcaaactgcacttgactttccagctgcgaacaacaaatccgtcctttcatttcgcctcctagtgttcttcccattcggcctcagcgcgagaacgagggaaaaggtacgtgcacgtacgttgacatggctccatccgagaagtgcggctggctgctgtacgtttccctcgccgccaaatgctgcggcaacggcgacggcaagccttaccgcgtggtaggctttgttgtcgttctcctcgccgccttcgtcgtcacgtcgctcctgcactgggcgtctcagggtggtgcggcgtgggggaggtattggtggaggaggaagggtctgggcattggcgaggcccgtatcccggggccacggggcttccccgtgatcggcagcatgggcctcatgaccggcctcgcgcaccggaagctcgcggcggcggcggcgggaaacgtcaggcgccggcggctcatgtcgttctccatgggagagaccagggtggtggtgaccgccgaccctgacgtggcgagagagctgctggctagcccggcgttcgccgaccggccggtcaaggagtccgcctacgggcttatgttccatcgcgccatcgggttcgccccctacggcgcctactggcgcacgctccgccgggtgtcgtcctcgcacctcttctcgccgcggcaggtggccgcctccgccgcgcagcgcgcagtgatcgcgcaccagatggtggatgccatgaggcccgtgggcggcgctggcgtcaagcacgtcgaggcgcggcggttcctgaaacgcgcgtcgctgcacaacgtgatgtggtccgttttcggccggaggtacgagctggacgaggcggggagcggggaggccgcggagctgaagagcctggtcgacgaaggctacgacctgctcggccagctcaattggtccgaccacctcccgtggctcgcgcgcttcgacctgcagaagatccggtccaggtgctccgccctcgtcccccgcgtgaaccgcttcgtcggcaggatcatcgacgagcaccgtgccgccctgaacgacgacgacgacgccgtggtagacttcaccgacgtcctgctctccctccaaggaagcgacaagctctccgacgccgacatgatcgccgtcctctgggagatgatctttcgtggcaccgacaccgtggcagtggtgatcgaatgggtgctggcccggctgatgctgcaccaagacgtgcaggcgagggtccacgaggagctggaccgggtggtcgggccgaaccgggccgtgaccgagtcggacgccgcctcgctcgtctttctccaggccgtagtcaaggaggtcctgcgccttcacccaccgggcccactgctgtcgtgggcgcggcttgccacgtctgacgtccacgtagatgggttacatgttcccgcggggaccactgccatggtcaacatgtgggccataacccacgacccaaccgtgtgggtcaagccggcggagttcaagccagaacggttcctcggcgggtcatcgtcggaccacgctgccgccggcgctgagttctctgtaacgggttccgatctcaggctcgcgccgttcgggtcgggcaggcggagctgccccggcaagtcgctcgcgatcgccaccgttggattctgggttgccacgctgctgcacgagttcgagtggacgccgccgtcgtccgacgggtcaggtggcgtggacctgtctgaggtgctgaggctgtcgtgtgagatggcagctccgctggaggcaaggctgaggccgaggcgtgctgtgtgatgacgtggctgggccatgcgggcagggtagacgttggcctcctcttcttctttactactcctactactatcagtgcgtgtagtgtagtggtaatgtagtgtcccgctttggaaatgtacctgctactaaaataggtccggtcctggtacgtgtactgctgtcctttactgttattagcagggtagatgtttaattacgtagttatgaactactatcaggaagtgagtgtgacagttttcttgtgcttccggtttgctgcctagagatgtactacaagttcctatgtaaaaatatttattttaatgcaagtatcagttgtgttaaaaaaaaaaaaaaaa

SEQ ID NO: 3702 - protein, 552 aa, Triticum aestivum
  misc_feature: PFam Name: p450; PFam Description: Cytochrome P450
  misc_feature: GI Number: 31711948; NR Description: At3g61880 [Arabidopsis thaliana] >gi|6633989|dbj|BAA88569.1| cytochrome P450 [Arabidopsis thaliana] >gi|6899886|emb|CAB71895.1| cytochrome p450 (CYP78A9) [Arabidopsis thaliana] >gi|17065344|gb|AAL32826.1|
  misc_feature: GI Number: 5921925; NR Description: Cytochrome P450 78A4 >gi|7430620|pir||T08114 cytochrome P450 - Monterey pine
  misc_feature: GI Number: 21592543; NR Description: cytochrome p450
  misc_feature: GI Number: 20197777; NR Description: putative cytochrome P450 [Arabidopsis thaliana] >gi|3831440|gb|AAC69923.1| putative cytochrome P450 [Arabidopsis thaliana] >gi|15226422|ref|NP_182189.1| cytochrome P450, putative P450
  misc_feature: GI Number: 50725143; NR Description: putative cytochrome P450
MAPSEKCGWLLYVSLAAKCCGNGDGKPYRVVGFVVVLLAAFVVTSLLHWASQGGAAWGRYWWRRKGLGIGEARIPGPRGFPVIGSMGLMTGLAHRKLAAAAAGNVRRRRLMSFSMGETRVVVTADPDVARELLASPAFADRPVKESAYGLMFHRAIGFAPYGAYWRTLRRVSSSHLFSPRQVAASAAQRAVIAHQMVDAMRPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGSGGVDLSEVLRLSCEMAAPLEARLRPRRAV

SEQ ID NO: 3703 - DNA, 1611 bp, Triticum aestivum
  misc_feature (1)..(1611): Ceres cDNA ID no. 21665863
  misc_feature (1)..(1611): Ceres CLONE  ID no. 779290
  misc_feature (1)..(1611): Also known as  Ceres CDNA ID no. 25088318
acttccgactagagatggatcgaaactcggaattataaacaacatcacgaccggcggtttgctcagaaaatagagaagcctcgatcaggagcgatggcgatggttggcgtcagggtcgcggccatcctcctcgtatcgatcgctgcctgttttcttctgctcggccatgcgggcgcggtcaacggcaaccaggcgccccactccccgtctccggtgatcgccatcgacttgggcaacaccaactcgtgcgtcgccggctacagccacggccatggtcaggtcgaaaccatgttccagctctgcatcccaacctgggtggccttccccggcgacggatccgtcttggtcggcgaggacgccaagaaccacgccgctcccaatcccatcttcggcttcaagcggctgctcgggaagagtcgcgacttggagcgcgaagaggaggaggtgcgggaactcatggtccgcgtgccgtacaaagtcgtcggccgcgaaaggcccctggttcaggtgcagatggccgacggcgcggtcaagaacctcggcgccgatgagatcacggccatggtgttggccaagctcagggagtcggccgaggcgtacctcggccgtgcaatccaggaggccatcgtcaccgtcccgcagcagtacaacgatccgtcaaggtattcgatgttgagggccgcggagctcgccggcctgcgcgtcacgaggatgatcgacgagccgaccgcggctgccgtcgctcacggcctccacaggaagctgcgcgacgagggcaacgtcctcgtcctccacgtcggcggcgggacgtcagacgcgagcgtcatgtggtatgtggacggcgtcttcgagttcatgggagcagacgaggaccctttctttggaggacaggacttcgaccagaggatcgtcgaccacttcgtggagctgatcaggaagaagcacggcaaggacctgagcaacgacaagggcgtgctgggcaggttgaggacggcgtgcgagcaggccaagaaggcgttgagcagccaagatgttgccgaactgagcatcaagtcgctggtcgatggtgtcgatttctccggctcgctgacccgggcagagtttgaggagctgaaccatgacttgttccttaaagccatggcgttggtggagagtgccatgagacaggctgggctagacaagaacaaggagctgcttgatgagattgtgctggttggtggaagcaccatgatccctgggattcggagactcgtcaccgattattttgatgggagggagctgaaaaatatcaatgcgtcggtgatgccagatcaaactgtcactctcggagctgctcttctaagccatcctatggcaaatgggtacccatgcatgggaggcgataggcgtcagtggggatactccacggactggtgttttaccgactgaacttcccgttattgattgactgcagtgagcaaaccactagcctcaagccctcaactgcgacaaattgtagcttatatatcatcttctttttgtaggttttgttaaatgtgaatgttggaatctcaggattacagccttacctgatgcaatgcaacagctgacttgtgaaaaaaaaaaaaaaaa

SEQ ID NO: 3704 - protein, 444 aa, Triticum aestivum
  misc_feature: PFam Name: HSP70; PFam Description: Hsp70 protein
  misc_feature: GI Number: 19813; NR Description: luminal binding protein (BiP) [Nicotiana tabacum] >gi|100340|pir||S21880 dnaK-type molecular chaperone blp5 precursor - common tobacco >gi|729623|sp|Q03685|BIP5_TOBAC Luminal binding homolog 5) (GRP
  misc_feature: GI Number: 19811; NR Description: luminal binding protein (BiP) [Nicotiana tabacum] >gi|100339|pir||S21879 dnaK-type molecular chaperone blp4 precursor - common tobacco >gi|729620|sp|Q03684|BIP4_TOBAC Luminal binding homolog 4) (GRP
  misc_feature: GI Number: 1346172; NR Description: Luminal binding protein precursor (BiP) (78 kDa glucose-regulated protein homolog) (GRP 78)
  misc_feature: GI Number: 13398537; NR Description: BiP-isoform D [Glycine max]
  misc_feature: GI Number: 2642238; NR Description: endoplasmic reticulum HSC70-cognate binding protein precursor [Glycine max] >gi|11277127|pir||T46574 dnaK-type molecular chaperone BiP
MAMVGVRVAAILLVSIAACFLLLGHAGAVNGNQAPHSPSPVIAIDLGNTNSCVAGYSHGHGQVETMFQLCIPTWVAFPGDGSVLVGEDAKNHAAPNPIFGFKRLLGKSRDLEREEEEVRELMVRVPYKVVGRERPLVQVQMADGAVKNLGADEITAMVLAKLRESAEAYLGRAIQEAIVTVPQQYNDPSRYSMLRAAELAGLRVTRMIDEPTAAAVAHGLHRKLRDEGNVLVLHVGGGTSDASVMWYVDGVFEFMGADEDPFFGGQDFDQRIVDHFVELIRKKHGKDLSNDKGVLGRLRTACEQAKKALSSQDVAELSIKSLVDGVDFSGSLTRAEFEELNHDLFLKAMALVESAMRQAGLDKNKELLDEIVLVGGSTMIPGIRRLVTDYFDGRELKNINASVMPDQTVTLGAALLSHPMANGYPCMGGDRRQWGYSTDWCFTD

SEQ ID NO: 3705 - DNA, 2258 bp, Triticum aestivum
  misc_feature (1)..(2258): Ceres cDNA ID no. 21665864
  misc_feature (1)..(2258): Ceres CLONE  ID no. 780090
  misc_feature (1)..(2258): Also known as  Ceres CDNA ID no. 24361319
aagtttccatcttctcctccttcccgaggcaccatgaggtcatcgtcgatggcgaccgcgatactatccatcgccgccgttgtcctcctgctcgccgtccaggacagccatggcgcgaaactgtgcatggactcgacgttcccaagggcggtcaacgggtccctttccttctgcggctacaacggcactgcttgctgcaacacgacggacgacgccgctgtccggaggcagtttgccgccatgaacatctcaggcacgccgtgcggcgacctcgtcaagtctatcctttgcgcgagatgcaacccgtacgccggcgagctcttcaccgtccggacaagccctcggacggtgccactgctatgcaacagcaccggcgtgtcgagccgtgtcagcggcgtggccgcggcgacggggtactgcgcgaaggtgtgggatacctgcaaggacgtgtccatcccggggtcgccgttccagccgcccaagggcggcgcatcggcgccgaagctcgccgaggtgtgggagtcagagggcgacttctgcggcgcgctgggcggcgagtccatctgcttcgacggtgaggccgcggcgttcaatgcgacccgcgtcgtgccaccggtgaacggtatgtgtctggagcgcgtcagcaacggctcgtacctcaacatggcggcgcacccggacggctccaaccgcgtgttcctcagcaaccaggccggcaaggtattccttgccaccgtgccgccgcagggctccggcaagccgctggagctggacgtggccaacccgttcctcgacattaccgacgaggtgcacttcgacaacgagttcggcctcctcggcatggccttccacccggacttcgagaagaacggccggttcttcgtctcctacagctgcgacaaaacgcaatcggcatcgtgctctggcaggtgcgcctgcaactcagacatcggctgtgacccgtccaagctcggcgccgacaacggcgcgcagccctgccagtaccagagcgtgatcgccgagtacaccgccaattcgtcctccggctcgccttcgaaggcgacctctgcaaacccgacggaggcgaggcggatcatgacgctcgggctgccgttcacgacccatcacggtgggcagatcctcttcagcccgggagacggctacatgtacttcatgatgggcgacggcggcagcgtcggcgacccatggaacttcgcgcagaacaaggggaccctgctcgggaagatcatccggatcgacgtcaacaacatgccaagtggtaacaacactcctagttggggcaactacggtatccccaaggacaacccgttctcaatggacccaaagttcgcgccagaggtcttcgccatgggtttcaagaacccgtggcgttgcagcttcgactccacgaagccgtcctacttcttctgcgccgatgtcggccagtctttgtatgaggaagtcgacctagtggtaaatggtgggaactacgggtggcgcgtgttcgagggcccccagtcatacccggcactgtcaactcccggtgggaacacctcggtcgactccatcaacgccatcttgccggtcatgggttacgcccacaacactgtcaacaacaatgttggctctgcctccatcatcggcggctacgtctaccgctccatgactaacccatgcctcaacggcaggtacatttacgcggacttgtatgcacagtccatgtggtcagggatcgagacgccggagaacagtggggtgtacaatgtgacgccgctgacattcggctgctccaagacgtcaccaatcctgtgtgatgtcgcggccaagagcccgctgccgtcattgggctacatcttctcctttggcgaagacaacgccaaggacttatacttgcttaccagcaagggagtgtacagggtggtcgaccctagcagttgcaactacgcatgcccaatcaagagctccacgcaggaaggggtgcccccgcctacctcgtcgccaagctcggcattcaatgcgcaaacttccaccgtaccaatgacgttgttggcaggagtgttgcttgtcttgctgagcttgggcttttgagaactattcattttaagttcagaatgttttgcaaagttgccatatggttatggtgttttgatgttgtatattttggatactctctctatgtgtgcaagcgtgtaaatttttagattgtatttatcaaattaaaagtcaaatatgcgcgaaatgcaaaaaaaaaaaaaaaa

SEQ ID NO: 3706 - protein, 684 aa, Triticum aestivum
  misc_feature: PFam Name: Mucin; PFam Description: Mucin-like glycoprotein
  misc_feature: GI Number: 5882745; NR Description: F25A4.24 [Arabidopsis thaliana] >gi|25406378|pir||C96777 F25A4.24 [imported] -
  misc_feature: GI Number: 50510121; NR Description: glucose/sorbosone dehydrogenases-like protein [Oryza sativa (japonica cultivar-group)] >gi|50509091|dbj|BAD30151.1| glucose/sorbosone dehydrogenases-like protein [Oryza sativa (japonica
  misc_feature: GI Number: 50428634; NR Description: putative HIPL1 protein
  misc_feature: GI Number: 37182326; NR Description: LRTS841 [Homo sapiens]
  misc_feature: GI Number: 49113217; NR Description: FLJ13840 protein [Homo
MRSSSMATAILSIAAVVLLLAVQDSHGAKLCMDSTFPRAVNGSLSFCGYNGTACCNTTDDAAVRRQFAAMNISGTPCGDLVKSILCARCNPYAGELFTVRTSPRTVPLLCNSTGVSSRVSGVAAATGYCAKVWDTCKDVSIPGSPFQPPKGGASAPKLAEVWESEGDFCGALGGESICFDGEAAAFNATRVVPPVNGMCLERVSNGSYLNMAAHPDGSNRVFLSNQAGKVFLATVPPQGSGKPLELDVANPFLDITDEVHFDNEFGLLGMAFHPDFEKNGRFFVSYSCDKTQSASCSGRCACNSDIGCDPSKLGADNGAQPCQYQSVIAEYTANSSSGSPSKATSANPTEARRIMTLGLPFTTHHGGQILFSPGDGYMYFMMGDGGSVGDPWNFAQNKGTLLGKIIRIDVNNMPSGNNTPSWGNYGIPKDNPFSMDPKFAPEVFAMGFKNPWRCSFDSTKPSYFFCADVGQSLYEEVDLVVNGGNYGWRVFEGPQSYPALSTPGGNTSVDSINAILPVMGYAHNTVNNNVGSASIIGGYVYRSMTNPCLNGRYIYADLYAQSMWSGIETPENSGVYNVTPLTFGCSKTSPILCDVAAKSPLPSLGYIFSFGEDNAKDLYLLTSKGVYRVVDPSSCNYACPIKSSTQEGVPPPTSSPSSAFNAQTSTVPMTLLAGVLLVLLSLGF

SEQ ID NO: 3707 - DNA, 1761 bp, Triticum aestivum
  misc_feature (1)..(1761): Ceres cDNA ID no. 21665865
  misc_feature (1)..(1761): Ceres CLONE  ID no. 780676
  misc_feature (1)..(1761): Also known as  Ceres CDNA ID no. 24368524
tccaccccaagtccccaacacacagcacacaacacaacacagccacgccgcctcccctcccctcccagtctcccacctccggcggcggcggcgagccagatagagagcgaggccggccgggggggaggaggaggaagatgatgatgcccacgggcggcgactccagctcccccgtgcgcgcgctgcggcggttggccggctccctcctcgccgccgcgcgcctccgcggctccttcagcgcatccaaatgcaagacggaggcgcggatggcggcggcgcggatgaagctgctgcggaaccgccgcgaggcgcaggtgcgcaagatgcgcggggacgtcgccgcgctgctccgcgacggccgcgaggacaccgcccgcatcagggtcgagcatgtaattagagaacaaaacactatggcggcaaatgagattgttgaacttttctgtgaactgattgttacacggcttcccatcattgccaagcagaaggaatgcccagcggacctgaaagaaggtatctgcagtttgatatttgcagccccaaggtgctctgaactccctgaactcactcggatgcgggacctttttgaaaagaagtatgggaaagatttcgttgctgctgcagttgacctgcgcccaaatgctggtgttaataaccttctaattgagaagctgtcagccaataagccgtctgggcaaactaagctgaaagttctcaaggatatagcaaaggagcatcaaatcgattgggacccgagcgaggctgagcaggatcttcttaaacctgctgaagagatgattcaaggacctagttcatttggtgaagcttccaaaatgcccgtgaagactacgctatcagcaaattttgtgcaacccagtccatctatttacagttctggatacgctgatgagtatgatgataataatgttagaggtgccaagcaattcaaggatgcagcttcagctgcacgagcagctgcggagtctgctgcgcacgcagcatctgccgctaaggctgcagccaaccttgccaaccagaacacccattcatccgacgaagacgaagacgatgacgatgacgatgacgaggacgaggactggaagaccactcttcatgagtccactcattctagcaggcgccaatcgatgatgagcaactcaagcagaacctccaggaaagaaaatgcatcggccttcgatgaaatgaggctccgtggaagcacaggcagaaggttaagcgggtcgaaccacatggaagataaagactcggacctgcttcaggatctgggtactggcaggacgcgcagaaggaacagccgtgctgctagcaaggtgcactcggagataaagtttgatgattcagaggcggaggacggcagcgacgccgagatacagtcctccctggagaggcggcctccacggaaggaacgttacccaggaaacggtcaccgcgaagagaaggaagcagaagacaacgatgacttccctgagccgccgaaggcgaaccccggctcccgcgttcatccgaacatgcccctggacttcgagaccctgacggcgcgcttcgaggcgctgaggtcatccggggggaagctcccttagcttgcgcagtggaatcgtgatgttgaatcctttgctgcgcctatactgctaagttatatacatattacttgtctcgtgcgtttggttttgcaaggtgctggcttgccccaaactattattccgtatctataatctataatacccaaaaaaaaaaaaaaaa

SEQ ID NO: 3708 - protein, 1761 aa, Triticum aestivum
  misc_feature: GI Number: 56784921; NR Description: MAPK activating
  misc_feature: GI Number: 33589706; NR Description: At1g34220 [Arabidopsis
  misc_feature: GI Number: 34910388; NR Description: P0692C11.15 [Oryza sativa (japonica cultivar-group)] >gi|19571094|dbj|BAB86519.1|
  misc_feature: GI Number: 34911298; NR Description: P0519D04.18 [Oryza sativa (japonica cultivar-group)] >gi|18844890|dbj|BAB85359.1|
  misc_feature: GI Number: 34222084; NR Description: At2g19710 [Arabidopsis
TCCACCCCAAGTCCCCAACACACAGCACACAACACAACACAGCCACGCCGCCTCCCCTCCCCTCCCAGTCTCCCACCTCCGGCGGCGGCGGCGAGCCAGATAGAGAGCGAGGCCGGCCGGGGGGGAGGAGGAGGAAGATGATGATGCCCACGGGCGGCGACTCCAGCTCCCCCGTGCGCGCGCTGCGGCGGTTGGCCGGCTCCCTCCTCGCCGCCGCGCGCCTCCGCGGCTCCTTCAGCGCATCCAAATGCAAGACGGAGGCGCGGATGGCGGCGGCGCGGATGAAGCTGCTGCGGAACCGCCGCGAGGCGCAGGTGCGCAAGATGCGCGGGGACGTCGCCGCGCTGCTCCGCGACGGCCGCGAGGACACCGCCCGCATCAGGGTCGAGCATGTAATTAGAGAACAAAACACTATGGCGGCAAATGAGATTGTTGAACTTTTCTGTGAACTGATTGTTACACGGCTTCCCATCATTGCCAAGCAGAAGGAATGCCCAGCGGACCTGAAAGAAGGTATCTGCAGTTTGATATTTGCAGCCCCAAGGTGCTCTGAACTCCCTGAACTCACTCGGATGCGGGACCTTTTTGAAAAGAAGTATGGGAAAGATTTCGTTGCTGCTGCAGTTGACCTGCGCCCAAATGCTGGTGTTAATAACCTTCTAATTGAGAAGCTGTCAGCCAATAAGCCGTCTGGGCAAACTAAGCTGAAAGTTCTCAAGGATATAGCAAAGGAGCATCAAATCGATTGGGACCCGAGCGAGGCTGAGCAGGATCTTCTTAAACCTGCTGAAGAGATGATTCAAGGACCTAGTTCATTTGGTGAAGCTTCCAAAATGCCCGTGAAGACTACGCTATCAGCAAATTTTGTGCAACCCAGTCCATCTATTTACAGTTCTGGATACGCTGATGAGTATGATGATAATAATGTTAGAGGTGCCAAGCAATTCAAGGATGCAGCTTCAGCTGCACGAGCAGCTGCGGAGTCTGCTGCGCACGCAGCATCTGCCGCTAAGGCTGCAGCCAACCTTGCCAACCAGAACACCCATTCATCCGACGAAGACGAAGACGATGACGATGACGATGACGAGGACGAGGACTGGAAGACCACTCTTCATGAGTCCACTCATTCTAGCAGGCGCCAATCGATGATGAGCAACTCAAGCAGAACCTCCAGGAAAGAAAATGCATCGGCCTTCGATGAAATGAGGCTCCGTGGAAGCACAGGCAGAAGGTTAAGCGGGTCGAACCACATGGAAGATAAAGACTCGGACCTGCTTCAGGATCTGGGTACTGGCAGGACGCGCAGAAGGAACAGCCGTGCTGCTAGCAAGGTGCACTCGGAGATAAAGTTTGATGATTCAGAGGCGGAGGACGGCAGCGACGCCGAGATACAGTCCTCCCTGGAGAGGCGGCCTCCACGGAAGGAACGTTACCCAGGAAACGGTCACCGCGAAGAGAAGGAAGCAGAAGACAACGATGACTTCCCTGAGCCGCCGAAGGCGAACCCCGGCTCCCGCGTTCATCCGAACATGCCCCTGGACTTCGAGACCCTGACGGCGCGCTTCGAGGCGCTGAGGTCATCCGGGGGGAAGCTCCCTTAGCTTGCGCAGTGGAATCGTGATGTTGAATCCTTTGCTGCGCCTATACTGCTAAGTTATATACATATTACTTGTCTCGTGCGTTTGGTTTTGCAAGGTGCTGGCTTGCCCCAAACTATTATTCCGTATCTATAATCTATAATACCCAAAAAAAAAAAAAAAA

SEQ ID NO: 3709 - DNA, 1180 bp, Triticum aestivum
  misc_feature (1)..(1180): Ceres cDNA ID no. 21665866
  misc_feature (1)..(1180): Ceres CLONE  ID no. 781201
  misc_feature (1)..(1180): Also known as  Ceres CDNA ID no. 24368520
aggccccctgttctctcctcccagtcccgtgccccactgcacccctgcctgccctcctcatctttgacccccgcgccaccacggtccaactcaaaagactgcccactccgaccaggagtccaagaaactcgccaagaacaaagcaacgcgcacgccgccaccagagccaacacacacaacgcaagccccttccaattctctgcaggcactccaactcttccgtccagtagcggcgctggccggcgaggccgtgatcgctaccaggcgcaggcgccgtgatgggctcgctgctcctgctctccttgctggtgatttctggggtcggggtcggcggcggcgtgaggctggcgggcaatggcgggtacgaggactggaggctgggcacggcgacctacatcaaggagtcccagggccacccgctcaatgacggtggcggcgcttgcgggtacggggacctggacatattcaggtacgggaggtacacggccgggctgagcggcgcgctgttcgggcggggcagcgcctgcggcggctgctacgagctccggtgcgtcaacaacatcctctattgcctgcggggcagccccaccgtcgtcgtgacggcgaccgacttctgcgcccccaacttcggcctcgcagacgactacggcggctggtgcaacttccccaaggagcacctggagatgaccgaggccgccttcctccgggtcgccaaggccaaggctgacattgtccaggtgcagttccgaagggtgagctgtgacagggccggcggaattcggttcacgatcaccggcggccccaacttcctccaggtgctgatcaccaacgtggcagccgacggcgaggtcgacgctgtgaaggtgaaggggtcgaagaccgggtggataccgatggggaggaactgggggcagaactggcagtgcgacgcggacctccgaggccagccgctctcgttcgaggtgaccggaggaaaggggaggacgatcaccatgtataacgttgcgccttcggactggatgtttgcgcaaacgttcgcaggcaagcagttcgtcgagtaggtgaaagaggattgcaagctccagcgactgtaattacaactacaagggttactaaaatgccgtgacccaagaatgaacgtgaatggttttcgctctgcccgccaaaaaaaaaaaaaaaa

SEQ ID NO: 3710 - protein, 260 aa, Triticum aestivum
  misc_feature: PFam Name: DNA_photolyase; PFam Description: DNA photolyase
  misc_feature: GI Number: 50910683; NR Description: putative cryptochrome 2 [Oryza sativa (japonica cultivar-group)] >gi|48716245|dbj|BAD23781.1| putative cryptochrome 2 [Oryza sativa
  misc_feature: GI Number: 50910681; NR Description: cryptochrome 2 [Oryza sativa (japonica cultivar-group)] gi|51964176|ref|XP_506872.1| PREDICTED B1215B07.27-1 gene product [Oryza sativa (japonica cultivar-group)] gi|28372347|dbj|BAC56984.1| cryptochrome 2
  misc_feature: GI Number: 23954324; NR Description: Cryptochrome 2 [Oryza
  misc_feature: GI Number: 40644276; NR Description: cryptochrome 2 [Oryza
  misc_feature: GI Number: 37725009; NR Description: cryptochrome 2A [Pisum
MGSLLLLSLLVISGVGVGGGVRLAGNGGYEDWRLGTATYIKESQGHPLNDGGGACGYGDLDIFRYGRYTAGLSGALFGRGSACGGCYELRCVNNILYCLRGSPTVVVTATDFCAPNFGLADDYGGWCNFPKEHLEMTEAAFLRVAKAKADIVQVQFRRVSCDRAGGIRFTITGGPNFLQVLITNVAADGEVDAVKVKGSKTGWIPMGRNWGQNWQCDADLRGQPLSFEVTGGKGRTITMYNVAPSDWMFAQTFAGKQFVE

SEQ ID NO: 3711 - DNA, 1459 bp, Triticum aestivum
  misc_feature (1)..(1459): Ceres cDNA ID no. 21665867
  misc_feature (1)..(1459): Ceres CLONE  ID no. 782149
  misc_feature (1)..(1459): Also known as  Ceres CDNA ID no. 24356926
gcggaacccccatccggtgtgcaaggaaggcccaatatttgaccagtttgaaggacagtggtgctggttcttgccatctgggtggtgctccatttgctaaggtgaggtctcctctgcctgcttcttggatctcactttatggccgagggcatggcaatggcccgcgctggatcattggtttcaaagcttgattccaagatatgctatcatagggatgcagcccttgagtacatggaaatcaaggctgtggttggagaagtcatagaagaaaaggagatgctccagcaggattatcatgcactgaaaggtgaacttgaggcggcaaagaaaacaattgtggaagtaaacaaggagcttgcagcaggaaacgaggagacctctctcagtaagaaggagctggagcttgtaaagaagaagcttcaagactgggaagctaagcaaaatctatctgagcaacagaattgctctgcttctgagcatgtccagcctagtaatagtaagcaggggcagaaaagatcaatgaggcaccaggaagtgccatctcaaggacctctgagaattgatgctgacaaacctgacctggcagaagagcgtcctgggagcatgctggtaaacaaccccattgttggccaaacctcagttgttccaccaagcacagatgatgacatggtggccctgcgtgaacatctgatcaagcaattccttgaaatcgacaaatacggcgggcggatcatcgggataaaggaaatgggcaaactgaatgtgaaggcatttgagattgcttgcgctgagaagttccgtaccacaaaagccgctgatgcgtcaagtaagctgtactcactgtggcagcagcggatcactgacgtaagctggaatcccttccacacggtcacggtcgagggcaatcatcaggaggttctgaatgtcaatgatgataagctgcaagaactgaagaaggaatggggagaaggcccctacaaagctgtcatcgatgcgctgatggagatgaaagagtacaactgcctaggcgacaggagcaccgtctatgagctatggaactacagggcggaccggaaagccaccctaacggagtgtactgagtacatggccgatcgtgtgcagcaactcacagtggtcaagcgcaggaggagtcgcaggacgatatgatggctcctgcaagatgcactagcaaggaacagaggctgctgaccccccttagtagtagctaagcagtaaaactgttgtgtgtgtgctttggataattattaatctggctgtggcaagagaggggaaactatgagagcaagcccttttgacgttgttggaccaagttgtagcttatggctatctgtactgttctactttatgctcacctctatctaaaacaatgctactctgatatttgaaattcctgcacccggatttcaaaaaaaaaaaaaaaaaaaaaaaaaaaaaaaaa

SEQ ID NO: 3712 - protein, 342 aa, Triticum aestivum
  misc_feature: PFam Name: XH; PFam Description: XH domain
  misc_feature: GI Number: 8885545; NR Description: transcription regulator-like [Arabidopsis thaliana] >gi|15238391|ref|NP_200747.1|
  misc_feature: GI Number: 50900592; NR Description: putative transcription factor [Oryza sativa (japonica cultivar-group)] >gi|12328532|dbj|BAB21190.1| putative transcription factor [Oryza
  misc_feature: GI Number: 8778384; NR Description: F16A14.2 [Arabidopsis thaliana] >gi|25402764|pir||D86271 protein F16A14.2 [imported] - Arabidopsis thaliana >gi|15222949|ref|NP_172834.1| XH/XS domain-containing protein / XS zinc finger domain-containing
  misc_feature: GI Number: 34912988; NR Description: putative transcription factor X1 [Oryza sativa (japonica cultivar-group)] >gi|6650526|gb|AAF21887.1| putative transcription factor X1 [Oryza sativa subsp. japonica] >gi|20161810|dbj|BAB90725.1|
  misc_feature: GI Number: 55296001; NR Description: X1-like [Oryza sativa
MAEGMAMARAGSLVSKLDSKICYHRDAALEYMEIKAVVGEVIEEKEMLQQDYHALKGELEAAKKTIVEVNKELAAGNEETSLSKKELELVKKKLQDWEAKQNLSEQQNCSASEHVQPSNSKQGQKRSMRHQEVPSQGPLRIDADKPDLAEERPGSMLVNNPIVGQTSVVPPSTDDDMVALREHLIKQFLEIDKYGGRIIGIKEMGKLNVKAFEIACAEKFRTTKAADASSKLYSLWQQRITDVSWNPFHTVTVEGNHQEVLNVNDDKLQELKKEWGEGPYKAVIDALMEMKEYNCLGDRSTVYELWNYRADRKATLTECTEYMADRVQQLTVVKRRRSRRTI

SEQ ID NO: 3713 - DNA, 1643 bp, Triticum aestivum
  misc_feature (1)..(1643): Ceres cDNA ID no. 21665868
  misc_feature (1)..(1643): Ceres CLONE  ID no. 784307
  misc_feature (1)..(1643): Also known as  Ceres CDNA ID no. 24361411
gtcatagatcttgtgctaattatcagttactccttggataaaggcattcacggcaggaggcctctttctgcagagttggccacttggccggcatggagcacggggacggacccggcggtccagaccctggcgggcagcagcgggaggaggagatcagtgactccgaatcaggctctgaatcgctcgagatctccgacctcaagaagcgcatgtggaaggaccagatgctgttgacgaggctcgagggccgcgccggcgccaagggcgtggcgccggctccagctgccggcgcatcttcctcgtcgtcgtcgggccaagaggagcctcccgacgtgcggtgccgccgcaaggccatgctgcgcgcgcaggacggcgtgctccggcacatgctcaggatgatggaggcctgcaacgcgcgcgggttcgtgtacggcgtcatcgacgaggccggcgagcccatgtccggctcctccgacagcctccgcggctggtggaaggagaacgtgagcttcgaccgcgctggccccatgggcctggccggccccatgggcgagagcccggtcgccctggcctcctccctccatcgtctcccagacatccaagacagcacgctcggatccgtgctctctgcgctcatccagcactgcgagccgccgcagaggagcttcccgctggagcgcggcctggcgccgccgtggtggccgacggggcacgagccctggtggggcacgcagggcgagatgcaggcccaccagggcgtgccaccgtaccggaagccgcacgacctaaagaaggcgtggaagatctccctgctgagcgcggtgatcaagcacatgagcccgcgcttcgaccagatgcgcaagctcgtgtggcagtccaagcggctgcagcagaagatgagcgccaaggagtccgagacctggtccaaggtgcttaggcaggaggaggcgctcagcagccggctaaagagctcgctgcggatcacgccgttcgatcaggaggaggaggaagaggaggaggaggaggtgaagaagaagaaggttgggaaggagagggacgacgatggtctggagagcgttgtgcgcggcgcgcaggacaaacgcaagcgcgagatctctcgcaccggcagctccggtgggagcggatcagagctgaccataatgccgccggatcagctcgctgctgcaatcacagaggagagccggagcccgatcgacgagctcatgaagctttactacggctgcatgcagggggtcgaaagctacgatgtccgggaaaaggacgatctgacaccgatgcattccgtagtgctcggaaacatagatgaggtggcgcaggatgtgctctttgatatcatcgggagctgccctgaaatagatgatgtgctgcgcttgatgggggagtgacatagccacgcagtcagttgtccaacctatgttacgcacggttattagttaggagtattattgaatactgttactgcactatttccatattggggttgctttttcgttttgagatgttggtattgttagttagggaagggtatttcatatgtcatgaaataacgcgtatgatcatttctcttatgtgacaactttgtactaaatcagcgatattttgtgccaaaaaaaaaaaaaaaa

SEQ ID NO: 3714 - protein, 437 aa, Triticum aestivum
  misc_feature: PFam Name: EIN3; PFam Description: Ethylene insensitive 3
  misc_feature: GI Number: 15425735; NR Description: EIN3-like protein
  misc_feature: GI Number: 30016898; NR Description: EIL3 [Nicotiana tabacum]
  misc_feature: GI Number: 30016900; NR Description: EIL4 [Nicotiana tabacum]
  misc_feature: GI Number: 14280040; NR Description: EIL1 [Lycopersicon esculentum]
  misc_feature: GI Number: 30016894; NR Description: EIL1 [Nicotiana tabacum]
MEHGDGPGGPDPGGQQREEEISDSESGSESLEISDLKKRMWKDQMLLTRLEGRAGAKGVAPAPAAGASSSSSSGQEEPPDVRCRRKAMLRAQDGVLRHMLRMMEACNARGFVYGVIDEAGEPMSGSSDSLRGWWKENVSFDRAGPMGLAGPMGESPVALASSLHRLPDIQDSTLGSVLSALIQHCEPPQRSFPLERGLAPPWWPTGHEPWWGTQGEMQAHQGVPPYRKPHDLKKAWKISLLSAVIKHMSPRFDQMRKLVWQSKRLQQKMSAKESETWSKVLRQEEALSSRLKSSLRITPFDQEEEEEEEEEVKKKKVGKERDDDGLESVVRGAQDKRKREISRTGSSGGSGSELTIMPPDQLAAAITEESRSPIDELMKLYYGCMQGVESYDVREKDDLTPMHSVVLGNIDEVAQDVLFDIIGSCPEIDDVLRLMGE

SEQ ID NO: 3715 - DNA, 1607 bp, Triticum aestivum
  misc_feature (1)..(1607): Ceres cDNA ID no. 21665869
  misc_feature (1)..(1607): Ceres CLONE  ID no. 784498
  misc_feature (1)..(1607): Also known as  Ceres CDNA ID no. 24357091
aaaagtcgccagcaactatctcttcttgcttcattcggtctctaggcggctagccattacgacaacacaccccagatatagttagtagtactggctagcaagcaaggtagtagtagccaggtgttgtccatggaggagatgggggaggagagcagcaggtatccatggcaggactacgacctgggcttcggggaggagctcatgagggagctcctcgaccagacgacgacggcgccatcggcaacaccaacggcggccggcgccgcaagcgctgataattcttcttcttccgacaaggggattggtgacgaggaggaaggggcggtgggacgccgggagtccatggtgaacaggctcatgtcgacggtctactccgggcccaccctcagcgacatcgagagcgccctctccttcaccggcgccggcgctggcgacctgctggacggccgcagcaagtaccactacagcccctccagcccagtggttttctcgccggagaaggtgctgggcaagatggagaacaagtacacgatgaagatcaagagctgcggcaacgggctcgccgacgatgggtacaagtggaggaaatacggccagaaagccatcaagaacagccccaacccaaggagttactaccggtgcacgaacccgcggtgcaacgcgaagaagcaggtggagcgcgccgtcgacgagccggacacgctcgtcgtcacctacgaaggcctccacctccactacacctactcccacttcctccagcagcagaccacccctccacccgccgccgccgccgcctcaagctccaagaagcccaagttgcaccccgccgccggcgccattacagactcccaccacgggagcacccctgtggcaacaacctcgccgccctctgcggccgtcgtccctgccggcgccggggacagcagcggcgacagcggcggtaacgtgatagccgacgcgggcttcctgctggagcacgcggtgcccaactgctcgccgtatgtgttcgacggcggattgttcggtgaggccggcgaggagcggcggatgacgagcgacgccggcgggctcctggaggacatggtgccactgatggtccggcggccgtcgtgcaactcggcggccaccaccgccagctcgtccacgacggtcggctcgcccgcggcgccggtgtcgtcgccctccccctccacgtcgtccgtgtcctggacccccgcgtcgccgtacatcgacatggccatcctctccaacatcttctagccagtagcgtagtgtcaattggtccatcacgatgatcgatcgggaacaattaggctcgaggaaaatcgaattgtttgtgcttgcatccaagcgtgcaagatgcacgtacgcacgaagggtgtgtgattagtagtactattattataccagctactactagtactagcatctagctaagatagttgtggcttactcccaaaataaggaggatttgtatgtgttgtgtgagtatagtatgattagtatattagtataggtaccggtggatgttgaatgaataattgtgtgcatgatgtgagtaatactcatacttatggtgtgcatggatggcaaaaaaaaaaaaaaaa

SEQ ID NO: 3716 - protein, 376 aa, Triticum aestivum
  misc_feature: PFam Name: WRKY; PFam Description: WRKY DNA -binding domain
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: PFam Name: Pyr_redox_2; PFam Description: Pyridine
  misc_feature: GI Number: 57899694; NR Description: putative WRKY DNA-binding protein 49 [Oryza sativa (japonica cultivar-group)] gi|57899221|dbj|BAD87370.1| putative WRKY DNA-binding protein 49 [Oryza sativa (japonica cultivar-group)]
  misc_feature: GI Number: 46394312; NR Description: TPA: WRKY transcription
  misc_feature: GI Number: 50251953; NR Description: putative WRKY
  misc_feature: GI Number: 46394398; NR Description: TPA: WRKY transcription
  misc_feature: GI Number: 46394332; NR Description: TPA: WRKY transcription
MEEMGEESSRYPWQDYDLGFGEELMRELLDQTTTAPSATPTAAGAASADNSSSSDKGIGDEEEGAVGRRESMVNRLMSTVYSGPTLSDIESALSFTGAGAGDLLDGRSKYHYSPSSPVVFSPEKVLGKMENKYTMKIKSCGNGLADDGYKWRKYGQKAIKNSPNPRSYYRCTNPRCNAKKQVERAVDEPDTLVVTYEGLHLHYTYSHFLQQQTTPPPAAAAASSSKKPKLHPAAGAITDSHHGSTPVATTSPPSAAVVPAGAGDSSGDSGGNVIADAGFLLEHAVPNCSPYVFDGGLFGEAGEERRMTSDAGGLLEDMVPLMVRRPSCNSAATTASSSTTVGSPAAPVSSPSPSTSSVSWTPASPYIDMAILSNIF

SEQ ID NO: 3717 - DNA, 973 bp, Triticum aestivum
  misc_feature (1)..(973): Ceres cDNA ID no. 21665871
  misc_feature (1)..(973): Ceres CLONE  ID no. 786480
  misc_feature (1)..(973): Also known as  Ceres CDNA ID no. 24368992
aagacccacccagcagtagtggcgagccacatctccgatgcgcatcgcctttccctctttcccaccctcctcctcttatcccccaaagcagaggaaagccggcgaggagctctccgtgctctgcttagcaggttcgatccagcaacccgtcgatcgatcgccggtgcaaggctagctgcccagccagcggcgtgatctggttttgatcggccggcgacccccatggcgtccatcgtggtgatcgacctggtgctcctcctcgacatcctcgccttcgtcctcgccatcggcgccgagcgccgccggagcacggcgcaactcggcgaggccgagcctggcggcaggtggtactgcgtgtacgacacggacgcgtccacctggtacggcgtcagcgcgctcgccctgctgctggtcggccaggccgtggccatggccgccagccgctgcttctgctgcggccgcgcgctctcgcccggccgctggcgcttcttctccggcctcttcttcgtcctctgctggctgacgttcgtgatcgcggaggtgtgcctgctggcggggtcggtgcggaacgcgtaccacaccaagtacgtgagcggctactacaacgagggggcgctgccctgcgccatgctgcgcaggggcgtcttcgccgccggcgccgccttcgccttcctcaccacgctcttcgtcatgctccactacgtcttctactccaaggcccgcgccgcgccaccgcccatcatcaacggcggcggcatcggcatgacccgcatctgatccctgcggctatggtcgtgtctgttcgtgtcgtgtgttgtaggataagtgtgggtgaatgggtggctctgtctgccgagaacagaggttgctagtgttagtgaacagctgaatagatcatgtgggattgtggagtgtgcgtccaagagatcagtctgtttgccttgagtattttaaaagaaaaaaaaaaaaaaaa

SEQ ID NO: 3718 - protein, 184 aa, Triticum aestivum
  misc_feature: GI Number: 34913784; NR Description: pectate lyase-like protein [Oryza sativa (japonica cultivar-group)] >gi|20146453|dbj|BAB89233.1| pectate lyase-like protein [Oryza
  misc_feature: GI Number: 34908076; NR Description: P0506B12.27 [Oryza sativa (japonica cultivar-group)] >gi|20160815|dbj|BAB89755.1|
  misc_feature: GI Number: 6682233; NR Description: putative pectate lyase [Arabidopsis thaliana] >gi|15232712|ref|NP_187565.1| pectate lyase
  misc_feature: GI Number: 30694193; NR Description: pectate lyase family
  misc_feature: GI Number: 42572687; NR Description: pectate lyase family
MASIVVIDLVLLLDILAFVLAIGAERRRSTAQLGEAEPGGRWYCVYDTDASTWYGVSALALLLVGQAVAMAASRCFCCGRALSPGRWRFFSGLFFVLCWLTFVIAEVCLLAGSVRNAYHTKYVSGYYNEGALPCAMLRRGVFAAGAAFAFLTTLFVMLHYVFYSKARAAPPPIINGGGIGMTRI

SEQ ID NO: 3719 - DNA, 1713 bp, Triticum aestivum
  misc_feature (1)..(1713): Ceres cDNA ID no. 21665872
  misc_feature (1)..(1713): Ceres CLONE  ID no. 786499
  misc_feature (1)..(1713): Also known as  Ceres CDNA ID no. 0
acctacgatcgatggagctagctccaatggcagaaaccactcgccttcagctcgcctgctacactctcctctgcgtccttgtcgtcaccatagtgctcaagctcaagctcaagatcggaccagactctgccggccgtctgaacctgcctcccggcccatgggcgctgccggtgatcggccacatgcacttcctgctgggcgccctgccgcaccaggccatgcgcagtctcgcccggcggcatgggcccgtcatgctcctccgcctgggccacgtcccgacgctggtgctctcctcggaggaggcagcaagggaggtgatgaaggtccacgacgccgccttcgccaaccggcccgtgtacgccaccgcggacgtcctcacctacggcgagcagaacatctccttcgcgcgcctcgacagccggcattggaaggccgcccggaagctgtgcagcgtggagctgctcagcccgaggcgcgtccgctccttccgccccatccgggaggaggaggcggcgaggctcgtgcggtccgtcgctgacgctgaggccggcgccgccgtcaacgtcggcgagagggtgaaggtgatgatgaacgacgtcatcatgagggtctccgtcggcgaccggtgccagcagcgggcgctgtacctggaggagctggacaaggggctggacgtcttgtccgggttcaacctgaccgacttgttcccgacgtcgcgcctggcactggtgctcggcggcgggtccctgagggcggcatgggaggtgcgcgagaggatccagtccatcttggacgccatggtcgaggagcacaagagggcgatggagagtgaggaggccgctgccgccggcgccggccatgagaacgaggacatcctcaccaccctgctgcggttccagagggacggtgggatgggcggcgtcaccctcacgaacgagaatgtcaacggcgtcttgttcgacattttctccgctggatcagagacgacggcgacgaccaccgtctgggccatgtcggagcttatcaggaacccacggacaatggccatcgcacagtctgaagtgcggcgagtgctccaaggcaagaccaaggtggccgaggcggacatcgacggccagctccactacctccagatggtcatcaaggagaccttcagattgcaccctccggtgccgttgctcctcccgaggctgtgcacggaacagaaaacaatcatgggctacgacgtgcctccgggcaccaccgtgttcgcaaacgtgtgggccatcggcagggacgagaagagctgggccgacgcgagcgaattcaagcccgagaggttcgaggtcgagaaggtggactacggtggtacagacttcaggttcctccctggtggcgcggggcggaggatgtgccccggtatgatgtttggtgtgtctaacatggagattgctctcgcgagccttctctatcacttcgaatggaggctccccgatggcgcgagcccggagaagcttgatatgaccgaggcatatgggatcacggcgcgtcggaagactaacctcttgttggaacctactgtttttgtgccttagtttgttggtttactaattgatgtgtgcatctttggctgcagagattgagagagtgtactttttcactgtatatgttacattggactttgtcgaaatacgttattgtatatcataatttgtgtcaaaaaaaaaaaaaaaa

SEQ ID NO: 3720 - protein, 1713 aa, Triticum aestivum
ACCTACGATCGATGGAGCTAGCTCCAATGGCAGAAACCACTCGCCTTCAGCTCGCCTGCTACACTCTCCTCTGCGTCCTTGTCGTCACCATAGTGCTCAAGCTCAAGCTCAAGATCGGACCAGACTCTGCCGGCCGTCTGAACCTGCCTCCCGGCCCATGGGCGCTGCCGGTGATCGGCCACATGCACTTCCTGCTGGGCGCCCTGCCGCACCAGGCCATGCGCAGTCTCGCCCGGCGGCATGGGCCCGTCATGCTCCTCCGCCTGGGCCACGTCCCGACGCTGGTGCTCTCCTCGGAGGAGGCAGCAAGGGAGGTGATGAAGGTCCACGACGCCGCCTTCGCCAACCGGCCCGTGTACGCCACCGCGGACGTCCTCACCTACGGCGAGCAGAACATCTCCTTCGCGCGCCTCGACAGCCGGCATTGGAAGGCCGCCCGGAAGCTGTGCAGCGTGGAGCTGCTCAGCCCGAGGCGCGTCCGCTCCTTCCGCCCCATCCGGGAGGAGGAGGCGGCGAGGCTCGTGCGGTCCGTCGCTGACGCTGAGGCCGGCGCCGCCGTCAACGTCGGCGAGAGGGTGAAGGTGATGATGAACGACGTCATCATGAGGGTCTCCGTCGGCGACCGGTGCCAGCAGCGGGCGCTGTACCTGGAGGAGCTGGACAAGGGGCTGGACGTCTTGTCCGGGTTCAACCTGACCGACTTGTTCCCGACGTCGCGCCTGGCACTGGTGCTCGGCGGCGGGTCCCTGAGGGCGGCATGGGAGGTGCGCGAGAGGATCCAGTCCATCTTGGACGCCATGGTCGAGGAGCACAAGAGGGCGATGGAGAGTGAGGAGGCCGCTGCCGCCGGCGCCGGCCATGAGAACGAGGACATCCTCACCACCCTGCTGCGGTTCCAGAGGGACGGTGGGATGGGCGGCGTCACCCTCACGAACGAGAATGTCAACGGCGTCTTGTTCGACATTTTCTCCGCTGGATCAGAGACGACGGCGACGACCACCGTCTGGGCCATGTCGGAGCTTATCAGGAACCCACGGACAATGGCCATCGCACAGTCTGAAGTGCGGCGAGTGCTCCAAGGCAAGACCAAGGTGGCCGAGGCGGACATCGACGGCCAGCTCCACTACCTCCAGATGGTCATCAAGGAGACCTTCAGATTGCACCCTCCGGTGCCGTTGCTCCTCCCGAGGCTGTGCACGGAACAGAAAACAATCATGGGCTACGACGTGCCTCCGGGCACCACCGTGTTCGCAAACGTGTGGGCCATCGGCAGGGACGAGAAGAGCTGGGCCGACGCGAGCGAATTCAAGCCCGAGAGGTTCGAGGTCGAGAAGGTGGACTACGGTGGTACAGACTTCAGGTTCCTCCCTGGTGGCGCGGGGCGGAGGATGTGCCCCGGTATGATGTTTGGTGTGTCTAACATGGAGATTGCTCTCGCGAGCCTTCTCTATCACTTCGAATGGAGGCTCCCCGATGGCGCGAGCCCGGAGAAGCTTGATATGACCGAGGCATATGGGATCACGGCGCGTCGGAAGACTAACCTCTTGTTGGAACCTACTGTTTTTGTGCCTTAGTTTGTTGGTTTACTAATTGATGTGTGCATCTTTGGCTGCAGAGATTGAGAGAGTGTACTTTTTCACTGTATATGTTACATTGGACTTTGTCGAAATACGTTATTGTATATCATAATTTGTGTCAAAAAAAAAAAAAAAA

SEQ ID NO: 3721 - DNA, 754 bp, Triticum aestivum
  misc_feature (1)..(754): Ceres cDNA ID no. 21665873
  misc_feature (1)..(754): Ceres CLONE  ID no. 786503
  misc_feature (1)..(754): Also known as  Ceres CDNA ID no. 24357151
aacagttcaattagaacaatctcttaaccctatctcaaattcattcagattctcccttcccctttttgatttttcttagaaaactcccaacttcgaatcaatatgaagaaagtggtgctaaaggtggaactccatgatgacaaaatcaagaaaaaggccatgaaggcagtatctggtatttcaggggtagagtcagtctcagtggacatgaaggaccagaaaatgactataattggggatgttgatcctgtaacagtagttggaaagtttacaaaattcagtcttggcaagcttagaaaattctgtcatgttgagatactttcagttggaccagccaaagaggaaccaaagaaagaggagaagaagccagaagccaagaaagatccaaaggaggaatatgctgaacttctgaaggtagttgaagccaattattatcagactagacatctgcaatacccttattactatagcagaactgtggaagagaatccaactggctgtgttatttgctaagtattggagtttgatggataataaatgagatcaaggaaagaagatggtggctggagttgagaaagatttgtttctgtttttgaaatttccttttttccttttctttgttaagttttggcctttcttcttgttttagtacacaaaagaaaaaaaaaaaaagagcagtctaaagcagagaaatataatgtgtacattattttgtggtgtaatacaatcaatttattcaaaaaaaaaaaaaaaa

SEQ ID NO: 3722 - protein, 136 aa, Triticum aestivum
MKKVVLKVELHDDKIKKKAMKAVSGISGVESVSVDMKDQKMTIIGDVDPVTVVGKFTKFSLGKLRKFCHVEILSVGPAKEEPKKEEKKPEAKKDPKEEYAELLKVVEANYYQTRHLQYPYYYSRTVEENPTGCVIC

SEQ ID NO: 3723 - DNA, 1633 bp, Triticum aestivum
  misc_feature (1)..(1633): Ceres cDNA ID no. 21665874
  misc_feature (1)..(1633): Ceres CLONE  ID no. 788258
  misc_feature (1)..(1633): Also known as  Ceres CDNA ID no. 25088320
gcacacagttttaaggatcgacgatgccggcgcccccgcacctcgtgttcgtgcccttcctcgcgcgcagccacttcgctccgctggcggccgccgcggcggccgcttgcggcgacggcaccaccggcgccaccatcctcaccacgccgcacttcgcggccctcgcgcccgcctccgtgccggtccgcgcggcgccgttcagcttccccggagggcacgaggacttctccctgctcccggacgaagcctccgcgccggcgttcttcttcgccgcggaggccgccctggcgccggcgctcgcggcggccgtgcgcgcccacgcgggcgccgtggccgtcgtctcggacgccgtgctccactgggcgccccgcgtcgcccgcgagtgcggcgtcccgcacgtcacgttccacaccatcggcgccttcgccgcggcctccatggtcgccgtcaacctccaccgccccgacgtcctgcaggaccccgtcgctgtccccggcggcttcccggtccccgtggagctccgcagggtccatgtcaacgaggaggctctggcgcacctccccctgttccgtgcggccgaggctgggagctgcgccgtcgccttcaacagcttctcggcgctcgaggctgattttgctgagtactaccggaacgtggatggctctcccaagaaggtgttcctcgtcggccccaggcgggctacccccagcaccgcccgcagcgacgtcgccgtcaccggcggcgcagagcgagaccccatcctgcagtggctcgacggccaggcaaccgggtcggtggtgtacgcctgcttcggcagcacgtgcggtctgagcgcggaccagctcaaggagctgggcgccgggctgcgcgcatcctgcacgccgttcctctgggtgatcccgacggcaacggagggcacggagcagcacgacgagcgcgcgtccggccacggcatggtggtggccgggcgatgggcgccgcaggcggagatcctggcgcaccgcgcggtgggcggcttcgtgagccactgcggctggaactcggtgctggacgcggtgtgcgccggcgtacccctcgcgacgtggccgctccgcgccgagcagttcctgaacgaggcgctcctggtggacgtgctccgcgtgggcgtgcgggtgcgggaggtgggcggcaaggcggacgtggaggcggtggtgccggccgacgcggtggccagcgcggtggggaagctgatggacggcggtgaggatgaagccgcggctaggagggcgagggtgagggagctcggcgtcgcgggtcgcgccgcggtggcggaaggagggtcatcgcgcagggactgggcacggcttgtagatgagctcaaggcgttgcacggccacggcaacgatgcactgattgacaagtgatggtcaaaggcccgttctattgagccgtcggttgtgcataagctgcggtgaaagtgaaaataagccttggagaaggacactatagtgaaaataagccatccagttccttttagtttctgtcattttagtttattttcctcatatgcccaatgaatagtttgtagtacccttggactataatttcgttctcgttaaatgatatggagttatttacaaaaaaaaaaaaaaaa

SEQ ID NO: 3724 - protein, 459 aa, Triticum aestivum
  misc_feature: PFam Name: UDPGT; PFam Description: UDP-glucoronosyl and
  misc_feature: PFam Name: Peptidase_S8; PFam Description: Subtilase family
  misc_feature: PFam Name: Pyr_redox_2; PFam Description: Pyridine
  misc_feature: PFam Name: Pkinase; PFam Description: Protein kinase domain
  misc_feature: PFam Name: Cation_efflux; PFam Description: Cation efflux family
  misc_feature: GI Number: 50917577; NR Description: putative glucosyl-transferase [Oryza sativa (japonica cultivar-group)] >gi|40538926|gb|AAR87183.1| putative glucosyl-transferase [Oryza
  misc_feature: GI Number: 53791383; NR Description: glucosyltransferase IS5a
  misc_feature: GI Number: 50901900; NR Description: putative glucosyltransferase IS5a, salicylate-induced [Oryza sativa
  misc_feature: GI Number: 30103010; NR Description: putative immediate-early salicylate-induced glucosyltransferase [Oryza sativa (japonica cultivar-group)] >gi|50919289|ref|XP_470041.1| putative immediate-early salicylate-induced glucosyltransferase [Oryza
  misc_feature: GI Number: 34910292; NR Description: putative glucosyl transferase [Oryza sativa (japonica cultivar-group)] >gi|11034535|dbj|BAB17059.1| putative glucosyl transferase [Oryza
MPAPPHLVFVPFLARSHFAPLAAAAAAACGDGTTGATILTTPHFAALAPASVPVRAAPFSFPGGHEDFSLLPDEASAPAFFFAAEAALAPALAAAVRAHAGAVAVVSDAVLHWAPRVARECGVPHVTFHTIGAFAAASMVAVNLHRPDVLQDPVAVPGGFPVPVELRRVHVNEEALAHLPLFRAAEAGSCAVAFNSFSALEADFAEYYRNVDGSPKKVFLVGPRRATPSTARSDVAVTGGAERDPILQWLDGQATGSVVYACFGSTCGLSADQLKELGAGLRASCTPFLWVIPTATEGTEQHDERASGHGMVVAGRWAPQAEILAHRAVGGFVSHCGWNSVLDAVCAGVPLATWPLRAEQFLNEALLVDVLRVGVRVREVGGKADVEAVVPADAVASAVGKLMDGGEDEAAARRARVRELGVAGRAAVAEGGSSRRDWARLVDELKALHGHGNDALIDK

SEQ ID NO: 3725 - DNA, 1919 bp, Triticum aestivum
  misc_feature (1)..(1919): Ceres cDNA ID no. 21665875
  misc_feature (1)..(1919): Ceres CLONE  ID no. 789745
  misc_feature (1)..(1919): Also known as  Ceres CDNA ID no. 24356853
gcttggattggggctcaagtagactgcagcatcgcggccagcggccagcagctaggcgccaacgaccaccctggacgtcctccccaacgcgcggcgtttcccgagcgcgcgaccgtccgggcggcgaaaccaccgccaccgcttggcgccttcttccttccttgagttgagttgggcctctttaagtctcccgcctcgttgccgcccgcggtgcctctccgcccgtgacgcccttgatagcgcggtgccgtcgctcgctgcgaaggtggggtcctcgtcgctgctcagggggtgctggaagatgggcgccgaggtggaggtcgtggccagggtggcgccgccgagggcgccgggcaagaagaggacctccaccacgctgctgcacctgcttcagctcgacaaccccgacggcgtcttcgtcttcgccgcggcggccaacaagctgccgccgccggagccggagcccgaggccgagagcctcatcgacaagatcgcctcctgctgccgggtcttcacgttcgcggacgacgacgccgccgagcgggacgccaagctggagcggctcgaggaggtgctcgccgcggtgcgctccagcggcaagaaccagccgcccgggctggaccacctcgtcatggtcgcgctggtcaagatgttcgccgccaacctgttccgcacgatgccgccgccggcaacgtgcccgtcggtgctcgccgaggcggcggacgaggaggccccctcggcgtccctgctcccgtcgtggccgcacctccaggcggtctacgacgtgctcctcgccgtcatcgccgcggccgacgccaaggccctccgcaaccacatcgaccgccccttcctcacggcgctgctggcgctgttcgcctccgaggatccccgcgagcgcgaccgtctcaagaccgcgtaccaccagctctacgccaagctgaccccggagcgcgccttcatgcgccgctccatggccgccgccctgctggcctccgtccacgagtgcggcggcggcgtggcggagctgctggagatctgcggcagcatcatcaacggcttcgcggtgccgctcaaggaggagcaccgcgggttcctgctccgggtgctgctgccgctgcaccgcgcgcgctggctgcacgcctaccaccgccagctcgtctactgcgtgctgcagttcgtgcacaaggagccggggctggccggcgccgtcgtggggggcatcctccggcggtggcccgtgaccaactgccagaaggaggtgctgctcatcgacgagctggaggagatcgtggacgccctggaccagcgccagttcgacgccctcgccgcgcccatctgctcccggatcgcccgctgcgccaccagctgcagctcccaggtggcggagcgggcgctgtacgtgtggaacaacgagcggttcctggagatggcgtcggccggcggcgccatggagcgcatcctgccgcccttcgtcgccagcgtggaggacaacctggagcgccactggagcaagtgcgtgcagcaggtcaccgccagcgtcaaggcgctgctcctgcaggtggcgccggacctctacgaccgctgcgccgccgacctcgccgccagccgcgccgaggcggacgcccgggccgccgcgcgcgacgcacggtggcataggctcgaggcggccgccgaggccaacgccgacgctgacctgagcagtagctaacgagcgtggtgtttgtttgggctttgtacattgcgtgatggcgatgccggccggcgggcaccgcaactgatggcgcggcgtcgtggctggcaaagtaccatgttggtttcagccacgacgcggcgcggcgaatatttgtgtgttttttcccaggcgcatgcgcctactgatatcggaccgagataactgcatattcgttgaaaaaaaaaaa

SEQ ID NO: 3726 - protein, 468 aa, Triticum aestivum
  misc_feature: PFam Name: B56; PFam Description: Protein phosphatase 2A
  misc_feature: PFam Name: Pkinase; PFam Description: Protein kinase domain
  misc_feature: PFam Name: Transferase; PFam Description: Transferase family
  misc_feature: PFam Name: Pyr_redox_2; PFam Description: Pyridine
  misc_feature: PFam Name: Peptidase_S8; PFam Description: Subtilase family
  misc_feature: GI Number: 6681331; NR Description: B' regulatory subunit of PP2A (AtB'beta) [Arabidopsis thaliana] >gi|21280992|gb|AAM44900.1| putative B' regulatory subunit of PP2A AtB'beta [Arabidopsis
  misc_feature: GI Number: 21537284; NR Description: B regulatory subunit of
  misc_feature: GI Number: 15222851; NR Description: serine/threonine protein phosphatase 2A (PP2A) regulatory subunit B', putative [Arabidopsis thaliana] >gi|42571451|ref|NP_973816.1| serine/threonine protein phosphatase 2A (PP2A) regulatory subunit
  misc_feature: GI Number: 9279607; NR Description: protein phosphatase 2A regulatory subunit B' [Arabidopsis thaliana] >gi|16323340|gb|AAL15383.1| AT3g26020/MPE11_17 [Arabidopsis thaliana] >gi|14194123|gb|AAK56256.1| AT3g26020/MPE11_17
  misc_feature: GI Number: 23296589; NR Description: putative AtBgamma protein [Arabidopsis thaliana] >gi|16604607|gb|AAL24096.1| putative AtBgamma protein [Arabidopsis thaliana]
MGAEVEVVARVAPPRAPGKKRTSTTLLHLLQLDNPDGVFVFAAAANKLPPPEPEPEAESLIDKIASCCRVFTFADDDAAERDAKLERLEEVLAAVRSSGKNQPPGLDHLVMVALVKMFAANLFRTMPPPATCPSVLAEAADEEAPSASLLPSWPHLQAVYDVLLAVIAAADAKALRNHIDRPFLTALLALFASEDPRERDRLKTAYHQLYAKLTPERAFMRRSMAAALLASVHECGGGVAELLEICGSIINGFAVPLKEEHRGFLLRVLLPLHRARWLHAYHRQLVYCVLQFVHKEPGLAGAVVGGILRRWPVTNCQKEVLLIDELEEIVDALDQRQFDALAAPICSRIARCATSCSSQVAERALYVWNNERFLEMASAGGAMERILPPFVASVEDNLERHWSKCVQQVTASVKALLLQVAPDLYDRCAADLAASRAEADARAAARDARWHRLEAAAEANADADLSSS

SEQ ID NO: 3727 - DNA, 1625 bp, Triticum aestivum
  misc_feature (1)..(1625): Ceres cDNA ID no. 21665876
  misc_feature (1)..(1625): Ceres CLONE  ID no. 790227
  misc_feature (1)..(1625): Also known as  Ceres CDNA ID no. 24357159
acaagacagaggcacatccgatacctccatccacacactgcctgcccactgccacaaccaccaagggcgacagagcggccgccagccatgtcgccgcctaccatgttcacgttgcagctgctccttgtcctggtggccgcaaccaccacggccgctcctgcggtcctcggcggaggaaagcaccaccgcggcgtccttagcacccccgtccgccggctcaagccggacgtgcgggtgtcgaagatcggcggcggcggcgccggcggcggcgctgtcaccgtcacctccgtcggcgaggcgttgcgtctctggaataatctgacaggagggcacttcgtcatctatgtgaccgccggcacctacgaagagcagatcatcgtacaacaaaggcgcaccaacgtggtgcttatcggcgacggcgtcggccgcacaatcatcacgggagccctgtccgataggacagggcacaacgtgatgcaatcggccacaatcagtgtgtttgctgatggtttcatggctcgggacgtgacgattcaaaacacggcgggcgggccaggcatcaaccaggccgtggctctccgggtccaggctgaccgagccgtgttctaccggtgccagatacacgggtatcaggacaccctcatggccgaattgcacctgcaattctaccgtgagtgtgagatatcaggcaccgtagactttatttttggggatgcgacagccgtgtttcaggactgcatcgtcttggcacgccggccggccgacggcaaacacgacgtcatcaccgctcaaggccgcggagcacatctcggtggttctgggttcgtgctgcagaactgcagcatcaccacggcgccaggggagacctacctgggccgtccttggaaggaccacgcaaccgtggtgtacatgttatgcaccatcgacgacatcatccacgcggacggatgggtggcttggaacaagaccaaccccaaggaacgcgtcaaaggtggcgtcactcctggccacgagggccaccttttctttggtgagttcgcgaaccacggcgccggcgccaatgtcgaccaccgcgtcgactggcatgggtttcatcgcctcaacgaggcacaggctaggctgtatgcgccggggaggttcatccagggaggcgcctggcttccccagacaggggtcccacattatctgggcctccgtgatggtgagtagtgcatccatccatcatacctgtctgcctgctgccgccgtttgagagccatccgtttgtatctctagtagtagtattgtagtagtagtagcagtagttcgtacaagtaccgcgggcatattgtacgagtgcgtagaggagcttgcagcaggatatgatggattcttcagcagtcggccaattagctagctatgtcctagctagcttctgagcatcattggcccaataaagtaagcatgcatgcgaccccctagctagctagaagctaggccagcagtccgtagtagcttgtgatcagtgatgtgtatcagtgttgtttgtgtgtgtgatcagatctgtcatgtatccattgttgagctatttgtcttggtgatgtttgcaacaaaaagtgtggttgtttgcaaaaaaaaaaaaaaaa

SEQ ID NO: 3728 - protein, 373 aa, Triticum aestivum
  misc_feature: PFam Name: Pectinesterase; PFam Description: Pectinesterase
  misc_feature: GI Number: 15081598; NR Description: pectin methylesterase
  misc_feature: GI Number: 50946339; NR Description: putative pectinesterase [Oryza sativa (japonica cultivar-group)] >gi|42407616|dbj|BAD08731.1| putative pectinesterase [Oryza sativa
  misc_feature: GI Number: 50921051; NR Description: putative pectin methylesterase [Oryza sativa (japonica cultivar-group)] >gi|30017519|gb|AAP12941.1| putative pectin methylesterase [Oryza
  misc_feature: GI Number: 15241079; NR Description: pectinesterase family
  misc_feature: GI Number: 1213629; NR Description: pectinesterase [Prunus persica] >gi|6093744|sp|Q43062|PME_PRUPE Pectinesterase PPE8B
MSPPTMFTLQLLLVLVAATTTAAPAVLGGGKHHRGVLSTPVRRLKPDVRVSKIGGGGAGGGAVTVTSVGEALRLWNNLTGGHFVIYVTAGTYEEQIIVQQRRTNVVLIGDGVGRTIITGALSDRTGHNVMQSATISVFADGFMARDVTIQNTAGGPGINQAVALRVQADRAVFYRCQIHGYQDTLMAELHLQFYRECEISGTVDFIFGDATAVFQDCIVLARRPADGKHDVITAQGRGAHLGGSGFVLQNCSITTAPGETYLGRPWKDHATVVYMLCTIDDIIHADGWVAWNKTNPKERVKGGVTPGHEGHLFFGEFANHGAGANVDHRVDWHGFHRLNEAQARLYAPGRFIQGGAWLPQTGVPHYLGLRDGE

SEQ ID NO: 3729 - DNA, 1611 bp, Triticum aestivum
  misc_feature (1)..(1611): Ceres cDNA ID no. 21665877
  misc_feature (1)..(1611): Ceres CLONE  ID no. 791111
  misc_feature (1)..(1611): Also known as  Ceres CDNA ID no. 24361233
cgtaccatcccgaccaggcgaccaccgcctccgctcaccgtcgacgactccaactccaactcgaaacaaaccccaaagccgacgccgccgcctgccccctgccccttgcccccgccgaccgcgccgaaaacatggactcgcttcttgccacctacgcctcttccgacgaagacgccgacgagagcatccccacacccgctcccgcgacccgccgcagcgaggccagcggaaagcccgccggcagcatcttctccgcgctcccgcaacccaagtcggcgcctatcttctcctcactcccggcgccgaaatccgccccgaccttctcctccaccccgcctcccaaatcctccgcttcctccggaaaccctaagcgcgtcgtccagttccgcccgccgccgatccgccagaccaccggggtcagctcggacgaggaggatgacgccgagaagcgccgtcccagcgctagcgaggcgcccccgcccccgtctgctggatcggggccggtgtcttcgttcctcccggcgcccaggcactcgcttggcttcggctccggcgcggccaggaggtcggccgtagacaccgccgggccggagaggtcaaatcttggtgctgctggcccctctagctcggctgtcaacagaggagcgccagaaaggtccgatactggccctgcggacgaggacgatcctgaggaaagcagcgatgaggacggcatgcctgctccggagcagcagcaagaacaacaggatcttggtgctggagctggagacgtccaacaccagggctatgatgctggagttggaaacgctaatgggtacgaaggctatgcatgggatccaaactattatgcatattatggtttggatccgaatagcaatttgaattatggggctgaaccacagtatgcagcatatggagtagagcaaggtggtgggtatgcaaatggatatggcggggagcacagtggtggatacgagcattcgacagcgcctccatgtggaggggaatatactggaggttacagtgctgaggctgtggcaatggcagcgccaccaatgccggagccggcactgccaccagaattgggcaggattggagtgaagagaggtaggagggatatgcctatggagattatagaggtgaatcaggcagaactggtcaagaaccgtccgagggaggacaaatccaagctcacggggatggcctttggtcctagttaccaagccgccccttcggggaagggaaagccctccaagctgcagaagagaaagcatcagatcggttctctcttctacgacctgaagcagaaggagatggagcttaccgagaggcgtgccaagggcttcctcacgaaagcggagactcaagcaaaatatgggtggtgagaatggtcacgaagacagccttgtatatcagaaattcagaatcgagctgtaactgtttatctatcttgttgtttaacattttgttgtagtgcctggtgatgtgaacccgttgtacgattataaccaaacaaatagttcattcaacctttgcttgtaaactgtgcatcaatttttacggaccatataaagaaggcaaagtgttcctgcgacaaaaaaaaaaaaaaaa

SEQ ID NO: 3730 - protein, 417 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: LMBR1; PFam Description: LMBR1-like membrane protein
  misc_feature: PFam Name: GATase_2; PFam Description: Glutamine
  misc_feature: GI Number: 6523547; NR Description: hydroxyproline-rich
  misc_feature: GI Number: 227614; NR Description: Thr rich extensin
  misc_feature: GI Number: 21992; NR Description: extensin [Volvox carteri]
  misc_feature: GI Number: 60678627; NR Description: plus agglutinin
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
MDSLLATYASSDEDADESIPTPAPATRRSEASGKPAGSIFSALPQPKSAPIFSSLPAPKSAPTFSSTPPPKSSASSGNPKRVVQFRPPPIRQTTGVSSDEEDDAEKRRPSASEAPPPPSAGSGPVSSFLPAPRHSLGFGSGAARRSAVDTAGPERSNLGAAGPSSSAVNRGAPERSDTGPADEDDPEESSDEDGMPAPEQQQEQQDLGAGAGDVQHQGYDAGVGNANGYEGYAWDPNYYAYYGLDPNSNLNYGAEPQYAAYGVEQGGGYANGYGGEHSGGYEHSTAPPCGGEYTGGYSAEAVAMAAPPMPEPALPPELGRIGVKRGRRDMPMEIIEVNQAELVKNRPREDKSKLTGMAFGPSYQAAPSGKGKPSKLQKRKHQIGSLFYDLKQKEMELTERRAKGFLTKAETQAKYGW

SEQ ID NO: 3731 - DNA, 2113 bp, Triticum aestivum
  misc_feature (1)..(2113): Ceres cDNA ID no. 21665878
  misc_feature (1)..(2113): Ceres CLONE  ID no. 792092
  misc_feature (1)..(2113): Also known as  Ceres CDNA ID no. 24357019
aacacagaccgcacttgagatcgccattcacacagccgagagagtgaggcagtcgcacgacctacgtagccttcgcttttccttccattaattttgctttgcccgctccggcccggcacgtagatagctccttcctccagacgagacgagtggtgcgtctcgttgatcgatcgaggtggtcgtttgccgaggttgaacggcgggccaatggcggggccggcgggagggcgggagctgccggacacgccgacgtgggcggtggcgctcgtctgtgccgtcatgatactcgtctccgtcgccatggagcacgccctccacaacctcggccactggttccacaagcggcacaagaaggccatgggggaggcgctggagaagatgaaggcggagctcatgctggtgggcttcatctccctgctcctcaccgtggcgcaggaccccatctccaagatatgcatctccgtggaggccggcagcaagatgctcccgtgcaagctgccctccgcttacgccggcgacggcaaggagaaccgccgaaggctcctctggctccagggcgagacccaccgccggttcctggccgccccggccggagaggacgtctgcgccaaacagggcaaggtggcgctgatgtcggcggggagcatgcaccagctgcacatattcatcttcgtgctcgccgtcttccacgtcctgtacagcgtcgtcaccatggctctcggccgtctcaaaatgaagcaatggaagaagtgggagtcggagacggcctcgctggagtatcagttcgccaatgatccatcgcggagccggttgacgcaccagacgacgttcgtgaggcggcacctgggcctgtccagcacccccggcgtcagatgggtggtggccttcttcaggcagttcttcgggtcggtcaccaaggtggactacctgacgctgcgccagggcttcatcaacgcgcatctctcgcagaagagcaggttcgacttccacaggtacataaagaggtcgctggaggacgacttcaaggtcgtcgtcggcatcagcctcaagctctggttcgtggcggtcctcatcctcttccttgatttccacgggatcggcactcttgtatggatgtctgtggttcctctcgtgatcctcttgtgggttgggaccaagctggagatggtgatcatggagatggcccaggagatccaggaccgggagagcgtcgtcaagggggctcccgtcgtccagcccagcaacaagtacttctggttcgaccgccccgactgggtcctcttcctcatacacctcacgctcttccagaacgcgtttcagatggcacatttcgtgtggacagtggtaggcacgcccggcttgaagaaatgctaccatcagaaaatgggagtgagcatcgccaaggtcgtgctcggggtggccgcccagatcatgtgcagctacatcaccttcccgctctacgcgctcgtcacgcagatgggctcacacatgaagagaagcgtcttcaacgagcagacggccaaggcgctgaccaactggcgaaaggtggccaaggagaagaagaaggcccgagacgccggcatgctgatggcgcagattggcggcgacgcgacgccgggcgtcggctcgtcgccggtgcacctgctccacaatgccggggcgcggtccgacgaccccgagagcgtgccggcgtcgccgagggccgagaaggagggcgggggcgtgcagcgtccggctgcggcgcttccggtgcacagggtacctccttgtgacgggtggaggtcggcctcgttgccggccctcgacgctcacgtccccggtgcagatttttgcttcagtacgcaacgttgatcgatcagacaaattcattcattattattttcgtgaatactcttggaaccgtatcatttcattgacagagagtagaaatagaaattacaggggtggctgtcctactactatgtatacaagggcgcagcaaaggatgccggtgagcagtagaaaagggttgctctccattgatctagttataagtgtatgtcacaaattgtttcaaaaaagagtgtatgtaataagaattgcaagtttcactgattcaaaaaaaaaaaaaaaa

SEQ ID NO: 3732 - protein, 547 aa, Triticum aestivum
  misc_feature: PFam Name: Mlo; PFam Description: Mlo family
  misc_feature: GI Number: 14334167; NR Description: MLo protein [Triticum
  misc_feature: GI Number: 14334169; NR Description: MLo1 protein [Triticum
  misc_feature: GI Number: 1877221; NR Description: Mlo [Hordeum vulgare subsp. vulgare] >gi|2894377|emb|CAA74909.1| Mlo protein [Hordeum vulgare subsp. vulgare] >gi|6016588|sp|P93766|MLO_HORVU MLO protein
  misc_feature: GI Number: 14718604; NR Description: Mlo [Oryza sativa]
  misc_feature: GI Number: 2765821; NR Description: Mlo-h1 protein [Hordeum vulgare subsp. vulgare] >gi|6016585|sp|O49873|MLH1_HORVU MLO
MAGPAGGRELPDTPTWAVALVCAVMILVSVAMEHALHNLGHWFHKRHKKAMGEALEKMKAELMLVGFISLLLTVAQDPISKICISVEAGSKMLPCKLPSAYAGDGKENRRRLLWLQGETHRRFLAAPAGEDVCAKQGKVALMSAGSMHQLHIFIFVLAVFHVLYSVVTMALGRLKMKQWKKWESETASLEYQFANDPSRSRLTHQTTFVRRHLGLSSTPGVRWVVAFFRQFFGSVTKVDYLTLRQGFINAHLSQKSRFDFHRYIKRSLEDDFKVVVGISLKLWFVAVLILFLDFHGIGTLVWMSVVPLVILLWVGTKLEMVIMEMAQEIQDRESVVKGAPVVQPSNKYFWFDRPDWVLFLIHLTLFQNAFQMAHFVWTVVGTPGLKKCYHQKMGVSIAKVVLGVAAQIMCSYITFPLYALVTQMGSHMKRSVFNEQTAKALTNWRKVAKEKKKARDAGMLMAQIGGDATPGVGSSPVHLLHNAGARSDDPESVPASPRAEKEGGGVQRPAAALPVHRVPPCDGWRSASLPALDAHVPGADFCFSTQR

SEQ ID NO: 3733 - DNA, 2096 bp, Triticum aestivum
  misc_feature (1)..(2096): Ceres cDNA ID no. 21665879
  misc_feature (1)..(2096): Ceres CLONE  ID no. 792606
  misc_feature (1)..(2096): Also known as  Ceres CDNA ID no. 24356857
acaagcgccaccacaccatctacctacctatgtgcgccggctgctaccttggtgcttgcgtagtgttcagcgagcaagagatcgatggacgcgcctcggcagcagcaggaggaggagcgcaaggagaagacgaaggcggtgaaggccgtctccgaggaggccgggtcgtcgtcctcggacaccggcgacgatggcgaggaggaggcgggcgccgtccacaaccaccgcggatggaaggccatgccctacgtcatagggaacgagacgttcgagaagctcgggacgatcggcacgctgtcaaacatgctggtgtacctgacaacggtgtaccacatgccgagcgtcaacgccgccaccctcctcaatgtattctccggcaccagcaacctcgccactgtcttcggcgcctacgtgagcgacacctacctcggccgctacaccaccatcgccgccgccaccatgtcctccttcataggcatgctcatcctcacgctcacggccgctatccacaccctccatcctcccgcgtgcaacgcgtccaaggggcaacattgtgagggtcccactggctcccagctcgccgccatcctagtgtccttcttcttcctagtcatcggtgctggaggcatccggccctgcaaccttgcctttggggccgaccagttcaacccacacactgctgatggtcgccgcggcatcgccagcttcttcaactggtactacttcaccttcacagtcgccatgatgctctcggcaaccgtcatcatctacctccagagcaacgttaattgggcgctagggctcgcagtgcctgccgcgctcatgggcctctcatgtgccgtcttcttcatgggcacacgcctctatgtccgtgtacgccccgagggcagccccttcacaagcttcgcccaagtcctcgtcgccgccgcccgcaagcgccacatccggcgagctcgcggcgatgccgagctgtttgacccaccgcaccagagtaagctcgtctccaagctggcatacaccgaccagtttgcgtgccttgataaggcggccgtgcggacccctgacgacgcgttgtgcatcgacgggaagacaccggctgacccgtggcggttgtgcacggtgcaacaggtggaggaggtcaagtgcctagcgcgcatcattccggtgtggtcgtcggggatcgtctacttcatcgtgctcacccagctgggcacctatgtcgtgctccaggctgcgcagatggaccgccgaatcagcaagtccagcagcttccagatcccgcaaggctccttcgtcgtcttccagatgctcgccctcacgatgtggatccctgtctacgaccgattcgtggtgccggcccttcgccgcttcacaaagcgcgagggcggcatcaccctgctccaacggatcggtgtcgggttggcgttgtctgtggcgacaatggtggtgtcagcggctgtggagcagcgacgacgaaagatcggctcgtcgatgtcgtgcttctggctggtgccgcagcaactgctggcgggcctgtcggaggcgttcggcgccatcgggcagattgagttctactaccggcagttcccggagaacatgcggagcgtggcgggggcgctctacttcctggggttcgcgatggcgagctacgcaagcgggctgatggtgatggtggtgcaccgggcgacgcgcgggcggggcggtcagcctgactggctggcgcaggacctggacgagggtagggtggacctgttctacctggtcaccgccgccatcgccactgtgaacctcgtctactttgtgatctgtgcacggtggtacaggttcaagaagtccgacgatgccggtgccggagatgttgagctcgacgacgacagcccgaagaaggctagtgctggtttagcttagttattattgcctccttttggggcttaatatactccgatgcatgcataggatggtagagtctaatggatatatgtgcatatgtacgtatgctcatcgatcgatcccggggaatgtatgtaatacagatttggaactaatcaaaaagccgaacaagggagattgaatagcagctaaaaaaaaaaaaaaaa

SEQ ID NO: 3734 - protein, 607 aa, Triticum aestivum
  misc_feature: PFam Name: PTR2; PFam Description: POT family
  misc_feature: GI Number: 16226701; NR Description: AT3g47960/T17F15_170
  misc_feature: GI Number: 6730698; NR Description: Similar to peptide transport proteins [Arabidopsis thaliana] >gi|21436191|gb|AAM51383.1| putative peptide transporter protein
  misc_feature: GI Number: 11933397; NR Description: nitrate transporter
  misc_feature: GI Number: 11933400; NR Description: nitrate transporter
  misc_feature: GI Number: 11933414; NR Description: nitrate transporter
MDAPRQQQEEERKEKTKAVKAVSEEAGSSSSDTGDDGEEEAGAVHNHRGWKAMPYVIGNETFEKLGTIGTLSNMLVYLTTVYHMPSVNAATLLNVFSGTSNLATVFGAYVSDTYLGRYTTIAAATMSSFIGMLILTLTAAIHTLHPPACNASKGQHCEGPTGSQLAAILVSFFFLVIGAGGIRPCNLAFGADQFNPHTADGRRGIASFFNWYYFTFTVAMMLSATVIIYLQSNVNWALGLAVPAALMGLSCAVFFMGTRLYVRVRPEGSPFTSFAQVLVAAARKRHIRRARGDAELFDPPHQSKLVSKLAYTDQFACLDKAAVRTPDDALCIDGKTPADPWRLCTVQQVEEVKCLARIIPVWSSGIVYFIVLTQLGTYVVLQAAQMDRRISKSSSFQIPQGSFVVFQMLALTMWIPVYDRFVVPALRRFTKREGGITLLQRIGVGLALSVATMVVSAAVEQRRRKIGSSMSCFWLVPQQLLAGLSEAFGAIGQIEFYYRQFPENMRSVAGALYFLGFAMASYASGLMVMVVHRATRGRGGQPDWLAQDLDEGRVDLFYLVTAAIATVNLVYFVICARWYRFKKSDDAGAGDVELDDDSPKKASAGLA

SEQ ID NO: 3735 - DNA, 1623 bp, Triticum aestivum
  misc_feature (1)..(1623): Ceres cDNA ID no. 21665880
  misc_feature (1)..(1623): Ceres CLONE  ID no. 793635
  misc_feature (1)..(1623): Also known as  Ceres CDNA ID no. 24356906
attgccttcacaagtctatccttcccgcgtcaacggcagcaggtccatggcgaacaccgtgatcctgtaccccggcctcaccgtgagccacttcgtccccatggtgcacctcgccggcgccctcgccgaccacggctacgccgtctccgtcgcgctcatcgaccccgccgtcaacggggaccccgccttccgcgccgtcgtcgcccgcgcggtcgcctccatgccgtccatccgattccacgcgctcccgccctccgaggacgcgcccacgctgagccccgacgcgccgttcatccccaggtacctcgacatcgtcggccgccacaacgaccgcctccgcgacttcctccgctcctttgcacgcggcgtccacgccgtggtcgttgactcgctgtccgtcggggcgctcggcgtcgccaagcggctcgggatccccgggtacgtcatgttcacctccggcgcggccgcgctcgccgccttcgtccagcttccttccgtcctcgctgaggtgcggacgaggttccaggagctaggcgacgcgccgctcgagttattcggccttccgcccatgcctgcctcccacctgctcggcgaattgctcgaggaccctgagagcgacacctacaaggcgacggtgatcgcgctgtacgggatcccggagggcgatggcatcctggtgaacacgttcgagtcgctggatgctggggtggtggcggcgctcggcgaccctcggtgtctcccgggccggatcatgccgccggtgtactgcgtcgggccattcgttgggggcgtcggaatcgaggcgaaagaccggcatgagtgcctcacgtggctagacgggcagccggacggcagcgtcgtgttcctctgcttcggcagcgggggaagccactcggcggagcagctcaaggagatcgccgtcggcctggagaactgcggccaccggttcctgtgggtcgtgggaaaccctttcaacgacgaccaggccaagcagttcgaccaggacctcgacgctctcttgccgaaccggttcctggcccgcaccagcggccgtggcctcgttgttaagcagtgggtgccgcaagcagaggtgctccgccacagggccaccggcgcgttcgtgacgcactgcgggtggaactctgtgctggagggcctgacggccggcgtgccgatgctgtgctggccgctgtacgcggagcagaagatgaacatgctgcgcatggtgggggagattggagtcgccgcggagatggtcgggtggcagcgggggctggtcgaggcagccgaggtggagggcaaggtgaggctggtcatggactccgaggatcgcatggagctccgggcgcgggcggcggcacacaaggaaggcgcggccgcggcctggagcgacggcggctcgtcgcgcgcggcgattgccaggttcttggccgacgtcgacagccggcagcctcagactcgtggtgatcggtgagagtgagcgtggacttggcatgcatacagtacatgcttcttgatgcatctcgtaccagagcgcgcatacagatgataatcgcattcgctgaggccaatgcatatgaaaatgaagttcaatgggcgatttctccaaaaaaaaaaaaaaaa

SEQ ID NO: 3736 - protein, 475 aa, Triticum aestivum
  misc_feature: PFam Name: UDPGT; PFam Description: UDP-glucoronosyl and
  misc_feature: PFam Name: Cation_efflux; PFam Description: Cation efflux family
  misc_feature: PFam Name: Mucin; PFam Description: Mucin-like glycoprotein
  misc_feature: PFam Name: Pkinase; PFam Description: Protein kinase domain
  misc_feature: PFam Name: MAGE; PFam Description: MAGE family
  misc_feature: GI Number: 52353391; NR Description: putative flavonol
  misc_feature: GI Number: 34908644; NR Description: putative flavonol 3-O-glucosyltransferase [Oryza sativa (japonica cultivar-group)] >gi|15408689|dbj|BAB64095.1| putative flavonol 3-O-glucosyltransferase [Oryza sativa (japonica cultivar-group)]
  misc_feature: GI Number: 34910206; NR Description: putative flavonol glucosyltransferase [Oryza sativa (japonica cultivar-group)] >gi|15624028|dbj|BAB68082.1| putative flavonol glucosyltransferase
  misc_feature: GI Number: 34910204; NR Description: putative flavonol glucosyltransferase [Oryza sativa (japonica cultivar-group)] >gi|15624027|dbj|BAB68081.1| putative flavonol glucosyltransferase
  misc_feature: GI Number: 52353393; NR Description: putative flavonol
MANTVILYPGLTVSHFVPMVHLAGALADHGYAVSVALIDPAVNGDPAFRAVVARAVASMPSIRFHALPPSEDAPTLSPDAPFIPRYLDIVGRHNDRLRDFLRSFARGVHAVVVDSLSVGALGVAKRLGIPGYVMFTSGAAALAAFVQLPSVLAEVRTRFQELGDAPLELFGLPPMPASHLLGELLEDPESDTYKATVIALYGIPEGDGILVNTFESLDAGVVAALGDPRCLPGRIMPPVYCVGPFVGGVGIEAKDRHECLTWLDGQPDGSVVFLCFGSGGSHSAEQLKEIAVGLENCGHRFLWVVGNPFNDDQAKQFDQDLDALLPNRFLARTSGRGLVVKQWVPQAEVLRHRATGAFVTHCGWNSVLEGLTAGVPMLCWPLYAEQKMNMLRMVGEIGVAAEMVGWQRGLVEAAEVEGKVRLVMDSEDRMELRARAAAHKEGAAAAWSDGGSSRAAIARFLADVDSRQPQTRGDR

SEQ ID NO: 3737 - DNA, 2000 bp, Triticum aestivum
  misc_feature (1)..(2000): Ceres cDNA ID no. 21665881
  misc_feature (1)..(2000): Ceres CLONE  ID no. 793753
  misc_feature (1)..(2000): Also known as  Ceres CDNA ID no. 0
ctcgtgctgccctactaaaaaaataaaaaaagtgaggaaaatctggtgttgctaatgctgtacgctggcgagctcaaccactccagcctgctgctccgaccaaagcgtggagccggacgaagcaaccaatctggatccctcaggccggtttctcgcaggaggcagcgtagggcggtggcgcggcacccggcggggtcacgggagcacaggtgcgcaagttagagcgattcgggaagcacaggctttggatttggagtcgtgcgcgcccccgttgacattttttctagctccgccactgcggtgtactagtggaatgcttacgagcaaatgaggaagagctgtggccttaactccggtccagggcggcccttcaacgaccgccggtggctgctccccttcctcgcgagcctcctcgtgtcggtcaccctcttcctggccgccgcctgcggcctcttctcgccgccctacttggccggcgacgacgccttcctcgtcgacgtcgtctcgttcaccgactgggacgatggaggcgcaccgtcgcagcgagacagcggccagtcagtggaacccgaggccaaggaccagctgctggatgacaacgacaaccccgacaacgccgccgtgaactcggacgattccgacgccgagccgcccaggctggcgtatctcctcgagggcaccaagggcgacggcctgcggatgcggagggtgctgcaggcgatataccacccgcgcaaccagtacatcctgcacttggatctggaggcgccgccccgggagaggattgacctggccatgtacgtcaagggggacccgatgttcagccaggtcgggaatgtgcgggtgatcgccaagggcaacctggtcacgtacaaggggccgacgatggtcgcctgcacgctccacgccgtggcgatcctcctcaaagaaggcttggagtgggactggttcatcaacctcagcgcctcggattatcccctcatgacgcaagatgatatacttcatgtattctcgtctttgccaagaaatcttaattttatagagcacatgcaaatatctggatggaaaaggatccaaagagcaaaacccatagttctggacccagggctttatctgtcaaaaaagtttgacctttctacgacacctgagcggcgagaactgccaacatctttcaaattatatactggttctgcttggataatgctcacgaaatccttcctggagtactgcatatggggttgggataatctgccacgcaccctcctgatgtactatgtcaacttcatctcctcaccagaaggttatttccatactgtgatctgcaactctgatgagtttcagggcactgcagttggtcatgacctgcactacattgcctgggactaccctgcaaaacagcatccgctgaccctctccatgaaggacttcaacaacatggtcaagagtggcgcaccctttgcacggaagtttcccaaggaagacaaggtcttggacaggatcgaccgtgagcttctgcaccgctctgaaggccggttcattcctggggcatggtgtaatgggagctttgaaggaggggctgacccttgtttgtctaggcaggaagactctgttttagagcctggtccaggcgctgagaggctgcgcggcttgatgaagaaggtgctgtcatgggattaccgcaacggcagctgctcgactctctcgtacgatcaaacaaagagagactggtatgttcccaaaagtaaaggataattttgattgcctgcttgtaaatgaaagagcttgaccccttccattgaaatgaacaatgctgatgagtgcgtcattctgaccaaggaaaatgttaaaatggtgatgttcataccacgatacacactaccatctcatggaaattaacaattgtggaagacttcattttcagttctacaatctttgctgtagtccaaacaggaaatggatccttgtatcatacatgttctttctcaaaaaaaaaaaaaaaa

SEQ ID NO: 3738 - protein, 474 aa, Triticum aestivum
MRKSCGLNSGPGRPFNDRRWLLPFLASLLVSVTLFLAAACGLFSPPYLAGDDAFLVDVVSFTDWDDGGAPSQRDSGQSVEPEAKDQLLDDNDNPDNAAVNSDDSDAEPPRLAYLLEGTKGDGLRMRRVLQAIYHPRNQYILHLDLEAPPRERIDLAMYVKGDPMFSQVGNVRVIAKGNLVTYKGPTMVACTLHAVAILLKEGLEWDWFINLSASDYPLMTQDDILHVFSSLPRNLNFIEHMQISGWKRIQRAKPIVLDPGLYLSKKFDLSTTPERRELPTSFKLYTGSAWIMLTKSFLEYCIWGWDNLPRTLLMYYVNFISSPEGYFHTVICNSDEFQGTAVGHDLHYIAWDYPAKQHPLTLSMKDFNNMVKSGAPFARKFPKEDKVLDRIDRELLHRSEGRFIPGAWCNGSFEGGADPCLSRQEDSVLEPGPGAERLRGLMKKVLSWDYRNGSCSTLSYDQTKRDWYVPKSKG

SEQ ID NO: 3739 - DNA, 1417 bp, Triticum aestivum
  misc_feature (1)..(1417): Ceres cDNA ID no. 21665882
  misc_feature (1)..(1417): Ceres CLONE  ID no. 794171
  misc_feature (1)..(1417): Also known as  Ceres CDNA ID no. 23483617
ggaaaagtccattcaaccttcggaaaactttctacgccgtagctgcagcactgcacttccgctatgcaccgctcaaccaccattgccaagctcgccttgctcctcctcgccactgcagccatgtcatgcggcttcttcgccgtcgcccatgcgcatgcgcggaagagctgctggccgcgcgagagggacgtgttgctggccttgaagcagggcatcaacgacaccgacggcgtcctcgcctcatggcaaaaactgcgccatgactgctgccgctggacgggcgtcgcctgcagcaacgaaaccggccatgtcaccgagcttgacatcggtctcagctggttgttcggccagataagtccttccttgctttctctccagcatctcgactacctggatctcagcaccacctccctagttggaccaaacggcagcagtgtattcccagatttcttgtcttctttgcacaacttgagacatctcgatctcgcccgcacgccatactctggtagaattcctgctcagctttccaatctttcaaatttggagtatctcgatctcagttggacatccctgcatggtcgtgctcagttcctgttttcttacaaaaacttgagacatctcgatctctccagaatgctcttttctggtacactgccgcgacagctaggcaatctatcaaacttgcaacaccttgacctccgttatatgcaaaatatacacacagcagatgtctcatggataactcatatgcatttcctggaatatcttgacatgagtgacataaatctcagcaccgccgacgtgttccctgtgtccaacacaatcccaactctcaaggacctcattcttagtaactgctcacttccaaatgcaaaccagccgctaaaacacctaaacctcacaagacttgagctgcttgatctcagcagcaactatctaggccatcgaattgatacgagttggttttggaacataacaggcatcacaggtcagggtggacgcggtccggtccggtccgggctttgaccgagccagcctttggaccggccgcggccggtccggtccggaccggaccaaggtggccagcgagcctactatccaggaccggaccgagaggagcaaagctcggccagcccgaatggaccgaatgggaccgatggctgggactctgtttaggctattttccagcctgggagtgctttgttggccattgtttaggctgttttgacgtatttagactgtagctgtacctgggagtgctctattaagcgttttggccattatttagcagtgccctgttgcgctttttggccacaatttaggctgtccaaatttagtgagtgctctgtttctgtataatgactagtatggcataagtaatttggacagcattttatttgcaaaaaaaaaaaaaaaa

SEQ ID NO: 3740 - protein, 320 aa, Triticum aestivum
  misc_feature: GI Number: 5739323; NR Description: Cf2/Cf5 disease
  misc_feature: GI Number: 44888778; NR Description: LRR protein WM1.7
  misc_feature: GI Number: 50906865; NR Description: putative HcrVf2 protein [Oryza sativa (japonica cultivar-group)] >gi|47848049|dbj|BAD21834.1| putative HcrVf2 protein [Oryza sativa
  misc_feature: GI Number: 44888781; NR Description: LRR protein WM1.2
  misc_feature: GI Number: 44888782; NR Description: LLR protein WM1.1
MHRSTTIAKLALLLLATAAMSCGFFAVAHAHARKSCWPRERDVLLALKQGINDTDGVLASWQKLRHDCCRWTGVACSNETGHVTELDIGLSWLFGQISPSLLSLQHLDYLDLSTTSLVGPNGSSVFPDFLSSLHNLRHLDLARTPYSGRIPAQLSNLSNLEYLDLSWTSLHGRAQFLFSYKNLRHLDLSRMLFSGTLPRQLGNLSNLQHLDLRYMQNIHTADVSWITHMHFLEYLDMSDINLSTADVFPVSNTIPTLKDLILSNCSLPNANQPLKHLNLTRLELLDLSSNYLGHRIDTSWFWNITGITGQGGRGPVRSGL

SEQ ID NO: 3741 - DNA, 1353 bp, Triticum aestivum
  misc_feature (1)..(1353): Ceres cDNA ID no. 21665883
  misc_feature (1)..(1353): Ceres CLONE  ID no. 798181
  misc_feature (1)..(1353): Also known as  Ceres CDNA ID no. 24357015
gcagtccgacgacgcaagtacaccaccccaccgcgccgccaccactcacccatcgatcgggagctagccaccatgcaggcccagggcatcctccgcgtccccggtcacctgccgacggcgctgcccctcccgcgccggcaatgccgccgcgtgtccgctgcggcggccgtggcggcggcggcgccgtcggtgcagcgcggcgtgacgcactcgatgccgccggagaaggcggaggtgttccagtcgctgcggggctgggcggcggggtcgctgctgccgctgctcaggcccgtggaggacatctggcagccggcggacttcctgccggactcgtcgtccgagatgttcgagcacgaggtgcgcgagctgcgggcccgcgccgccgcgctgcccgacgagtacttcgtggtgttggtcggggacatggtcaccgaggaggcgctccccacgtaccagaccatgatcaacaccctggacggcgtccgcgacgagaccggcgccagcgcctgcccctgggccgtctggacccgcgcctggaccgccgaggagaaccgacacggcgacgtcctcaacaagtacatgtacctctccggccgcgtcgacatgcgcatggtcgagaagaccgtccagtacctcatcggctccggcatggacccgaggacggagaacaacccgtacctgggcttcgtgtacacgagcttccaggagcgcgcgacggccgtctcccacggcaacaccgcgcggctcgccaaggcgcacggcgacgacgtgctggcgcgcacctgcggcaccatcgccgccgacgagaagcgccacgagacggcctacagccgcatcgtggagcagctgctgcggctcgacccggagggcgccatgctcgccatcgccgacatgatgcgcaagcggatcaccatgcccgcgcacctcatgcacgacggcagcgacatggacctgttcgagcatttcgcgtctgtggcccagcgcctcggcgtgtacaccgcgcaggactacaccgacatcgtcgagttcctcgtcaagcggtggaagctggaggcgctggagggcgggctctccagcgaagggcggcgggcccgggacttcgtctgcgggctcgcgccgaggatgcggcgcgcggcggagagggcggccgacagggccaagaaggacgagcccaggaaggtcaagttcagctggatctttgacagggaagtggttgtctgagatagctatagtgttggcctgacttctgagactactgagatagtgacatgatcctgtaatgtcgttctgtgttcttgtgttcctctctttgcaaagttggtttatagtgccttttgaaaaaaaaaaaaaaaa

SEQ ID NO: 3742 - protein, 382 aa, Triticum aestivum
  misc_feature: PFam Name: FA_desaturase_2; PFam Description: Fatty acid
  misc_feature: GI Number: 34907410; NR Description: putative stearoyl-acyl carrier protein desaturase [Oryza sativa (japonica cultivar-group)] >gi|21952814|dbj|BAC06230.1| putative stearoyl-acyl carrier protein
  misc_feature: GI Number: 4704824; NR Description: stearoyl acyl carrier
  misc_feature: GI Number: 533084; NR Description: delta-9 stearoyl-acyl
  misc_feature: GI Number: 3355632; NR Description: stearoyl-acyl carrier
  misc_feature: GI Number: 474833; NR Description: stearoyl-acyl carrier protein desaturase [Solanum commersonii] >gi|3915030|sp|Q41319|STAD_SOLCO Acyl-[acyl-carrier-protein] desaturase, chloroplast precursor (Stearoyl-ACP desaturase)
MQAQGILRVPGHLPTALPLPRRQCRRVSAAAAVAAAAPSVQRGVTHSMPPEKAEVFQSLRGWAAGSLLPLLRPVEDIWQPADFLPDSSSEMFEHEVRELRARAAALPDEYFVVLVGDMVTEEALPTYQTMINTLDGVRDETGASACPWAVWTRAWTAEENRHGDVLNKYMYLSGRVDMRMVEKTVQYLIGSGMDPRTENNPYLGFVYTSFQERATAVSHGNTARLAKAHGDDVLARTCGTIAADEKRHETAYSRIVEQLLRLDPEGAMLAIADMMRKRITMPAHLMHDGSDMDLFEHFASVAQRLGVYTAQDYTDIVEFLVKRWKLEALEGGLSSEGRRARDFVCGLAPRMRRAAERAADRAKKDEPRKVKFSWIFDREVVV

SEQ ID NO: 3743 - DNA, 2374 bp, Triticum aestivum
  misc_feature (1)..(2374): Ceres cDNA ID no. 21665884
  misc_feature (1)..(2374): Ceres CLONE  ID no. 798706
  misc_feature (1)..(2374): Also known as  Ceres CDNA ID no. 24356966
tttatctctcccagactttcccccattcccctcgaaccctagcggctgccggcgacgacgccgtcgcctggccgccccgtgaccgaccacgacctgccgagctcctccgcgacaccctcgaccccggtctcccgacgcctgctccctctcttcctcaaggacacaaactcaaagatgggaaagggtgacagggagaaggaagcgaagcgccgacgacgcggccgcagcagcaagagatcgcgcaatgccacaccctcttcggactctgattcttccccttcgccggactcctctcctagccgcagccccggaccccggagtcgcagtagcagcaaacctgaaaagtcgtcctcatctcgtcgccgccgccatcaccacaagagcagtggccgctcacgcagttcccgtgacgatgatagacatcgtcacaggcggaggcgccgggatgagcgtgcccgtcacagcagcgatggcagcgacatgtcgggatcaggctcagatgattcaggatggatcgaggaggcgcaggaaatcgtccgtggcattctcagtgaattccctgccatcaccagcgagcttcgtcagcttctccaaatgatagatagtggtgaaggcattgatatttctggaatttctgacaagccattggtgaagcgtttgaagaaacttttcagatccctcaaattgaaagaaagtgcaaatggagcttacttgcttgcagcaaaaggtgttcctacccttgatgttgttggaccagtattagcagcaagtgccaaacatggaaatgatccaaatgaaactgtggcacgaaatagacaacaagtaccgttgcctaactttgacgtacaaaataaagatgacatccctcctgaagatggaggagaagttgaccgggaagaggacacccctataaagagggtaattggtcctgcaatgccatcacgtgaattactagctgcagcagccgaaatgacagaggctcttaggtgccgggatgctgaattggaagctgatgatggatttcttataggtcctccaccaccagccatggtcgctgaagctgcatctgcaaatgaagccgagcgatttgaagaggttactcgaatattgggtgctgatgcagacgccctctatgatgttctgggcataaattggaagatgtcgtctgataacatcaagaaaaggtattggaagctatctcttttagtgcatccggacaagtgccctcatccttcagcacaggaggcttttgtgaaattgaacaatgcttttaaagacttgcaagaccctcaaaagagaggcgcaatagatgagaagatacaaaagaaagaagagatggaacaattcgaggttgagcttaaagcaatgcgcgaggctgcagaatggagacgattacaaggtatatctcttgaaggcgatgaagaacttttggcagttccgaaacagccagaggcaccgcctacacgagacgaatggatgactacattgccacctgaaagaaaagctggagtaccaatgcattcaactacggcatttagcatgaatggcaaagaaggacgtggtgacacaagtgcatggacagatagtccacttgatagagcccagaaagcacagcaaaactacttagaagcctacaacaaagcgaaggcaattgcagatggacatgaagagcagggcaaaagcgcaaatgcttctcttgtggataaatacaactcctccaagcggtcggtatctcttgtgcagaagcaccgagagaacaaaaaggagaaaaaaaagcagaagcaacaacgagggaaggaagaatgggaggagaaccacccatggaagccgtgggaccgtgagaaagacttgaccgctgggcggcaaaatgtggctttggatccagagaacacggcacaaggattgtcgtcccgtttctcatctggagctgtgcagaggaacttcctgtgagcaattgcagtcaggctgctcgaggcaattgcagtcagactgcttgagcatgccttgattggtggccagtacgatggtacgtatttgttttcggatcccggagttgataggggcacagaaaccatagagaatgtaaggtttgtggcatctgctatatgaactaggttcgcatgttgtttcctggagagagagctgaagttattgcttgtgagttgtttcgaactgtataacaataccaggcaggtcttcgttcatggctcattactcccgagtccgaagaactatgtttttagagtcaaaaggatggaataatgttgtatactatcctgctatgctaccagtcattggctgatgatgctaacctactgatacttattgcaagtacaatgagcttttgctaaaaaaaataaaaaaaaaaaaaaaa

SEQ ID NO: 3744 - protein, 591 aa, Triticum aestivum
  misc_feature: PFam Name: DnaJ; PFam Description: DnaJ domain
  misc_feature: GI Number: 34914410; NR Description: P0516D04.3 [Oryza sativa (japonica cultivar-group)] >gi|20804698|dbj|BAB92385.1| P0516D04.3
  misc_feature: GI Number: 42562967; NR Description: DNAJ heat shock
  misc_feature: GI Number: 7920153; NR Description: lipopolysaccharide
  misc_feature: GI Number: 55959529; NR Description: RP11-245H20.2 [Homo
  misc_feature: GI Number: 1228982; NR Description: C4SR protein [Xenopus laevis]
MGKGDREKEAKRRRRGRSSKRSRNATPSSDSDSSPSPDSSPSRSPGPRSRSSSKPEKSSSSRRRRHHHKSSGRSRSSRDDDRHRHRRRRRDERARHSSDGSDMSGSGSDDSGWIEEAQEIVRGILSEFPAITSELRQLLQMIDSGEGIDISGISDKPLVKRLKKLFRSLKLKESANGAYLLAAKGVPTLDVVGPVLAASAKHGNDPNETVARNRQQVPLPNFDVQNKDDIPPEDGGEVDREEDTPIKRVIGPAMPSRELLAAAAEMTEALRCRDAELEADDGFLIGPPPPAMVAEAASANEAERFEEVTRILGADADALYDVLGINWKMSSDNIKKRYWKLSLLVHPDKCPHPSAQEAFVKLNNAFKDLQDPQKRGAIDEKIQKKEEMEQFEVELKAMREAAEWRRLQGISLEGDEELLAVPKQPEAPPTRDEWMTTLPPERKAGVPMHSTTAFSMNGKEGRGDTSAWTDSPLDRAQKAQQNYLEAYNKAKAIADGHEEQGKSANASLVDKYNSSKRSVSLVQKHRENKKEKKKQKQQRGKEEWEENHPWKPWDREKDLTAGRQNVALDPENTAQGLSSRFSSGAVQRNFL

SEQ ID NO: 3745 - DNA, 1748 bp, Triticum aestivum
  misc_feature (1)..(1748): Ceres cDNA ID no. 21665885
  misc_feature (1)..(1748): Ceres CLONE  ID no. 798851
  misc_feature (1)..(1748): Also known as  Ceres CDNA ID no. 24767042
acgatggttttgatactgaagataggaagtacaagcacttcgttcaagttcgcaatataattgtggcgcggtcgtctccctccctccgccgtaaagaaatataagagcatttccacctctccacggctgtctccgccgggacgccatggcagaagccagcagcgaggccaccggcgcagcgcctccacctctccacgtcgtggtgttcccatggctagcgttcggccatttcacccccttcctcgagctctccgagcagatcgccaggcgcgggcacgccgtcaccttcgtctccacgccgaggaacgtcgccaggctgaggcccgtcaacccccgcatccgcctcctccccctgcccctgccgagcgtcgacggcctgccggacggcgccgagtccacggccgacgtcccgccagagaaggtggacctcctcaaggtggcgttcgacggcctcgccgctccttttgcccgctttcttcacgaggcttgcgccggcggggacggcgcgacggagttcggcaagaggcccgactggatcttcgtcgacttcgcacactactggctcccacccatcgctgagcagcacaaggtaccgtgcgccttgttccacatctgcccggcgccgttcgtggccttcatcggccccaaggcggcgaacgaggcgcacccgcggacgacggcagaggacctgatggcgcagccgcggtggatcccgttcccgaccaccatcgcccaccgtctccacgaggccaaggacatgctagtccagacgttccgcgccaacgcgtccggcccgtccgacgcctgccggctctggcagacggagcagcgctgcccgctcgtgatcctgcgcggcagccgcgaggtcgacggcccgctctgcggccccttcctcgccgacctcttcggcaagcccgtcgccctctgcggcctcctcgccccatacgacgccgcgctcgccgcccaagaaacactcgacgacgagagcgagagcgagagcgcgagcctcatgcgctggctggacgagcagccggcgaggtccgtgatctacgtcgcgttcgggagcgaggcgccgctgacccgccaccacgtccgcgagctcgcgctcgggctggagctcgcgggcgcgcggttcctctgggcgctgcgggggccgagcgccgccctgctcccggacgggttcgaggagcgcgtggccgtgggcgggcgcggcgtggtgcgcgccgggtgggtgccgcaggtgcgcgtcctggcgcgcggcgcggtgggcgcgttcctgacgcacgccgggctgagctcgctcacggagagcttcctgttcggccacccgctggtgatgctgccgctgttcctggaccagggcgtgacggcgcgcggcatggcggcgaggggcgtcggcctggaggtgcccagggaagagggcgacggctcgttcggcagggacgacgtggccgcgacggtgcggcgggtgatggcggagggcgaggaagggaaggcgttcgcgcgcaacgccggggagctccaggcggttctctgggacagagcgaagcaggacgagtacgtcgacgatctggtggcagagcacttgctgcgcctgcgcctgtgatgctgcctcagcgaggctgcttctcgtggacagtgagtgtgcgatgctcagtgctcggtaatgctattcgtacgtacttcctctgtaaaaaataatactgtaatatataaagtaaaataatacggtaaaaaaaaaaaaaaaa

SEQ ID NO: 3746 - protein, 486 aa, Triticum aestivum
  misc_feature: PFam Name: UDPGT; PFam Description: UDP-glucoronosyl and
  misc_feature: PFam Name: Glyco_transf_28; PFam Description:
  misc_feature: PFam Name: Aldedh; PFam Description: Aldehyde dehydrogenase family
  misc_feature: PFam Name: FH2; PFam Description: Formin Homology 2 Domain
  misc_feature: PFam Name: Transformer; PFam Description: Fruit fly
  misc_feature: GI Number: 50935007; NR Description: putative UDP-glucosyltransferase [Oryza sativa (japonica cultivar-group)] >gi|34393982|dbj|BAC83830.1| putative UDP-glucosyltransferase
  misc_feature: GI Number: 50935013; NR Description: putative UDP-glucosyltransferase [Oryza sativa (japonica cultivar-group)] >gi|34393985|dbj|BAC83833.1| putative UDP-glucosyltransferase
  misc_feature: GI Number: 50919219; NR Description: putative UDP-glucoronosyl and UDP-glucosyl transferase [Oryza sativa (japonica cultivar-group)] >gi|41469414|gb|AAS07237.1| putative UDP-glucoronosyl and UDP-glucosyl transferase [Oryza sativa
  misc_feature: GI Number: 50934999; NR Description: putative UDP-glucosyltransferase [Oryza sativa (japonica cultivar-group)] >gi|34393978|dbj|BAC83826.1| putative UDP-glucosyltransferase [Oryza sativa (japonica cultivar-group)]
  misc_feature: GI Number: 50909939; NR Description: putative UDP-glucosyltransferase [Oryza sativa (japonica cultivar-group)] >gi|46806235|dbj|BAD17459.1| putative UDP-glucosyltransferase
MAEASSEATGAAPPPLHVVVFPWLAFGHFTPFLELSEQIARRGHAVTFVSTPRNVARLRPVNPRIRLLPLPLPSVDGLPDGAESTADVPPEKVDLLKVAFDGLAAPFARFLHEACAGGDGATEFGKRPDWIFVDFAHYWLPPIAEQHKVPCALFHICPAPFVAFIGPKAANEAHPRTTAEDLMAQPRWIPFPTTIAHRLHEAKDMLVQTFRANASGPSDACRLWQTEQRCPLVILRGSREVDGPLCGPFLADLFGKPVALCGLLAPYDAALAAQETLDDESESESASLMRWLDEQPARSVIYVAFGSEAPLTRHHVRELALGLELAGARFLWALRGPSAALLPDGFEERVAVGGRGVVRAGWVPQVRVLARGAVGAFLTHAGLSSLTESFLFGHPLVMLPLFLDQGVTARGMAARGVGLEVPREEGDGSFGRDDVAATVRRVMAEGEEGKAFARNAGELQAVLWDRAKQDEYVDDLVAEHLLRLRL

SEQ ID NO: 3747 - DNA, 1970 bp, Triticum aestivum
  misc_feature (1)..(1970): Ceres cDNA ID no. 21665886
  misc_feature (1)..(1970): Ceres CLONE  ID no. 798931
  misc_feature (1)..(1970): Also known as  Ceres CDNA ID no. 0
gagtaggagtcggagtagcgccgtgtcgtgtcgtgtgtggtgtcttccactcactcccgcccccgccggacccctgcctgccgccctcgccgcgcgggaacgcagatgcggcggccctgacccctgagcgagggccgatcgggatgaagtggggaggaggaggagtcgccttcgcgttgctcgcggcggtggtcggcgtcgcggccgccgcggagggggactcgctcgccggactcgccgcgggcatcgacggcgccgcgccagaggtgaaggaattggggccatgggcgaaggggctgctgaacgggatgccggatggggcagcagggccggcggccatggggcccgtcgccaagtatccgttggtactggccgaggacaggacgcggcggccggacgttctccgccatctcaggatgtatggaggtggttggaacatcaccaacaagcactactgggcgtctgtatcattcacaggggttgctggatttctccttgctgccctgtggtttatttcatttgggattgctgcagcttcattctgcttttgtaaatcaagagtgggcaaagcaaaggtttctcatgcagatgtagcacgacctgtgttgcttgtggttgctgtgcttgctttattaactggatgcattgtccttctctatgggcagaatgaattccgtgaagaagctaccgatactttggattatgttgtcaaccaatctgatttcactatccagacactgaggaatgttacagattacttgtcatttgcaatgacgatcaatgtggcagcactgtatcttccatcagatgtgcaggctcagattaacaatttgaaagtggacctaaataaagcagctgataccatatctttgaagacaacagaaagctacaaaaggatcagaaaagttctccataatgtgtctgttgcattgatttgcatagctgtgttaatgcctgttcttgcattccttggatatgttctggagctatacggaccaagatatacagtttacacatttgctaccatatgctggaacatagtggcagctctcttcattcttatcgggattcttttgatagttagcagtgcttcaaaggatacatgccaggcaatggacgaatgggcagaccatcctcgagcagaaactgctctcagcaacatccttccatgtgtggacgcgagtacaaccaaccgaaccttgtaccagagtaaacaagtcgtggtgcagctcgtgaagttggtcaacagggctatatccgctctttcgaaccgaaaagagcgccatctgcatcctgggcagctcatgccttacctgtgttctccctacgatgaaaacctgaatgatcggcagtgcttgtctaaggaggtgacatttgacaatgcaacgacagcatggcaggactacacgtgcaacgctcccgacgcggacgcgtgctccggcccaagcaccgtgacaccggagatctacagccagcttgtcacagcggcgaacgtgagctacgcgctgcaccactacgcgccgcccatgctcaacttccaggactgcaagtttgtgcgcgacacattcagctccatcgcctcgcagtactgcccgcccctggagcacgacctcagcctcgtctccgcggggctggcgctcctcgcctcgggcctcgtcctcggccttctcctgatgctctttgcggaccgcccccgaaaaagggaggaggtgtccgagcagacgtcggggttcagagtcgcacccgtagactgctccccgtgacagacagacaggggatgcatgagtacattttttttacttctgttgtcatcgtaaaattagtaaagcttcgtggttactgaaaccagtatagtataagtttgaggactagttaggggagggaagaaggcctgagcactaccggggtgacaaagggggaagaaaccccattttgcagcgaagagtttggtgcgaaaaaaaaaaaaaaaa

SEQ ID NO: 3748 - protein, 539 aa, Triticum aestivum
MKWGGGGVAFALLAAVVGVAAAAEGDSLAGLAAGIDGAAPEVKELGPWAKGLLNGMPDGAAGPAAMGPVAKYPLVLAEDRTRRPDVLRHLRMYGGGWNITNKHYWASVSFTGVAGFLLAALWFISFGIAAASFCFCKSRVGKAKVSHADVARPVLLVVAVLALLTGCIVLLYGQNEFREEATDTLDYVVNQSDFTIQTLRNVTDYLSFAMTINVAALYLPSDVQAQINNLKVDLNKAADTISLKTTESYKRIRKVLHNVSVALICIAVLMPVLAFLGYVLELYGPRYTVYTFATICWNIVAALFILIGILLIVSSASKDTCQAMDEWADHPRAETALSNILPCVDASTTNRTLYQSKQVVVQLVKLVNRAISALSNRKERHLHPGQLMPYLCSPYDENLNDRQCLSKEVTFDNATTAWQDYTCNAPDADACSGPSTVTPEIYSQLVTAANVSYALHHYAPPMLNFQDCKFVRDTFSSIASQYCPPLEHDLSLVSAGLALLASGLVLGLLLMLFADRPRKREEVSEQTSGFRVAPVDCSP

SEQ ID NO: 3749 - DNA, 1392 bp, Triticum aestivum
  misc_feature (1)..(1392): Ceres cDNA ID no. 21665887
  misc_feature (1)..(1392): Ceres CLONE  ID no. 798977
  misc_feature (1)..(1392): Also known as  Ceres CDNA ID no. 24360358
tttttcggtgtttgctttagaaggggagagtttggtctacacacaccaccacatgaagagcatggtgacgccattgacgagggtcttaccctttcgtcacccaaatggccataatacccttccattttctcttacacgctacccttcttcaccaaacttctccttctcccctctcactctcactctttccatggctgcttcaccccaatcctccgctccaactgtgtcgcctggtgatgttaacatcgacaaagatggtgtatttcaattgattcaagctcatcaggaaaaagctgctagacttccaccagttgaggagattcgaactgtccttgatcgtagcgtgcgcgggatgctctctacattctcaaagaagtttgatggttatccatcagggtctatggttgactttgcatgtgattcaaatggatatcctatattagcagtgagcgacttggcagttcattcaaaggacctaactgccaatcctaaatgttcattgcttgtggctagagatcctgaagataggactgatttagtgattactgtacatggtgatgctatctctgttcctgaaaatgaaagagaagccgttcgagctgcatatttggcgaggcatcccaatgcattttgggttgactttggagacttccaattcttgcgcattgaaccgaaagttgtacgatttgtgtcaggtgttgccacagctttgttaggatcaggagagtttagtggagatgagtataaatctgcaaaagttgatcccatagctcagttttccaagccagtggcgtctcatatgaacaaagatcatgctgaagataacaaagtgattgtgcagcattggacctcagttccagtggactttgccttcatactagatttggatagtcttggtttcaatgttaaggctggttatcagggtgatactttcaagcttcgtgtacctttccctcgatgtgcagaagatagaaaggatgtgaagactctcattgttgagatgcttcaagctgctaggcctaaagttgattgatcacttcacagatcaatgatgaacagcacctgccatccttcttggggagaggacaaaatgtatacgtcaaaaaagtaaatgcagttataatttccaaagataaagatgacaaagcaaatggttgactttcctaatttcttgttcactctatttgggattttcaagagggaaagcacttgaatattctagcatacagcacaagtggtgtgatactttatctaagaaacaaacccttcatacataaatggttttattatgtatttcttcaggtgtgagttgaaacaatgtatggatggataataattaattatttttggtacttgcaatagcaaactctgagctgaaaaaaaaaaaaaaaa

SEQ ID NO: 3750 - protein, 1392 aa, Triticum aestivum
  misc_feature: PFam Name: AMP-binding; PFam Description: AMP-binding enzyme
  misc_feature: GI Number: 7188339; NR Description: 4-coumarate--CoA ligase
  misc_feature: GI Number: 50252056; NR Description: putative 4-coumarate
  misc_feature: GI Number: 51536395; NR Description: putative 4-coumarate--CoA ligase 4CL2 [Oryza sativa (japonica
  misc_feature: GI Number: 51536394; NR Description: putative 4-coumarate--CoA ligase 4CL2 [Oryza sativa (japonica
  misc_feature: GI Number: 45549453; NR Description: 4-coumarate coenzyme A
TTTTTCGGTGTTTGCTTTAGAAGGGGAGAGTTTGGTCTACACACACCACCACATGAAGAGCATGGTGACGCCATTGACGAGGGTCTTACCCTTTCGTCACCCAAATGGCCATAATACCCTTCCATTTTCTCTTACACGCTACCCTTCTTCACCAAACTTCTCCTTCTCCCCTCTCACTCTCACTCTTTCCATGGCTGCTTCACCCCAATCCTCCGCTCCAACTGTGTCGCCTGGTGATGTTAACATCGACAAAGATGGTGTATTTCAATTGATTCAAGCTCATCAGGAAAAAGCTGCTAGACTTCCACCAGTTGAGGAGATTCGAACTGTCCTTGATCGTAGCGTGCGCGGGATGCTCTCTACATTCTCAAAGAAGTTTGATGGTTATCCATCAGGGTCTATGGTTGACTTTGCATGTGATTCAAATGGATATCCTATATTAGCAGTGAGCGACTTGGCAGTTCATTCAAAGGACCTAACTGCCAATCCTAAATGTTCATTGCTTGTGGCTAGAGATCCTGAAGATAGGACTGATTTAGTGATTACTGTACATGGTGATGCTATCTCTGTTCCTGAAAATGAAAGAGAAGCCGTTCGAGCTGCATATTTGGCGAGGCATCCCAATGCATTTTGGGTTGACTTTGGAGACTTCCAATTCTTGCGCATTGAACCGAAAGTTGTACGATTTGTGTCAGGTGTTGCCACAGCTTTGTTAGGATCAGGAGAGTTTAGTGGAGATGAGTATAAATCTGCAAAAGTTGATCCCATAGCTCAGTTTTCCAAGCCAGTGGCGTCTCATATGAACAAAGATCATGCTGAAGATAACAAAGTGATTGTGCAGCATTGGACCTCAGTTCCAGTGGACTTTGCCTTCATACTAGATTTGGATAGTCTTGGTTTCAATGTTAAGGCTGGTTATCAGGGTGATACTTTCAAGCTTCGTGTACCTTTCCCTCGATGTGCAGAAGATAGAAAGGATGTGAAGACTCTCATTGTTGAGATGCTTCAAGCTGCTAGGCCTAAAGTTGATTGATCACTTCACAGATCAATGATGAACAGCACCTGCCATCCTTCTTGGGGAGAGGACAAAATGTATACGTCAAAAAAGTAAATGCAGTTATAATTTCCAAAGATAAAGATGACAAAGCAAATGGTTGACTTTCCTAATTTCTTGTTCACTCTATTTGGGATTTTCAAGAGGGAAAGCACTTGAATATTCTAGCATACAGCACAAGTGGTGTGATACTTTATCTAAGAAACAAACCCTTCATACATAAATGGTTTTATTATGTATTTCTTCAGGTGTGAGTTGAAACAATGTATGGATGGATAATAATTAATTATTTTTGGTACTTGCAATAGCAAACTCTGAGCTGAAAAAAAAAAAAAAAA

SEQ ID NO: 3751 - DNA, 1080 bp, Glycine max
  misc_feature (1)..(1080): Ceres cDNA ID no. 21665888
  misc_feature (1)..(1080): Ceres CLONE  ID no. 808304
  misc_feature (1)..(1080): Also known as  Ceres CDNA ID no. 24356345
aggtttcttggatcttcttcttctattctggagtaaataagggaggttgcaatggacactagtattagtattagttaaagaaaaccccattgcattccatttggcaactattcctatccaattttaaatgctcttccacctcacgagatctccgtggccctagcctaccactactcacttcttcaatgtcctactcctcttcgatatgagtcaactcggcgccgtgttgcggactcagagggagcccaggaggagtaccattctgggtttgttgacggagcaaatggacggcgttgatagtgggacccgcaggaggcgcagcttcaaggaacgcttcggattcatcggcatggggtgctgtggggccacctggggcttccgttccgacgcgctaagtgtcacccaaggagaacagcaacagcaggaaacggatccagagtgcgtgggtccagcaggtttgggttcgggtatgaatctcgcggcggcgttagcggcggagaggcagctccgggggccgcaggaggaggcagtgagagcgccggggacgccgtggagggtgtcgctgatgaggctgctggaggagaccgaggcggagaaggagaaggagaaagagaaagaggagaatgttgtggggaatgattcggtgtgctgcgtgtgcatgggaaggaagaaaggcgcagcgttcatcccatgtggacacactttttgcagggtgtgttccagggaactgtggcttaatcgaggctcttgtcccctttgcaatcgctccatcctcgagattctcgacattttctagaatttcttctaactactttttattattcttgatccagaaccaaccacttcatccctccgcatgtgtaatagtatcatactatgaatctcatcatgtatttgttaccgcgctaaatgtttctctcttgtatgtactatatactactatatgcctgtgactttacaccagacaacattcaacaaagtcggctccattattttgtttctctttttttgtttttatgtaggactttttttttccagccaaattcattttttaaaatattttcaaaaaaaaaaaaaaaa

SEQ ID NO: 3752 - protein, 196 aa, Glycine max
MSQLGAVLRTQREPRRSTILGLLTEQMDGVDSGTRRRRSFKERFGFIGMGCCGATWGFRSDALSVTQGEQQQQETDPECVGPAGLGSGMNLAAALAAERQLRGPQEEAVRAPGTPWRVSLMRLLEETEAEKEKEKEKEENVVGNDSVCCVCMGRKKGAAFIPCGHTFCRVCSRELWLNRGSCPLCNRSILEILDIF

SEQ ID NO: 3753 - DNA, 1542 bp, Triticum aestivum
  misc_feature (1)..(1542): Ceres cDNA ID no. 21665890
  misc_feature (1)..(1542): Ceres CLONE  ID no. 815086
  misc_feature (1)..(1542): Also known as  Ceres CDNA ID no. 24361430
cttccccgaccagctcacaccacccaacgccgcgctgaacaatgcgattcactgagctactacctcgctctccttgctgatacaccaccgcctcgcgacctcgcctcgagagcccaatggccgcgcgcatgacgcggcgccctgccgtgttcctgctcctcgccgccgcccttctcgcggttgcggtacagccggcggcagcgacgctgcatccggtggactacctggcgctgcaggccgtccggcgcgcgctctccgacctgccgggctccggcttcttcgcttcgtgggacttcaccggcgacccctgcggcttcgcgggggtctcctgctccggcgatggccgggtcgtcacgctggccctcggggacccgcgagccggcgcgccgggcctctcgggcgcattcccctctgccgcgctcgcgcgtctctccgcgcttagctcgctctcgctcgtccccggccgcgtatccggggggttatcctccgccgtcgcggcgctcccgtcgctccgcttcctcgctctgtctgggaacctcatctcgggcaacctccccggagcattctcccctgctcttcggacggtcgatctcagcaagaactccttctccggcaagataccctcgtcgctgctccaaatcaggagtctccgaacgctcgtcctctcccacaactccctctccggcgagatccccaagacagtgagttcgccgctggtccacctcgaccttaggaacaatcgcctatccggcggcgtaccgccgctcccgatgacggtcgtgtacctcagtctcgctgggaacaggctctccggccgcgtgggcggcgtccttcgcagactgacgaggctgtcgtttcttgacctcggcgggaactggttctccggcgaggtgcccggagaagtcttctcgttccggattgggtacctgcagctgcgcaagaatgccttctctggcgagctccggccggcggggcggttgccttcgggcgccacggtggacctcagccacaacgcgctatccgggcgggtgccggcggagctggcgagcgcggccgcagtgtacctgaacgggaacaagtttgctggcgcggtgccggcggagattgtggcggcggcggagggcgggcgcatgcgggtgctcttccttcaagacaacttcctgaccggcatcagcgtgcgcggcgtgccgtcgagcgcagcggtatgtgcacactggaactgtgttgcgccgccgccaaccgtggtggccgcgtgcccggccaagggcggcaggggccggcgccggccgccggctcagtgcggcgggaggagggggtaaggaaggaaatgttttaaggcttttggggtggtttagtgggtaatgatggtgtcatagctcatgacacaggtgaaaaaccaatttttggtgtatattttgtgatcttcctttagatatacggccgtagtttgtcagttgtacacgtgtaaggtggatctggtgtgtttcagtgtcagcgattgcgatttacacagagaaactttgtacaaaaaaaaaaaaaaaa

SEQ ID NO: 3754 - protein, 400 aa, Triticum aestivum
  misc_feature: GI Number: 7487940; NR Description: leucine-rich repeat protein F21B7.28 - Arabidopsis thaliana >gi|30678566|ref|NP_563685.2| leucine-rich repeat family protein
  misc_feature: GI Number: 7269786; NR Description: putative leucine-rich repeat protein [Arabidopsis thaliana] >gi|3924604|gb|AAC79105.1| putative leucine-rich repeat protein [Arabidopsis thaliana] >gi|7487941|pir||T01392 leucine-rich repeat protein T4I9.11 -
  misc_feature: GI Number: 9294152; NR Description: leucine-rich repeat disease resistance protein-like [Arabidopsis thaliana] >gi|15229088|ref|NP_188391.1| leucine-rich repeat family protein
  misc_feature: GI Number: 51091086; NR Description: leucine-rich repeat family protein-like [Oryza sativa (japonica cultivar-group)] >gi|51090758|dbj|BAD35237.1| leucine-rich repeat family
  misc_feature: GI Number: 50911254; NR Description: putative fasciated ear2 [Oryza sativa (japonica cultivar-group)] >gi|49388391|dbj|BAD25527.1| putative fasciated ear2 [Oryza sativa
MAARMTRRPAVFLLLAAALLAVAVQPAAATLHPVDYLALQAVRRALSDLPGSGFFASWDFTGDPCGFAGVSCSGDGRVVTLALGDPRAGAPGLSGAFPSAALARLSALSSLSLVPGRVSGGLSSAVAALPSLRFLALSGNLISGNLPGAFSPALRTVDLSKNSFSGKIPSSLLQIRSLRTLVLSHNSLSGEIPKTVSSPLVHLDLRNNRLSGGVPPLPMTVVYLSLAGNRLSGRVGGVLRRLTRLSFLDLGGNWFSGEVPGEVFSFRIGYLQLRKNAFSGELRPAGRLPSGATVDLSHNALSGRVPAELASAAAVYLNGNKFAGAVPAEIVAAAEGGRMRVLFLQDNFLTGISVRGVPSSAAVCAHWNCVAPPPTVVAACPAKGGRGRRRPPAQCGGRRG

SEQ ID NO: 3755 - DNA, 1698 bp, Triticum aestivum
  misc_feature (1)..(1698): Ceres cDNA ID no. 21665891
  misc_feature (1)..(1698): Ceres CLONE  ID no. 816367
  misc_feature (1)..(1698): Also known as  Ceres CDNA ID no. 24361552
ctcgattagtttttgaagtgcagaggtggttcacgtacaaccgccgctaaccgcgcgcgcgcgctgcccggagcgacgacgcgcggcgcgggccggccgaggagagcgcgccggattcgtgcggtggcctgacctagggtttcgccgcgagatggacggccgggctcagccgcagcagcagcagacgccgctgccgctgccgctgccgccgccgccgcagcagacgacgccaccgccgacgccgcagacgcagacgccgcgcgtgagctcgccgccgccggtggcccccggcgtcatgatgccgcagcacgcctacggcgcgatgccgccgggctccgcgagcgtcatgcacgggatgccgctcgccttcaaccccatggcgtcgcccggggcctcgcaggcggcattgaagcccgcggacatgccgccgctcgccatgtaccggcccgattccaccccgccgggcatgccgcagtccgtcggcggcggcggtggcgccctggtggtcagcgtcagcggcagcggcagcggcggggagctcgtgaagaagaagaggggaaggccgaggaagtacgggccggacgggaccatgggctcggcggtgaaggccgaggcgggcgggcagtctggtggcgcgggctccaactcgaatcctgacgggaagcgcagaggacggcccccgggatctggcaaaaagaaacagctcgatgccttaggttcagctgggacatcatttactcctcacataataactgtcaagcctaatgaggatgttgcttcgaaaataatgtctttttcacaacaaggcccacgtactacatgtataatctcagcaaacggtgcgctgtgcacagcaacactccgtcaaccagcaacctctggtggcatagtgacatatgagggccactttgatattctctctctgtcgggctcatttctgctggcagaggatggtgacactcgtagcaggacaggtggtctgagtgttgctctggctggaagcgatgggcgtatcgtaggaggttgtgttgcaggaatgcttatggctgcaacgcctgtccaggttgtggtgggcagcttcatcgccgaaggtaacaaaaagcccaaggaagaacaaccgaaacgcgagccaacatctgcgccgatgcttacatctgcgccgatgcagacgcctgctggcttcggtgcagcctcagctgctgctacgccatcagatggaacatcaagtgaccattctgatgacccagggagccctatgggacccaacggtagcacgttcaacaatgcaggccatccgacacacgcttcatatgctccggtgggctggtccctctccgggaaccaaggccgctacgacccagacatgaagatggtgaccgactaatggctccccgatttgcagcagctttattctctagtatttgacctagtagagtgtagggtttcctgcaccggcgccaacaattcattgtcggccaataatccggtgtgctagaggtagtcggagagcctttcatggaaggcctgaggagcaaaaataagtagcattgtcttgccctgttaatgttgcttttagtttgtatctcttatctgctttcgcagttagtagcttatgcttggagttgttatatcctaatcaacggtttctattacccatgaatttgtatttcagtctaaaaaataaaaaaaaaaaaaaaa

SEQ ID NO: 3756 - protein, 410 aa, Triticum aestivum
  misc_feature: PFam Name: Extensin_2; PFam Description: Extensin-like region
  misc_feature: PFam Name: Protamine_P1; PFam Description: Protamine P1
  misc_feature: GI Number: 37537056; NR Description: putative AT-Hook DNA-binding protein [Oryza sativa (japonica cultivar-group)] >gi|12643044|gb|AAK00433.1| putative AT-Hook DNA-binding protein
  misc_feature: GI Number: 14326504; NR Description: At2g33620/F4P9.39
  misc_feature: GI Number: 50947571; NR Description: putative AT-hook DNA-binding protein [Oryza sativa (japonica cultivar-group)] >gi|42408801|dbj|BAD10062.1| putative AT-hook DNA-binding protein
  misc_feature: GI Number: 2598227; NR Description: AT-hook protein 1
  misc_feature: GI Number: 20196849; NR Description: AT-hook DNA-binding protein (AHP1) [Arabidopsis thaliana] >gi|19548037|gb|AAL87382.1| At2g33620/F4P9.39 [Arabidopsis thaliana] >gi|42571033|ref|NP_973590.1| DNA-binding family protein /
MDGRAQPQQQQTPLPLPLPPPPQQTTPPPTPQTQTPRVSSPPPVAPGVMMPQHAYGAMPPGSASVMHGMPLAFNPMASPGASQAALKPADMPPLAMYRPDSTPPGMPQSVGGGGGALVVSVSGSGSGGELVKKKRGRPRKYGPDGTMGSAVKAEAGGQSGGAGSNSNPDGKRRGRPPGSGKKKQLDALGSAGTSFTPHIITVKPNEDVASKIMSFSQQGPRTTCIISANGALCTATLRQPATSGGIVTYEGHFDILSLSGSFLLAEDGDTRSRTGGLSVALAGSDGRIVGGCVAGMLMAATPVQVVVGSFIAEGNKKPKEEQPKREPTSAPMLTSAPMQTPAGFGAASAAATPSDGTSSDHSDDPGSPMGPNGSTFNNAGHPTHASYAPVGWSLSGNQGRYDPDMKMVTD

SEQ ID NO: 3757 - DNA, 1579 bp, Triticum aestivum
  misc_feature (1)..(1579): Ceres cDNA ID no. 21665892
  misc_feature (1)..(1579): Ceres CLONE  ID no. 817094
  misc_feature (1)..(1579): Also known as  Ceres CDNA ID no. 24357171
cctacccctttttactgcgctgcgcacgcccacagcctgcagctagcttgcgacgggacacatgacgacgacgcgccccgccgctacgaccgaggaagaggaagaggaggaggcggtggtggccgcctctgcagcggccaatgccgcgccaccggacgcagacgatcgggagcagcagaagaaggttcgggcgaggaagaagaagaagcgtcggagggcgccgagcgaggaggagctggccgcgctgaggtccgtgctccgctgggcccgccgcggcgaggcgggcgacgacgatgcggcggactgtggtgggcacctgttgccggcggggaggcggcggccgcgcgtggcggtggagctgcatgcgcactcgacgcgcagcgacggctcgctctcgcccgcggcgctcgtggagcgcgcgcaccgcaacggggtgaaagtgttcgcgctaactgatcatgacaccatggcgggtgtcgcggaggcgatggagactgcaaaggaattttccatcaggatcatccctgctgttgagataagtgcagtttattcgcctagtaatggatcaggagccaatgaacctgttcatgttcttgcatactacggtagttggggccctgctaaatctcaggaactggagaaggttctatctagcatcagggagggccgctatacacgtgccaaggagatgctatcgaaacttaggaacctcggcatgccattgaacttcgaagatgtatctaatatagcagggagtggggtggctccagggcgggtgcacgttgcgcgtgccatggttgaagctggatatgttgataatcttaggcaagctttcagcaggtacttgtacgatggagggcctgcttatgctactggtagtgagccagctggggaatctgttgtgcagctaatatgtagaactgggggcatagctgttttggctcatccgtgggcattgaaaaatcctgttcctgtgataaaggatttgaaggctgctggtctgcatgctattgaggtctatcgaagcgatgggaaactatctggattgagtgatctggctgatacttatgagcttctgaagctcggtggatcagattaccatggacgagatgacaaggaagaacctgatataggaagtgttgatcttccggtcttgccattttttagatttcttgaggcagctcaaccaatttggtgcaatgctatcaaggaaatttttgcaaacgccactgaaagaactggcttgaatggcccaaaaggatgtcatcggactaactctgtagatgatttatgtgatacgtgcctttcttctccagaactgggggaaacagatgattctgaggctgaggtcctcaggacggaatttgcggacattatcctcagcaacagaagctgcaagacgcttattgaacagcgagcggaaatcacctctcttctccactgacacagtcgggtttgtgcagttttagacattgactgagactctgacaggacatgatctgggctgcactttaatctattcatattctggaaaaatataaattgtccagtgggcatgtgatcaaaaaaaaaaaaaaaa

SEQ ID NO: 3758 - protein, 460 aa, Triticum aestivum
  misc_feature: PFam Name: PHP; PFam Description: PHP domain
  misc_feature: GI Number: 50912855; NR Description: putative PHP domain N-terminal region:PHP domain C-terminal region [Oryza sativa (japonica cultivar-group)] >gi|46390125|dbj|BAD15560.1| putative PHP domain N-terminal region:PHP domain C-terminal region [Oryza
  misc_feature: GI Number: 20466107; NR Description: At2g13860/F13J11.19 [Arabidopsis thaliana] >gi|15450377|gb|AAK96482.1|
  misc_feature: GI Number: 57233605; NR Description: PHP domain N-terminal region family protein [Dehalococcoides ethenogenes 195] gi|57224053|gb|AAW39110.1| PHP domain N-terminal region family
  misc_feature: GI Number: 53691572; NR Description: COG0613: Predicted metal-dependent phosphoesterases (PHP family) [Desulfovibrio
  misc_feature: GI Number: 49235225; NR Description: COG0613: Predicted metal-dependent phosphoesterases (PHP family) [Moorella
MTTTRPAATTEEEEEEEAVVAASAAANAAPPDADDREQQKKVRARKKKKRRRAPSEEELAALRSVLRWARRGEAGDDDAADCGGHLLPAGRRRPRVAVELHAHSTRSDGSLSPAALVERAHRNGVKVFALTDHDTMAGVAEAMETAKEFSIRIIPAVEISAVYSPSNGSGANEPVHVLAYYGSWGPAKSQELEKVLSSIREGRYTRAKEMLSKLRNLGMPLNFEDVSNIAGSGVAPGRVHVARAMVEAGYVDNLRQAFSRYLYDGGPAYATGSEPAGESVVQLICRTGGIAVLAHPWALKNPVPVIKDLKAAGLHAIEVYRSDGKLSGLSDLADTYELLKLGGSDYHGRDDKEEPDIGSVDLPVLPFFRFLEAAQPIWCNAIKEIFANATERTGLNGPKGCHRTNSVDDLCDTCLSSPELGETDDSEAEVLRTEFADIILSNRSCKTLIEQRAEITSLLH

SEQ ID NO: 3759 - DNA, 1723 bp, Triticum aestivum
  misc_feature (1)..(1723): Ceres cDNA ID no. 21665893
  misc_feature (1)..(1723): Ceres CLONE  ID no. 817402
  misc_feature (1)..(1723): Also known as  Ceres CDNA ID no. 24361259
cttttaaatcggagacgcgacgccatacggacacagagcacgcacacggatactagcagcagctcagctccatctcattaatggcgctctccacgctcctactgccctcctcctcctccaccgccgccgacacctccgaccgccgccgcggccagcagccgcagaaccaccacagcaagcgcaagaagaagccgccggcgctgccgcccccgctctcccccgcgccgaggactcccggccgacgccatcttgccgccaccgggacgccttccaggaagagccccgccctcgccgcgcccaccgccggcgccaaggccaggctcgtcgcgtccaaggaccaccgtcaacgccgcagtggctcgaagaaggcgactgcgcagaagcccgcgcggccggcgtcgtcgtgggagcagctgaagagcctgctgagctgccggagcgcgacggcggccgcgcgcgtgcacgacccggccgccctcgcgcgggggcccggcgcgggagggtactgggggacatcgctctgctccatgcgcgacgtggccaccgtcgacggcgcctcctcggccgcctccgtcgtcgtggaccaccgcgacaccgccccgctcaaccgctcctcccgccgcgcccaccactcctcgtcgtcggcagcgggcggcggcgggcacccgtcctccctccgcggcctctccggctgctacgagtgccgcgccatcaacgtcgagcccgtctcaaggaggtaccctcggccgagggagctgtgtccgtgctcgcagtgcggcgaggtgttcaccaaggccgacagcttggagcagcaccaagccgtccgccatgccgtgtcggagctggggccggaggactcggggcggaacatcgtggagatcatcttcaagtcgagctggcagaagcgggaccgccccatctgccacatcgaccgcatcctcaaggtccgcaacccgccccgcaccgtcgcccgcttcgaggcctaccgcgacgccgtgcgcgcccgctgccgcgccgacgtctccgcgggaggcggcggcgccacgcgcgccgcggccgacggcaacgagctgctgcggttccacccggccgcgctcgcctgcgagctcggcgccgacggctccacctcgctgtgcgcgtcctgcgacgatggtgacgccgacggtaagacggcggccgcggcgtgcggggtgtgcgcggcgatccggcacgggttcgcgccctgggccggcgcgcacccgctgggcgtgcgcaccacagcgagcagcggccgcgcgcacgacgtctgcggtgccgaagcggtgggagcgccggggtggcgggcgatgctggtgtgccgggtgatcgccgggcaggtgcgacggcgggacggggacgaggatggggaggagaaggaggttgaggctgggccgttcgactcggtggccggcgacgacgcgggcggcgcgtacggggtgctggaggagctgttcgtggccaaccccagggccatcctgccgtgcttcgtcgtggtgtaccgcgtcgacgtggacgcacaatgacatgcatatgcactgtaacaattatatttgccctgtacacctacatatggatatgtatgtgaatttgtactactaattgtatgttcgcatcgatcaattgtgtcggcttgcttgaagatatatatatatatatatatatagtgctattttagtgcgaaaaaaaaaaaaaaaaaaaaaaaaaa

SEQ ID NO: 3760 - protein, 486 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Drf_FH1; PFam Description: Formin Homology Region 1
  misc_feature: PFam Name: Cupin_1; PFam Description: Cupin
  misc_feature: GI Number: 5777616; NR Description: CAA30374.1 protein [Oryza
  misc_feature: GI Number: 62701936; NR Description: Zinc finger, C2H2 type,
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
  misc_feature: GI Number: 15222333; NR Description: zinc finger (C2H2 type) family protein [Arabidopsis thaliana] >gi|9369383|gb|AAF87132.1|
  misc_feature: GI Number: 9802582; NR Description: T2E6.3 [Arabidopsis thaliana]
MALSTLLLPSSSSTAADTSDRRRGQQPQNHHSKRKKKPPALPPPLSPAPRTPGRRHLAATGTPSRKSPALAAPTAGAKARLVASKDHRQRRSGSKKATAQKPARPASSWEQLKSLLSCRSATAAARVHDPAALARGPGAGGYWGTSLCSMRDVATVDGASSAASVVVDHRDTAPLNRSSRRAHHSSSSAAGGGGHPSSLRGLSGCYECRAINVEPVSRRYPRPRELCPCSQCGEVFTKADSLEQHQAVRHAVSELGPEDSGRNIVEIIFKSSWQKRDRPICHIDRILKVRNPPRTVARFEAYRDAVRARCRADVSAGGGGATRAAADGNELLRFHPAALACELGADGSTSLCASCDDGDADGKTAAAACGVCAAIRHGFAPWAGAHPLGVRTTASSGRAHDVCGAEAVGAPGWRAMLVCRVIAGQVRRRDGDEDGEEKEVEAGPFDSVAGDDAGGAYGVLEELFVANPRAILPCFVVVYRVDVDAQ

SEQ ID NO: 3761 - DNA, 1913 bp, Triticum aestivum
  misc_feature (1)..(1913): Ceres cDNA ID no. 21665894
  misc_feature (1)..(1913): Ceres CLONE  ID no. 817590
  misc_feature (1)..(1913): Also known as  Ceres CDNA ID no. 24356910
ccccaacacatcacagaagaaatccccatctcctgagcccctttgtgccggcgccatgaggcgcttggatgggtcggggttctccgtctccgtggccggcaagcgcaagcgttcgccggagtacccctgcgtgtcgcgcttccggcagcggcgactcctctccttcctccggcgccagaagctgttcgacgcctacgacgtgcttaccggcgagtcgggtgcgcgcatcgacctgtaccatctgaccgaccttgtcaaggcgggccggtgggacgaggccatcgaccatctctcctgcttcctgccgtgcgaccttgctctgggcgcccacggccgcgtcctcctccacttcctccgcgtgcacaaggccgtccacgacatcgtctccggggcgcccgagagccgtgccgtctctgccgctctcaggatgtgcttcaccaagaattttaccatcaaccacgccatcaccaagctccgcaccatcctctggtccctccactcctccagcggattcagggactccctggactttgggcgcgtgagagacaaggctgcatccactgtcgtttacttggcttatcaaactacagagttgagagaacatatgaaagaggcgcgtggcccagcggaaccccacaatgtactccccattggcttcggcttccgtccaaggcgccatgtgaagcgaggccccatcccgggctctgttcttgtcaggcactatcttcgtaagaggaggatgcttgcttcttcgatatcaagtcactgtgaagggtcaagttctgaatcgttaattaaggcaaaagaatggatggtggatcttgttgattcatgtttggaagctggtaagcggcatcaagggtatccacttcaatatgtttgtactccaatggtacacaaaggtgctcctgttgatccattctcgcggagtaatcttggtacattcagaagtccggctagaaatcctggcatgtcatcagacaccgatttcgacttgttagtcctcaagacaaaggaatgggcaatttaccttacagatcaacggctggaagcttggccggaccttagtcaagggtatgagtatccatttcgctgtgtcaataaggatggttttccagttgcccgaattttgcagactatccctgttaccttggtggggcatgctaaaagttttgcactttcatcactaacaaaagcagaagttccatccttcattcaggtgctccatcctttggaaggtcctgctagaaactatgggatctcaccagtgacaaatgctggtggtctaccttcacagtccatgtctgctatcttggcacctccttatgaccagttcttgattacaacagagaaagatgcaggtgctctgtcctcaaaggccatgtctgctatcttggcatctccttctaaatatatcaaggcaaatgcagatgttctaccctcagagactatgtctgctatctgggcatctccttatgaaaactctctggtctcaacagtgacaaatgcaggtacacataagcatttgagtcaagaacattgctatactgagaatgtttgccaggatttcagcccaaggaagaatccaaggatggaactgacaactgttgggcaaggctttaatccgaaaaggcaacggacaactctggcttcgctgattgaaggtgaagctgaaggtcacctcacaccatgttcttgagtggtgggatcgactttactcatggagcttctatatttgtgaaaagacgccccgatactgttagtgggcttgttgtgctgctgcccccagcgtgaactttgttgtttttattttttgtgaacctatgttgtgcgttccgatcgtactttgaactatgtattattgctacttgagccaagttatgtctttttttttggtaaaaaaaaaaaaaaaa

SEQ ID NO: 3762 - protein, 547 aa, Triticum aestivum
  misc_feature: GI Number: 1582641; NR Description: mucin
  misc_feature: GI Number: 53718955; NR Description: putative lipoprotein [Burkholderia pseudomallei K96243] >gi|52209369|emb|CAH35314.1|
MRRLDGSGFSVSVAGKRKRSPEYPCVSRFRQRRLLSFLRRQKLFDAYDVLTGESGARIDLYHLTDLVKAGRWDEAIDHLSCFLPCDLALGAHGRVLLHFLRVHKAVHDIVSGAPESRAVSAALRMCFTKNFTINHAITKLRTILWSLHSSSGFRDSLDFGRVRDKAASTVVYLAYQTTELREHMKEARGPAEPHNVLPIGFGFRPRRHVKRGPIPGSVLVRHYLRKRRMLASSISSHCEGSSSESLIKAKEWMVDLVDSCLEAGKRHQGYPLQYVCTPMVHKGAPVDPFSRSNLGTFRSPARNPGMSSDTDFDLLVLKTKEWAIYLTDQRLEAWPDLSQGYEYPFRCVNKDGFPVARILQTIPVTLVGHAKSFALSSLTKAEVPSFIQVLHPLEGPARNYGISPVTNAGGLPSQSMSAILAPPYDQFLITTEKDAGALSSKAMSAILASPSKYIKANADVLPSETMSAIWASPYENSLVSTVTNAGTHKHLSQEHCYTENVCQDFSPRKNPRMELTTVGQGFNPKRQRTTLASLIEGEAEGHLTPCS

SEQ ID NO: 3763 - DNA, 1796 bp, Triticum aestivum
  misc_feature (1)..(1796): Ceres cDNA ID no. 21665895
  misc_feature (1)..(1796): Ceres CLONE  ID no. 817674
  misc_feature (1)..(1796): Also known as  Ceres CDNA ID no. 23727194
agattcaaagcgatcgttcaaagccatggcagggcactcgcccactctccctcatcttgtcttacttgagcaccggcagccatcatccgcctcccattaagaactccagaccgtcaccatggctgcctcttctcctcccaagtcccaacccatcactatggggcctcttccgccgctcgtattagcactctttctcctacctctcctctacttgttcttcaggggcggtagcaagggacgatcgacacagggagcaagaaacgctcccgggccgccgaaacagcttcccgtgctcggcaacctcctgcagctcggcggccggccacaccggtacttccagtcgctcacccagaagtacgggccggtggtgcaggtgcagctcggccgcgtgcggatggtcgtcgtcgcgtcgcctgaggcggccaaggaggttctccggacgaacgacctgcactgctgcagccgcccaaattcaccaggtgcgaggatgctgagctacaacttcctcgacgtggctttcggcccctacagcgactactggcgcgagatgcggaagctcctcgtgctggagctgctgagcgtgaggcgcgtccagtccttcgcctacgcccgggccgcagaggtggaccgccttgtctcctccctcgccggcacccctccgggcaccccggtcgacctcagcgagcagctgtacgcgctctcggacggcatcatcggcacggtggccttcgggaagatgtacgggtcggagtcgttcgagaggaccagcttccagcggatgatggacgagacgctgcgggtgctcggcagcttcacgttcgaggacttcttcccgtcgtcggcgctcgcacggtgggcggacgccctcaccggcgtggcgtcgcggcggcggagggtcttcctcaggatcgataggttcttcgacgcggtcatcgacaagcacctcgagccggggaggctggcggccggggtgcaggaggacatggtcgacgcgctggtgaagatgtggagggatcaagatggggctctggcgctgacgcgtgataacatcaagggaatcctgatggatacattcgccggtgggatcgacacttgcgctgtgacgacgatctggatcatggcggagctgatgaggaacccaagggtgatgcggaaggcgcagtcggaggtacgcgccgcggtggggaacaaatccagagtgtacgaagaagacgcccagggcctcaagtacctcaagatgatagtgaaggagaacttcaggctccacccgccggggcctctgctgatcccaagagagaccatgcagagctgcgaggtcgccggctacagcgtgcccgcgggcaccaggatacacgtcaacgtctgggccatggggagagacccggagatatgggacaggccggaggagttcttccccgagcggttcgaggacgcgcaggttgatttcagggggctgcacttcgagctccttccgttcgggtcgggacgaagggcctgccctgccgtcgccatgggcgtggccaatgtggaggtcgtgctggccaacctgttgtattgcttcgactgggagcttcccgagggcgtgaaggaggacgacgtcgatatggaggaaacagggcagcttgttttcagcaagaaggtggctcttgagcttgtgccagttaagcggtagtgatatctttttttagtgatatcttttttttgagattctagtgatatctcatatgtttcaaatgccacctagtgcttcctcaataaactaaacagtagtttaaatcccaaaaaaaaaaaaaaaa

SEQ ID NO: 3764 - protein, 517 aa, Triticum aestivum
  misc_feature: PFam Name: p450; PFam Description: Cytochrome P450
  misc_feature: GI Number: 5915841; NR Description: Cytochrome P450 71E1 (4-hydroxyphenylacetaldehyde oxime monooxygenase) >gi|7430623|pir||T14640 cytochrome P450 CYP71E1 - sorghum >gi|2766452|gb|AAC39318.1| cytochrome P450 CYP71E1 [Sorghum
  misc_feature: GI Number: 50936051; NR Description: putative cytochrome P450 71E1 [Oryza sativa (japonica cultivar-group)] >gi|27817968|dbj|BAC55732.1| putative cytochrome P450 71E1 [Oryza sativa (japonica cultivar-group)] >gi|50509544|dbj|BAD31248.1|
  misc_feature: GI Number: 37788136; NR Description: cytochrome P450 protein
  misc_feature: GI Number: 34897434; NR Description: putative cytochrome P450 [Oryza sativa (japonica cultivar-group)] >gi|27573338|gb|AAO20056.1| putative cytochrome P450 protein [Oryza sativa (japonica cultivar-group)]
  misc_feature: GI Number: 28392854; NR Description: putative cytochrome P450 monooxygenase [Arabidopsis thaliana] >gi|38503391|sp|O65788|C722_ARATH Cytochrome P450 71B2 >gi|4850391|gb|AAD31061.1| Identical to gb|D78605 cytochrome P450
MAASSPPKSQPITMGPLPPLVLALFLLPLLYLFFRGGSKGRSTQGARNAPGPPKQLPVLGNLLQLGGRPHRYFQSLTQKYGPVVQVQLGRVRMVVVASPEAAKEVLRTNDLHCCSRPNSPGARMLSYNFLDVAFGPYSDYWREMRKLLVLELLSVRRVQSFAYARAAEVDRLVSSLAGTPPGTPVDLSEQLYALSDGIIGTVAFGKMYGSESFERTSFQRMMDETLRVLGSFTFEDFFPSSALARWADALTGVASRRRRVFLRIDRFFDAVIDKHLEPGRLAAGVQEDMVDALVKMWRDQDGALALTRDNIKGILMDTFAGGIDTCAVTTIWIMAELMRNPRVMRKAQSEVRAAVGNKSRVYEEDAQGLKYLKMIVKENFRLHPPGPLLIPRETMQSCEVAGYSVPAGTRIHVNVWAMGRDPEIWDRPEEFFPERFEDAQVDFRGLHFELLPFGSGRRACPAVAMGVANVEVVLANLLYCFDWELPEGVKEDDVDMEETGQLVFSKKVALELVPVKR

SEQ ID NO: 3765 - DNA, 1856 bp, Triticum aestivum
  misc_feature (1)..(1856): Ceres cDNA ID no. 21665896
  misc_feature (1)..(1856): Ceres CLONE  ID no. 819132
  misc_feature (1)..(1856): Also known as  Ceres CDNA ID no. 24361488
cacacactctccaccacctcgcccccccggccgtgacgaactctgcctcgtcgccgccgccgcacgcagcagagcatggctccccccggcggccgcctcctcgccgcggcattgtgcctgctcctcctcgccgccgcagacgcgggcaccgtgggcgtgaactgggggcgggtggcgaacgacctgcccagcccggcggcggtggtgcagctgctcaagcaacacggcatcgcgcaggtcaagctctacgacacggagcccgccgtgctgcgcgcgctcgccggcagcggcatcaaggtggtcgtcgcgctgcccaacgagcagctcgcggccgccgccaggcgcccctcgtacgcgctcgcctgggtgcgccgcaacgtcgccgcctactacccggccacgcagatccagggcatcgccgtcggcaacgaggtgttcgccacggccgccaacgtcacggcgcagctcgtaccggccatgatcaacgtgcacgcggccttggccaggctcaacatggacaaggccgtcaaggtgtcgtcccccgtcgcgctctccgcgctcgccaactcgtacccgccctccgccggcgtgttcaaggaagagctcgcgcagtcggtgatgaagcccatgctcgacttcctggcgcggaccggctccgacctcatggtcaactgctacccgttcttcgcctacgcggacaatgccggcgtcatctcgctcgactacgcgctcttccgccccaacgccggcgagctcgactccgggagcggcctcaagtactacagcctcctggacgcgcagctggacgccgtgttcgcggccgtgggcaggctgggcagctacaacggcgtgcacgtggtggtgtcggagacggggtggccgtccaagggcgacgccaaggaggtcggcgccggcgcggccaacgccgcggcgtacaacgggaacctggtccggcgcgtgctgtccaggaacgccggcaccccgcgccgccccgacgcggacgtggacgtgtacctcttcgcgctcttcaacgagaaccagaagcccgggccgacctcggagcggaactacggcgtgttctacccgaaccagcagaaggtgtacgacgtggagttcgtcctcggcgccggcggcggctccgtgggcggcgccggcggccttgggtggcaggacaacggcggcggcaatgcgcctcccgtgagcggggcgggagggggggtggtgagggcggcggcgacgccggggtcggcgtggtgcgtggcgaacgcgatggcgggcgaggcgcggctgcaggcggcgctggactacgcgtgcgggccgggcgacgcggactgcaagggcatccagcccggcgcggcgtgcttcgagcccaacaccatggtcgcccacgcgtcctacgccttcaacgactactaccagcgcaagggccgctccatcggcacctgcgacttcgccggcgccgcctacgtcgtcaaccaagcaccaaagatgggcaagtgcgagctcccctccacggtctgagacaaggcaacagtggccaaagggagaggaggtggaaatatctatgcaccgaaggtcggccaaagcgcagggaaagaggggaggaatgctggacatctctgccccttttctttggtctttgcccgctgcaggcgtacgtagaacattggtggtagtgctgtagccggccggctgtgcgcctttctgcagccttggttcatgggggatatctttgtttaaccgctagtagtctctgtaactatgcttttactgtaagcttggattacttactagtaatatagattaattctaagtataatactagtagccttttgtgtccaaaaaaaaaaaaaaaa

SEQ ID NO: 3766 - protein, 481 aa, Triticum aestivum
  misc_feature: PFam Name: Glyco_hydro_17; PFam Description: Glycosyl
  misc_feature: PFam Name: X8; PFam Description: X8 domain
  misc_feature: PFam Name: Extensin_2; PFam Description: Extensin-like region
  misc_feature: PFam Name: Peptidase_S8; PFam Description: Subtilase family
  misc_feature: PFam Name: Pyr_redox_2; PFam Description: Pyridine
  misc_feature: GI Number: 18700155; NR Description: AT5g55180/MCO15_13
  misc_feature: GI Number: 4097948; NR Description: beta-1,3-glucanase precursor [Oryza sativa] >gi|11279331|pir||T50563
  misc_feature: GI Number: 21594590; NR Description: beta-1,3-glucanase-like
  misc_feature: GI Number: 18423719; NR Description: glycosyl hydrolase
  misc_feature: GI Number: 9758115; NR Description: beta-1,3-glucanase-like
MAPPGGRLLAAALCLLLLAAADAGTVGVNWGRVANDLPSPAAVVQLLKQHGIAQVKLYDTEPAVLRALAGSGIKVVVALPNEQLAAAARRPSYALAWVRRNVAAYYPATQIQGIAVGNEVFATAANVTAQLVPAMINVHAALARLNMDKAVKVSSPVALSALANSYPPSAGVFKEELAQSVMKPMLDFLARTGSDLMVNCYPFFAYADNAGVISLDYALFRPNAGELDSGSGLKYYSLLDAQLDAVFAAVGRLGSYNGVHVVVSETGWPSKGDAKEVGAGAANAAAYNGNLVRRVLSRNAGTPRRPDADVDVYLFALFNENQKPGPTSERNYGVFYPNQQKVYDVEFVLGAGGGSVGGAGGLGWQDNGGGNAPPVSGAGGGVVRAAATPGSAWCVANAMAGEARLQAALDYACGPGDADCKGIQPGAACFEPNTMVAHASYAFNDYYQRKGRSIGTCDFAGAAYVVNQAPKMGKCELPSTV

SEQ ID NO: 3767 - DNA, 2066 bp, Triticum aestivum
  misc_feature (1)..(2066): Ceres cDNA ID no. 21665897
  misc_feature (1)..(2066): Ceres CLONE  ID no. 819684
  misc_feature (1)..(2066): Also known as  Ceres CDNA ID no. 24361341
atttcggttcctcctcccttccgcggaactaccagggcgggcttgcgcgcgggggcggaagaagcgcgcaagcttagcacatgcggacaccgtcggggccccgccgccaagcttgaaaggtagaattggaagggggcatggctggcgtggaggggcagccgccgcctcagatcagcagcatgtccaaggcgcaggacggtggcaccaagccgaatctggtcaaggagcacgttccggggagcgagctctggaccgatggcctcatctgcgcttttgagctcgtcaagggtcacaggaagctggttcatcacaaatcgttgccaaagattgatctcgcgcacatgaagaaccaggcagctaggaatgggcatcgcgttgtgagcccggcaccgaatgagggaggtctggtggagatccccggccaggcggagcttggtatcgatccttttgcggtcaaagacaggccatcacatgctggagatgttcatgatcacaagtgggtgccgattggatggtcaaggattgctgagctgagccagagggttcagtcagatgctagctgggagaatgaacatgtgccgataagcgacagtgaggatgattacactgtagccgatgttgcggctccgtactggctgcgtcctgggggacctacatggtggttccatgttaccgcaggccatccttccgttgacgcatggttgggtagtgctcactggatgcatccagctatcagaactgcactgagagatgaaagccggctgataagcgaccggatgaagtaccttctctatgaggtcccagttagagttgcaggaggactgttatttgagcttcttggtcaatcagttggggatccaaatcatgaagaggaagacatacccattgtacttagatcgtggcaggcacagaactttcttttaactgcaatgcatgtgaaaggtccttcaaccaatgtaaatgttttaggagtgactgaagtgcaggagttgcttatttctggtggaagtcaaacacccagatcagctcatgaagtaatagcacatttggtcagtcgcctttcgcgatgggatgacagattgttccgtaaatatgtctttggggaagcagatgaaattgaattgaagtttgtgaataggagaaatagtgaagatctgaacctagtcagcatcatattgaatcaagaaatcaggaggttagcaacacaggtgatcagggttaaatggtcactgcatgcaagagaagagatcatacttgagctgctccggcatttgaggggaagtgccacaagaatcattttagagagagagaggaagtccgcaagggagatgttggaggagcaggaagctgtccgtggccgcttgttcaccatccaggatgttatgcagagcactgttcgtgcatggttacaggacagaagccttcgtatcacccacaacctggctattttcggcggtggcggcatagttctatccataatcactggcctctttggaatcaacgtggatggcataccgggagctcagaatactccgtatgcttttgggctgtttgcggggcttctcttcttcctggggataatccttgttggcgttgggttgatgtatcttgggctgacaaatccagtaaccagtgagaaggtgaaggtgaggaagctggagctccagcagcttgtttcgatgttccagcatgaggcggagcagcatgggaaggtgagggaaggcctgagccggcacggcttgtcgccgagttccgctgcatcttcgggcgatgaaggctacatcctgatttcctgatcttgctaatgcctcaaactctgaaatagtgtaagctcaggccacgctggggaacctggtgttttgtctgagtaaaatcccggctatccccgtgggaagtaaactgattcctgtctgattggttcatgtgtcctcaacaggcgtatagaaaatgatacacccaacagagtatctgtgtgatgattgtcactgaggagttggtataaaaatatagagagagatgttcaatgcgatttgagtaacagattggatccaaaaaaaaaaaaaaaa

SEQ ID NO: 3768 - protein, 552 aa, Triticum aestivum
  misc_feature: PFam Name: CorA; PFam Description: CorA-like Mg2+
  misc_feature: GI Number: 34910878; NR Description: P0003E08.5 [Oryza sativa (japonica cultivar-group)] >gi|15289842|dbj|BAB63539.1| P0003E08.5
  misc_feature: GI Number: 34912358; NR Description: P0518F01.15 [Oryza
MAGVEGQPPPQISSMSKAQDGGTKPNLVKEHVPGSELWTDGLICAFELVKGHRKLVHHKSLPKIDLAHMKNQAARNGHRVVSPAPNEGGLVEIPGQAELGIDPFAVKDRPSHAGDVHDHKWVPIGWSRIAELSQRVQSDASWENEHVPISDSEDDYTVADVAAPYWLRPGGPTWWFHVTAGHPSVDAWLGSAHWMHPAIRTALRDESRLISDRMKYLLYEVPVRVAGGLLFELLGQSVGDPNHEEEDIPIVLRSWQAQNFLLTAMHVKGPSTNVNVLGVTEVQELLISGGSQTPRSAHEVIAHLVSRLSRWDDRLFRKYVFGEADEIELKFVNRRNSEDLNLVSIILNQEIRRLATQVIRVKWSLHAREEIILELLRHLRGSATRIILERERKSAREMLEEQEAVRGRLFTIQDVMQSTVRAWLQDRSLRITHNLAIFGGGGIVLSIITGLFGINVDGIPGAQNTPYAFGLFAGLLFFLGIILVGVGLMYLGLTNPVTSEKVKVRKLELQQLVSMFQHEAEQHGKVREGLSRHGLSPSSAASSGDEGYILIS

SEQ ID NO: 3769 - DNA, 1611 bp, Triticum aestivum
  misc_feature (1)..(1611): Ceres cDNA ID no. 21665898
  misc_feature (1)..(1611): Ceres CLONE  ID no. 819913
  misc_feature (1)..(1611): Also known as  Ceres CDNA ID no. 0
cttagttgtttcctcctgccctgccgtcccgtcgccattattcccccggcccggccgcccccctcctcccgcattcaccaacccatccaagaaaacgaagaaaacaagaaactccaaagctctctagtctttgccgtgagcaatcgacagagatctgttgcatccaataaatcggtgctaccactcctgcttagttgcaggctatatggctgagacgggaggcgcacgttgtttgcatgcaagccttgatgtgttggcttctgatgttcactccaggctggagttccacaagagtgcctatacggactacgccggcatcaacaatgcgcttcactgggtcatggaggaaaaagcaaagcttcagctacaacagaatgctgtcactgaaaaggacaaactgatcactgaaaaggacaaactgatcgctgaactgaaaacaaggaatgaagaacaggcagcagagattgaatctctaaaggaagagctggaagtaagggagtcaagccatgtactattagcactgcagggaagtggtcttcagagtagccagtctggaagaaataaacggacacgagaatctgatggcaacggtgaagttgctgatgagcatggtgttatggacaatcctgatcaagatgatcaaggtttaagcactgagcttgagaatgctaaaaaggaactttctgatatccactctaagctgatcaagggattcatggatattggtgctacttcaacacggaatgttgcaataaagaatataggcgaattgagctacaagccgttccaacaggcatgccttaagaagctgcctccagaagaagcttcgaagaaagcttctgagttgtacaacttttggcagaagcagctgctgaacccagagtggaatccctccaaaactgtcatggagaaaggtaaccctaaggaaggtatctctaagattgatgtcgatgatgccgatctgctaaagctacgtgctgaatggggtgaagacgtgtacaaggctgtggcgaattgtttggtggaaatcgaaaaatgtggcaggctgacggacagaaccatcatacccgtgatttgggatcaaaaggaggacaggacagccactcgcagtgaaagtgttgagtacatgtgcagccaagtgaggcgtctgagaactcgcaggaactgactttgcaggcgcaaggcaggctggtggaagaacatggaggtctgtcgtatcgactccattttggaaacaggggcagtagaagtagcaaacctatggtgagaactgaagactggaggagtctcattctgtcgaagaacgaaaccgcagctgatcgtatggcagaacattgtcatgatctgtgtgttatgtgatcgtttagtactgcctaactacgaaccttaaaatagattaacgcaagcagcccttttgaccaccgtattttagctgtcctcttagtttcagtgttctcctggactctccggcagcaattcagcggcacctacattactttgaactgtaaagcttgctgatgaggggaacttttgcatcgttgcactgtcgtgctgcactgcaaacgcaatatattaaactagccttttaaattgccaaaaaaaaaaaaaaaa

SEQ ID NO: 3770 - protein, 320 aa, Triticum aestivum
MAETGGARCLHASLDVLASDVHSRLEFHKSAYTDYAGINNALHWVMEEKAKLQLQQNAVTEKDKLITEKDKLIAELKTRNEEQAAEIESLKEELEVRESSHVLLALQGSGLQSSQSGRNKRTRESDGNGEVADEHGVMDNPDQDDQGLSTELENAKKELSDIHSKLIKGFMDIGATSTRNVAIKNIGELSYKPFQQACLKKLPPEEASKKASELYNFWQKQLLNPEWNPSKTVMEKGNPKEGISKIDVDDADLLKLRAEWGEDVYKAVANCLVEIEKCGRLTDRTIIPVIWDQKEDRTATRSESVEYMCSQVRRLRTRRN

SEQ ID NO: 3771 - DNA, 1600 bp, Triticum aestivum
  misc_feature (1)..(1600): Ceres cDNA ID no. 21665899
  misc_feature (1)..(1600): Ceres CLONE  ID no. 819971
  misc_feature (1)..(1600): Also known as  Ceres CDNA ID no. 24360291
gttaccatccttctcctaccttcctccttccccttctgcaagataggactccatgaatccttgtactggttgtaatagccattgctactgaagtacttagtaatcttgatcgagagctacgccttccatcgctactcttacacctcccccgtgcaaataagcagccgccgccgagtctgccttgccaatactctctggagatgcaaagcctcccatgggcgattatccgaagcgtcagcagagtcggctctgctgcgcctcgctggtggcttccagctcttgcccgacgagatgcccctccactcatggagtcagtaccgtcttatccaaatcaacatctctataaaattttccgtgagaagcatagcaagctggatttgccgtgcctctccttctgttctgctactacacgaggcatggataaagcagagaggatgaaggcagcagaggagagcaatcccatggtagagacaagtgcaatacaagatgtgtattaccagccaatcatcccgggtagcagccaccgtgatggtactatatacaagaaaaggcttgaatgggaaagtgaatactgtgtagatgttgacgaccgcacagaaactcagctggagccagcatcttgggacgatatgacatgtgaaatgatgcagattttctccttaaagttagctaaatctcctatcaacagtggctcaatgcagttatatggatacatcgcggcacgagatgaatatgatttaaggcttaattatcttttcaatcgtagcagagaagatcccatcgtcgtgcaacagggttctctcattcaaatgaccggacctaagagaggcattgcatttcactgtgatgttctacttgagtttgacatgagaatcaagaacggagaaaacgaaggagatgacacacagttgattgatggaatgtcggaatttcgtggactattaatgccatgggaaccaactgaaattcccattaatggtaattgtgctacagttgagatgtctgctgcacttgtgagtaatgcaattgcggccactgtagaagttatcatatcagaagcacatggtgattttgatctatccctcagttccattgtttctgttgtggaggaacatgaatttcagctttttcatggctccgctggcgactggtgtggtgcaaggaggtttgtgattgctgtcacagtaaatactatgttgcatttgaagttcatgcttggtcacagatgctccaacggtaacattgaagacacttgttccttcaaagccaagctaaacggacacgccatccatcaaacaaattttgaggctgcttctatcttgacgaaggtgacatgggcggcatggcctcatgaaatgtttcgttgactagatactgattgtctttgtgttggaatcgggtactgttatacctgattcctatttcaataagtggactattttctagtaagtttgttttatgcttcgttatattcacatcagatattgatccgagaggcattacgcatgacaaatgtgtaacatcaaacctgattccttgaagttttggtcaatgtgcgcatgacgaatgcagggtttaactcttaaaaaaaaaaaaaaaa

SEQ ID NO: 3772 - protein, 388 aa, Triticum aestivum
MQSLPWAIIRSVSRVGSAAPRWWLPALARRDAPPLMESVPSYPNQHLYKIFREKHSKLDLPCLSFCSATTRGMDKAERMKAAEESNPMVETSAIQDVYYQPIIPGSSHRDGTIYKKRLEWESEYCVDVDDRTETQLEPASWDDMTCEMMQIFSLKLAKSPINSGSMQLYGYIAARDEYDLRLNYLFNRSREDPIVVQQGSLIQMTGPKRGIAFHCDVLLEFDMRIKNGENEGDDTQLIDGMSEFRGLLMPWEPTEIPINGNCATVEMSAALVSNAIAATVEVIISEAHGDFDLSLSSIVSVVEEHEFQLFHGSAGDWCGARRFVIAVTVNTMLHLKFMLGHRCSNGNIEDTCSFKAKLNGHAIHQTNFEAASILTKVTWAAWPHEMFR

SEQ ID NO: 3773 - DNA, 2095 bp, Triticum aestivum
  misc_feature (1)..(2095): Ceres cDNA ID no. 21665900
  misc_feature (1)..(2095): Ceres CLONE  ID no. 820234
  misc_feature (1)..(2095): Also known as  Ceres CDNA ID no. 24360295
taaccccggtgcatcagacaccagactcgaaaatgccgatgttgcccagctccttcaccacctcctcctcatggcaatcacaccaagatgcctcctcgatttgcactaaccaagaactggactacgaccatccttactacttcggcattgaggaggtggccgtggacgccgacgaactggagctcggcctccgggctcacaaggcgaccagggtcgactacctcagctcgccgtaccaggcgtcttggccatcggcgcaggcagacctcgagtcctcgcgcgtcaggaagacgaagcagttccgggacgttcttgagacgtgcaagcagaaggtggaggccatggaggccatggaacggtcgtcatcgccagtcggcagtggcgggttcgaggaacaaggtgaggcggtggttgccgtggacgacgtccggggcggcggtggtggcagcggagctgatggcatgcggctcgtgcagctgctggtcgcctgcgccgaggcggtggcgtgccgcgaccgcgcgcaggcggctgcgctgctgcgtgagctgcaggtcggcgcgcccgtgcacggcacggcgttccagcgcgtcgcgtcgtgcttcgtgcagggcctggcggaccggctggccctggcgcacccgccggccctcggaccagcgagcatggcgttctgcctcccgcggtcgtcgtgcctcgatggagcgcgcggcgaggcgctcgccgtggcgtacgagctgtgcccgtacctgcgcttcgcgcacttcgtggcgaacacgtccatcctggaagccttcgagggagagagcaacgtccacgtggtggacctcggcatgacgatgggcctgaaccgcggccaccagtggcgcgccctgctcgacagcctcgccacacgggcctgcggcaagccggcgcgcgtgcgcgtcaccggtgtcggcgcccgcgtagacaccatgagggccgtcgggcgcgagctcgaggcgtacgcgaatgagctcgggataaccctcgagttcatggccgtcgaccgcaccctggagagcctccacgtggacgacctcggcgtggaggccgacgaggccgtggccatcaacagcgtcctggagctgcactgcgtggtgaaggagagccgcggagcgctcaactccgtcctgcagaccatccgcaagctctcgccgaaggcgttcgtgctcgtggagcaggacgccggccacaacgggcccttcttcctggggcggttcatggaggcgctccactactacgccgcgctgttcgacgccctcgacgcggcgctcccgcgctacgacgcccggcgcgcgcgcgtcgagcagttccacttcggcgccgagatccgcaacgtggtcgggtgcgagggcgcggcgcgcgtggagcggcacgagcgcgcggaccagtggcggcgccgcatgagccgtgcgggcttccagtccatgcccttcaagatggcggccaaggcgcgggagtggctggaggagaacgccggcggcagcggatacaccgtggccgaggagaagggatgcctcgtgcttggatggaagggaaagccagtcatcgccgcctcgtgctggaaatgctagacgccgatcactgctgctcgccgcccggccgctttcggaacgcttcacttttggcaggtgccgcagtgtacgtgatggtgggcgccgtggaggtgttcacgttcatcgggcaaatggagttcttctacgagcaggcgcgggacgccctgcggagcgcggatctcctgcgcggcgatcgcgctgttcaaatacgcgagctcggcgcttctccctcttgtggtggatcccgacgacatcaacgatggtcacctggagtcctggactacttcttcgccatgttctgcgtcggcaacttcggcgcgtacctgctcttcgcatggtggcacaacagcaagaagactgctgattgaactatagaggtcaccgtacttgtgtaccaataaatttcgaacgcttggtgattagtcagtacttcctctatccgggtttataagttggacacatattttaacgtcttcttttgagaaatatatgtgttatgttgtacaaaaaaaaaaaaaaaa

SEQ ID NO: 3774 - protein, 519 aa, Triticum aestivum
  misc_feature: PFam Name: GRAS; PFam Description: GRAS family transcription
  misc_feature: PFam Name: Peptidase_S8; PFam Description: Subtilase family
  misc_feature: PFam Name: HlyD; PFam Description: HlyD family secretion protein
  misc_feature: PFam Name: APC_basic; PFam Description: APC basic domain
  misc_feature: GI Number: 34907740; NR Description: gibberellin response modulator-like protein [Oryza sativa (japonica cultivar-group)] >gi|20161620|dbj|BAB90540.1| gibberellin response modulator-like
  misc_feature: GI Number: 34907746; NR Description: gibberellin response modulator-like protein [Oryza sativa (japonica cultivar-group)] >gi|20161623|dbj|BAB90543.1| gibberellin response modulator-like
  misc_feature: GI Number: 63054405; NR Description: GIA/RGA-like gibberellin
  misc_feature: GI Number: 20465941; NR Description: putative gibberellin regulatory protein [Arabidopsis thaliana] >gi|17979049|gb|AAL49792.1| putative gibberellin regulatory protein [Arabidopsis thaliana] >gi|15777857|gb|AAL05911.1| RGL1
  misc_feature: GI Number: 6017107; NR Description: RGA1-like protein [Arabidopsis thaliana] >gi|15228553|ref|NP_186995.1| gibberellin response modulator, putative / gibberellin-responsive modulator,
MPMLPSSFTTSSSWQSHQDASSICTNQELDYDHPYYFGIEEVAVDADELELGLRAHKATRVDYLSSPYQASWPSAQADLESSRVRKTKQFRDVLETCKQKVEAMEAMERSSSPVGSGGFEEQGEAVVAVDDVRGGGGGSGADGMRLVQLLVACAEAVACRDRAQAAALLRELQVGAPVHGTAFQRVASCFVQGLADRLALAHPPALGPASMAFCLPRSSCLDGARGEALAVAYELCPYLRFAHFVANTSILEAFEGESNVHVVDLGMTMGLNRGHQWRALLDSLATRACGKPARVRVTGVGARVDTMRAVGRELEAYANELGITLEFMAVDRTLESLHVDDLGVEADEAVAINSVLELHCVVKESRGALNSVLQTIRKLSPKAFVLVEQDAGHNGPFFLGRFMEALHYYAALFDALDAALPRYDARRARVEQFHFGAEIRNVVGCEGAARVERHERADQWRRRMSRAGFQSMPFKMAAKAREWLEENAGGSGYTVAEEKGCLVLGWKGKPVIAASCWKC

SEQ ID NO: 3775 - DNA, 1547 bp, Triticum aestivum
  misc_feature (1)..(1547): Ceres cDNA ID no. 21665901
  misc_feature (1)..(1547): Ceres CLONE  ID no. 820453
  misc_feature (1)..(1547): Also known as  Ceres CDNA ID no. 24357007
gccgcttcgcccctcgcctccgctacctactcctaccaaccaccatgtcgctctcctcctccgtcatctcctctcgaagctgcgacggcgacggggagcagcctctcctcccgcactcgagcctcgagatcgccggcgcgcggcgcggcctcctcgccggcttcgacagcctccgccgcccgtaccgcgccttccccgtcttcgcgtccaaccgccacgtcgagaccatcttcgcggccttcacgcgctcgctccccaccgtggcattccggcgcgagtgcctacgcacccctgacgacggagccgtcgccctcgactgggtctccggcgacgaccgcgcgttgccgggagacgcacctgtgctaatccttctgcctggtctgacaggggggagtcaggatacatatgtacgacatatgcttttgagagctagaagcaaaggatggcgtgttgtggtattcaatagccgtggatgtgcaaatagtcctgtgaccacagcgaagttctattctgcttcatttactggagatctccgtcaagtagtcgatcatgttttatcccgttatcctcaatctaatatctatgctgctggctggtctcttggagcaaatattcttgtgcgctaccttggcgaggagactgataaatgctctctttctggagcagtgtccatgtgcaatccgtttaatttggtaatagctgatgaagatttccataaagggttcaacaacatctatgatagagcacttgctaactctctgagggttatatttaagaagcatgcacttctttttgaaggattggatggtgaatatgacataccaaaggcagccaatgcaaaaactgttagagattttgatcaaggcctaacccgagtttcatttggtttcaggtcagtagatgattactacagcaactcaagcagctcagattctatcaagaatgtttccatacccttactgtgcatacaggcggataacgatccaattgcaccatccaggggaattcccagagaagatatcaaggcaaatccaaattgcctactgatagtaacaccagagggtggtcatcttggatgggtagcaggcgacgaagctccatttggatgtccttggactgaccctattgtcatggagtttctagaacatgttcacaatgaaacgggctcaaccagcaagaatagcgtggccaatgagccgcagggtgttccaaagacatcagtaccacacttgtcggaacatgtgtagagatagtaacattgcgtttccattcgatgcggacgttttatacgtatagttaggcttcagttgctgttctgcagctgaaatgtgctacacttgctccaccaacacaaaggttctgaacatcttaaaaatttattggcgtcggtaatccatcgctggctccccattttactgacatttcgacatgaagtaattatttgccatttggaaggcttgctgtatcaaactgtaccattgtatagagtatttcaactgcattcatccatgcatgtacccatcacggcatcaaaaaaaaaaaaaaaa

SEQ ID NO: 3776 - protein, 400 aa, Triticum aestivum
  misc_feature: PFam Name: Abhydrolase_1; PFam Description: alpha/beta
  misc_feature: GI Number: 21593159; NR Description: putative LEA protein
  misc_feature: GI Number: 51969948; NR Description: putative LEA protein
  misc_feature: GI Number: 4835230; NR Description: putative LEA protein [Arabidopsis thaliana] >gi|15230305|ref|NP_190648.1| late embryogenesis abundant protein, putative / LEA protein, putative [Arabidopsis thaliana] >gi|7487939|pir||T08400 late embryonic
  misc_feature: GI Number: 50911297; NR Description: putative late embryonic abundant protein EMB8 [Oryza sativa (japonica cultivar-group)] >gi|49388448|dbj|BAD25578.1| putative late embryonic abundant
  misc_feature: GI Number: 1350545; NR Description: EMB8 [Picea glauca] >gi|7446463|pir||T09290 late embryonic abundant protein EMB8 - white spruce >gi|2501572|sp|Q40863|EMB8_PICGL
MSLSSSVISSRSCDGDGEQPLLPHSSLEIAGARRGLLAGFDSLRRPYRAFPVFASNRHVETIFAAFTRSLPTVAFRRECLRTPDDGAVALDWVSGDDRALPGDAPVLILLPGLTGGSQDTYVRHMLLRARSKGWRVVVFNSRGCANSPVTTAKFYSASFTGDLRQVVDHVLSRYPQSNIYAAGWSLGANILVRYLGEETDKCSLSGAVSMCNPFNLVIADEDFHKGFNNIYDRALANSLRVIFKKHALLFEGLDGEYDIPKAANAKTVRDFDQGLTRVSFGFRSVDDYYSNSSSSDSIKNVSIPLLCIQADNDPIAPSRGIPREDIKANPNCLLIVTPEGGHLGWVAGDEAPFGCPWTDPIVMEFLEHVHNETGSTSKNSVANEPQGVPKTSVPHLSEHV

SEQ ID NO: 3777 - DNA, 1909 bp, Triticum aestivum
  misc_feature (1)..(1909): Ceres cDNA ID no. 21665902
  misc_feature (1)..(1909): Ceres CLONE  ID no. 821189
  misc_feature (1)..(1909): Also known as  Ceres CDNA ID no. 24360211
accaaattcccctcctttcctccggcccgatcgaacgaccccgcctggatcgcgccgcgccggagcccagatgcccccgcgcctcgtgctcctgctcctcctcctggccgccaccttcccaccgccggccgcggcccgggtcggcgaccacgagccccctccccctcccccgcacccgcgcgcccgccagcaccgggcccagagcggcggcggtaccgggggcgcgagccgcgtgctcaccaccgcgctcgtcgccgccgcgtcgctcctcgccgtgctcctgctctacctctgcgtcgccatcgccgtgcgccgcatccgcggcaagggggagggcggcggcgggcgcgcgtcgcggcagcaggcgtcgcagtcctcccgcgcggcggcgttcctccgccgccacggcctgcaccacagccgcccggccttcacctacgagcagctccgcgccgccacggccgggttcgacgccgcgcgcaagctcggggacggcggcttcgggacggtgtacctcgcgtacctcccgcccgcgggccgccccgccgccgtcaagcggctccacgtgccgccctccccgtccccgtcctccgccaccatcaccaagtccttctgcaacgaggtgctcatcctctccgcgctccgccacccgcacctcgtccgcctccacggcttctgcgccgacccgcgcgcgctgctcctcgtctacgacttcgtccccaacggcaccctctcgcaccacctccaccgccggggccgcggcatcgccgccacgccgcccccgccgccgctcccctggcggacccggctcgccatggcggcccagatcgcgtcggcgctggagtacctccacttcgcggtgaagccgcacgtggtccaccgcgacgtcacctcctccaacatcttcgtggaggcggacatgcgcgcccggctcggcgacttcgggctgtcgcggctcctggcgacgcccgacgcctgctccacggcgaccgggcgggaggtggtgtgctgcacggcgccgcagggcacgccggggtacctggacccggactaccaccggtcgttccagctgacggagaagagcgacgtgtacagcttcggcgtggtggtgctggagctggtgacggggctgcggcccgtggacgtgggccgggagcggcgggacgtgacgctggcggactgggtggtgtccaagatccagatcggcgagctgagggaggtggtcgacccgccggtgctgggcgagctccccggcgtgatgcccagcgtggaggcggtggcggagctggcgttccggtgcgtggcgccggacaaggacgaccggcccgacgcccgggaggcgctggccgagctgaggaggatccaggggatgctccccgagctgtccggccacaaggactcctcttgactttggatggcacagatcagaactgagccagcactgcaaaatctatcctgaccgcttggctgacagattggtcgcagttatcgttgcatttgtcgaagacgagtgcctcattgtggatgaccggatggcaaatctgttcagacatgtcgcgacccaaatccaaggtacgtggaggtttatagatatactgagatcaatcaacggtaggatgatactgtgacagtgatatgagcttacctgtgttggttctgtgagctcaaggagtagcatgagcaagctcctctgccttttgtgtttggcagtagcttgtgatcaaaatgaacaagtgtaacatagaggaggattcttagtaatgctgttccagtcaagatgaacacctgtaagttggttctgtagtcaagaaactgatgttaggtacgccgtatgagacaggcatcccacaattgggttcttgttatatcgcaagtagtagtattaattttcccaaaaaaaaaaaaaaaa

SEQ ID NO: 3778 - protein, 445 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 42563092; NR Description: protein kinase family
  misc_feature: GI Number: 50900622; NR Description: P0443D08.12 [Oryza sativa (japonica cultivar-group)] >gi|15408730|dbj|BAB64133.1|
  misc_feature: GI Number: 15529242; NR Description: At1g25390/F2J7_14
  misc_feature: GI Number: 34911340; NR Description: P0034C09.1 [Oryza sativa (japonica cultivar-group)] >gi|18565401|dbj|BAB84588.1| P0034C09.1
  misc_feature: GI Number: 56784948; NR Description: wall-associated kinase
MPPRLVLLLLLLAATFPPPAAARVGDHEPPPPPPHPRARQHRAQSGGGTGGASRVLTTALVAAASLLAVLLLYLCVAIAVRRIRGKGEGGGGRASRQQASQSSRAAAFLRRHGLHHSRPAFTYEQLRAATAGFDAARKLGDGGFGTVYLAYLPPAGRPAAVKRLHVPPSPSPSSATITKSFCNEVLILSALRHPHLVRLHGFCADPRALLLVYDFVPNGTLSHHLHRRGRGIAATPPPPPLPWRTRLAMAAQIASALEYLHFAVKPHVVHRDVTSSNIFVEADMRARLGDFGLSRLLATPDACSTATGREVVCCTAPQGTPGYLDPDYHRSFQLTEKSDVYSFGVVVLELVTGLRPVDVGRERRDVTLADWVVSKIQIGELREVVDPPVLGELPGVMPSVEAVAELAFRCVAPDKDDRPDAREALAELRRIQGMLPELSGHKDSS

SEQ ID NO: 3779 - DNA, 893 bp, Triticum aestivum
  misc_feature (1)..(893): Ceres cDNA ID no. 21665903
  misc_feature (1)..(893): Ceres CLONE  ID no. 822586
  misc_feature (1)..(893): Also known as  Ceres CDNA ID no. 0
cgatcgcaggaatctcattcccccacctgcgccaagcaagctcatgagagcagcctgtcaaggtggcaatggagggaccaagagcggtggcgatggtggcggtgatcgtcctggtggcgtgttgtggtgctcagctggctgtcgccggaggtgaccagggccagccggcggcgggagggccggaggcgagtctgctgtgcatcagcgagtgcgggacgtgccccacggtgtgcacgtcgccgccgccagctcctccctcgccgtcatcatcatcatctacaccgtcgcctccctcgccgtcatcgtcatcatcaacaccgtcgcctccctcgccatcgacgtcgatcctcccgctgcccacgcccccgccgccgtatctgactctgctgctcccgccgcccccgtcgtcatcgtcgacggagctgcccccgtccacgccgtcgccgactccaccgaagagcagcggcgggtcgtcatcgtcttcgtcttcctcggctccgtcctcgcacttctcgtcgccgccgtccccgccgtcgtcctcggcgaacccgtactactacttctacctctccgggggcagcaggagccgcggcgcgtcgagcgtctacgccgtcgtcatcctcgcgctgctcctgcccgccgtcaccttttggaggtgagatgaggtgttggacgttgtcgttgcgtcgccgtgtgcccattctggtgaactcctcgtgtgtttatagtactacaagtactgtcacttcttttcccttcccggcccccgtcagattcagaagctagcagcacttccactgtctagtagtaattcgtttttgttgttgtaaccctgtctagtaattcgtcccttgtgtaatgttactgctgattattaacaaaaaaaaaaaaaa

SEQ ID NO: 3780 - protein, 196 aa, Triticum aestivum
MEGPRAVAMVAVIVLVACCGAQLAVAGGDQGQPAAGGPEASLLCISECGTCPTVCTSPPPAPPSPSSSSSTPSPPSPSSSSSTPSPPSPSTSILPLPTPPPPYLTLLLPPPPSSSSTELPPSTPSPTPPKSSGGSSSSSSSSAPSSHFSSPPSPPSSSANPYYYFYLSGGSRSRGASSVYAVVILALLLPAVTFWR

SEQ ID NO: 3781 - DNA, 1507 bp, Triticum aestivum
  misc_feature (1)..(1507): Ceres cDNA ID no. 21665904
  misc_feature (1)..(1507): Ceres CLONE  ID no. 824157
  misc_feature (1)..(1507): Also known as  Ceres CDNA ID no. 24357175
aacattttcaggacaaagcatagccgagcaagatgccaagagcaatcatcgcgagctagctagcaagttaggtgacgatggccgatcgcggcggcaaggcaccagcatggacatccgcgacggccgtggacgtcgacgctgagatggtcatcgtcggcgccgggatcgcggggctcgcgaccgcgctggcgctgcggcggctcggcgtgggcgcggctggcggcggcgtcctggtgctggagcggcacgccgagctgcgctccacaggcgccgcgctcaccatcttccccaacggctggttcgcgctccgcgccctcggcgtcgcgcacaagctcacctcccgctacgatgccttcgaaacatcccgagtgactactctggaaactggagcaacgcaggtgttccgctttgcagggcgtaaaagcagcagcggcgacgtgagagtgagaccgatgcatcggaaggcgctgctggaggcgctcgcggaggagctgcctccgggcaccatcaggttctcgtccaagctcgcctcgatcgccaccgagaaggcgcagggttccccggagatcgccgtcctacggttagacgacggtacggtgatccgatccaaggtgctgatcgggtgcgacggggtgcactccgtggtgtcgcagtggctgggcctgtcggagccggcgagctcaggccggtccgccgtccgcgggctcgccgtgtacccggacgggcacggcctgaagaaggagctccggcagttcctctcggagggtctgagggccggcatggtgcccatcagcgacaccgatgtctactggttcctcgtcaacaacaccgtccctgcagagcaggaggccggcacggaccccgccaagatcctgcgggaggtcacggacaacctgggcaggcacatgccggcggagtacctggacgtggcgcgccactccgactccggcaacctgtcgtgggcgccactgctgtaccgcgccccctgggccatcctcaggggtccggcggcccgcgggccggtcacggtggccggcgacgcgttccacccgatgacccccgacatggcgcagggcgggtgctccgcgctggaagacgcggtggtgctcgcgcgcgctttgtctcgggcggccacgcccgccgacggcgtggcctcctacgtggctgagcggcgtggccgggctgcctggctggtcgccggggcatacctgtcgggctgggtccagcagggcgggaccaacgtccggggcgtgcgagggtacatggtcaggctgtttcgcgactggatcttttacaggttcttgttccccaggctcgccgatacaatgtggttcgattgcggcgacctggtggagccaaacgcggagggcaagacccactccgagtaaactaaatgccatattgcgttatactccctccgccaatgatgtgttatatagcctgtccagacgtgaccttatcaattcacatgaaaatatgtgtgttttctataaaaaaaaaaaaaaaa

SEQ ID NO: 3782 - protein, 436 aa, Triticum aestivum
  misc_feature: PFam Name: FAD_binding_3; PFam Description: FAD binding domain
  misc_feature: GI Number: 38605914; NR Description: OSJNBb0088C09.8 [Oryza
  misc_feature: GI Number: 3426064; NR Description: monooxygenase [Arabidopsis thaliana] >gi|7270837|emb|CAB80518.1| monooxygenase 2 (MO2) [Arabidopsis thaliana] >gi|4467141|emb|CAB37510.1| monooxygenase 2 (MO2) [Arabidopsis thaliana]
  misc_feature: GI Number: 4164576; NR Description: CTF2A [Arabidopsis thaliana]
  misc_feature: GI Number: 21536869; NR Description: putative monooxygenase
  misc_feature: GI Number: 20197535; NR Description: putative monooxygenase [Arabidopsis thaliana] >gi|18403916|ref|NP_565814.1| monooxygenase
MADRGGKAPAWTSATAVDVDAEMVIVGAGIAGLATALALRRLGVGAAGGGVLVLERHAELRSTGAALTIFPNGWFALRALGVAHKLTSRYDAFETSRVTTLETGATQVFRFAGRKSSSGDVRVRPMHRKALLEALAEELPPGTIRFSSKLASIATEKAQGSPEIAVLRLDDGTVIRSKVLIGCDGVHSVVSQWLGLSEPASSGRSAVRGLAVYPDGHGLKKELRQFLSEGLRAGMVPISDTDVYWFLVNNTVPAEQEAGTDPAKILREVTDNLGRHMPAEYLDVARHSDSGNLSWAPLLYRAPWAILRGPAARGPVTVAGDAFHPMTPDMAQGGCSALEDAVVLARALSRAATPADGVASYVAERRGRAAWLVAGAYLSGWVQQGGTNVRGVRGYMVRLFRDWIFYRFLFPRLADTMWFDCGDLVEPNAEGKTHSE

SEQ ID NO: 3783 - DNA, 1898 bp, Triticum aestivum
  misc_feature (1)..(1898): Ceres cDNA ID no. 21665906
  misc_feature (1)..(1898): Ceres CLONE  ID no. 826055
  misc_feature (1)..(1898): Also known as  Ceres CDNA ID no. 24357087
accaatccatccaatccctaggaaacaaggaggtgaaggaacaccagaccggcctcctctcgacgcgcctccgcccccgcccccgccgaccaccgcgaggtgctccccctctccctcttccgcgccctgccgcctgaattccgctgcttcatttgcgcctaatcgatccgctccgtgtgctggtcattctagggtttactgtcgttggctgaatcgagagctcgcgcgtacgtgctaatcgctaatccgcggagcggcggtcgttgtgtcgttgattcgccatggggagcaaggggcgcatgcctcctccttaccaccaccggccgctcccaggtcccggctctggtccgccgcatggcatgatgcaccgtgatccgtacggcccgggcatgcaccaacagccaggaccggggccatacccctacgatatgttgccgccgcctgagatcctggagcagaagctcgcggcgcagtgtggagagatacagaagctggcgctggagaacgaacggctcgccgcgagccatgcatctctgaggaaagagctcgctgccgcgcagcaggagctgcagaggatacaagcgcagggggaggctgcgaaggtcgccgaggagcaggagatgagggggctccttgataaggctgccaagatggaggccgatctgaagtcgtacgagtctgtcaaggcggacctgcagcaggcgcacgccgaggcgcagaacctggcggcggcaaggcagcatttgttggcggatgcgcagaagctgaacaaagacctgcagaggaactttggcgaggcacagcagctgccagtactcaaggctgatcttgatgctgctagacaggaatatcagcacctcagggccgcatatgagtatgaaaggaaactgaagatggaccactccgagtcgctgcagggaatgaagaaaaattatgactccatggttacagagttagagaagcttcgtgctgagttgacaaacacaactaatattgacagaagtggtactttgtacaatcctaattttgctcagaaggatggtggtacatctagccaccattctgcttatgatggtggctatggggttgcacaggctaggacgccccctggtatgccagaccctttaagcggaagcccagctggaactgctcctcgttctggatatgatccatcaagagggaattcatatgagacttctcgtcttgctagagtccatgatgcatcaaggggtgctactggttacgactctctgaaagttgctggatatgatacttctagaatgcctgcacttggagctcaggcagcggctccaactgctcatgggagtagtgctggttactatggatcaagtcaggtcacaccaccttcgcatgcacgggcaccaggtgcacccacctatggatctgcacaggtgccaccatcatatgcttctgggccagtcccatcttcatcatacggcgcaacaacagctcagggactaccatcatatggacaaatacaggctccatcttatgcacacacacagatgccaccatcctatggactagcacaggcatcatcacattttgccccaacccagggggggtcaccgtacgggttgtctgcacagcctcagggctatggatccgcgcaagcagcacctaacatcggtggtgcttatcaagctccacatggacgcagataaattggtgataaccgtactttgttgtgatctagttggcgcgagagacatggcgctgcttccttgtttaccagagtcaaatttagtttctgcagctaccacggtaccaaactgctgttttatcggtctgatacaaatctttcttgcaatctgtaagagattatatgtgcaagcatatttgtttctgagatggcgatgatttccataaaaaaaaaa

SEQ ID NO: 3784 - protein, 467 aa, Triticum aestivum
  misc_feature: PFam Name: Extensin_2; PFam Description: Extensin-like region
  misc_feature: PFam Name: FH2; PFam Description: Formin Homology 2 Domain
  misc_feature: PFam Name: Chorion_2; PFam Description: Chorion family 2
  misc_feature: GI Number: 50937587; NR Description: myosin-like protein [Oryza sativa (japonica cultivar-group)] >gi|33146484|dbj|BAC79593.1| myosin-like protein [Oryza sativa
  misc_feature: GI Number: 47678875; NR Description: transglutaminase [Zea mays]
  misc_feature: GI Number: 47678879; NR Description: transglutaminase [Zea mays]
MGSKGRMPPPYHHRPLPGPGSGPPHGMMHRDPYGPGMHQQPGPGPYPYDMLPPPEILEQKLAAQCGEIQKLALENERLAASHASLRKELAAAQQELQRIQAQGEAAKVAEEQEMRGLLDKAAKMEADLKSYESVKADLQQAHAEAQNLAAARQHLLADAQKLNKDLQRNFGEAQQLPVLKADLDAARQEYQHLRAAYEYERKLKMDHSESLQGMKKNYDSMVTELEKLRAELTNTTNIDRSGTLYNPNFAQKDGGTSSHHSAYDGGYGVAQARTPPGMPDPLSGSPAGTAPRSGYDPSRGNSYETSRLARVHDASRGATGYDSLKVAGYDTSRMPALGAQAAAPTAHGSSAGYYGSSQVTPPSHARAPGAPTYGSAQVPPSYASGPVPSSSYGATTAQGLPSYGQIQAPSYAHTQMPPSYGLAQASSHFAPTQGGSPYGLSAQPQGYGSAQAAPNIGGAYQAPHGRR

SEQ ID NO: 3785 - DNA, 1644 bp, Triticum aestivum
  misc_feature (1)..(1644): Ceres cDNA ID no. 21665907
  misc_feature (1)..(1644): Ceres CLONE  ID no. 826592
  misc_feature (1)..(1644): Also known as  Ceres CDNA ID no. 24357126
aggaatccgtcagacggagacgagacgacatcggggaaacggagcggacagccgcgctcgatcgtcgggagcggccccgccaacgccatgcgtccgttggcgccaaagaccagcgtcgaaacgcactgccgagtagctaaacatagcgctcctccgccgcatataagcggccagcgtcgccgtccacctctcgcctcaccatacccagccagagaccaaggcacgcagccactatcaagatggtgacggcgggaagaagcaatgccgccaccgccctggcagtggcgctggcgctgctcgggagcacggcgtgggcagccgtggcgccgtaccagccgaggccggccgccggcgggccgccgtcggtgccggcgggccccctggacatcgtgatgctgggggccaagggcgacggaaagacggacgcgacgcaggcggtgatgaaggcgtggaagaacgcgtgcggggcgacggggacgcagaagatcgtgatcccgccgggcaacttcctggtgggcgcactggagctgtcgggcccctgcacctcctccatcatcatccggctggacggcaacctcctgggcaccggcgacctcaccgcctacaagaagaactggatcgaggtgatgcgcgtggacaacttcgccatcaacggccacggcatcatcgacggccagggccccctcgtgtgggagaagaaccagtgcagcaagcactacgactgcaagatcctccccaacagcctggtgctggactacgtgaacaacgcgacgatccgtggcatcacgctcaagaacgcaaagttcttccacctcaacctcttcaactgcaagtcggtgctggtggagaacgtggagatcacggcgccggggaacagccccaacacggacggcatccacatgggcgactcggaggacgtgaccatcaaggcgaccaacatcggcgtcggcgacgactgcatctccatcgggcccggcaccaagcacgtcaagatccacggctcccggtgcggccccggccacgggatcagcgtgggcagcctggggcggtacaaggacgagaaggacgtggaggacatccaggtgaccaactgcaccatcaagggcgccaccaacgggctccggatcaagtcgtacgaggactccaagtcggcgctccgggccacccgcttcgtgtacgacgacgtgaggatggacaacgtctcctaccccatcgtcatcgaccagaagtactgccccaacaacatctgcgccaaggcccccggcgcctccaaggtggtcgtcgccgacatcgtcttcaagaacatcgtcgggacgtcggcgacgccggaggccgtcacgctcaactgcgtcaacaacgtgccctgccagggcctccagctcgtcaacgtcaacctcaagtacaccggcaccaacaacaagaccatggccgtctgcaagaacgccgtcggcaagtccgtcaacgtcgtcaaggagctcgcatgcctctgactcaagccacgcacgcccgcccacccggattcattctttcttttgttaatttgatttgattaattttgtttctttctttttcgcttcctattatcatacgtttgttttcagttttacttaaatcaactggtgtaagcgaaaaaaaaaaaaaaaa

SEQ ID NO: 3786 - protein, 416 aa, Triticum aestivum
  misc_feature: PFam Name: Glyco_hydro_28; PFam Description: Glycosyl
  misc_feature: PFam Name: Mucin; PFam Description: Mucin-like glycoprotein
  misc_feature: PFam Name: Pkinase; PFam Description: Protein kinase domain
  misc_feature: GI Number: 50905965; NR Description: putative exopolygalacturonase precursor [Oryza sativa (japonica cultivar-group)] >gi|49388133|dbj|BAD25264.1| putative exopolygalacturonase precursor [Oryza sativa (japonica
  misc_feature: GI Number: 288612; NR Description: polygalacturonase [Zea mays] >gi|548493|sp|P35339|PGLT_MAIZE Exopolygalacturonase precursor (ExoPG) (Pectinase) (Galacturan 1,4-alpha-galacturonidase) >gi|629854|pir||S30067 polygalacturonase
  misc_feature: GI Number: 22422; NR Description: polygalacturonase [Zea mays]
  misc_feature: GI Number: 22419; NR Description: polygalacturonase [Zea mays] >gi|288374|emb|CAA46679.1| polygalacturonase [Zea mays] >gi|22417|emb|CAA40850.1| polygalacturonase [Zea mays] >gi|129940|sp|P26216|PGLR_MAIZE Exopolygalacturonase precursor
  misc_feature: GI Number: 288379; NR Description: polygalacturonase [Zea mays] >gi|548492|sp|P35338|PGLS_MAIZE Exopolygalacturonase precursor (ExoPG) (Pectinase) (Galacturan 1,4-alpha-galacturonidase) >gi|629853|pir||S30066 polygalacturonase
MVTAGRSNAATALAVALALLGSTAWAAVAPYQPRPAAGGPPSVPAGPLDIVMLGAKGDGKTDATQAVMKAWKNACGATGTQKIVIPPGNFLVGALELSGPCTSSIIIRLDGNLLGTGDLTAYKKNWIEVMRVDNFAINGHGIIDGQGPLVWEKNQCSKHYDCKILPNSLVLDYVNNATIRGITLKNAKFFHLNLFNCKSVLVENVEITAPGNSPNTDGIHMGDSEDVTIKATNIGVGDDCISIGPGTKHVKIHGSRCGPGHGISVGSLGRYKDEKDVEDIQVTNCTIKGATNGLRIKSYEDSKSALRATRFVYDDVRMDNVSYPIVIDQKYCPNNICAKAPGASKVVVADIVFKNIVGTSATPEAVTLNCVNNVPCQGLQLVNVNLKYTGTNNKTMAVCKNAVGKSVNVVKELACL

SEQ ID NO: 3787 - DNA, 1779 bp, Triticum aestivum
  misc_feature (1)..(1779): Ceres cDNA ID no. 21665908
  misc_feature (1)..(1779): Ceres CLONE  ID no. 826615
  misc_feature (1)..(1779): Also known as  Ceres CDNA ID no. 24360350
aagaaggttccgttgttcagagaggtattcaagagtcacatcgccctcgcgccatgggctgctgcagccacagacaccattccacttgatcagcatgtacaaaaggagctggtcctctgctaacaacaggctaaggaccttgtcagcagcagctgttgggaccgatgtcacggtggagggttcgtcatctccggcaggagaaacttccgatgccgcacctgccgctgctgaaactactgggcaggctgtggctagcaagagcccggcttcctcccctcccaagttaggtcgcaacccacgtaagagcgagatgccgccgttgaaggatggtgatctagttcctggtgcatcctttaccgggaaagtcaggtctatcaagccatttggagtctttgtcgacattggagcattcaccgaaggccttgttcatatctccagagtaagtgacggttttgtcgaagatatatctaccctcttcactgttgggcaagaggtgtcagtgaaattagtggaagtaaataaagaaacaaggcgcatctccttgacaatgcggacaggtggagattatgtcaaggaagcacctacggctccaagcggtgggaggagcccaactgcagctgcgcctagaagctcaccaaggcaaacaaaggatttcaagaagatagacgaggcaaagtatacacgaggacaatctctgactggcactgtgaaaaattcgacaagaacagggtcatttgtgacactgcctgatggagaagaaggattcctcccaagggaagaggaagcagcggcactgtttacccttatcgggcattccgcactggaggttggtcaagaggtaacggtgaaagtgttgaatgtagcacgaggccaggtcacattgacgatgaaggggggagaagatgatgacgacgagttgtcgtcgttaaacaccaacctgaagcagggatggtccagagggaccaacgctttcgagttagctttccgtaggagcaaggaaatctctgcattcttggaccagagggaaaaggttacggctccagaagtgaaaacagaagttgagactgagacttcagtttcaacttctggggttgaaagcaccgttgacgacaagctcgttgagcctcctactgaaattgaaagcaaagaggatagttctttaacagaagctgtcactggcgtcgttgagcctcctacagtttctgttactgaagttgaaagcaaagaggaggacagcgcttcaacagaagctgtcactggcgccgttgagcctcctacagtttctgctactgaagttgaaagcaaagaggaggacagcccttcaacagaagctgtcactggcgccgttgaggaaatcactcctcttgataaggttgaggagccagaagaatcagtgccggaggttcctgcaactgcaagtagcgagcctgctgtggtaactgaggaagtagcagcctcggatgagaaaaccacagaggtttctgctgctggagctgcagaagcaagcacaaccacaggtcagcagtaattttgtcgacaagatcttatctgcaaaaggccctgacatgtagtaatttgatcagtcacatcctgtctgcgaaaggctcttcaagcaactctacctaattaggaagagtattaggatagattgcatgtaaactgttcaagcaactccttttgccagttctttttacatttcttcttgtggtattgttccttactttggtaaatgacgcaagaatcaatgcacttaattttgtttcaaaaaaaaaaaaaaaa

SEQ ID NO: 3788 - protein, 477 aa, Triticum aestivum
  misc_feature: PFam Name: S1; PFam Description: S1 RNA binding domain
  misc_feature: PFam Name: MARCKS; PFam Description: MARCKS family
  misc_feature: GI Number: 31194619; NR Description: ENSANGP00000000001 [Anopheles gambiae] >gi|21290323|gb|EAA02468.1| ENSANGP00000000001
  misc_feature: GI Number: 15615909; NR Description: polyribonucleotide nucleotidyltransferase (general stress protein 13) [Bacillus halodurans C-125] >gi|25311853|pir||C84068 polyribonucleotide nucleotidyltransferase (general stress protein
  misc_feature: GI Number: 48825691; NR Description: COG1098: Predicted RNA binding protein (contains ribosomal protein S1 domain)
  misc_feature: GI Number: 16804407; NR Description: similar to B. subtilis general stress protein 13 containing a ribosomal S1 protein domain [Listeria monocytogenes EGD-e] >gi|47094388|ref|ZP_00232080.1| S1
  misc_feature: GI Number: 46908540; NR Description: S1 RNA binding domain protein [Listeria monocytogenes str. 4b F2365] >gi|46881812|gb|AAT05106.1| S1 RNA binding domain protein [Listeria
MYKRSWSSANNRLRTLSAAAVGTDVTVEGSSSPAGETSDAAPAAAETTGQAVASKSPASSPPKLGRNPRKSEMPPLKDGDLVPGASFTGKVRSIKPFGVFVDIGAFTEGLVHISRVSDGFVEDISTLFTVGQEVSVKLVEVNKETRRISLTMRTGGDYVKEAPTAPSGGRSPTAAAPRSSPRQTKDFKKIDEAKYTRGQSLTGTVKNSTRTGSFVTLPDGEEGFLPREEEAAALFTLIGHSALEVGQEVTVKVLNVARGQVTLTMKGGEDDDDELSSLNTNLKQGWSRGTNAFELAFRRSKEISAFLDQREKVTAPEVKTEVETETSVSTSGVESTVDDKLVEPPTEIESKEDSSLTEAVTGVVEPPTVSVTEVESKEEDSASTEAVTGAVEPPTVSATEVESKEEDSPSTEAVTGAVEEITPLDKVEEPEESVPEVPATASSEPAVVTEEVAASDEKTTEVSAAGAAEASTTTGQQ

SEQ ID NO: 3789 - DNA, 1763 bp, Triticum aestivum
  misc_feature (1)..(1763): Ceres cDNA ID no. 21665909
  misc_feature (1)..(1763): Ceres CLONE  ID no. 826944
  misc_feature (1)..(1763): Also known as  Ceres CDNA ID no. 24357179
actcactgaaggtagctagcttaggcatcttgagggtaggcatggaggactgggtgtactacttcctctccatcaccttgtgcctcaccctgtcccttgtgttctcatccctgcgcgaatgcaaggcggcgggctcgccgttcctcccgcctgggccgacctcgctgacggctttcggcccgctgcttttgctcgcctggacaagcgtcaacatcgagtcggtagtccgcgtcgcacgctcatggtatggccccgtgttcacgctctacctcctcccatccttccccgtcgtgttcgtcgccgaccgggccgtggcgcaccgcgtccttgtgcagctcggctcggcgttcgccaaccggcctccggccaacctcgccacccgcatcttctccagtgatcagcacaacatcacgtccgccgcgtacggcccgctgtggcgcacgctccggcaaaacctcaccggccgggcgctccacccttcgagcatcccgcggtacgccgccgcccgccggcgcgccgcctcgggcctcgtcgacggcatcacacgccagatgcgaagcggccaaggggtcgtcgtcatcgaggggctcctgcacgaggccgtcttccacgtgattgcatgcatgtgcttcggccaggggctcgacgacgcctccatcgcggcagtcacgtctctgcagaggcagtttctcaaggaggtggtggggttccaggtgttcgggtcgagccccaaggtcagcaagctcctcttctggcgacggtaccagaggatgctgtccatgcgccggcggcaggaggaggtgttcatcccgctgatacgtgcgtgccgtgcgcggcgcaacaccgccggcaagagctttgaaatggattgctacgtcgactcgctcatcagcctccgcatcccggagcaaggtggcagcagcaggcacctgacggacggcgagatcgtcgccttgtgcaccgaactcttgtccgggcccgtcgactctacggtaaacatgttgcagtgggccatggcgaacctcgtcacacggccggacatccaggcgaagctccgggccgaaataaacaacgccgccgatggccaggtccgggaggaggagcacctgccgtacctccgggcggtggtcctggagtcgctgaggcggcacccaccggcgcgcttcatcctgccgcacgcggcggccggggagaacggcacggtgctggacggcttcaccgtgcccaaagaggtgtcggtgaacttcacgctgggcgacatggccatggacaggaaggtgtggccggaccccacgcagttccggccggagcggttcctgcccggcggcgagggggaggacctggacctcacggggagcaaggagatcaaaatgatgccgttcggtgccggtcgtcggatgtgccctggcatcgacgtttcgctgctgcacgtcaacctccttgtggccaccatggtgagggcgttccagtggagcgaggtgcccggcgagccggtggacttcactgagacgctggagctcaccatagtcatgaagcgcccactccgtgccaaggtcgtgccatgccatgctactagctagctagcagctctcaatcgtcctctatcattgtcccatcggagtaactacatacaatatacaatacaatatgctgctagcttgcttgatctatcagctctctagagtttaataagttcaagatataaatagttgtatccaaataaaatgttaccgtacgtaatagacctaaaaaaaaaaaaaaaa

SEQ ID NO: 3790 - protein, 512 aa, Triticum aestivum
  misc_feature: PFam Name: p450; PFam Description: Cytochrome P450
  misc_feature: GI Number: 50725109; NR Description: putative cytochrome P450
  misc_feature: GI Number: 50941211; NR Description: putative cytochrome P450 [Oryza sativa (japonica cultivar-group)] >gi|28971944|dbj|BAC65385.1| putative cytochrome P450 [Oryza sativa
  misc_feature: GI Number: 46095226; NR Description: ACT11D09.3 [Cucumis melo]
  misc_feature: GI Number: 34895180; NR Description: putative cytochrome P450 [Oryza sativa (japonica cultivar-group)] >gi|20160664|dbj|BAB89608.1| putative cytochrome P450 [Oryza sativa (japonica cultivar-group)] >gi|21104832|dbj|BAB93417.1|
  misc_feature: GI Number: 37536034; NR Description: putative cytochrome P450 [Oryza sativa (japonica cultivar-group)] >gi|10140690|gb|AAG13525.1| putative cytochrome P450 [Oryza sativa (japonica cultivar-group)] >gi|31433046|gb|AAP54606.1|
MEDWVYYFLSITLCLTLSLVFSSLRECKAAGSPFLPPGPTSLTAFGPLLLLAWTSVNIESVVRVARSWYGPVFTLYLLPSFPVVFVADRAVAHRVLVQLGSAFANRPPANLATRIFSSDQHNITSAAYGPLWRTLRQNLTGRALHPSSIPRYAAARRRAASGLVDGITRQMRSGQGVVVIEGLLHEAVFHVIACMCFGQGLDDASIAAVTSLQRQFLKEVVGFQVFGSSPKVSKLLFWRRYQRMLSMRRRQEEVFIPLIRACRARRNTAGKSFEMDCYVDSLISLRIPEQGGSSRHLTDGEIVALCTELLSGPVDSTVNMLQWAMANLVTRPDIQAKLRAEINNAADGQVREEEHLPYLRAVVLESLRRHPPARFILPHAAAGENGTVLDGFTVPKEVSVNFTLGDMAMDRKVWPDPTQFRPERFLPGGEGEDLDLTGSKEIKMMPFGAGRRMCPGIDVSLLHVNLLVATMVRAFQWSEVPGEPVDFTETLELTIVMKRPLRAKVVPCHATS

SEQ ID NO: 3791 - DNA, 1809 bp, Triticum aestivum
  misc_feature (1)..(1809): Ceres cDNA ID no. 21665910
  misc_feature (1)..(1809): Ceres CLONE  ID no. 829228
  misc_feature (1)..(1809): Also known as  Ceres CDNA ID no. 24361391
gaatcgcccacgcccggtccactcttcttcttggtcctgcccctagccctacagcttagatgcgtgcatatgtagctgcattgcccaattgaggcgccaattcggagaaagatatcgctgccgcattcatgcgtgccggagctataccacccaccgatttggccatttgggggtaggtgaggaccagtatttgcgtccggtttagattggggagggctgcttcgcttgaccatttgtaagtgcagagctgctgctgcttactccgacacaagtaaggaaaagggaatccccctccgcgactttgctgattcgatgtcacgggcatccggatgtcattgccgatcgccgccatagtcggcattgccgccggtggcgccgccttgctcgtcttggtggccgtggtgatcgcactttggtgccgggcgcgcgcgcggcgtaacaggacatccgaaaccggctcctcggatccttccaccctagtggagtggggcaaggggggccgaagttcctcggcgccggagcgtcagggcgccagacaattctctctcgaggagctggcgcaggcgaccaacaacttcagcgaggccaacttggttggcgccgggagctttggcctggtgtacaaggggttgctttttgatggttcagttgtggccatcaagaggcgcatgggagcaccaaggctggagttttcggacgaggttaggaggctttcagagatttgtcatcggaacatcgtaactctgattggttattgccaggaaggaggtctacaaatgctagtgtttgagtactcacccaatggcaatgtctgtagccatctatatgattcagggaaaggctccatgacacggcttgagttcaaacagaggctagcaatagccattggtgcagctaaaggtctgaatcatctgcatagtcttatgcctcctttgatccacaagaacttcaagacgagcaatgtactggtcgatgagaattttattgcgaaggtggctgatgctggactttttaggttacttagaggacatgaagatgtcgggtcatcgcatgggtttagtagcagtgtctaccaggatcccgaagcacacttggtggcgcagttttctgaaagcagcgacgtctacagctttggagtgtttcttttggagctaattactggcagagaagctgctagcttgcaacctgcagaatccagagaatctctggcccactggctggaagcacatttcagttcaaatgaactgattgacccaaggttaggtggcggtttcacgacagaaggtatgaaagaatttgttgggcttgctttccagtgtctgaacccatcctccagaaggcggccgaagatgaggctggttgcggctgaactagaccgtattctcgagacggagatgtctctaacaacgattatgggcgacggaaccgcgatcatcacccttgggagccaactatttacatcgtaaagacagagattgattgcatgtctgttatttgatgacatgatgattgttttttaagagtccagcagctgttgtttatgataagttgtacaggctctgcattgtagcgaattaccatgtatggttgttttttaagcttatcatggttattatattctgtaaggtaggtgagaagaaatagatctgtatgtatctttctttttcttcctcctatttgtcactcgacgaattgtatgtaattttcagaccgtttgctgttctgatgctgtaatccctgagagcactatcaatttgagttcctgtgctaagctggtaccatattaacttcccaaaaaaaaaaaaaaaa

SEQ ID NO: 3792 - protein, 378 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 34907204; NR Description: serine/threonine protein kinase-like protein [Oryza sativa (japonica cultivar-group)] >gi|15408804|dbj|BAB64200.1| serine/threonine protein kinase-like
  misc_feature: GI Number: 30688460; NR Description: protein kinase family
  misc_feature: GI Number: 57899627; NR Description: nodulation receptor
  misc_feature: GI Number: 34907096; NR Description: putative serine/threonine protein kinase [Oryza sativa (japonica cultivar-group)] >gi|20161841|dbj|BAB90755.1| putative serine/threonine protein kinase [Oryza sativa (japonica
  misc_feature: GI Number: 34909240; NR Description: putative receptor protein kinase [Oryza sativa (japonica cultivar-group)] >gi|15528782|dbj|BAB64823.1| putative receptor protein kinase
MSLPIAAIVGIAAGGAALLVLVAVVIALWCRARARRNRTSETGSSDPSTLVEWGKGGRSSSAPERQGARQFSLEELAQATNNFSEANLVGAGSFGLVYKGLLFDGSVVAIKRRMGAPRLEFSDEVRRLSEICHRNIVTLIGYCQEGGLQMLVFEYSPNGNVCSHLYDSGKGSMTRLEFKQRLAIAIGAAKGLNHLHSLMPPLIHKNFKTSNVLVDENFIAKVADAGLFRLLRGHEDVGSSHGFSSSVYQDPEAHLVAQFSESSDVYSFGVFLLELITGREAASLQPAESRESLAHWLEAHFSSNELIDPRLGGGFTTEGMKEFVGLAFQCLNPSSRRRPKMRLVAAELDRILETEMSLTTIMGDGTAIITLGSQLFTS

SEQ ID NO: 3793 - DNA, 1797 bp, Triticum aestivum
  misc_feature (1)..(1797): Ceres cDNA ID no. 21665911
  misc_feature (1)..(1797): Ceres CLONE  ID no. 830006
  misc_feature (1)..(1797): Also known as  Ceres CDNA ID no. 24361215
aaaacatacacggggacctcctccattctatcttctcgaggtgcccacgcccctcctcctcgaccacccaatccggttcacaccgcctctcgccgtcgccatgtcggtcgccgtggcggccgcctcctcctacctcccctctcgctacgcactgggccacgccaactcgcaccgccctctccgccccctgcgcttcatctcttccccgccgcagccgtgcgcctccccagcgtcgctcctccggcggcggcgggcggcggcgcccaccaccttctgctccgcgccgtcgctcggccgcgtcggctggccgcgccgcgaggggagcgcctggctgctctccttcagcgccgaggccgatgcctccccgtcggacgcggagggggccgtggacccctccgaggcggtctccgcgctgctcccgctcgtcgtcgtcgccacggccgtcgccgccctcggcaaccctgccactttctcctgggtctccaaggagctgtacgcacctgcactcggaggcatcatgctctccattggcatcaaactatccttcgacgacttcgctctggccttcaagaggccagtgccgctgtcgattggatacatggcacagtacatgctcaagcctctgctgggagtgctgatcgcaagggtgttccggatgccatcggccttcttcgcgggtttcatgcttacatgctgcgtctcgggcgcgcagctttcgagctatgccagcttcctggggaaaggagatgttgcgttgagtattctgctcacaacctactccaccatatcttcggtgattgtgacacctatcctcactggtttgttgattggttcagtggttccggttaatggaattgcaatggcgaaatcgattctccaggtggttcttctgcctgtgacactaggtctccttctgaatacctatgcaaaaccagtggttaatgtcatacaaccagtgatgccatttgttgctatggtgtgcacatcactctgtattgggagccctcttgctataaataggaccatgctcctctcatcacagggattcatgttacttctccccatagtgactttccacattgcggcctttgttgtgggttactgggtttccaagttgcctcagttgaggcaagaagagcctgtttgtaggactatttcagtgtgtactggaatgcagagctccaccctagctggacttcttgctacgcaatttcttggaatcagccaggcagttcctgcagcatgttctgttgttgtcatggcaatatttggtttgactcttgcatcgtactggggaagtggcatgcgaataagagacattccttcgagattcttcccacaagcttccgctgatgcaagatcgtgagaggctggatttatagcattgaaattttttcaagggctcccagcttgagaaactctgctgccgtttggggatgcagttacagggatgatgtcctgcgcctcatccagcaatcaggcatgccatagtagctacaaaaggcagaactataaacagcagattgtgcaagataagcagcggctgaggataacctcgccacagaaacaacctgcatggctgcatacgacggaaggataatgagatgccagtcatttatcagctatcataccatgtgcagtaggctccattaattagtggcgcctccttagccattttttgtagatactaggtagtagacacgttcatgatccctatgtataccactaagcatatgcatgcgcaatgccaatatcatccacgcattcttcgcaagatgaaaaaaaaaaaaaaaaaaa

SEQ ID NO: 3794 - protein, 421 aa, Triticum aestivum
  misc_feature: PFam Name: SBF; PFam Description: Sodium Bile acid symporter
  misc_feature: GI Number: 50908255; NR Description: bile acid:sodium symporter-like [Oryza sativa (japonica cultivar-group)] >gi|47848126|dbj|BAD21908.1| bile acid:sodium symporter-like [Oryza
  misc_feature: GI Number: 21554890; NR Description: unknown [Arabidopsis thaliana]
  misc_feature: GI Number: 20269901; NR Description: putative
  misc_feature: GI Number: 30683305; NR Description: bile acid:sodium
  misc_feature: GI Number: 34911708; NR Description: P0707D10.18 [Oryza sativa (japonica cultivar-group)] >gi|13603433|dbj|BAB40160.1|
MSVAVAAASSYLPSRYALGHANSHRPLRPLRFISSPPQPCASPASLLRRRRAAAPTTFCSAPSLGRVGWPRREGSAWLLSFSAEADASPSDAEGAVDPSEAVSALLPLVVVATAVAALGNPATFSWVSKELYAPALGGIMLSIGIKLSFDDFALAFKRPVPLSIGYMAQYMLKPLLGVLIARVFRMPSAFFAGFMLTCCVSGAQLSSYASFLGKGDVALSILLTTYSTISSVIVTPILTGLLIGSVVPVNGIAMAKSILQVVLLPVTLGLLLNTYAKPVVNVIQPVMPFVAMVCTSLCIGSPLAINRTMLLSSQGFMLLLPIVTFHIAAFVVGYWVSKLPQLRQEEPVCRTISVCTGMQSSTLAGLLATQFLGISQAVPAACSVVVMAIFGLTLASYWGSGMRIRDIPSRFFPQASADARS

SEQ ID NO: 3795 - DNA, 1671 bp, Triticum aestivum
  misc_feature (1)..(1671): Ceres cDNA ID no. 21665912
  misc_feature (1)..(1671): Ceres CLONE  ID no. 832016
  misc_feature (1)..(1671): Also known as  Ceres CDNA ID no. 24357011
actcgctcactcgtcgctcccagcatcccaaaccctcgatcccctttctccaccgcggccgccatggcgtcgccgccgccgccgctggtctccatccccatccccgacgacctcctggaggagatcttcctccgcctgcccaccccggacgcggtcgcccgcgcctccgccgcctgcacctccttccgtcgcgtcatcaaaggccgcgccttccgccgccgcttccgcgcgctgcaccggcctcccctcctcggcttcatggacgcagccggattccaccccgcccaggcgccgcacccctccgctccgctcaccggcgccctcgccccctgcgccgccgatttctccttcgtcccggccgtcgtttcttctgcctcctacatcccgcgaggtgtccaagccgatggggaaggcccccgctggcgcccccgcgacgtccgcgacggccgcgtcctcctcgattgggtctccctccacccacgcgccatgcgcatatgctgctacatggaagacggctacgaagtaagcatcctcatggatttcggtgagctcgccccgcgtgaccgccccacctggactgaacgggagcggtgcaacgctgccgagttccacctcgccgtctgtgaccccctgtccagcagatccgtgctgcttccaaccatacccgaggagctcgccgtccagccgcaagattaccttcgggaattcgagcctgtgctcgctcccaacaccagcgaggacggcgaggaggaacacttcaaggtgatatgcatagcaaaataccacacaaagctcgtcctctttgtcttcccgtccacaactatgcagtggtctatggtcgagcctcccatttccccttctttggagcacatgtcctgttttgactgcgtgcgcggatgcttctactggacagagccttatcgatggagtgaccatttgatggtgctggacacacgcaccatgaggttttccactgtcgaccttctcaccggttaccatatggagctcagaggtctgcctgaccagagctttgatcgtcggcgcccaaatgctgttgttttgggccgagaaggaacccttgagatgttttctcttgtccgtcaacacggatcctttgccctctatcatacctctctgcagaataattcgcaggaatggaagcttgagaaggtcatacagctgcctcgacaatatcatgactattccatttccacagtgggtgcggctgagggattcttgttcttccgaggcactctagaagatattcctgttgagaatgtcaacgtggattgctactcaatggaggtcaatacatatggaattaccaaagtctgtacaaagacggagaagtacttcaaccgcacgtgtaccctcccatactttagcttcccaccgctgttatcggaaccaactatctgatcaactgctctgagctcgctggccttgatcttgcttggacctgaaccatacatctggagtaggatggcggatgttcaagatggtgctgatgtagtttgatatgtccgtgttaagtgtcatatgtatgtaagcaggatatggtatcagcaagttgactttgcctgacaatgacgtctaagactggtattgttgtttgtgttggaagattggctaggctagtggtgctgactttggtcaaaaaaaaaaaaaaaa

SEQ ID NO: 3796 - protein, 451 aa, Triticum aestivum
  misc_feature: PFam Name: F-box; PFam Description: F-box domain
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: 7tm_1; PFam Description: 7 transmembrane receptor
  misc_feature: GI Number: 32422095; NR Description: predicted protein [Neurospora crassa] >gi|28926713|gb|EAA35680.1| predicted protein
  misc_feature: GI Number: 14253159; NR Description: VMP3 protein [Volvox
  misc_feature: GI Number: 2429362; NR Description: proline rich protein
  misc_feature: GI Number: 13592175; NR Description: ppg3 [Leishmania major]
  misc_feature: GI Number: 51766362; NR Description: similar to paternally
MASPPPPLVSIPIPDDLLEEIFLRLPTPDAVARASAACTSFRRVIKGRAFRRRFRALHRPPLLGFMDAAGFHPAQAPHPSAPLTGALAPCAADFSFVPAVVSSASYIPRGVQADGEGPRWRPRDVRDGRVLLDWVSLHPRAMRICCYMEDGYEVSILMDFGELAPRDRPTWTERERCNAAEFHLAVCDPLSSRSVLLPTIPEELAVQPQDYLREFEPVLAPNTSEDGEEEHFKVICIAKYHTKLVLFVFPSTTMQWSMVEPPISPSLEHMSCFDCVRGCFYWTEPYRWSDHLMVLDTRTMRFSTVDLLTGYHMELRGLPDQSFDRRRPNAVVLGREGTLEMFSLVRQHGSFALYHTSLQNNSQEWKLEKVIQLPRQYHDYSISTVGAAEGFLFFRGTLEDIPVENVNVDCYSMEVNTYGITKVCTKTEKYFNRTCTLPYFSFPPLLSEPTI

SEQ ID NO: 3797 - DNA, 2193 bp, Triticum aestivum
  misc_feature (1)..(2193): Ceres cDNA ID no. 21665913
  misc_feature (1)..(2193): Ceres CLONE  ID no. 833088
  misc_feature (1)..(2193): Also known as  Ceres CDNA ID no. 24357187
aatcttccatcgtcacgaaaaccgaacccgccacccgcctcgaatcctccacctccaaaccctagcagccatccatggcgacggagacgggtcccgccgcgccgcgcctcctcctgggcccgccgctggtccgcgcggcgcgcccctcgcccgccgacgacgccccggagtcgcacccgttcctcgacctcctcgacgcggccttcaacgcgccgtccgccgccgaggccaaggcggcgctggccccgcggcgggcgcgcacggagaactgcaacgccacgtacgccaactcgggcgacccctgcgtcgacttcttcttccacgtggtcccgaccacgcccgccgcgcgcgtgcgcgagctcctcgccgccgcctgggcccgcgacccgctcacggcgctcaagctcgcctgcaacctccgcggcgtgcgcggtaccggcaagtcggacagggagggcttctacgccgccgcgctgtggctgcacgaccaccacccgcgcacgctcgcctgcaacgtcgccgcgctcgccgagttcggctacctcaaggacttccccgagctgctcttccggctcgtccgtggccaggacgtgcgcaggctcgccaaggagggcgccgccgccgacaaggcgcgcagggagggcaagcagctcgcggagcagcgggtcggcctccgcgccaggctcgccggccgcaagcgcgcccgcgaggccgctaccaggtccgtcacggaggtggcggagcagaagacggaggccatggaggtcgatcagaagaaggcctccaagcggggcgtgccgaagaaggtccggaccatggccaagctcgccgtgcagtcgctcgagacctactacggcgaccgcgcgtaccgcttcctgtttgacgccgtggccgacttcttcgccgccctgctcgcctccgacatgaagcagatggcccccggcggcaagaagaggaagatcgggctcgccgccaagtggtgccccacgccgggctcctccttcgaccgcgccacgctgctctgcgaggccatcgcctgccgcctcttcccgcgcgactccgaccccgagtacgccgagctctccgacgagcactacagctaccgcgtcctccgccgcctccgccgcgacgtcctggcgcccatccgcaaggccctggagctcccggaggtctacatgtgcgcgcagcggtgggacgaagtgccctacgcgcgcgtcgcctcggtggccatgcggcgctacaaggccctcttccagaagcacgacgaggagcgcttcgccaagtacctcgaggacgtggaggccggcaaggccaagatcgcggcgggcgccgtcctgccgcacgagatcgccgccgcggcctaccgcggcgaggaggacgaggtggcggagctgcagtggcgccgcatggtggacgacctccgcgccaagggctcgctgcgcaactgcatctccatctgcgacgtgtccgggagcatggagggcacccccatggaggtggccatcgcgctgggcgtgctcacctcggagctcagcgaggagccgtgggcgggcaaggtgatcacgttccacaccaggccctccatccacgtgatcaagggcgagacgctgcgggacaagatgcggttcgtcgccaagctcgagtggcacgggagcaccaacttccagggcgtgttcgaccgcatcctcgccacggccagggaggcccagctgccgccggagaagatgatcagaaccgtcttcgtctacagcgacatggagttcggcgaggcgtgcgggcggggcgtctacaacggcatgccctacggcgaggggtcgtgggacacggactacgccgccatctgccgcaagttcagggacgccggctacggcgacgccgtgccccaggtggtgttctggaacctgcgcgactccaagtcgacgcccgtgacgtccacccagcccggcgccgccatggtcagcggcttctccaagaacgtgctcaagatcttcctgcagaacgacggcgtggtcaaccccgaggccatcatgacccaggccatcgctggcgacgagtaccagaagcttcaaatctacgattagtttcttgttagattagatagatcgatcccatacttagttcgtgacgattctctagttgaactcatgccgtggtgattggtcagttggcttgttttcaaaaaaaaaaaaaaaa

SEQ ID NO: 3798 - protein, 668 aa, Triticum aestivum
  misc_feature: PFam Name: Pyr_redox_2; PFam Description: Pyridine
  misc_feature: PFam Name: Atrophin-1; PFam Description: Atrophin-1 family
  misc_feature: PFam Name: Pkinase; PFam Description: Protein kinase domain
  misc_feature: PFam Name: Glutenin_hmw; PFam Description: High molecular
  misc_feature: PFam Name: APC_basic; PFam Description: APC basic domain
  misc_feature: GI Number: 31232507; NR Description: ENSANGP00000004655 [Anopheles gambiae] >gi|30174516|gb|EAA13969.2| ENSANGP00000004655
  misc_feature: GI Number: 33340423; NR Description: unknown [Bacteriophage Felix 01] >gi|38707820|ref|NP_944857.1| unknown [Bacteriophage
  misc_feature: GI Number: 13592175; NR Description: ppg3 [Leishmania major]
  misc_feature: GI Number: 6322209; NR Description: GPI-anchored cell surface glycoprotein required for diploid pseudohyphal formation and haploid invasive growth, transcriptionally regulated by the MAPK pathway (via Ste12p and Tec1p) and the cAMP pathway (via Flo8p);
  misc_feature: GI Number: 15901602; NR Description: cell wall surface anchor family protein [Streptococcus pneumoniae TIGR4] >gi|25389341|pir||E95206 cell wall surface anchor family protein [imported] - Streptococcus pneumoniae (strain TIGR4)
MATETGPAAPRLLLGPPLVRAARPSPADDAPESHPFLDLLDAAFNAPSAAEAKAALAPRRARTENCNATYANSGDPCVDFFFHVVPTTPAARVRELLAAAWARDPLTALKLACNLRGVRGTGKSDREGFYAAALWLHDHHPRTLACNVAALAEFGYLKDFPELLFRLVRGQDVRRLAKEGAAADKARREGKQLAEQRVGLRARLAGRKRAREAATRSVTEVAEQKTEAMEVDQKKASKRGVPKKVRTMAKLAVQSLETYYGDRAYRFLFDAVADFFAALLASDMKQMAPGGKKRKIGLAAKWCPTPGSSFDRATLLCEAIACRLFPRDSDPEYAELSDEHYSYRVLRRLRRDVLAPIRKALELPEVYMCAQRWDEVPYARVASVAMRRYKALFQKHDEERFAKYLEDVEAGKAKIAAGAVLPHEIAAAAYRGEEDEVAELQWRRMVDDLRAKGSLRNCISICDVSGSMEGTPMEVAIALGVLTSELSEEPWAGKVITFHTRPSIHVIKGETLRDKMRFVAKLEWHGSTNFQGVFDRILATAREAQLPPEKMIRTVFVYSDMEFGEACGRGVYNGMPYGEGSWDTDYAAICRKFRDAGYGDAVPQVVFWNLRDSKSTPVTSTQPGAAMVSGFSKNVLKIFLQNDGVVNPEAIMTQAIAGDEYQKLQIYD

SEQ ID NO: 3799 - DNA, 1804 bp, Triticum aestivum
  misc_feature (1)..(1804): Ceres cDNA ID no. 21665914
  misc_feature (1)..(1804): Ceres CLONE  ID no. 833336
  misc_feature (1)..(1804): Also known as  Ceres CDNA ID no. 23414664
caaacccacccaccgatccgtcacaacccacaaaaaaaaaactcgaaaaagctccaggcccgaccgagagagcgacgcccgtctccccacgtcgtcccccaccatggcacgcgccgccgcggcggggccgggcctcctcctggccctgctcctgctcgccgtcgcggccgtcgcctcggccgccgacatgtccatcatcgcctacaacgcggagcacggggcgcgcgggctggagcgcacggaggcggaggcccgggccgtctacgacctctggctggccgagcacggcgggggctcctaccccaacgccaactccatccccgagcgggagcgccggttccgggccttctgggacaacctccgcttcgtcgacgcccacaacgcgcgcgccgcggccggcgaggaggggtaccgcctcggcatgaaccgcttcgccgatctcaccaacgacgagttccgcgccgcctacctcggggtcaagggcaccgccgagaggaacagggccgcccgcgtcgtcggcgagaggtaccgccacgatgggtcggacaagctgccggaggccgtcgactggagggagaagggcgccgtcgcccccgtcaagaaccagggccaatgcggaagttgctgggctttttctgcagtcagcacagtagaaagcatcaaccaaattgtcactggtgagatggtgacattatctgagcaggagcttgtggagtgcgacatcaatggcgggagcagtggctgcaatggtgggcttatggatgacgcctttgagttcatcataaagaacggtggcattgatactgaagatgactacccttacaaagccgtggacggcagatgtgatgtcctcaggaaaaatgcgaaggtggtgagcattgatggctttgaagatgtccctgaaaatgatgagaaatcgttgcagaaggcggttgctcaccagcccgtgagtgttgccattgaagctggaggccgggagttccagctctaccattcgggtgtcttcagtggaaggtgtggcacgcaactcgaccacagtgtggttgctgttggctatggcaccgagaatggcaaggactactggattgtccgcaactcatggggtccaaactggggagaggctgggtacctccgcatggagcgcaacatcaacgtgaccagtgggaagtgcgggatagccatgatgtcatcataccccaccaagaagggcgctaaccctcccaagccagccccaacacctccctcaccgccgacgccgcctcccccagtcgcccctgaccacgtttgcgacgagaacttctcatgccctgcaggcagcacctgctgctgttcgtttggcttcaggaacctttgcctggtgtggggctgctgcccggctgaaggggccacctgctgcaaggatcattccagctgctgcccaccggactaccccgtctgcaacatcagggctgggacttgctcagcgaccaagaacagcccgctgagcgtgaaggccttgaagcgcaccctggccatgcgaaacacggcatgaactcgtcgggagacagcggtgtctaaggtggagtagaaggatgcggctgctggagcttttctccctccgtgcacccaagaagcctttgtgcaaaatttgaaccagacattgcttttgtagaattgttgttgcttagtattacgattctagcagtaccgctcgctttatatatcccctacttctacatgtactcaattgtacatagctcgcccccatttgtactcgtactatcttaaagaatattcgtcagagctaagaaaaaaaaaaaaaaaa

SEQ ID NO: 3800 - protein, 475 aa, Triticum aestivum
  misc_feature: PFam Name: Peptidase_C1; PFam Description: Papain family
  misc_feature: GI Number: 19548039; NR Description: F2G19.31/F2G19.31 [Arabidopsis thaliana] >gi|14517542|gb|AAK62661.1|
  misc_feature: GI Number: 62526575; NR Description: cysteine protease CP1
  misc_feature: GI Number: 50355611; NR Description: cysteine protease
  misc_feature: GI Number: 50355619; NR Description: cysteine protease
  misc_feature: GI Number: 6682829; NR Description: cysteine protease
MARAAAAGPGLLLALLLLAVAAVASAADMSIIAYNAEHGARGLERTEAEARAVYDLWLAEHGGGSYPNANSIPERERRFRAFWDNLRFVDAHNARAAAGEEGYRLGMNRFADLTNDEFRAAYLGVKGTAERNRAARVVGERYRHDGSDKLPEAVDWREKGAVAPVKNQGQCGSCWAFSAVSTVESINQIVTGEMVTLSEQELVECDINGGSSGCNGGLMDDAFEFIIKNGGIDTEDDYPYKAVDGRCDVLRKNAKVVSIDGFEDVPENDEKSLQKAVAHQPVSVAIEAGGREFQLYHSGVFSGRCGTQLDHSVVAVGYGTENGKDYWIVRNSWGPNWGEAGYLRMERNINVTSGKCGIAMMSSYPTKKGANPPKPAPTPPSPPTPPPPVAPDHVCDENFSCPAGSTCCCSFGFRNLCLVWGCCPAEGATCCKDHSSCCPPDYPVCNIRAGTCSATKNSPLSVKALKRTLAMRNTA

SEQ ID NO: 3801 - DNA, 1259 bp, Triticum aestivum
  misc_feature (1)..(1259): Ceres cDNA ID no. 21665915
  misc_feature (1)..(1259): Ceres CLONE  ID no. 833929
  misc_feature (1)..(1259): Also known as  Ceres CDNA ID no. 24357052
atttcagaaccagtgtctcccctgctgaagcccatctctcgctctcgctccttggtggctacaaaaccacaagaggccaagcgcctgcgcgctagctgcatccatccagagcccagagccagaggcatgcggtgatggagttcacggggccggagcacgccgccgggacgccgcccggcacgcgcgcgccctccgacgcctcctcggggaacagcggggcggccgggagctgggaggcgaggtaccgcgagtgcctgcgcaaccacgcggccgcgcagggcgggcacgccgtggacgggtgcggggagttcatgccctccggcgcccacgacctcctcaggtgcgccgcctgcgggtgccaccgcagcttccaccgcagggacgacgggcagcagcacccccgcctcttcctccccgcgcccgccgccacgccgacgacggctccgcgcgtgccgctgctcatgccgcctccgcagcaccaccacccctacgcggccggccacccgctcgcgccgccgttcgcgtacaacccccaccaccaccaataccaacgcacacccagcggcggtggcacgacgaccgagtcgtccagcgaggagcccggcccgggcccgccctcgacgtcggctccagggcaggggcacgggcaggcgcggcggccgaagcggttccggacgaggttcacggcagagcagagggggcagatgctggcgctggcggagcgggtggggtggcggatgctgaaacaagacgaggccctggtggagcagctctgcgcgcaggctggcgtccggcggcaggtcttcaaggtctggatgcacaacaacaagcaccacaggaggcagccgcagccgccacagtcccaacagcagcaacaacaacggtagggtgcccgtagccatgggaggggacaagctcacgaatccccacatcattatttttgtacttccgacaggggaagagggattaattaaacagggggactgaagtgaagtgaagcgaggggctctctctaatcttcatcattgtctcctagttttacttcttgttcttgatcatggttcatgatccttgcttggtttaatccttttgtttctagttgatgcgtcagttaattgggatgatgagggcactcaacgcgcatacgtacatttgtccttattttctactgtacgtatttgatttggcctctgaacaagaagatcaattgaccacggcaatttccttcatgccatcttgctcgaaaaaaaaaaaaaaaa

SEQ ID NO: 3802 - protein, 250 aa, Triticum aestivum
  misc_feature: PFam Name: ZF-HD_dimer; PFam Description: ZF-HD protein
  misc_feature: PFam Name: Homeobox; PFam Description: Homeobox domain
  misc_feature: PFam Name: 7tm_1; PFam Description: 7 transmembrane receptor
  misc_feature: GI Number: 5091602; NR Description: 10A19I.6 [Oryza sativa
  misc_feature: GI Number: 13277218; NR Description: ZF-HD homeobox protein
  misc_feature: GI Number: 53689757; NR Description: ZF-HD homeobox
  misc_feature: GI Number: 13277216; NR Description: ZF-HD homeobox protein
  misc_feature: GI Number: 21536616; NR Description: unknown [Arabidopsis thaliana]
MEFTGPEHAAGTPPGTRAPSDASSGNSGAAGSWEARYRECLRNHAAAQGGHAVDGCGEFMPSGAHDLLRCAACGCHRSFHRRDDGQQHPRLFLPAPAATPTTAPRVPLLMPPPQHHHPYAAGHPLAPPFAYNPHHHQYQRTPSGGGTTTESSSEEPGPGPPSTSAPGQGHGQARRPKRFRTRFTAEQRGQMLALAERVGWRMLKQDEALVEQLCAQAGVRRQVFKVWMHNNKHHRRQPQPPQSQQQQQQR

SEQ ID NO: 3803 - DNA, 1472 bp, Triticum aestivum
  misc_feature (1)..(1472): Ceres cDNA ID no. 21665916
  misc_feature (1)..(1472): Ceres CLONE  ID no. 833986
  misc_feature (1)..(1472): Also known as  Ceres CDNA ID no. 25088329
actttcctgccttcctccattgctcgccagaccgtccttaagccaactcaggtagcagcaactagagccgacatgatggcggaggcgtggatggacgtgctgccgccgccggcgccctacttcgccgggcagccgtgttgggccgtgcagcaggagcgtcgcggaggcggcgcctggacgctggaggagaacaaggtgttcgaggaggcgctcgcggcgatcgacctggacgcgccggaccggtgggagatggtcgcgctgatgttgcccaggaagacggtcgccgacgtggtgaaccactaccgggccctcgagaacgacgtcgggttcatcgaggccgggctggtcccgttccctcactacgacagctcgtccccttcgtccgggttcactctggactgggacgggggcgccgccggcgccggcgggttccggcgcggctactgcctcaagcgcgggcgcgccgaccaggagcggaagaagggcgtcccgtggacggaggaggagcaccggctcttcttgaaggggctgaagaagtacgggcgaggggactggaggaacatctcccgcaactacgtgacgagccgcacgccgacgcaggtggccagccacgcgcagaagtacttcatccggctcacctccggcggcaaggacaacaagcgccgctccagcatccacgacatcaccaccgtcaacgtgcccgacgacgacgaccgcgacagcccctcagggtcaccgccgtccgtggtcaccaccgtcgacacgaagccctcgccgtcctacggggggcaacggcatgccttcgtgccgtcgacgctgccagcggggacgctcggcggcggccacccgtacggcaacgtgaagctcgagcaccagagctcgttcatgtccggcgcgggcctcgacctcgacgactcgctcctcctgcagatgcaatgcggccagctgtgacggagctttctcgccgcggcgaagcccgcacggaggacaaaacagcggcggccacctctcaccatcatcgcatccacgggcgctaccacaccagggacgaggcaggcaggcgggcgcgcttgcctcgagagcagtttggttgcagagtcgctgtgcttgtgtctctctcgaccgacactcagatgatggaacgcaagcgaaaatatctgagagcgacacggcggtgttgagcgtacgtgcaggtctgcgtccatggagaaacctcaagaacccatcggcgtgccgtccagtgtacataattccgccacacccaagaacctccactgtactgaaaaaagaatctgtaataagccttcgatgaagcttgtgctccggtgtgctccggtcaggagctagctagcgccggcctgaaaattggttcgaacgtttctctgtctattgtactccaaatgaatccgtcgccattgttaaacttgcgccgcctgcctccccgtgagaggttttgaaaaaaaaaaaaaaaa

SEQ ID NO: 3804 - protein, 292 aa, Triticum aestivum
  misc_feature: PFam Name: Myb_DNA-binding; PFam Description: Myb-like
  misc_feature: GI Number: 34908386; NR Description: P0529E05.19 [Oryza sativa (japonica cultivar-group)] >gi|18461206|dbj|BAB84403.1|
  misc_feature: GI Number: 29824293; NR Description: putative MYB family transcription factor [Arabidopsis thaliana] >gi|26451319|dbj|BAC42760.1| putative MYB family transcription factor [Arabidopsis thaliana] >gi|30687381|ref|NP_181344.2| myb
  misc_feature: GI Number: 3335378; NR Description: putative MYB family transcription factor [Arabidopsis thaliana] >gi|7446171|pir||T01241 probable MYB family transcription factor [imported] - Arabidopsis
  misc_feature: GI Number: 51557078; NR Description: MYB transcription factor
  misc_feature: GI Number: 34895714; NR Description: putative myb-related
MMAEAWMDVLPPPAPYFAGQPCWAVQQERRGGGAWTLEENKVFEEALAAIDLDAPDRWEMVALMLPRKTVADVVNHYRALENDVGFIEAGLVPFPHYDSSSPSSGFTLDWDGGAAGAGGFRRGYCLKRGRADQERKKGVPWTEEEHRLFLKGLKKYGRGDWRNISRNYVTSRTPTQVASHAQKYFIRLTSGGKDNKRRSSIHDITTVNVPDDDDRDSPSGSPPSVVTTVDTKPSPSYGGQRHAFVPSTLPAGTLGGGHPYGNVKLEHQSSFMSGAGLDLDDSLLLQMQCGQL

SEQ ID NO: 3805 - DNA, 1782 bp, Triticum aestivum
  misc_feature (1)..(1782): Ceres cDNA ID no. 21665917
  misc_feature (1)..(1782): Ceres CLONE  ID no. 834049
  misc_feature (1)..(1782): Also known as  Ceres CDNA ID no. 24360320
agcatatatacacccaaagtaaaagcatctccccacaccactgataacaatgtcgatctcgttctcgcaagagctgctcatctccacactcgccatcattcttcttcccctgatgttgtacctcaggtctagcagatcaaagaacccatcagtgctccccataaactggccaatagtgggggtgttcccttaccttatcgccaacttccacaacctgcacgactacctcgccgtcgtcctcgccggatcaggccacaacttcagggcgcacggcccgcctgggaccgggttgcggttcttcatcacatgcgaaccggccaacgtccggcacatcttcacgacgaaccatgcaaacttccccaagggcgcggagttcgccgccatctttgacatcgcgggtggcagcttcttcaccaccgaaggcgagccctggcgtcggcagcgcgcaagagcccagagagtcttgagcaacccacggttgcttgcctgtatgaccgcttgctgccgcgacaaggtggagaacggcctcctcccggtgctcatgcacatggcgagcaccgggaccacgttcgacctgcaagatttgacaataaggctcgtgctcgacatgaccgccacgcctctctttggcgtggacccaggcctcctgtcctcggacatgccgcccatggacgccgcggtcgccatggacacggtcatggaggtggccttgttccggcacatcgtgccgacctctggttggaaggtgatgaggcggctaaacatcggcccggaaaggaagctcgccgcagcacacacggttctacgagggttcattgaggagatgatggagaggaggaagaggaaggaacatgctggtaatgagggagctccttccgtggacatcctgtcttcctacatcgacgatccagactaccagcagaacgatggcttgctccatgcgacgctcatcaactacatgatcgccgggagggacacgatcggcacagctttgacatgggtcttctacaacctcgcccagaaccctcatgtcgtgtcgttcatccgccacgaactatcacccatcgcatcacagaaagcagccacaggcgccaacaatagcagcacgatggtgatctttgaaccggaggagacaaaatctctcgtctacatgagagccgccatacacgagtctctcaggttgcaccccccggtccccatcgagcgtaagacggcggtcgcccacgacgtgatgccgagtggccatgtggtacacgccggtgacaccttattaatttctctccactccatggggagaatggaaggcgtgtgggggaaagactgccgggagtataacccggatagatggctctcagaggatggcaagaaactgcggtacgtgccgtcttacaattttttgtcattcagctcgggcccgaggctgtgccttggcaaggacgtctcattcatgcagatgaatactattgttgcggcaatggtgtggaactttgatgtggaagtggttgaagggcagagagtccagccgaagatgtcttgtgtgctgcagatgaaaaatggactcatggtgaagttgaagaagcgagaaatgtaacctttggtctctttttcttatctgcaattgtatcttgcgtgagtctttcgcgttcgggacctcagggtatttgtatgtgtactgttgtatgatttatttttctgtcaatataatgttatatgaataaaaatagagtgaggatttggtgtccactaggtgtggcgcccctcgatttaaaaaaaaaaaaaaaa

SEQ ID NO: 3806 - protein, 513 aa, Triticum aestivum
  misc_feature: PFam Name: p450; PFam Description: Cytochrome P450
  misc_feature: GI Number: 50943165; NR Description: putative cytochrome P450 [Oryza sativa (japonica cultivar-group)] >gi|37806345|dbj|BAC99858.1| putative cytochrome P450 [Oryza sativa
  misc_feature: GI Number: 34906256; NR Description: putative cytochrome P450 [Oryza sativa (japonica cultivar-group)] >gi|9081783|dbj|BAA99522.1| putative cytochrome P450 [Oryza sativa
  misc_feature: GI Number: 7270933; NR Description: cytochrome P450-like protein [Arabidopsis thaliana] >gi|5042165|emb|CAB44684.1| cytochrome P450-like protein [Arabidopsis thaliana] >gi|7430718|pir||T09365 cytochrome P450 homolog F23K16.120 -
  misc_feature: GI Number: 7270932; NR Description: cytochrome P450-like protein [Arabidopsis thaliana] >gi|5042164|emb|CAB44683.1| cytochrome P450-like protein [Arabidopsis thaliana] >gi|7430717|pir||T09364 cytochrome P450 homolog F23K16.110 -
  misc_feature: GI Number: 30692374; NR Description: cytochrome P450 family
MSISFSQELLISTLAIILLPLMLYLRSSRSKNPSVLPINWPIVGVFPYLIANFHNLHDYLAVVLAGSGHNFRAHGPPGTGLRFFITCEPANVRHIFTTNHANFPKGAEFAAIFDIAGGSFFTTEGEPWRRQRARAQRVLSNPRLLACMTACCRDKVENGLLPVLMHMASTGTTFDLQDLTIRLVLDMTATPLFGVDPGLLSSDMPPMDAAVAMDTVMEVALFRHIVPTSGWKVMRRLNIGPERKLAAAHTVLRGFIEEMMERRKRKEHAGNEGAPSVDILSSYIDDPDYQQNDGLLHATLINYMIAGRDTIGTALTWVFYNLAQNPHVVSFIRHELSPIASQKAATGANNSSTMVIFEPEETKSLVYMRAAIHESLRLHPPVPIERKTAVAHDVMPSGHVVHAGDTLLISLHSMGRMEGVWGKDCREYNPDRWLSEDGKKLRYVPSYNFLSFSSGPRLCLGKDVSFMQMNTIVAAMVWNFDVEVVEGQRVQPKMSCVLQMKNGLMVKLKKREM

SEQ ID NO: 3807 - DNA, 1601 bp, Triticum aestivum
  misc_feature (1)..(1601): Ceres cDNA ID no. 21665918
  misc_feature (1)..(1601): Ceres CLONE  ID no. 835484
  misc_feature (1)..(1601): Also known as  Ceres CDNA ID no. 24357059
cgatccccaaatcaaatcgctgcctgctgcttcctccacccaaccctaaccctaaccctagccgcgccgccaccatcgatccccaaatcccttctccctccaccaaaccctaatccaaagctagctagccgccatggcccgttccatggttctgctcgaccgcgagattgatttcaccccccacgatgaggcgctatccggccgacagttccggtggggattctgggaaggaagaggactacaaacccgcgaagccaggagtgatgaagtcatcaagtacctgcggaccttcaaggcccgcgcagtcgtcgacaatccgccggagctctccttcctccacatactggtgccgccgcaatccctcccgctcccgcctccattcatggacctggactcgggccgcatctccagcacggacaagaacctggtcgccctttacgccggcgggtaccgccctggctctagtttgtcgggaggctatctcatctacgacgccaggaaggactccctctccgtcatcccccgtctcccctccgacgacttgcatggagtcatggggcaccagtcggccgtcgtcatgtgcgacgcccaaggggagggctacgttcttgccgagctcatcaagaaaggattctcccaggccggggtctggctgtggaagtcgtccgccccacaaccagaatgggtctcgttacccgggagccatccccttccatccagcagattcaccgttgacttgtgcttctcttaccggggctctaccctttgctgggtggatctgctcaaaggcatgttcctctgtgatctcaaccaagactgcgacaacaagttcagctttatcaagctgccactagactgtccagccctggattgcaacttagaggagtccagctttatcaacaagttctgcacccgcccagaggagttccgttccatggcctgtgtttgtgaccacatcaagcttgtctccttggatgaatctggattggaactctcggtctggactctgttgactgatcactcagactggatcgaaacctccaagtacaatgttgataaaatctgggcaaacgtcaactatcagtctactgttttgagacagcttattccgtctcttcctgtcctgagcatccatgaagacggggttgtctacttggtcgtgaatgatgaaagcatcgtggaccatcgactagatcataaaggccagtatttgcttcgtgttgacatgaagagtaacgagatccagatctctccacagcctacaaggcgtatttgttaccaactctttgccagcgagttcagtgcgtaccgacagcatttacaggattgaccgagagatagaagcaagagagttcggtgcgagtggaaagacgttgaagatttgagatgttggcaacataacatgtggaactggtacttaaagtccactggagacatttactgttgtcattatctgatgttagtagttataaactgaatggtgggtagtatgtgttttcactcatggctttatgtctactgagtggcttgttttggatttgtaactggtaatggcttgtttatttttgtgactgctgattctggcaaaaaaaaaaaaaaaa

SEQ ID NO: 3808 - protein, 398 aa, Triticum aestivum
  misc_feature: GI Number: 34895356; NR Description: P0494A10.32 [Oryza
  misc_feature: GI Number: 34906218; NR Description: P0666G04.15 [Oryza sativa (japonica cultivar-group)] >gi|13122432|dbj|BAB32913.1|
  misc_feature: GI Number: 34895420; NR Description: P0445D12.20 [Oryza
MARSMVLLDREIDFTPHDEALSGRQFRWGFWEGRGLQTREARSDEVIKYLRTFKARAVVDNPPELSFLHILVPPQSLPLPPPFMDLDSGRISSTDKNLVALYAGGYRPGSSLSGGYLIYDARKDSLSVIPRLPSDDLHGVMGHQSAVVMCDAQGEGYVLAELIKKGFSQAGVWLWKSSAPQPEWVSLPGSHPLPSSRFTVDLCFSYRGSTLCWVDLLKGMFLCDLNQDCDNKFSFIKLPLDCPALDCNLEESSFINKFCTRPEEFRSMACVCDHIKLVSLDESGLELSVWTLLTDHSDWIETSKYNVDKIWANVNYQSTVLRQLIPSLPVLSIHEDGVVYLVVNDESIVDHRLDHKGQYLLRVDMKSNEIQISPQPTRRICYQLFASEFSAYRQHLQD

SEQ ID NO: 3809 - DNA, 1726 bp, Triticum aestivum
  misc_feature (1)..(1726): Ceres cDNA ID no. 21665919
  misc_feature (1)..(1726): Ceres CLONE  ID no. 835818
  misc_feature (1)..(1726): Also known as  Ceres CDNA ID no. 24361353
ccaaatccaatgctctacatttcttccttctcgtgccctttcttgatttgcgcatggacagtgacttgcgttgccagcaaagagccatcctgctaggccctttgccaacatctccgtagatcacattccagagcagatagacagaagaatggagaggaagaagaaggggtggttcgagcgcatcaagaggctcttcatctccgaacccaagcagaaacccaaaccagacaagaaggtgaagagcaagagatggctggtagggaagctcaagacccagcactcgtttgccctgccagctccggagccggagccggcgacgggtcagattcagataaggcaggcggaggaggagcagagcaagcacgcagtggcggtcgcgctcgcctccgcagcggccgcagaggcagccgtcgcggccgcccacgcggccgcggaggtggtccgcctcacaggaccgccctcgccggcgccggcgccggcgcgtgaggacgccgcgtcttccggccacgaactgttcgccgccgtcgcgatccagtcagcctaccgcggatacctcgcgcggagggcactgcgcgcgctcaagggcctggtgaggctgcaggcggtgatccgcgggcaggcggtgcggcggaagacggcggcgacgctgcggggcctcgagtcgctggtcaagatccaggcccggcagcgcgccagggccgacgtcgaccacgagcacgacggcgacggcatggacgccctgctgaggagaggccgggagctgtacgccgccgcgctgcaagagcagcagcagagcagccgggggtgggacggcagcaccctctccaaggaagagatgggcgccgtgatgaggagcagggaggaagccgccatcaagcgcgtgcgcgcgctgcagtacgcctccatccagaacgagaagatcggcatcaggaggcagcccatgtccagggacgagatggagacgctcaaccagcgctggagctggctggaggagtgggtcggctcgcagcccttcgacaaggacgtggccgtcgacgtggtcacccacccccacccgccgccgcctcgctccagggactccctcgcctgcctcgaggacgacgacgaccatgatgacgacggctatggcaggcggctcggctactcgtccaggcggtccttcggccgcgccaggcgcacgccagggagggggagcgtcgacgacgggctgcaggcctgctcgccggcggtggctttcccggggtacatggcgtccacggcgtccgccaaggccaagttccggtccatgagcacgcccaaggagcgcttcgccgtgccatccgacgcatactcggagcagtgcttcgccgaccgcctcatgtcacccatcccgtccatgtcgccgatgccgtccatcgccagcgacatgggttttgctcgctccagcaggccgccggttgcgcagcggtcgccgcgtgtcaagggggggccgatgacgccgtcgaggatccgctccaggaggtcccccagccgccacagcttcggctctgaagccgcgctgcaccagatgcagatggagcactacacccctattcgctagacacaaacaaacttctttgtaatgtgaccaatgctgccttgtttggcgggcttgctctctctgggtctgaccatggaaaccttctcaaactgaccgtgctgtgcgaatgcaatatggatctgcaaactttcaaaaaaaaaaaaaaaa

SEQ ID NO: 3810 - protein, 476 aa, Triticum aestivum
  misc_feature: GI Number: 50940489; NR Description: calmodulin-binding protein family-like [Oryza sativa (japonica cultivar-group)] >gi|42409298|dbj|BAD10560.1| calmodulin-binding protein family-like
  misc_feature: GI Number: 21594016; NR Description: unknown [Arabidopsis thaliana]
  misc_feature: GI Number: 23308403; NR Description: At3g49260/F2K15_120 [Arabidopsis thaliana] >gi|21593446|gb|AAM65413.1| SF16-like protein [Arabidopsis thaliana] >gi|13605619|gb|AAK32803.1| AT3g49260/F2K15_120 [Arabidopsis thaliana]
  misc_feature: GI Number: 6723396; NR Description: SF16-like protein [Arabidopsis thaliana] >gi|11358844|pir||T45831 SF16-like protein -
  misc_feature: GI Number: 34908016; NR Description: P0460C04.18 [Oryza sativa (japonica cultivar-group)] >gi|20805259|dbj|BAB92925.1|
MERKKKGWFERIKRLFISEPKQKPKPDKKVKSKRWLVGKLKTQHSFALPAPEPEPATGQIQIRQAEEEQSKHAVAVALASAAAAEAAVAAAHAAAEVVRLTGPPSPAPAPAREDAASSGHELFAAVAIQSAYRGYLARRALRALKGLVRLQAVIRGQAVRRKTAATLRGLESLVKIQARQRARADVDHEHDGDGMDALLRRGRELYAAALQEQQQSSRGWDGSTLSKEEMGAVMRSREEAAIKRVRALQYASIQNEKIGIRRQPMSRDEMETLNQRWSWLEEWVGSQPFDKDVAVDVVTHPHPPPPRSRDSLACLEDDDDHDDDGYGRRLGYSSRRSFGRARRTPGRGSVDDGLQACSPAVAFPGYMASTASAKAKFRSMSTPKERFAVPSDAYSEQCFADRLMSPIPSMSPMPSIASDMGFARSSRPPVAQRSPRVKGGPMTPSRIRSRRSPSRHSFGSEAALHQMQMEHYTPIR

SEQ ID NO: 3811 - DNA, 1290 bp, Triticum aestivum
  misc_feature (1)..(1290): Ceres cDNA ID no. 21665920
  misc_feature (1)..(1290): Ceres CLONE  ID no. 835899
  misc_feature (1)..(1290): Also known as  Ceres CDNA ID no. 24356993
ataaccagcgccgctccttttcggatcccccgcagaaaagtgggtgaaaaagagcaacggaggaacaatccaagaccctcttctccgccgcgcctgccacccgctgaggcccgcctatcggcccaaatggcctcacccccttccccgcccccgccctcgccgccgccgcgggccgacgagccacgcagcggcgggggcagggcgccgatcccgccctacgtcaaggcggcggcggggtcgctcggcggcgtgatggaggcgtgctgcctgcagcccatcgacgtggtcaagacgaggctgcagctggaccgcgcgggggcctaccgcggcatcgcgcactgcggcaccaccgtcgcgcgcgccgagggcgtgccggcgctctggaagggcctcacgcccttcgccacccacctcacgctcaagtacgcgctccgcctcggctccaatgccatgctgcagtccgccttcaaggaccccgtcaccggcaaggtctccgcgcagggccgcctcgcctccggcttcggtgccggcgtcctcgaggccctcgtcatcgttaccccattcgaggtggtaaagattagattgcagcaacaaaaaggactaagcacggacctgctgaaatataaagggcccatacactgtgcaaagacaattgttcgtgaggaaggcatttttggtctgtggtctggagcatcaccaactgtcatgcgcaacggcacaaaccaagctgcgatgttcacagccaagaacacgatagacatccttctctggaagaagcatgaaggggacgggaaggttctccagccatggcagtccatggtctccgggttccttgcaggaaccgcagggccgatctgcaccgggcctttcgacgtggtgaagaccaggctgatggcccaagggaggaccggcgacatcaagtacaagggcatgttccacgcgatacggacgatacacgcggaagagggcctccgggccctgtggaagggcctgcttcccaggctgatgaggattccacctggccaggccataatgtggacagtggctgatcaggtgatgggcctctatgagcgaacatatctgcagtcgtctcaggtgtaacccgccgcctgctttcgaagctgctgcgccgaattgattggttagtcggcgccattttgggttgcctggaatcctggatattcatttgttcattgcttgagagactggtattggtcggagcaatgagcccatgtactttagtagtccacaaaataatgattaaacccccttccaaaaaaaaaaaaaaaa

SEQ ID NO: 3812 - protein, 324 aa, Triticum aestivum
  misc_feature: PFam Name: Mito_carr; PFam Description: Mitochondrial
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: GI Number: 21593290; NR Description: unknown [Arabidopsis thaliana]
  misc_feature: GI Number: 396595; NR Description: ACR1-protein
  misc_feature: GI Number: 46443947; NR Description: potential mitochondrial succinate-fumarate transporter [Candida albicans SC5314] >gi|46443782|gb|EAL03061.1| potential mitochondrial
  misc_feature: GI Number: 57227192; NR Description: succinate:fumarate antiporter, putative [Cryptococcus neoformans var. neoformans JEC21] gi|58267604|ref|XP_570958.1| succinate:fumarate antiporter,
  misc_feature: GI Number: 6322555; NR Description: Mitochondrial succinate-fumarate transporter, transports succinate into and fumarate out of the mitochondrion; required for ethanol and acetate utilization; Sfc1p [Saccharomyces cerevisiae]
MASPPSPPPPSPPPRADEPRSGGGRAPIPPYVKAAAGSLGGVMEACCLQPIDVVKTRLQLDRAGAYRGIAHCGTTVARAEGVPALWKGLTPFATHLTLKYALRLGSNAMLQSAFKDPVTGKVSAQGRLASGFGAGVLEALVIVTPFEVVKIRLQQQKGLSTDLLKYKGPIHCAKTIVREEGIFGLWSGASPTVMRNGTNQAAMFTAKNTIDILLWKKHEGDGKVLQPWQSMVSGFLAGTAGPICTGPFDVVKTRLMAQGRTGDIKYKGMFHAIRTIHAEEGLRALWKGLLPRLMRIPPGQAIMWTVADQVMGLYERTYLQSSQV

SEQ ID NO: 3813 - DNA, 2270 bp, Triticum aestivum
  misc_feature (1)..(2270): Ceres cDNA ID no. 21665921
  misc_feature (1)..(2270): Ceres CLONE  ID no. 835914
  misc_feature (1)..(2270): Also known as  Ceres CDNA ID no. 24361357
aaaacccccctccgccattcctccaattttccattttcgatattcatgctgcaatggtgcgtgagctccgcgccgactccttctacgcccgcctccgcgccgccgccgccgccgcggcagcggtttcctccgcctccgcctcccctctcctgatcctcccgtccgcggccgacgccgactcactctgcgcgctcaggatcctcgcccacgtcctctccgccgactccgtccgcttttccgtctaccccgtcgcctccaccgccgatgccgccgaactcctcgcctccttctcgggcgccactgcgtcctcacccctgtcgccgccgccgctctgcgtattacttatcaactggggcgcgcgctccgacctcctccgcggcatcctgccgcgcggctccaccgccttcgtcgtggattcgcaccgccccgtgaacctccgcaacctcgccgcggggaacgaccgcgtcatcgtgctcttcaccgctgatgacgagcgcgccgccgacctgtcgtatgacttcgacgcgtcctcccttgccgacgcctccgacctaacggccgagggggacgcggacgacgaccacctccgcgcctccgaggaggaggagtcagatacctcggattacgattccggcgccgagggcgggaggaggaagagacggtgggcgtccgatgacgcggaggcggacggtgacgatccggtgaggctgttcgggaggctgcggcgggagtactaccggctcggcaccttccacgggaagccgtcggggtgcctcatgtacgacctcgcccacaagctgcgcaggaacaccaacgagctcctctggcttgcctgcgtctccctcaccgaccagttcgtccacgagcgcatcaccaacgagcgctaccaggacgcgggcatggagctcgagcagcacatcaacggatccggcaacctcgatccgtccggcgtcggctccgtggtcaccctcaaggacgggaccaggatccgtgcgcccgagacctcccgcatcgcctacgaggacgagccgaggcttatgctgctgcgggagtggaccttgttcgactccatggtctgctcctcttatgtcgcgacgaggctcaagacgtggagcgacaacgggctcaagaagctgaagcttcttctggcgaggatggggttcccgctcgccgactgccagaaggggttccagtacatgagcatggaggtcaagaggaagatgcgcgatgagtttgaccgcttcctgccggagtatgggctcaccgagttctactacagaagcttcctgcgggtgcacgggtacaagtccaaggtctctgctgcggatgttgtgtatggcgtcacagctttgcttgaatgtatgagtgccgagtccaacgattcgaaggagtgttctgctgctgagcaattctgggttgcatactctgcgctgtctccgagcaatgtggatcagctgcaaaaaggaatgcaatctgcaattgagatacagagggctatattgaggcaagggagctcggcaatcaccaagagcggcttcatacggagtgcaaagaagttcaggtgggtgaagctcgatgacccagtggacacgagcaagctgtgccaccctcaggcgcttaccaagttctgcttcttcctgatggatgcactgaaggaacggggtgcaaggacgaagccactggtgtgtgcttgcttagggagggagcctgagaaggtgctggtagttggggtatgggggaagcccaggcttggggcagttcaggggaattcgttcggtaatgcatttaggtcagcggcaggggagattggcgcagactatttccatgacatgtttgagtcatcatggattgttcttgacgttgttgctgtcagttctttcatgattcggttaacggagaagctgtaatgatggcatgcgctgtctatgctagttatccttttagtcccaaaacaagaagggacttgaggcttgattctgcctccaaatataggagcttcagtcctggcggtacatgacatgtattctctccttatccacctgaactttttcatgatcatgttttgcagcgagaaaggaggttttcccactgtttagccaattcaattagcaaatgatagatcaataaaattcagatgcaaaccttgtcacaatatggagatggacaaggtatatggtactgttgacctgatagtgtaccttgtatctgtgcttgcataagtacgtgccttctgattatagaaaagtgtcgtctccaaaaaaaaaaaaaaa

SEQ ID NO: 3814 - protein, 617 aa, Triticum aestivum
  misc_feature: PFam Name: CDC45; PFam Description: CDC45-like protein
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: LMBR1; PFam Description: LMBR1-like membrane protein
  misc_feature: GI Number: 40641826; NR Description: putative cell division cyle protein 45 [Arabidopsis thaliana] >gi|9294166|dbj|BAB02068.1| CDC45 (cell division cycle 45) -like protein [Arabidopsis thaliana]
  misc_feature: GI Number: 57226990; NR Description: cell division control protein 45, putative [Cryptococcus neoformans var. neoformans JEC21] gi|58267200|ref|XP_570756.1| cell division control protein
  misc_feature: GI Number: 19115605; NR Description: cdc45 related protein [Schizosaccharomyces pombe] >gi|26391978|sp|O74113|CC45_SCHPO Cell division control protein 45 homolog (Suppressor of nda4 protein)
  misc_feature: GI Number: 47087075; NR Description: zgc:56264 [Danio rerio]
  misc_feature: GI Number: 34870038; NR Description: similar to CDC45L
MVRELRADSFYARLRAAAAAAAAVSSASASPLLILPSAADADSLCALRILAHVLSADSVRFSVYPVASTADAAELLASFSGATASSPLSPPPLCVLLINWGARSDLLRGILPRGSTAFVVDSHRPVNLRNLAAGNDRVIVLFTADDERAADLSYDFDASSLADASDLTAEGDADDDHLRASEEEESDTSDYDSGAEGGRRKRRWASDDAEADGDDPVRLFGRLRREYYRLGTFHGKPSGCLMYDLAHKLRRNTNELLWLACVSLTDQFVHERITNERYQDAGMELEQHINGSGNLDPSGVGSVVTLKDGTRIRAPETSRIAYEDEPRLMLLREWTLFDSMVCSSYVATRLKTWSDNGLKKLKLLLARMGFPLADCQKGFQYMSMEVKRKMRDEFDRFLPEYGLTEFYYRSFLRVHGYKSKVSAADVVYGVTALLECMSAESNDSKECSAAEQFWVAYSALSPSNVDQLQKGMQSAIEIQRAILRQGSSAITKSGFIRSAKKFRWVKLDDPVDTSKLCHPQALTKFCFFLMDALKERGARTKPLVCACLGREPEKVLVVGVWGKPRLGAVQGNSFGNAFRSAAGEIGADYFHDMFESSWIVLDVVAVSSFMIRLTEKL

SEQ ID NO: 3815 - DNA, 1840 bp, Triticum aestivum
  misc_feature (1)..(1840): Ceres cDNA ID no. 21665923
  misc_feature (1)..(1840): Ceres CLONE  ID no. 837643
  misc_feature (1)..(1840): Also known as  Ceres CDNA ID no. 24356958
atcacccccaccaagccggctgcctctctgctgcgaacaggcggattaaccagccagaggcccggcacaaacacttggcgcggcagacgagcccgggcagccatggccatctgctactgctcggagccggcgcaatgcctccaccgggccctgctcgcgccggagaggccgtaccccaggctgcaggaccgcaagaggaccaaggtgcccgccggcgacggccttctggccgaggtggcctccatcctctgcctcacggcgccgattgtcggcgcggggatcctcctctacctgcgctccctcgtgtccatggtgtttcttggccgcctcggccagctcccgctcgccggcggctccctcgcgctcggcttcgccaacatcaccggctactccgtgctctccggcctcgccggcggcatggaccccgtctgcggccaggccttcggcgccggccggacggacctcctccgcgcggcgctccgccgcaccgtcgtgctgctcctgctcgcgtccgtccccatcagcgtgctctgggtcgccatgcaccgcgtcctcgtcgccacgggccaggacccggacatcgcctccacggcgtacgcctacatcctctgctccctccccgacctcgtcgtgcagtcattcctccacccgctccgcatttacctccgcgcgcagtccgtcacgctcccactcacctatgcggcggcggcggccgtgctcctccacgtgcccatcaacttcgtcctcgtggacgtcctcggtctcggcatccgcggcgtcgcgctcggcgccgtctgcaccaacctgaatttcctgctgttcatcgtggcgtacgtgtgcttcttcggaatgtacggccacgacgagggcgagacgaaagcgtccgtgacggcggccgaggaggagggcgccaaggagtggtggagcttggtgaggttgtccgtgcacagctgcatgtcggtctgcttggagtggtggtggtacgagatcatggtgctcctctgcggcgtgctcgctgacccaaaggcggcggtggcggccatgggggtgctgatccagaccacgtcgctcatatacatcttcccgcactccctcggctgcgcggtgtccacgcgcgtcggccacgagctcggcgcccgccggccagagcgtgcgcgcctcgtggcgcgcgtcgggctcggtctgggcgcggtgctaggcgtcgtggcatgcgcattcgcggtgtccgtgcggggcgtgtgggcgcggatgttcaccgcggacgatgccatcctgcggctcacggccgcggcgctgccgctgctgggcttggcggagctgggcaattgcccgcagacgacggggtgcggcgtgctgcgcggcagcgcgcgccccgacaaggcggcgaggatcaacgtctcggcgttctacggcgtgggcatgcccgtggcgctgctgctggcattccggccagggcggctggacttccgcgggatgtggggcggcatgctggccgcgcagctggtgtgcgccgcgctgatgctgcgcgccgtggtggcgacggactgggaggagcagacggaacgcgcgcgcgagctcaccggcggcaatgccggcgaagctgtggacggtggcaagagaaagcatgcagaagcggccaaagcagatgccgacaactcatcgctcgtgctggccgactgtgtgtagcggacgacgggcatcgattcttggatcatttgaatcctcgattgattcttttagctataggaaaatttttctctctagttttgtaatttactcaactttttggggggattccaggcaatgacaagctgcgatctccttaaaaaaaaaaaaaaaa

SEQ ID NO: 3816 - protein, 527 aa, Triticum aestivum
  misc_feature: PFam Name: MatE; PFam Description: MatE
  misc_feature: PFam Name: Pkinase; PFam Description: Protein kinase domain
  misc_feature: PFam Name: Avirulence; PFam Description: Xanthomonas
  misc_feature: PFam Name: FH2; PFam Description: Formin Homology 2 Domain
  misc_feature: PFam Name: Pyr_redox_2; PFam Description: Pyridine
  misc_feature: GI Number: 52076031; NR Description: ethionine resistance
  misc_feature: GI Number: 50253264; NR Description: membrane protein-like
  misc_feature: GI Number: 37536202; NR Description: putative membrane protein [Oryza sativa (japonica cultivar-group)] >gi|27311284|gb|AAO00710.1| putative membrane protein [Oryza sativa (japonica cultivar-group)] >gi|31433137|gb|AAP54690.1|
  misc_feature: GI Number: 50948199; NR Description: putative ripening regulated protein DDTFR18 [Oryza sativa (japonica cultivar-group)] >gi|42408089|dbj|BAD09230.1| putative ripening regulated protein
  misc_feature: GI Number: 15241158; NR Description: MATE efflux
MAICYCSEPAQCLHRALLAPERPYPRLQDRKRTKVPAGDGLLAEVASILCLTAPIVGAGILLYLRSLVSMVFLGRLGQLPLAGGSLALGFANITGYSVLSGLAGGMDPVCGQAFGAGRTDLLRAALRRTVVLLLLASVPISVLWVAMHRVLVATGQDPDIASTAYAYILCSLPDLVVQSFLHPLRIYLRAQSVTLPLTYAAAAAVLLHVPINFVLVDVLGLGIRGVALGAVCTNLNFLLFIVAYVCFFGMYGHDEGETKASVTAAEEEGAKEWWSLVRLSVHSCMSVCLEWWWYEIMVLLCGVLADPKAAVAAMGVLIQTTSLIYIFPHSLGCAVSTRVGHELGARRPERARLVARVGLGLGAVLGVVACAFAVSVRGVWARMFTADDAILRLTAAALPLLGLAELGNCPQTTGCGVLRGSARPDKAARINVSAFYGVGMPVALLLAFRPGRLDFRGMWGGMLAAQLVCAALMLRAVVATDWEEQTERARELTGGNAGEAVDGGKRKHAEAAKADADNSSLVLADCV

SEQ ID NO: 3817 - DNA, 1346 bp, Triticum aestivum
  misc_feature (1)..(1346): Ceres cDNA ID no. 21665925
  misc_feature (1)..(1346): Ceres CLONE  ID no. 842526
  misc_feature (1)..(1346): Also known as  Ceres CDNA ID no. 24360324
ttttctttcttcccagttcctcttctcttctcttaccgccgccgccgccggaggagtgagcagcagcgtgagtcgtcggcggggacggaggggccggagatggggttcgagtcgtcggcggagacggagcggttcctgtgcgagcggctgctggacgcggcgcagcccatcgcggagcgcttccgcgcgctcttctccctccgcaacctccgcggcgacggcccccgccgcgccctcctccaagctgcaagggatccttccaacttgcttgcacatgaggctgcatttgcacttggacaaatgcaggacgctgaggctatccctgcattagagggagttctcaaggatctttcactgcatccaattgtccgccatgaggctgctgaagcccttggagctattggcttggaaaagagcatttccctgttaaaagagagtttagtagctgatcctgccgtggaggtgcaagaaacgtgtgagttggctcttagacggatagaagggcagaagaatgctagtggcgctgaaagcacaacaatttcgccttatctatcagttgatccagcactgcctgccaagcaaggactctcagtagaacaactaagggagcttctcctcaatgagcaagaaaagatgtatgaacgttatgcagctctttttgcgcttaggaatgatggcggagattatgctgtttctgctatcattgaatctctaggtgtgaaaagtgctcttctgcgccacgaggtcgcttatgtgttaggtcagctgcagaacaaagcagcttcagatgcactttctggtgttctccagaatgttgatgagcacccaatggtcaggcatgaagctgccgaggcccttggttcgattgcagatcaagaaagcattgcacttctagagcaattcgccaaggaccccgagcccatcgtctcccagagctgtgaggtagctctcagcatgcttgagtacgaaaggtcggggaagtcattcgagttcctgttcctacagactcctcaggtacagcaggagtcctgagctcagccaggtccaggacaagaagggtgattgcccaggccccggggaaaatataggcctaatatcattagattctgatatgcgtatgggctaaatatacacattgacttagcatgcatctgtaatctcaagttggcctccacacggattgtattcgactggcgagtactgtagaattttggtcttgtgtttgatattactgcttgcatgatgcatggcatgcagttgtattcgatgaggcgcaaagaacacactgagcagggggttcgatatgaaaggcttcccttttattgcttcgaaaaaaaaaaaaaaaa

SEQ ID NO: 3818 - protein, 1346 aa, Triticum aestivum
  misc_feature: PFam Name: HEAT_PBS; PFam Description: PBS lyase HEAT-like repeat
  misc_feature: GI Number: 22655416; NR Description: At3g58180/F9D24_90 [Arabidopsis thaliana] >gi|13926240|gb|AAK49594.1| AT3g58180/F9D24_90 [Arabidopsis thaliana] >gi|18410896|ref|NP_567062.1| PBS lyase HEAT-like
  misc_feature: GI Number: 19527182; NR Description: RIKEN cDNA 1110033C18 [Mus musculus] >gi|12805629|gb|AAH02295.1| RIKEN cDNA 1110033C18
  misc_feature: GI Number: 51593692; NR Description: MGC85454 protein
  misc_feature: GI Number: 66499923; NR Description: PREDICTED: similar to
  misc_feature: GI Number: 31240985; NR Description: ENSANGP00000017698 [Anopheles gambiae] >gi|30173519|gb|EAA00938.2| ENSANGP00000017698
TTTTCTTTCTTCCCAGTTCCTCTTCTCTTCTCTTACCGCCGCCGCCGCCGGAGGAGTGAGCAGCAGCGTGAGTCGTCGGCGGGGACGGAGGGGCCGGAGATGGGGTTCGAGTCGTCGGCGGAGACGGAGCGGTTCCTGTGCGAGCGGCTGCTGGACGCGGCGCAGCCCATCGCGGAGCGCTTCCGCGCGCTCTTCTCCCTCCGCAACCTCCGCGGCGACGGCCCCCGCCGCGCCCTCCTCCAAGCTGCAAGGGATCCTTCCAACTTGCTTGCACATGAGGCTGCATTTGCACTTGGACAAATGCAGGACGCTGAGGCTATCCCTGCATTAGAGGGAGTTCTCAAGGATCTTTCACTGCATCCAATTGTCCGCCATGAGGCTGCTGAAGCCCTTGGAGCTATTGGCTTGGAAAAGAGCATTTCCCTGTTAAAAGAGAGTTTAGTAGCTGATCCTGCCGTGGAGGTGCAAGAAACGTGTGAGTTGGCTCTTAGACGGATAGAAGGGCAGAAGAATGCTAGTGGCGCTGAAAGCACAACAATTTCGCCTTATCTATCAGTTGATCCAGCACTGCCTGCCAAGCAAGGACTCTCAGTAGAACAACTAAGGGAGCTTCTCCTCAATGAGCAAGAAAAGATGTATGAACGTTATGCAGCTCTTTTTGCGCTTAGGAATGATGGCGGAGATTATGCTGTTTCTGCTATCATTGAATCTCTAGGTGTGAAAAGTGCTCTTCTGCGCCACGAGGTCGCTTATGTGTTAGGTCAGCTGCAGAACAAAGCAGCTTCAGATGCACTTTCTGGTGTTCTCCAGAATGTTGATGAGCACCCAATGGTCAGGCATGAAGCTGCCGAGGCCCTTGGTTCGATTGCAGATCAAGAAAGCATTGCACTTCTAGAGCAATTCGCCAAGGACCCCGAGCCCATCGTCTCCCAGAGCTGTGAGGTAGCTCTCAGCATGCTTGAGTACGAAAGGTCGGGGAAGTCATTCGAGTTCCTGTTCCTACAGACTCCTCAGGTACAGCAGGAGTCCTGAGCTCAGCCAGGTCCAGGACAAGAAGGGTGATTGCCCAGGCCCCGGGGAAAATATAGGCCTAATATCATTAGATTCTGATATGCGTATGGGCTAAATATACACATTGACTTAGCATGCATCTGTAATCTCAAGTTGGCCTCCACACGGATTGTATTCGACTGGCGAGTACTGTAGAATTTTGGTCTTGTGTTTGATATTACTGCTTGCATGATGCATGGCATGCAGTTGTATTCGATGAGGCGCAAAGAACACACTGAGCAGGGGGTTCGATATGAAAGGCTTCCCTTTTATTGCTTCGAAAAAAAAAAAAAAAA

SEQ ID NO: 3819 - DNA, 1170 bp, Triticum aestivum
  misc_feature (1)..(1170): Ceres cDNA ID no. 21665926
  misc_feature (1)..(1170): Ceres CLONE  ID no. 843086
  misc_feature (1)..(1170): Also known as  Ceres CDNA ID no. 23725975
gctcccgttgatttcttggcagcgtccgtccgcagctagaaaccaaagcacactcgtcttcttccttccccattctgtcagctactcttcttcctcctcctcctcctcacatggacgcgtcatcgtcggaggaccgtcagtcgccacgcagcaggcagctgcagctgcagggcccgcgccccccgcggctgtccgtcagcaaggactcccacaaggtcaggaagccgcccgtcgtgccgctgccctacggagcccggcagcaagcccccaacaaccgccaccagcaagctcagccgcgggcgccggtcatcatctacgacgcctcgcccaaggtcatccacacccagcccggcgagttcctggcgctcgtccagcgcctcaccggcccgggcgcgccggctcagtactccgccgaggaggcggcggggtcctctgccatgccgccgcagttccagccgcaggaactgcctttctcgccggcggcgaggtacgccgcgatcgagaggtccgtccggccgctgccgcctgggcccgcgccgtacgccgccggctcctggctggacctggatggcttcgcggaggtcctcggcccgggacggcccgggatcctctcgcccgtgccgtcagcgctgccggcggcggcctcggcggggctgttctcgccgctgccgttcgacaccagctccctgtcctggctcaacgacctgagcccgttcctcgcctccgccggcgcccgcgacgcgccgcccttcgcctcgagccctggcggcctgctgcttgccacgcccaccgtgccctcgccggggatgatgatgcggttcttcagcgactttccggacctgtaaattaacctgatttgatttgatttgtttttttctgcgtccgggtttaaatggctgccggaggaccagggagtaggtgtgctagtgagcttcgtctctgggtagttggctaatcaatcagaaaaaaaatactactcctcctgattgagtattaagttgagtagatagacatcgctcctgttaattgtttgacattgtcaactgattgagtagtgtaggtttgtgttaaccttgtttcaagattattgactcttgggagccaaccacctttggtgggtggttctttcaattaattctgattgtgttacttgcaaaaaaaaaaaaaaaa

SEQ ID NO: 3820 - protein, 244 aa, Triticum aestivum
  misc_feature: PFam Name: Caudal_act; PFam Description: Caudal like protein
  misc_feature: PFam Name: Pyr_redox_2; PFam Description: Pyridine
  misc_feature: GI Number: 21536582; NR Description: unknown [Arabidopsis thaliana]
  misc_feature: GI Number: 51451549; NR Description: optomotor blind
  misc_feature: GI Number: 51451463; NR Description: optomotor blind
  misc_feature: GI Number: 51451551; NR Description: optomotor blind
  misc_feature: GI Number: 51451603; NR Description: optomotor blind
MDASSSEDRQSPRSRQLQLQGPRPPRLSVSKDSHKVRKPPVVPLPYGARQQAPNNRHQQAQPRAPVIIYDASPKVIHTQPGEFLALVQRLTGPGAPAQYSAEEAAGSSAMPPQFQPQELPFSPAARYAAIERSVRPLPPGPAPYAAGSWLDLDGFAEVLGPGRPGILSPVPSALPAAASAGLFSPLPFDTSSLSWLNDLSPFLASAGARDAPPFASSPGGLLLATPTVPSPGMMMRFFSDFPDL

SEQ ID NO: 3821 - DNA, 1670 bp, Triticum aestivum
  misc_feature (1)..(1670): Ceres cDNA ID no. 21665927
  misc_feature (1)..(1670): Ceres CLONE  ID no. 847328
  misc_feature (1)..(1670): Also known as  Ceres CDNA ID no. 23561406
ccagtttcccctcctccaaacccttcaccgctctcggcgccgactgccgattcctcagtttcccctccccaaacccttcaccgctctcgtctcctcagttccgccgccgccgccatggcttcgtccccctgcgacatcgccctcaaggcagccctcggcggccaactccgcctcctcaagagaatggccaagaaggtggatctccggcgagccaaggacgataaagggcaaaccgcacttcatttcgctgcggccaaggggtgcctggacagctgcaagttcctggtggaggaatcagggcttgatgtcgattccgccacgaaaacagatgtgacaccgatgttctacgccgcatttgggggaaatgtcgaggttatgaggtaccttctcgaccgcggcgcagacccatccacggccgatgacaggggctctgtgtcattgcacaatgcagcagaggaaggacactgcgaggctgtgaggctattgctgttgaaaggggttcatgtggatcctatggatcatcggggcacaccattacacttggcggttgcaaaggaccatgttgaggttgtgaaggttctgctggagcatggtgctaatcccaacagagtggctaatcacgtcttttcaccactcatgatggccgtctgtggaaaggccttgaaatgcatgaagctactgattgaggctggcgctgatgtgaatgttcatggttactctggaccaactcctttaacggaggcagttgatgatggcttaatggactttgtcatgattttactagaggctggagccgacgctaacatccctaaccagcatggcgcagttccaattgagctagcagcagctcgtggtcaacgtgagcttgttgaaattctgtttcctaagacaaaacccattccatctcagccagtttggagcgttaatgggataatgaatactgcaagatcaccacgtatcaagcatcaggacgcatcttctgtggaacaacggatagctgatttgaagtcacgaggaaaggaagcatttggaaaggaagactatattacagcgatgtacttctatggcctggtaatggatatagacccacttgatgccaccatgtttgctaaccggagcctctgctggctgcggatgcgagaaggggacagagctttggaagatgcacggcaatgcataatgatgcggccccattggtccaaggcatggtaccgtgagggcaaagctctcagtttcatgaagacgcgttcctgaaagcacaggaactggaccctaagagtgacgagatcaccaaagctctgagggaggctgtcagtgcgatggaggagctgcgcgtgtgatataagcagctgccagtgccgggtcgctcggagaggaggaagaagagaacgagacgggctggctttgattcattctcccatctctgtatcgaccctgctgtattttccttgcaccagatgctaccctagtagtagtactacactaggtattactgctcgtgtgtcagaaggtgttgcagctggctagctaaccagtccccaagctgtgctggatcaggggtctcgattttggtaggctacggcgatgttttgtgacagacggcatatgcctgatggtgtgctctgcaatgatatggtcgttaccgtttcttttcaaaaaaaaaaaaaaaa

SEQ ID NO: 3822 - protein, 379 aa, Triticum aestivum
  misc_feature: PFam Name: TPR_1; PFam Description: Tetratricopeptide repeat
  misc_feature: PFam Name: TPR_2; PFam Description: Tetratricopeptide repeat
  misc_feature: GI Number: 50908589; NR Description: putative ankyrin-like protein [Oryza sativa (japonica cultivar-group)] >gi|47848270|dbj|BAD22094.1| putative ankyrin-like protein [Oryza
  misc_feature: GI Number: 27542766; NR Description: ankyrin-like
  misc_feature: GI Number: 50898666; NR Description: ankyrin repeat protein E4_8-like [Oryza sativa (japonica cultivar-group)] >gi|47497788|dbj|BAD19887.1| ankyrin repeat protein E4_8-like
  misc_feature: GI Number: 50898646; NR Description: ankyrin repeat protein-like [Oryza sativa (japonica cultivar-group)] >gi|47496993|dbj|BAD20103.1| ankyrin repeat protein-like [Oryza
  misc_feature: GI Number: 6175185; NR Description: ankyrin-like protein [Arabidopsis thaliana] >gi|23197986|gb|AAN15520.1| ankyrin-like protein [Arabidopsis thaliana] >gi|22531046|gb|AAM97027.1| ankyrin-like protein [Arabidopsis thaliana]
MASSPCDIALKAALGGQLRLLKRMAKKVDLRRAKDDKGQTALHFAAAKGCLDSCKFLVEESGLDVDSATKTDVTPMFYAAFGGNVEVMRYLLDRGADPSTADDRGSVSLHNAAEEGHCEAVRLLLLKGVHVDPMDHRGTPLHLAVAKDHVEVVKVLLEHGANPNRVANHVFSPLMMAVCGKALKCMKLLIEAGADVNVHGYSGPTPLTEAVDDGLMDFVMILLEAGADANIPNQHGAVPIELAAARGQRELVEILFPKTKPIPSQPVWSVNGIMNTARSPRIKHQDASSVEQRIADLKSRGKEAFGKEDYITAMYFYGLVMDIDPLDATMFANRSLCWLRMREGDRALEDARQCIMMRPHWSKAWYREGKALSFMKTRS

SEQ ID NO: 3823 - DNA, 2410 bp, Triticum aestivum
  misc_feature (1)..(2410): Ceres cDNA ID no. 21665928
  misc_feature (1)..(2410): Ceres CLONE  ID no. 847412
  misc_feature (1)..(2410): Also known as  Ceres CDNA ID no. 23390843
ctatcctttcatttgctccctctgattccattccatgacgcactgactggattggatgctgcctgccggatctatccccacctcagagcacagctcaccggacaagaggaatccctccttcctcagctccgatttgcaacctaccttccttccttccggcgagccgccatgcctccagtccagcctgtccaatccccccgacctagatagatagacagacacaaggagagctctgctctacgcaacccatggcggccaaggcgccggccccttccgcgcgctcccgggccctcgcctccgcctccgcgcccgcgccggcctcctccaggcgccccaatgccactcccgcagcagacaccgccgcgccatccacctccgccaccacctccccaccgccatcctccccgccgtccgccccgcctccaaagctcgccgcctccccaccgcccgcctcgccgccaccgacgccgcccgccgcactccccactccaaagcccgcgccttccacttccacgccgcctccaaccaccacaagcccacctgctccgccccccaagcgctcccccgccgcagcaccgccgccgacggctcctgcgccaagacccacgccgcccgctccagctccaagaaccgcgccgacctcccagtccccggcggcctcgccccccgcccacgccgcgccgcacgccaagccatcgccgcctcccgcggccggccaccacccgcagctgccgacgccggccaccgccgtcgacccggccaaccagcacggcaggagccccaacaagtcctccacgcagtccgccggcgagcggggccgcaaggcctccccctcgccgggcagcagcaacggggggggccagcaacggcgtcgtcatcgccgtcggcgccgtgctcgccttcctcgtggtcaccctcatagccgccgccgttctctacaccaagaagcgccggagggggcgggacgactaccgcgccggcttccggtcgccgccttactcttcagagctaccaccgtcagttccttcgggcggcggctcggcgaacgcggcaatgtcgtcgtcggccgacccctccgtccacaccaactacagcgccggcagcccgaggctgaaagcgtgcgtgtccgacatgagcgtcggcaactcgcgcttcttcacttaccaggaaatgtaccagatcaccgacggtttctcgccgcgcaatttgctcggcgagggagggttcgggtctgtgtacaagggccggctgcccgaagggaaagacgtggctgtcaagcagctgagggacggcagcgggcaaggcgaacgcgagttccaggctgaggtggagatcattagccgcgtgcatcaccggcatttggtgtctctcgtggggtactgcattgccaatagccagaggctgctcgtctacgatttcgtgtccaatgacaccctgcattatcaccttcacggacagggaaggcctgttttagagtggtcggctagggttaaaatcgccgccggcgctgctcgtggaatagcatacctacacgaagattgccatccaaggataatccaccgagacataaaatcctcaaacattttattggataataactttgacgcactggtggctgattttggtcttgcaagattggctctggatgctgtaacacatgtaactacccgtgttatggggacatttggatacatggctccagagtatgcatcgagtggcaaactgactgagaaatctgatgtgttctcttttggtgttgtactcttagagcttatgactggtcgaaagcctgttgattcatccagaccattgggtgatgagagccttgttgagtgggctagaccattgcttagtcgagctcttgagacaggaaagctggaagggttagtcgaccccaggcttgagaagaatttcaatgaggtagaaatgttccgtatgattgaatctgcagcagcctgcattcgacactcgtcatcaaagaggcccagaatgagccaggtggtgcgggtcctcgatagcttagcggatattgacctaacgaacggtgtccagccagggcaaagcgagctcttcaacgtggcaaacacggcggatatcaggatgttccagcagatggtgcagggcaatcaggatgacagttctgccttcagccaatatagttggatcagtcgcagtagggccgacgccgaggcaacctcctcaaactccaggatcttgtgatcgtctttgtttctgtgctccatgtgtgcgtagctattcttctcgacccactgattcggccgggctgtatcgaccatcgaaaaagtctggtgtaattcttgccttgttacgatgattgctcctgtgtagatcacatgaggaagatgtactcttgtttgacaaattattaagctcaaaaaaaaaaaaaaaa

SEQ ID NO: 3824 - protein, 627 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 30725492; NR Description: At3g24600 [Arabidopsis thaliana] >gi|13877617|gb|AAK43886.1| protein kinase-like protein
  misc_feature: GI Number: 50949005; NR Description: Similar to an Arabidopsis somatic embryogenesis receptor-like kinase (AC007504) [Oryza sativa] >gi|9945053|gb|AAG03090.1| Similar to an Arabidopsis somatic embryogenesis receptor-like kinase (AC007504) [Oryza
  misc_feature: GI Number: 15218591; NR Description: protein kinase family
  misc_feature: GI Number: 42562273; NR Description: protein kinase family
  misc_feature: GI Number: 13447449; NR Description: receptor protein kinase
MPLPQQTPPRHPPPPPPPHRHPPRRPPRLQSSPPPHRPPRRHRRRPPHSPLQSPRLPLPRRLQPPQAHLLRPPSAPPPQHRRRRLLRQDPRRPLQLQEPRRPPSPRRPRPPPTPRRTPSHRRLPRPATTRSCRRRPPPSTRPTSTAGAPTSPPRSPPASGAARPPPRRAAATGGASNGVVIAVGAVLAFLVVTLIAAAVLYTKKRRRGRDDYRAGFRSPPYSSELPPSVPSGGGSANAAMSSSADPSVHTNYSAGSPRLKACVSDMSVGNSRFFTYQEMYQITDGFSPRNLLGEGGFGSVYKGRLPEGKDVAVKQLRDGSGQGEREFQAEVEIISRVHHRHLVSLVGYCIANSQRLLVYDFVSNDTLHYHLHGQGRPVLEWSARVKIAAGAARGIAYLHEDCHPRIIHRDIKSSNILLDNNFDALVADFGLARLALDAVTHVTTRVMGTFGYMAPEYASSGKLTEKSDVFSFGVVLLELMTGRKPVDSSRPLGDESLVEWARPLLSRALETGKLEGLVDPRLEKNFNEVEMFRMIESAAACIRHSSSKRPRMSQVVRVLDSLADIDLTNGVQPGQSELFNVANTADIRMFQQMVQGNQDDSSAFSQYSWISRSRADAEATSSNSRIL

SEQ ID NO: 3825 - DNA, 1762 bp, Triticum aestivum
  misc_feature (1)..(1762): Ceres cDNA ID no. 21665929
  misc_feature (1)..(1762): Ceres CLONE  ID no. 859210
  misc_feature (1)..(1762): Also known as  Ceres CDNA ID no. 24361298
agcagccaccagccgccgccatcgaccacttcctccactcctcctcggtgtcgactaccaagttgaagttggatgatgcgggggacgaagcttccgtgctcgccggaggcagggccgaggtgtggaggacaggaggagcacggccccgacatccgcaatgatggattggttgctgcttcttcaagggttaagagaatgaaggtctcgcactgccggcaaaattgttcgtcaactgacgatgcaaatggccagacaaagacaggggcctcaccctgccaacaaggcgataccactcagacagagcagtgttcagagccatatcttcccgaggacatctggcatcatatacattccttgatgccactgaaagatgctgccagagctgcctgtatgtctcagtccttcctgtcttcctggagatgccgttccaacctcgttcttagtagggaatcatttggcttgggtcaaggtgaaaaggaaacagctagagattttagaagaaaaattgaccatattctgagaaaccactcaggaactggcgtgagaaaactcaacctttggttggttccaaattacaatgcgaagaaccgtggttacgttgacaaatggcttgagaaggcagttacaccagggattgaagaactcacccttagtatgcctataaacaacaaatccaaatacgagtttccatgcacggttttatcaaatgggaggggggactcgcttcggtgtctttgccttaccaattgttcttttcatcctatagccttgcttggttgtttgagaagcttgaccaaattagagctgtttatggtgcgtattccaggggatgagctatgctgccttctttctagttcttcagctttagagtggctttcacttaggtattgcagtaaggtaaactgcttgaagataccatgtcaccttcagcatctaaggcacgtgaaggtggaagattgcagcatgcgaatgatagagagcaaagctccaaatctctccagctttcagtttaaaggtgacctcaaggtacaagtctcacttggaaaagcattgcaagtgaagagcttatacatgaggagcaccgtatttggttgtgacactcgagcagagctggcgtccagcatgccaagcagggaggtggtcaattcaccaattgtgtctagcaaactcaccgacctgaaatctatgatcatctgtcttggagaaatggccttttgcctgagctttgattgtcagtctatgttttctatccttggtgcttctcttacgttggagactttcatctcacgtgtatctgatggactcatgcagcatgccttagttttcggagatccctcaagatcgtggatgttggacatgagtggcggcggcgtgtccccattgaataagagtctgattaagctagcgtgtcatatcctcagggcctggttgatttaaacctgtccctgttctgggagtgcaaggactgtcacggggacatggtaatgccaaatgtcatgcatagagcactctgcagttggaaactaaactaagtgcaagtctgtctcctgagtttctgaagctttgtgtggtcgatcatggtgttgaacattaggtgttatgctaattatattcggttatagattttgtagctgggttattgtttccttaaattactagaactggtcattgttaaattgatgtagttcgtctgtaatattacctacaatagaagtgttgctaaataaagttactctgcttgttatcaaaaaaaaaaaaaaaa

SEQ ID NO: 3826 - protein, 454 aa, Triticum aestivum
  misc_feature: PFam Name: F-box; PFam Description: F-box domain
MMRGTKLPCSPEAGPRCGGQEEHGPDIRNDGLVAASSRVKRMKVSHCRQNCSSTDDANGQTKTGASPCQQGDTTQTEQCSEPYLPEDIWHHIHSLMPLKDAARAACMSQSFLSSWRCRSNLVLSRESFGLGQGEKETARDFRRKIDHILRNHSGTGVRKLNLWLVPNYNAKNRGYVDKWLEKAVTPGIEELTLSMPINNKSKYEFPCTVLSNGRGDSLRCLCLTNCSFHPIALLGCLRSLTKLELFMVRIPGDELCCLLSSSSALEWLSLRYCSKVNCLKIPCHLQHLRHVKVEDCSMRMIESKAPNLSSFQFKGDLKVQVSLGKALQVKSLYMRSTVFGCDTRAELASSMPSREVVNSPIVSSKLTDLKSMIICLGEMAFCLSFDCQSMFSILGASLTLETFISRVSDGLMQHALVFGDPSRSWMLDMSGGGVSPLNKSLIKLACHILRAWLI

SEQ ID NO: 3827 - DNA, 1707 bp, Triticum aestivum
  misc_feature (1)..(1707): Ceres cDNA ID no. 21665930
  misc_feature (1)..(1707): Ceres CLONE  ID no. 859287
  misc_feature (1)..(1707): Also known as  Ceres CDNA ID no. 24357217
atacttttttctattcatgtgttctgagaatccaacgaatttttggcggagaaaatggaggccgccactgccgctagctctgaccttaaccccaaatctaagcatttgacctcgctcctgtcggcgacctccacatccttcgccgccgtgcctccctccccgaccaagcagcggccagcgcctccgttccccagccacgcgcccgcgagattcatcctcctccccattgctccctctccccagcttagccgcgccccaatcccctactggcctgctcgatgccttgagatcacttttccccaccggaaaccctcgccgccgccgccgccgccattaatttctacgcgcaagctccaatttcaggaggcccagaatgaggacggcgtcgatgtgcaccgcatctactgtgcggggcacgcacacgttcaagatcgccggctacagccttcacaagggcctcggcgtcggcaatttcatcccgtctgccaccttcgacatcggcggctacctctggcgcgtactgtactaccccgatggggagatggagatggagaatggggatcacgcctccgttttcctcgaccttgttagcgaggacaccgaggcgagggcgttcttcgaggtcaggttggtcgacaagactaacaagctgccgccttcggtggtgctctcccagaagacgccgtatgtgttcaacagcaatggacgtaggagctccgtgggcgacgacttcttgcaaccatcggcgtacctgctggacgacagccttgtgcttgagtgcgatgtcacagttctgagggaatccaaggtgaccctgactgcgaccaccttcgacatccaagtgcctccctcagacttgggggagcatttcagggaattgctagagaaggaggaggaagcagatgtcgtttttgaggttgaaggggaggtttttcccgcgcataagattgtggttgcagggcgctcgccggtcttcaaagcgcagctctttggaccgatgagcgacagggcaaagcaacgcataacagttgaagatatgcagcctgctgttttcaaggcgttgcttcacttcatctacacagattcgttgccttcgatggaaaaacttgatggagatgagggcaaagaaatggttaagcacttgcttgtggctgcggataggtatgcgatggaaaggatgaaggttatgtgtgagagcatcctttgcaaaagtcttgatgttgagaatgtcactgctacattggctctagctgaccagcatcactgcagcaacctcagagacgcttgccttgagtttatcacttctacggatagaatggatgatgtcatggcaagccaagggtatgctcacctcaaaagatcctgcccttctattgtcatagatgtcctcgaaaaggcaaaaaagtcccgcaaaatttagtacgttcatccatgtttagcttatgaatagttgaatagtttgtttagttgacgcataacctcgtaagatgaaagttggcttctcagttattagtttccggtgatcttttggagaagggtaggcttttgtaaaatgcatgtgatggaggctcctcttgctatatcttgtatatgatgacgattgacgatgaatcttatttatgaatttatgccagcttgctagtgttctcgaaaatgccctgacagtctggctaaacaattaggttactgttaaaaaaaaaaaaaaaa

SEQ ID NO: 3828 - protein, 348 aa, Triticum aestivum
  misc_feature: PFam Name: BTB; PFam Description: BTB/POZ domain
  misc_feature: PFam Name: MATH; PFam Description: MATH domain
  misc_feature: GI Number: 50942509; NR Description: zinc finger POZ domain protein-like [Oryza sativa (japonica cultivar-group)] >gi|38636858|dbj|BAD03124.1| zinc finger POZ domain protein-like [Oryza sativa (japonica cultivar-group)] [Oryza sativa (japonica
  misc_feature: GI Number: 50942517; NR Description: putative speckle-type POZ protein [Oryza sativa (japonica cultivar-group)] >gi|38636861|dbj|BAD03127.1| putative speckle-type POZ protein
  misc_feature: GI Number: 50939715; NR Description: putative zinc finger POZ domain protein [Oryza sativa (japonica cultivar-group)] >gi|23617108|dbj|BAC20790.1| putative zinc finger POZ domain
  misc_feature: GI Number: 15239625; NR Description: speckle-type POZ
  misc_feature: GI Number: 50940781; NR Description: putative spop [Oryza sativa (japonica cultivar-group)] >gi|42408456|dbj|BAD09637.1|
MRTASMCTASTVRGTHTFKIAGYSLHKGLGVGNFIPSATFDIGGYLWRVLYYPDGEMEMENGDHASVFLDLVSEDTEARAFFEVRLVDKTNKLPPSVVLSQKTPYVFNSNGRRSSVGDDFLQPSAYLLDDSLVLECDVTVLRESKVTLTATTFDIQVPPSDLGEHFRELLEKEEEADVVFEVEGEVFPAHKIVVAGRSPVFKAQLFGPMSDRAKQRITVEDMQPAVFKALLHFIYTDSLPSMEKLDGDEGKEMVKHLLVAADRYAMERMKVMCESILCKSLDVENVTATLALADQHHCSNLRDACLEFITSTDRMDDVMASQGYAHLKRSCPSIVIDVLEKAKKSRKI

SEQ ID NO: 3829 - DNA, 1573 bp, Triticum aestivum
  misc_feature (1)..(1573): Ceres cDNA ID no. 21665931
  misc_feature (1)..(1573): Ceres CLONE  ID no. 859715
  misc_feature (1)..(1573): Also known as  Ceres CDNA ID no. 24357225
cttttcccctgcctctcgggctgtttgtttggtggtctccgccccgtcctacacgccgtgcgtgagtgcgtgcgaatgggggagcggcgggctgggcgagccatgcgtccgatttgatgcgatttggttctggagagcttggtcgggtgcgaggaggaagaaagccccgatctttcgtccagggcccgagagatttccgttgggcaagggaattttcaaaggagaaatctgaagagcacacaaacttcgtctcctgagctgaactcctggtcgacgaagcagaagccatggggtcaggggactggttcaagaccatcatcagcaagaagaagtcgaaacggggcaagtcaaagcacgcaaagaaggttgctgcgcaacgcaatggagccaacctgccgcagcaaaagcccagcaacgctccttcttccagcagcgaccctgaagacaacgcagcactggaagactgggcagctacccggattcagaacgcgtttcggcgccacaaggcaaggaggacgctccgttgcctgaggggagttaaaagactgcgcattgttggccagagcaatccagttaccaagcagaccagtgccacactgagctacatacagtcttggaacaagttacaggctgagctaagaaaccggcgtgctttcatggtcaccgaagggcgcaacaggaagaagaagcaagagaaccaagtcaaacttgatgcaaagctccaaaatttgcaggttgcgtggaatggaggctcgaataccatggatgaaatagttgccaggatacatctaagggaagaagcagcagtaaagcgtgagcgagccatggcatatgcgtttaaccatcagtggagggcaaagtctgccacaagccaaggaaacttcaactatggggtcgggaacggtggctggggctggagctggatggaccgctggatcgctgcacgaccatgggagccccgatctatggtcacccctgaaaacccgaagaagggacaatcaaagaaagacaacaccagcacaaaccagtcagctctgaagctgcaaggtgcaatcagtctaagcaacaacaccagtgaccggaaagttcccaagaagaagtcatctccctctcctgataagaagaaaccggtagcgaaaacggagcagaaaccagtagcgaaaacagagcagaaaccaaaggcggcaggccctcccaaggcgaagtcgaaggacatgaagaggaaccaagagaagcagcaacaacccgcggttcctgcgatcactgcttgaaacccgcggcgaaaaggttaccggagacgttgtatgatacatcctgtgaagtttctcttttcttttacactcttatgtggtttgtctcttacattgctgttttatcggaacaagaagtgaccaatgtagaatgtgtttggtttgcgcgattgcacacatacctaatgagagtggtttttggttaggactaggatctctactgtgcgcattgtatgcgggtgtgtaatatgatgccatctctgtctgctgggctgaaatggttctgttggaacaaaagttcaagttcaaaaaaaaaaaaaaaa

SEQ ID NO: 3830 - protein, 327 aa, Triticum aestivum
  misc_feature: GI Number: 55297446; NR Description: SF16 protein-like [Oryza sativa (japonica cultivar-group)] gi|55296691|dbj|BAD69409.1| SF16
  misc_feature: GI Number: 2342719; NR Description: putative SF16 protein {Helianthus annuus} [Arabidopsis thaliana] >gi|25408319|pir||A84751 probable SF16 protein (Helianthus annuus) [imported] - Arabidopsis
  misc_feature: GI Number: 15233296; NR Description: calmodulin-binding
  misc_feature: GI Number: 2739366; NR Description: putative SF16 protein {Helianthus annuus} [Arabidopsis thaliana] >gi|7487891|pir||T00974 probable SF16 protein (Helianthus annuus) [imported] - Arabidopsis
  misc_feature: GI Number: 3075399; NR Description: putative SF16 protein {Helianthus annuus} [Arabidopsis thaliana] >gi|25367166|pir||D84657 probable SF16 protein (Helianthus annuus) [imported] - Arabidopsis
MGSGDWFKTIISKKKSKRGKSKHAKKVAAQRNGANLPQQKPSNAPSSSSDPEDNAALEDWAATRIQNAFRRHKARRTLRCLRGVKRLRIVGQSNPVTKQTSATLSYIQSWNKLQAELRNRRAFMVTEGRNRKKKQENQVKLDAKLQNLQVAWNGGSNTMDEIVARIHLREEAAVKRERAMAYAFNHQWRAKSATSQGNFNYGVGNGGWGWSWMDRWIAARPWEPRSMVTPENPKKGQSKKDNTSTNQSALKLQGAISLSNNTSDRKVPKKKSSPSPDKKKPVAKTEQKPVAKTEQKPKAAGPPKAKSKDMKRNQEKQQQPAVPAITA

SEQ ID NO: 3831 - DNA, 601 bp, Triticum aestivum
  misc_feature (1)..(601): Ceres cDNA ID no. 21665932
  misc_feature (1)..(601): Ceres CLONE  ID no. 859748
  misc_feature (1)..(601): Also known as  Ceres CDNA ID no. 24357370
acacacacacacacacacaaaccatatacgagatccggccatagaccagccaggagcaagcactatggaacgagcgagcaacggcagcgcacaagacgatgagctcagccttgagcttaccctggccaccgaggcgccggcgtctggcgcaccagacggcttcttcctctgcgtccactgcgaccgcaagttccgcagctcgcaggcgctcggcggccaccagaacgcgcacaagcaagagcgtgccgtcgccaagcgccggcgagaagctgctgcggcagccacccgcacacaggaatcaaggtcaaggaaggcggggaggcatgctgctactgctactgggatgtccgagcctgcagagggcaagcagggcgggagctcgtccaagtgtggcgacgacgacgaggtggacttgtctctccggctataagcgatccctctaacgatcttctaatatacgaggatttgtgttatttcctcctaggtaagtcagaatttagctactttggtttggaaaaataatgttttaccttcctatagcaacaatttggtcacccgttttctttcaatctagttgattttgttaaaaaacaaaaaaaaa

SEQ ID NO: 3832 - protein, 121 aa, Triticum aestivum
  misc_feature: PFam Name: zf-C2H2; PFam Description: Zinc finger, C2H2 type
  misc_feature: GI Number: 7329659; NR Description: putative zinc finger protein [Arabidopsis thaliana] >gi|11358704|pir||T48207 probable zinc finger protein - Arabidopsis thaliana >gi|15241084|ref|NP_195806.1| zinc finger (C2H2 type) family
  misc_feature: GI Number: 13605609; NR Description: At1g66140/F15E12_19 [Arabidopsis thaliana] >gi|16604378|gb|AAL24195.1| At1g66140/F15E12_19 [Arabidopsis thaliana] >gi|15810083|gb|AAL06967.1| At1g66140/F15E12_19 [Arabidopsis
  misc_feature: GI Number: 46981882; NR Description: putative zinc finger
  misc_feature: GI Number: 62733300; NR Description: Chain A, Nmr Structure Of The Single Qalggh Zinc Finger Domain From Arabidopsis Thaliana
  misc_feature: GI Number: 30725290; NR Description: At5g25160 [Arabidopsis thaliana] >gi|27923889|sp|Q39262|ZFP3_ARATH Zinc finger protein 3 >gi|4063732|gb|AAC98442.1| ZFP3 zinc finger protein [Arabidopsis
MERASNGSAQDDELSLELTLATEAPASGAPDGFFLCVHCDRKFRSSQALGGHQNAHKQERAVAKRRREAAAAATRTQESRSRKAGRHAATATGMSEPAEGKQGGSSSKCGDDDEVDLSLRL

SEQ ID NO: 3833 - DNA, 1724 bp, Triticum aestivum
  misc_feature (1)..(1724): Ceres cDNA ID no. 21665933
  misc_feature (1)..(1724): Ceres CLONE  ID no. 860824
  misc_feature (1)..(1724): Also known as  Ceres CDNA ID no. 25088332
ctccccaaaatccatcccgcgggagacacgagcgtgcgagggagagaggccgctgctcgtcctggtcccggtgggatgaagattgacgatcccctcgacttcgagggggataacgaccccctcctcaccgtccgccgccccgccaagaggaagaaggttattgggctggatgatctcgtagaagattactttaattccggtaaggatgagctcaaagcttctgctgctaagtctaagggtcgccccaaaggagacaattcagacgatgaagataggcaggtcaggaagaaggagattgacttctgcaaatttgtggaggagtgtgaggaaaaggcgaaagcgatggatcctggagaggatgtaccccaatggggccagcaagttttcggctgtcagaaatcaccctcggttcttaatagcacgggagttgaaaattgccaacttttgcaatcattctgtggggatgagcagttaggttttgatctagagattgaacgaggagagggctttttcgaaggcatgctgatcaatggatggcttttgaagttggtactcctatatggttctgttgaagactctatagcatcatgggtgctgaccaagttactgtactcatccaataagaagttgcaagattctgcatctgaattttggggtagtctcctttccctaaatgaggatgataaaccatttgtaaaccttggatactttccaagctactctattcttatgggtgctatactcaactatggatacctacatgatgctccttccactaaaacttgcacctctgaaattgcggttgcagacacttcagatggtggtccacctcaaaacatcactgcatggttaagagttgtatctgcttgctgcaaaattagaaaaatgcatgccgtcttctcaccttcggaagcggaagatgtccttgttattgttatttcactctttttggaccgtcgacttgaagggctgctgcttattttgggagattgcctaaattcactcatctcatacttcaatacgagtgaatgggaaagtagctgtctgattgttgctgagtcaatttctaagagggtcaagatggatcttaattgtttaaggcttgttgactgcattaccggaaccaacgaccgtagcaaattcctaaggagccagctggcccttcagttgctcaaaaatagcttcggccttaaagtagcgaatgttgaaaggatcctgaagtcggtcacatcgataaatgtgaaggagaaagaatgcaatttcttcatgctgtacgtgcacatagttttgatggacaacctgctcttctcgagcgacgcgttcagaaacaagacagcgataatcgacgcttggcgcatttttttacggaactgctcgacccatataggatgcacggactggaggttctacgcttcgaaggtccgaaacaaggcgtcgtatctcctgcaaggtgcaatgctgaaaaggcctgctggcagtggtaacattcctgccaagtgatttgaaccaacctactgaaatgcctgctgctggagagcacggaacctacgccctgatttactagcacaagtagtatgtttagggtgaattttaggctcatttttgggtacctgatggtggctgacagtattctcagcccatgtatagcgtagtccccagcagtctcaagtctcaacgccgagaatgccatttgatgaacttttggagcaaaaaaaaaaaaaaaa

SEQ ID NO: 3834 - protein, 474 aa, Triticum aestivum
  misc_feature: GI Number: 34904514; NR Description: OSJNBa0010K01.20 [Oryza sativa (japonica cultivar-group)] >gi|13486875|dbj|BAB40105.1| OSJNBa0010K01.20 [Oryza sativa (japonica cultivar-group)] >gi|20160476|dbj|BAB89428.1| B1066G12.1 [Oryza sativa (japonica
MKIDDPLDFEGDNDPLLTVRRPAKRKKVIGLDDLVEDYFNSGKDELKASAAKSKGRPKGDNSDDEDRQVRKKEIDFCKFVEECEEKAKAMDPGEDVPQWGQQVFGCQKSPSVLNSTGVENCQLLQSFCGDEQLGFDLEIERGEGFFEGMLINGWLLKLVLLYGSVEDSIASWVLTKLLYSSNKKLQDSASEFWGSLLSLNEDDKPFVNLGYFPSYSILMGAILNYGYLHDAPSTKTCTSEIAVADTSDGGPPQNITAWLRVVSACCKIRKMHAVFSPSEAEDVLVIVISLFLDRRLEGLLLILGDCLNSLISYFNTSEWESSCLIVAESISKRVKMDLNCLRLVDCITGTNDRSKFLRSQLALQLLKNSFGLKVANVERILKSVTSINVKEKECNFFMLYVHIVLMDNLLFSSDAFRNKTAIIDAWRIFLRNCSTHIGCTDWRFYASKVRNKASYLLQGAMLKRPAGSGNIPAK

SEQ ID NO: 3835 - DNA, 1608 bp, Triticum aestivum
  misc_feature (1)..(1608): Ceres cDNA ID no. 21665934
  misc_feature (1)..(1608): Ceres CLONE  ID no. 860923
  misc_feature (1)..(1608): Also known as  Ceres CDNA ID no. 24361327
gagtagtgagtgctctagaaacgggacgcgctggccgtaaaaagaaaatccctccccgccgctgttggtgacggagaccgcgtcgccgccgccgccgcctgccgctggttcggccccggtgcgacggcgtaaacgaacggcacctctcgtcactgcggcgggtgatctcgctcctgcggacgctcgcctcgccccggtaggtcgtctcttccactgcaggtctacaagatgccctggaagaatcaagaacctacaagcatatgcgaaggaggaagcacaagtaagagagcaaaggcctcctcgcctcgcaattctgaccgagaagattctccgcctcggcgcgacggcttcacacgtatgatgcgaaggaggatgcgtcctcgcggttatcctatgccggatggtgtttatgggggcatgcgcttggtgaacacctttgagctttgtttcaaagagttagatggctacaatgaagatcacacgaagatcaaattacttgctttaagcgtgtctcagtctattgtctcgcttgcttcgtttaaggggaaaacgcgacagtttacgtgcacaggcacaattgtaggacgcacgccatccagcatgagcattctaacatctgctagtttagtgagatgcaccaacgatgaaactgagatagatgataaactgaagattaaggtgcgcctgcccaacggcaagattgttccaggaaaattgtggaaatacgatctgtattataatattgctgttgtcaacatgaaggctttccctgaatttcgtgcagccgacattcataatcaagtcgaagctaatgccaaattacctcaaagtaaactggtagccattggacgagcttttgaatccggagaactaatggctacagctggcacactgctgtataaaactaccaaacttgactgccaggaactcatgacctcttcttgttatatcacaaaggagagttgtgcagccatggcttggtctgaggattggatcacttcaagctcaaaagctgggtacccgtgtagaactacacgacagcttccccgatgcacatggaatctatgtagagagggtttttgatggatccccggcagcaaattctggaacgaaagttggcgatgtcattaccaagcttgatgaagtccctttgttcagtgcacaagagttccataagctggttttggacaagacggagagtactacgcaacacggtgatgtgatgccttttgaggtatctgtcctaaggccgggtaacagttttgacttctgtgcaactatcaacgctgaagtgattgacatgagcaaacaaaacagatggccggtacccaagaccaagtggatatatccagataatgaatatgatgatgaggggccccttgttcgaaagtgctcccgacctgactatcgatatccttcccccgatgaggacgagtccacacaagattgtgatgaagagtgaggagtaatcttgtagggttagtaaagacaagttgagatcttcttgacaactgaaatgaaagtataaaaaacccgaaatgaaagtctatgttgccagatttatgtttggtactccctctgttccataaaaggaaaaaaaaaaaaaaa

SEQ ID NO: 3836 - protein, 229 aa, Triticum aestivum
MPDGVYGGMRLVNTFELCFKELDGYNEDHTKIKLLALSVSQSIVSLASFKGKTRQFTCTGTIVGRTPSSMSILTSASLVRCTNDETEIDDKLKIKVRLPNGKIVPGKLWKYDLYYNIAVVNMKAFPEFRAADIHNQVEANAKLPQSKLVAIGRAFESGELMATAGTLLYKTTKLDCQELMTSSCYITKESCAAMAWSEDWITSSSKAGYPCRTTRQLPRCTWNLCREGF

SEQ ID NO: 3837 - DNA, 1544 bp, Triticum aestivum
  misc_feature (1)..(1544): Ceres cDNA ID no. 21665935
  misc_feature (1)..(1544): Ceres CLONE  ID no. 861087
  misc_feature (1)..(1544): Also known as  Ceres CDNA ID no. 0
atcgtaacacactttggtttggtttggtttggttggagctacgaacaaacaagcagaggagcttctccttcttcttcctcttgcttgcttgcttgcttctccatccatacatccatggagcagcacttcgtccatttcggtgccaccaccacgcctcctcctcctcaacccaaacccaaagcttcaccgccactctgctaccacacttcatcaccgatcttggccgacgactaccacacctcctcacccatgtcgtcggccttcgacatgggtgacaccgacgacatgcacctcctcaacaccctcctcctgcacatacagacgggcagcgcttcttctcacgtggaacctgcccattactccttggacctggaattggacatggagccatcttcctcttcaaccagctcctcctcctcctactcctcctccgagcagcagcagaagcatcacgggatgcccaccaccgcaggacagagcccatccaatcgccgtgcatcgcagcagcagcagccacaccccgcgccggcggccaccaagggcctcatcggcgtgcgcaagcggccgtggggcaagttcgccgccgagatcagggactccacccgcaagggcgcccgcgtctggctcggcaccttcaacacccctgaggcggccgccatggcctacgaccaggccgccttctccgtgcggggcgccgccgcggtgctcaactaccccgtcgaccgtgtccaggagtcgctccgcaccctcgcgctccgtcccgacgtgccgggaggctcccctgtgctggccctaaagcgccgtcactccatccgcaagcgctcccccaacaaggccaagaagacggcgctagagcccaccaagatgatggagcagtcgggcgcagccatgccggcgcaacagcagctgctgccagtacagtccgcgggcgtggtggagctggaggacctgggcgcggactacctggaggagctgctccgggtgtccgacgagccgtccgcgtcgtccaccatgctgatgggggcctttgatcatcatcaccatcaccatgtcgacgaccaatccgcgctggccagcacggcgccgatgctgttcccccattgctagctagctccatccatggccggctggctcatctgccggcgcctcctcgtcctctgctctctcactctctctgctttgagttaattgcaaatagtgcccatccatggaccgatcactcgatcagtcagttttccttctgtttttttttttcgccgtcctgttgcatgccacggcagcagcaccggagggcaatcaggcggcaacagccaacggcttttgtatgtacgtatatgtagtagaactagtatagtatgcctctctgtttcgtttcgtacgtactacaatacgtcaaacaaaaagatagttattatagaacaataatatactgtacgtacatatgccaacggctttccatacaattattattgtgctgtgcagggtataagtattacagtatgaatgaatggcatgctgatgcacttctaaaaaaaaaaaaaaaa

SEQ ID NO: 3838 - protein, 330 aa, Triticum aestivum
MEQHFVHFGATTTPPPPQPKPKASPPLCYHTSSPILADDYHTSSPMSSAFDMGDTDDMHLLNTLLLHIQTGSASSHVEPAHYSLDLELDMEPSSSSTSSSSSYSSSEQQQKHHGMPTTAGQSPSNRRASQQQQPHPAPAATKGLIGVRKRPWGKFAAEIRDSTRKGARVWLGTFNTPEAAAMAYDQAAFSVRGAAAVLNYPVDRVQESLRTLALRPDVPGGSPVLALKRRHSIRKRSPNKAKKTALEPTKMMEQSGAAMPAQQQLLPVQSAGVVELEDLGADYLEELLRVSDEPSASSTMLMGAFDHHHHHHVDDQSALASTAPMLFPHC

SEQ ID NO: 3839 - DNA, 2373 bp, Triticum aestivum
  misc_feature (1)..(2373): Ceres cDNA ID no. 21665936
  misc_feature (1)..(2373): Ceres CLONE  ID no. 861311
  misc_feature (1)..(2373): Also known as  Ceres CDNA ID no. 24361282
accgagacgcgcgcgccagatccaacggccaacggggagggccctccccccaacggcgcggacgcacctgtccgtccgttcccttcccccctcgtcgccatcccgcacactcccctcgtgccccccaccgccggcggaagccgccaaaaaccccggccgcctgctgccgatccgcgcaccgcacgccgacacgcccgcctcgtgaactaacccggcgcccctccgccactgctgcacacgcgcgcagggttcagtcagggctttggcccgaggttcaggccgggatgagatccccatccctcgagccagccgcggccgcctcgccggtcccccgggctgcggccttcgggcgggtccgggtcgcccacggcgcgcgggggctgcgtggcgtcgcgggcgccggcgtccctgggaccgcgggccgcctgagggtgctcgtcgccgcgctcccggagcccctcctccaccggctcatgcccgcgcaggagggcgccgcagcactgtcgccggaggctgatgaggtgcatggggacatggcttctgccgagatttcgtcacccgctgctcgtgctgttcctggaagcacactgcgtgtcagatttgtgctaaaagagcggtgcaacttcggccaaagcttccagatggtcggcgacgacccggcgctcggcctgtgggaaccggcgagggcggtggctttggattggtctgaaggccacaattggacagtggagaaagatttgcctgccaacaggctgattgagttcaagttcttgctgcaagattccctggggaagttccactggcagaatggacctaacagaaccctacagacaggtgaaaccacaaagacattggtggtctacgaggattggggtaatgcgaagaatcagaaagtagcagaggagggagacgccccggttcaaatgatggaggcagttctcgatggtgatcacggcagaaatggtgttgtttcggcacatgagctacaagtgtgtgacaatcaagagatgaaagaaccagatgcgcccatgccgatcccttggggcggagcttttggccgggtccgggtcacctacggcgggcaggggctgcggcgcgtcggcagcgatggcttggctgggactgccggccgcctgagcgtgctcgtcaccgcgctaccgaagcccctcgagcagctcgtgcccacacaggagggtggcatagcactagcgccggaggctgatgaggtccaggggggagtggcctctgctgagatttcgtcaccacctgctcctgctgttcctggaagcacagtgcgcgtcagatttgtgctaaaagagcagtgcacctttggccaaagcttccacctggtcggtgatgtcccagcacttggcctctgggaaccgacgaatgcggtcgctatggattggttggaaggccatgactggaccgtagagaaagatttacctgccaacaggttgattgagttcaagttcttgctccaagattccttgggaaagttccattggcagaatgggcctaatagaagcctacagacaggtgaaaccacaaagacattggtggtctacgaagattggggtaatgcgaagaatcagaaagtggcagaggagggacacaccccggttcaaatgatggagacagttgtcaatgatgatcacggcagaaatggtgttgtttcggcacatgagctacaagtgtgtgacaatcaagagatcaaagaggatgaatcaactataagcgatgatgataattcaatggctgctgctattgcatctgttggagaggaaacaatgaaggcatgtgaagctgatcaaccagagctattgatgggcgaacagaaaattcaagatgagcttcgttatgaaatagacacagcaccccagaatggcagggctacgacgtatgctgatgctgatggtgaatacgatgaaacgaccgacgatgatagtatcctgcccaagaatggcgctctggttaagcatgggctggcaggagcttttgagcgcgagttgctttggggttggaaggccttgcagcagctcgtgggcttcaaagcggacacatgagagatgatgcatctggtattgcttgctatgtatgcacgagggcatggcggtttagacggcatgctgttcctcaaaatgatgtagtggagaacactagcaggtagcagcagctactgagtattttgttgtggccctctgttgtgtgtacatagtttctctgggagaaacgctatttgtcaagggattgtaacaacttgttatcaataagccatgatcggtctgtcgacagtttgtaaagcggcccccgttttgacccagggaagataatatcctctgcaaggatggtcagcgaaaaaaaaaaaaaaaa

SEQ ID NO: 3840 - protein, 593 aa, Triticum aestivum
  misc_feature: PFam Name: CBM_20; PFam Description: Starch binding domain
  misc_feature: GI Number: 34908424; NR Description: OJ1402_H07.11 [Oryza sativa (japonica cultivar-group)] >gi|15290006|dbj|BAB63700.1| P0683F02.3 [Oryza sativa (japonica cultivar-group)] >gi|21743328|dbj|BAC03322.1| OJ1402_H07.11 [Oryza sativa
  misc_feature: GI Number: 23505873; NR Description: At5g01260/F7J8_240 [Arabidopsis thaliana] >gi|16323041|gb|AAL15255.1| AT5g01260/F7J8_240 [Arabidopsis thaliana] >gi|18412808|ref|NP_568087.1| glycoside hydrolase starch-binding
  misc_feature: GI Number: 46228760; NR Description: starch binding domain
  misc_feature: GI Number: 66778368; NR Description: Cytochrome c biogenesis protein, transmembrane region [Anaeromyxobacter dehalogenans 2CP-C] >gi|66855954|ref|ZP_00400025.1| Cytochrome c biogenesis protein,
  misc_feature: GI Number: 61658242; NR Description: glucoamylase precursor
MRSPSLEPAAAASPVPRAAAFGRVRVAHGARGLRGVAGAGVPGTAGRLRVLVAALPEPLLHRLMPAQEGAAALSPEADEVHGDMASAEISSPAARAVPGSTLRVRFVLKERCNFGQSFQMVGDDPALGLWEPARAVALDWSEGHNWTVEKDLPANRLIEFKFLLQDSLGKFHWQNGPNRTLQTGETTKTLVVYEDWGNAKNQKVAEEGDAPVQMMEAVLDGDHGRNGVVSAHELQVCDNQEMKEPDAPMPIPWGGAFGRVRVTYGGQGLRRVGSDGLAGTAGRLSVLVTALPKPLEQLVPTQEGGIALAPEADEVQGGVASAEISSPPAPAVPGSTVRVRFVLKEQCTFGQSFHLVGDVPALGLWEPTNAVAMDWLEGHDWTVEKDLPANRLIEFKFLLQDSLGKFHWQNGPNRSLQTGETTKTLVVYEDWGNAKNQKVAEEGHTPVQMMETVVNDDHGRNGVVSAHELQVCDNQEIKEDESTISDDDNSMAAAIASVGEETMKACEADQPELLMGEQKIQDELRYEIDTAPQNGRATTYADADGEYDETTDDDSILPKNGALVKHGLAGAFERELLWGWKALQQLVGFKADT

SEQ ID NO: 3841 - DNA, 1679 bp, Triticum aestivum
  misc_feature (1)..(1679): Ceres cDNA ID no. 21665937
  misc_feature (1)..(1679): Ceres CLONE  ID no. 861436
  misc_feature (1)..(1679): Also known as  Ceres CDNA ID no. 24357229
gaaaaaaaaaaactcaccgctcagctcagcgcctcgggcggaagaaggaccgaccgaccgaccggacgtgcgccgccgcggttctgccggcgacctgagctcgtcgacggcgccggccaccgaccgctttgcctccagatttgagtgggagattggcgatggtggatgctgatgagatgccccaaccgatctatgccgagaataaaccatgtgcggaaatcgagtcgcggcgccattcccccactttgatgctggccgtggtaaccaaggtgctcgatgacgacgacctcctcgccgagatcctcctccgcgtcgtgttccccaccaccctcgtccgtgccgccctcgtctgcaagcgttggtaccaccacgcctctgaccgccggttcctccgccggttccgcaagctccacccgccctgcctcctcggcttctatgttgttttcaagggtgcacgcttcataccgatgcagcctcaaccacccgagctcgctgccgtcgtccgccatgttgcaggctacaggtttggcaacttgattgacttgaaggactgccggaatggcattgtcttgaccagggaccggaaacaaggagtattgacatataaagtcccgttgtgccctgagagaggcatgcccactgtcccaccactcccacgcacccagggcggcagcattttctatttcggtgaaatcctctccaaagaagaaggcgatggcctgtcctgtttttatatggtagtggaggtttccaaggagacaaaagaggtcacggtgagcgtatatatgctgcaagatggtgtctggtgcatggttacatcatccaaaaaccagctgcattggccgctgccaaggccaaaccctgttcttgttgacaataaaatctatatgggatctgcccgtggcaacaacattcttgtcttggatttgagtgcctcaactttctccgtgattcacctccctcaaggagtggagtatgcatcttcagaaatcaagttgtcacgtaccgatgatgcttccggtgtatatctcatccatttgcgtcccatggagtttcaactttgcgtatggctccacaaggaagacaactggctgctggtggataccatgtatttgcatgagatgtgtgccattttggggaagacagatcgccggtatgtgcatataaggcaggtgggagacaatgatcagtttgtacttttacagacttctcaatacatattctacttggatatcaagtgcagaacactgcataaagtggatgagatgacagtcgatgaacaatgttatgctgacatccatccttttatgatgatctggcctcccatattccctgccctcaaggacgatcctgcaaggaatgccatatgaaggaggactatatcaagaagcttttggatggccagtgacatttagggcctcgtcaaggaatagcagagagctgcactgcctgattagcagttgtaagtgcgtccactgtaacctgcacgggattaattagggtgctatgcaacaaaagcaggtccaatcctttgtatgcatgtttagtagtttgattcggatatattgcggccactgtaaccgcgcatgatagatattagacctatccgttgtatgcatgtttagtagttatctcacctgatccgcttggatcgtactggcccaaaaaaaaaaaaaaaa

SEQ ID NO: 3842 - protein, 403 aa, Triticum aestivum
  misc_feature: PFam Name: F-box; PFam Description: F-box domain
  misc_feature: GI Number: 32489920; NR Description: OSJNBa0038P21.5 [Oryza
  misc_feature: GI Number: 34914028; NR Description: OJ1014_G12.29 [Oryza sativa (japonica cultivar-group)] >gi|20146312|dbj|BAB89094.1| OJ1014_G12.29 [Oryza sativa (japonica cultivar-group)] >gi|21328077|dbj|BAC00661.1| B1144D11.8 [Oryza sativa (japonica
  misc_feature: GI Number: 34914580; NR Description: P0455H0310.25 [Oryza sativa (japonica cultivar-group)] >gi|15623977|dbj|BAB68032.1| P0455H0310.25 [Oryza sativa (japonica cultivar-group)] >gi|20804484|dbj|BAB92179.1| P0520B06.2 [Oryza sativa (japonica
MVDADEMPQPIYAENKPCAEIESRRHSPTLMLAVVTKVLDDDDLLAEILLRVVFPTTLVRAALVCKRWYHHASDRRFLRRFRKLHPPCLLGFYVVFKGARFIPMQPQPPELAAVVRHVAGYRFGNLIDLKDCRNGIVLTRDRKQGVLTYKVPLCPERGMPTVPPLPRTQGGSIFYFGEILSKEEGDGLSCFYMVVEVSKETKEVTVSVYMLQDGVWCMVTSSKNQLHWPLPRPNPVLVDNKIYMGSARGNNILVLDLSASTFSVIHLPQGVEYASSEIKLSRTDDASGVYLIHLRPMEFQLCVWLHKEDNWLLVDTMYLHEMCAILGKTDRRYVHIRQVGDNDQFVLLQTSQYIFYLDIKCRTLHKVDEMTVDEQCYADIHPFMMIWPPIFPALKDDPARNAI

SEQ ID NO: 3843 - DNA, 1560 bp, Triticum aestivum
  misc_feature (1)..(1560): Ceres cDNA ID no. 21665938
  misc_feature (1)..(1560): Ceres CLONE  ID no. 862374
  misc_feature (1)..(1560): Also known as  Ceres CDNA ID no. 23732748
caaaagccccctcaaaagccgaaggagacctcgactggaaggcaccgccgggcgcaagaactccaacgaacaaaccacgcggggcggccggtcaaatctacgccaccaggcgtgcgagggcctcgccgcagttcgattcgactcccccctcctccgcctccctcgattctcgccgcggaagcgaaaatgagcgacaatctcatggaaaaagtgaacgctctcggcgagcgcctcaagatcaccgggtcggaggtgagcaagcagatgcaggccggcatgagctccatgagcttcaagatgaaggagctcttccaggcgcagactccggccgacaagatcgtcgaggacgctaccgccgagaccctcgaggggcccgactgggccgccaacctcgaaatctgcgacctgatcaacaccgagaaggtgaacagcgtcgacctgatccgcgggatcaagaagcggatcatgctcaaggaggctagggttcagttcctcgccctcttcctccttgagaccatcgtcaagaactgcgagaaggccttctccgaggttgcggccgagaggattctagatgagatggtcaggctgattgatgacccccagacggtggtcaataacaggaacaaggcccttacgctcattgaggcgtggggagagtctggcgatgagctccgctacttgccggtctatgagcaaacctacaagagcctgaaatcaagaggaattcggtttcctggacgtgacaatgagagcctggcccccatatttactccaccacgctctgttgctgaagctgaagttgctgcaaatttctcccagcagacattcgaagatgtacatgtgcatacatatactgctgaagaaacaaaggaagctttcgatgtggcccgtaacagcatggaacttctttcaactgttctttcatcctcccctcagcaggatgctttgcaggatgacttaacaaccactcttgtgcaacaatgctaccaatctcaacacactatccagagattcatcgagacggctggagacaatgaggccttgctctttgaggccttgagtgtgaatgatgaggtcctgaaagtgctatccaaatacgaagagatgaagaagcctatggcgtcggcacgtacagaacagccagtggtcataccaattgccacggagcatgaagattccgtgactgttggcaatgaggatgccctggtcagaaaaccagctgctgctcgagcaatgtcaggcggcgatgatgatatcctcgatgatcttgacgagatgatatttggcaagaaggggggcagtagttcccaggacgtgtccaaaaggcaggacccaaagaaggatgacctaatcaacttctaaataccgtcccagcaagttgcggagttcctctagggatacacagcatgtctgctgctttttatactgctgaacgatgtctgtattcatccggtagaagactgcactgcacgtacattcagttagggatttgggtcgcttgtttatttgcatatacgatgataccttgtcctccagagtttgtccaaaaaaaaaaaaaaa

SEQ ID NO: 3844 - protein, 391 aa, Triticum aestivum
  misc_feature: PFam Name: VHS; PFam Description: VHS domain
  misc_feature: PFam Name: GAT; PFam Description: GAT domain
  misc_feature: GI Number: 21537352; NR Description: TOM (target of myb1)-like protein [Arabidopsis thaliana] >gi|9755689|emb|CAC01701.1| TOM (target of myb1)-like protein [Arabidopsis thaliana] >gi|27311895|gb|AAO00913.1| TOM (target of
  misc_feature: GI Number: 50911763; NR Description: putative target of myb1 [Oryza sativa (japonica cultivar-group)] >gi|41052948|dbj|BAD07858.1| putative target of myb1 [Oryza sativa (japonica cultivar-group)] >gi|41053212|dbj|BAD08174.1|
  misc_feature: GI Number: 30686081; NR Description: VHS domain-containing
  misc_feature: GI Number: 42571359; NR Description: VHS domain-containing
  misc_feature: GI Number: 50906855; NR Description: putative VHS domain-containing protein [Oryza sativa (japonica cultivar-group)] >gi|47848044|dbj|BAD21829.1| putative VHS domain-containing protein [Oryza sativa (japonica
MSDNLMEKVNALGERLKITGSEVSKQMQAGMSSMSFKMKELFQAQTPADKIVEDATAETLEGPDWAANLEICDLINTEKVNSVDLIRGIKKRIMLKEARVQFLALFLLETIVKNCEKAFSEVAAERILDEMVRLIDDPQTVVNNRNKALTLIEAWGESGDELRYLPVYEQTYKSLKSRGIRFPGRDNESLAPIFTPPRSVAEAEVAANFSQQTFEDVHVHTYTAEETKEAFDVARNSMELLSTVLSSSPQQDALQDDLTTTLVQQCYQSQHTIQRFIETAGDNEALLFEALSVNDEVLKVLSKYEEMKKPMASARTEQPVVIPIATEHEDSVTVGNEDALVRKPAAARAMSGGDDDILDDLDEMIFGKKGGSSSQDVSKRQDPKKDDLINF

SEQ ID NO: 3845 - DNA, 1207 bp, Triticum aestivum
  misc_feature (1)..(1207): Ceres cDNA ID no. 21665939
  misc_feature (1)..(1207): Ceres CLONE  ID no. 864823
  misc_feature (1)..(1207): Also known as  Ceres CDNA ID no. 24360276
cccacgaaaaagatcccccgagaagaccaaaccgagctcagcaacctccaccatgtccatgtccatggccaccaccaccctcctccggctcgcgccgctgccgccgcacccccgcctcctcgccccgacctccaagaagcccgccctcctcgcgcccctcggcagcggccgccgcgccctgcggctcgcgagggccgccggcgacgggctcgtggaccagaccgtctacaacggcgtgtacgggccctggtcggtggacgacgccgacgtgcgggaggtgctgctgtaccgggccgggctggtcacggccgccgcctccttcctggtggccgcctcggggtcgttcctgccggaggggaacgcggtcggcgacgccgtccggcggggcgccgacctcttcttcgccgccggggcaggggggctcgggctgtcgctcgtgctgatccacatctacgtcacccccatcaagcggttcctccaggcgctctgggcggtcggcgtgctcggctccgtcggcacctacgccctcgccgcgcggccgctcgacgaggggctcgtccggtacgtgctggagcaccccggggcgatgtggttcgtcggcccgaccttcgcggcgctcacaggcctcgtcttcaaggaaggtctctgctatggaaaattagaagctggtatcttaacgtttgtcatccccatccttcttcttggacacctgtctggtttgatgaacgacgggacaaaaatgagcctcttaggagtgtggatggcgctcttcaccgtgttcgccgcgaggaaattccagcagcccatcaaggacgacattggcgacaagtcggttttcatattcaacgccctccccgaagaggaaaagaaggctctgctgcagaggcttgaggcaccaactgagcagaagttcgattaacaggtactaggacagtgtcaatacctagtcgatggatgtccggatcagcgcttccatgaagaggaatggaaactttgccactgaagctcgagatcggcgaactgagcagaaacttgaatagctgtaggtagcacaatgcagatagctagttgcgaccgatggatgtatgtaactgttctgcatggtcgttctggagaccagtgcgcatgccagtatgtatagatgagaaccttggaactgtgatgtagttgcatatcttttccttgacggccaaaaaaaaaaaaaaaa

SEQ ID NO: 3846 - protein, 288 aa, Triticum aestivum
  misc_feature: PFam Name: Cation_efflux; PFam Description: Cation efflux family
  misc_feature: GI Number: 46117678; NR Description: COG5413: Uncharacterized
  misc_feature: GI Number: 33863806; NR Description: conserved hypothetical membrane protein [Prochlorococcus marinus str. MIT 9313] >gi|33635389|emb|CAE21714.1| conserved hypothetical membrane
  misc_feature: GI Number: 23124217; NR Description: COG5413: Uncharacterized
  misc_feature: GI Number: 45505614; NR Description: COG5413: Uncharacterized
  misc_feature: GI Number: 48890828; NR Description: COG5413: Uncharacterized
MSMSMATTTLLRLAPLPPHPRLLAPTSKKPALLAPLGSGRRALRLARAAGDGLVDQTVYNGVYGPWSVDDADVREVLLYRAGLVTAAASFLVAASGSFLPEGNAVGDAVRRGADLFFAAGAGGLGLSLVLIHIYVTPIKRFLQALWAVGVLGSVGTYALAARPLDEGLVRYVLEHPGAMWFVGPTFAALTGLVFKEGLCYGKLEAGILTFVIPILLLGHLSGLMNDGTKMSLLGVWMALFTVFAARKFQQPIKDDIGDKSVFIFNALPEEEKKALLQRLEAPTEQKFD

SEQ ID NO: 3847 - DNA, 1062 bp, Triticum aestivum
  misc_feature (1)..(1062): Ceres cDNA ID no. 21665940
  misc_feature (1)..(1062): Ceres CLONE  ID no. 878756
  misc_feature (1)..(1062): Also known as  Ceres CDNA ID no. 23561526
aaaaacaccagttcttccccaaatcttgcaaaacctaaccctcagccccgaccacacggccgccgccgccaccaaccactcgaccgcagcgccggcttcctcccggaacacagtcgccgccgaccgcctagtcgtcgccgagcacccttctctaccaaggaaaccttcgccgcttcgtccccatcccccgcgcacctagcgcctgcttcctcccgaggaatgccgcagaccgccctccatccccaccacaacagcgacctcctccacaggtttcctccgccgagcaggcctcctcctcctcaagctttctcccccgaacagggcctcctcctccacgagcatccttccccgagcactaagttgggccgcatcctggttccctcacccgagcagcggaccttcctgtacggcccctctcctgagaagctccacctcctctacatcctcccccaggtgcagcgccacctccttgctcaccgagagcacttggctgtgtgcatcttgtttgtcctctccaccaagcagcatcggctactccatacaagcacataagcttatgctcttatgattatatatttaccaatgactattatggttgatagttttaaagtctttgcttctatctatgcagttgagaatgacttataagttcatggcaaaagcagcaacatgagtacgcaaccacaagcaagctgaggggttatttctagacaaaactttaggaaccgagttcactacaactcgaagtcttgtgcatggaggagaattgagatatttgcgcattctgtactggtcaaaaggttggcatcatggttggaagatcttctatgctactctctacatgatgtttcttctacatgatagcgcttgaagtctacatgatgtttcttgtattcatagctcaaaccatttgtttagcttagtttgaacaaaaaatattattgtcttacatgtaaataatgtttactaatgtagctggatgctactgaacgcatgtacgaaagtcaaaatactaaagtgttagtcattacgtgtttgacaaaaaaaaaaaaaaaaaaaaaa

SEQ ID NO: 3848 - protein, 110 aa, Triticum aestivum
  misc_feature: PFam Name: Extensin_2; PFam Description: Extensin-like region
  misc_feature: PFam Name: Drf_FH1; PFam Description: Formin Homology Region 1
  misc_feature: PFam Name: FH2; PFam Description: Formin Homology 2 Domain
  misc_feature: PFam Name: Pyr_redox_2; PFam Description: Pyridine
  misc_feature: PFam Name: LMBR1; PFam Description: LMBR1-like membrane protein
  misc_feature: GI Number: 14253159; NR Description: VMP3 protein [Volvox
  misc_feature: GI Number: 6523547; NR Description: hydroxyproline-rich
  misc_feature: GI Number: 50940371; NR Description: putative pherophorin-dz1 protein [Oryza sativa (japonica cultivar-group)] >gi|42408241|dbj|BAD09398.1| putative pherophorin-dz1 protein
  misc_feature: GI Number: 28912428; NR Description: serine-proline rich
  misc_feature: GI Number: 49182258; NR Description: serine/proline-rich
MPQTALHPHHNSDLLHRFPPPSRPPPPQAFSPEQGLLLHEHPSPSTKLGRILVPSPEQRTFLYGPSPEKLHLLYILPQVQRHLLAHREHLAVCILFVLSTKQHRLLHTST

SEQ ID NO: 3849 - DNA, 1126 bp, Triticum aestivum
  misc_feature (1)..(1126): Ceres cDNA ID no. 21665941
  misc_feature (1)..(1126): Ceres CLONE  ID no. 883701
  misc_feature (1)..(1126): Also known as  Ceres CDNA ID no. 0
acagctcgccgcttatcgcacagcgcagagctcgatcgaggtgcaacactctgctagattacatcacatagctagcttggtttagctgctgccacgcacggaaactactggtactagctagctaggtagctacgtgatcgtgatcatggccttagtgcgggagccgatggtgatgtacgacggcggcttcgacgccgaagcatccgcgttcgacgcgctcggctacagcggccacgacgcgctgctcggaggcgtcgacgcggcggcgctcttcgggggctacgcctacgcccacgacgagccaaccggcgccgccagcgcctacgtgcggaacagcgcgagctgggcgagcgcggggccttcagtgctctcgttcggccacggcgcgcggggccacgcggcccagcaggaggtcgtggaggaggagcccgactgcgacgcgtgggtggacgacatggacgtagatcagggccatcagcacgcggcgccggcgtcgaccatagggtttgacccggccacgggctgcttcagcctgactcagagttccgtcggcgcgcggcggccgttcgggctcctgttcccgggcacgtccaatggctcgcccgatgccgcgacgccggcgcgcggttcctcgaagcgatcgtacgcggaccaggacgcggagccgcggaccaccaagaagccgtgcggtgcgagcaggaagacgagcaaggcgaagccggcggcgcccaccactacctcgcccaagggggacccgcaaagcctcaccgcaaagaaccggcgggagaagatcagcgaacggctccggacactgcaggagctggtgcccaacggcaccaaggtcgacatggtcaccatgctcgagaaggcattcagctacgtcaagttcctgcagctgcaagtcaaggtgctggcgacggacgagttctggccggcgcaagggggaacggcgccggagatctcccaggtgaaggaggcgttggacgccatcttatcgtcgcagagggggcaactgaactgaactgcttagctagcctccgtggcaaacatatggtagagattaatcagtaacgaaccacctcgttcgaagataaataaggaggcatatgcaaaaaaaaaaaaaaaa

SEQ ID NO: 3850 - protein, 291 aa, Triticum aestivum
MALVREPMVMYDGGFDAEASAFDALGYSGHDALLGGVDAAALFGGYAYAHDEPTGAASAYVRNSASWASAGPSVLSFGHGARGHAAQQEVVEEEPDCDAWVDDMDVDQGHQHAAPASTIGFDPATGCFSLTQSSVGARRPFGLLFPGTSNGSPDAATPARGSSKRSYADQDAEPRTTKKPCGASRKTSKAKPAAPTTTSPKGDPQSLTAKNRREKISERLRTLQELVPNGTKVDMVTMLEKAFSYVKFLQLQVKVLATDEFWPAQGGTAPEISQVKEALDAILSSQRGQLN

SEQ ID NO: 3851 - DNA, 1409 bp, Triticum aestivum
  misc_feature (1)..(1409): Ceres cDNA ID no. 21665942
  misc_feature (1)..(1409): Ceres CLONE  ID no. 885628
  misc_feature (1)..(1409): Also known as  Ceres CDNA ID no. 24357245
gttttctttgccaccctgcccgcccgtccctcgccgatcgatgaccgcacctcccaccacatctgactaactccggccagggacgcatcgccttgcctgtatatataggagcgagcggacgacccgcgcgccccatcaatcgccatggctgtggacctgcaacgccttcgccacatgttactcaccaccggcgacggcggcggtcaccaccagctctactccgccgctgctatgccagcgagtgggccttgttatggcgctgcggtgtcgtgcgagcgggggcaccagccgtacgcggacctcttcacgctgccgccgccgccgacgatgacttcggccccgtatcagtgttcagagttcttggcgatggacgcggttgatctggctaagaagggcggcaaccccgacggtgttcaggaaatgatcaccaagaagcggaggcgcgaggagcggtcgtcgatgcttagcgcggccgacgctcttgcggcccacgcgcagcagcagaccatcgacgtccaccgcatcctgctcaaacatgcgcaaaagatgtggactactctggcggagcagaggcagagccacacgaggctcatcgtgtggaccgtggaggccagggcggcgaagcggctcaaggccaaggatgaggacattgagcggatcaggagcatgaactgggcgctcgaggagcgtcttcggaacctcctcatggaggctcagatgtggcgcgatgtcgcgcagtcccatgaggccacggccaacgtgctccgcggcgacctacagcgggcgctcgactcccaggcggttcgtggcggtggaagcgacgacggtcaggaggacgacgccgagtcgtgctgctggggagagaagcaggtgcctttgtgcgcggaggaggaggtgggcacgccggtagtggaggagcgtcacgcgacaggagcaggaaggtgcaaggggtgccgcgagggcgcggccgttgtgctgctgctgccgtgcaggcacctctgcgtgtgcgcgccgtgcgcggccgcggcgcaggcgtgcccggcgtgcggaagcgccaagaatggcatcgtctgcatcaacttttcgtgatgcgggaggaatagttttagagtagacattttgtttccttctgaaacttactagagtcgacttttgtttgtattcttttgttcactttttctattgttgttgaccgaaagcggctcctctgccatgcgccgtgtgaggttgggctgctgacatgtgggccaggttttcaacgggtccacatgtcaatggtagaacgatagggtgccgaaggttagagtatcctcctacttgtgttgacgggatgataaataggaggatggttggatcacatagatatgagaggacttgtatcccctttttgtttaaaaaaaaaaaaaaaa

SEQ ID NO: 3852 - protein, 314 aa, Triticum aestivum
  misc_feature: GI Number: 21617976; NR Description: unknown [Arabidopsis thaliana]
  misc_feature: GI Number: 21593126; NR Description: inhibitor of
  misc_feature: GI Number: 50909081; NR Description: SBP1-like [Oryza sativa (japonica cultivar-group)] >gi|49388268|dbj|BAD25386.1| SBP1-like
  misc_feature: GI Number: 45602841; NR Description: S-ribonuclease binding
  misc_feature: GI Number: 45758663; NR Description: S-RNase binding protein
MAVDLQRLRHMLLTTGDGGGHHQLYSAAAMPASGPCYGAAVSCERGHQPYADLFTLPPPPTMTSAPYQCSEFLAMDAVDLAKKGGNPDGVQEMITKKRRREERSSMLSAADALAAHAQQQTIDVHRILLKHAQKMWTTLAEQRQSHTRLIVWTVEARAAKRLKAKDEDIERIRSMNWALEERLRNLLMEAQMWRDVAQSHEATANVLRGDLQRALDSQAVRGGGSDDGQEDDAESCCWGEKQVPLCAEEEVGTPVVEERHATGAGRCKGCREGAAVVLLLPCRHLCVCAPCAAAAQACPACGSAKNGIVCINFS

SEQ ID NO: 3853 - DNA, 1700 bp, Triticum aestivum
  misc_feature (1)..(1700): Ceres cDNA ID no. 21665943
  misc_feature (1)..(1700): Ceres CLONE  ID no. 886372
  misc_feature (1)..(1700): Also known as  Ceres CDNA ID no. 24357264
acaccacacctcacctcatcgcagtttcatcacaaatccaaaacaaaacgtctccgccgacgacccgcatccgatagcccccttctccgcgccttctccggcgagaagcacccacaacggtctcaccggcggccatgccggctacggactaccagggctcctcctcctcctcccactccccgttcgcctccttcggccgctcgctgctgtctcgaagccgggacaccccggcgtcccccgccatgcttccgtccagcggggaggccgaggtcgaggcgttccagcggcacgtggccgttagcctcgcggagctgagggacggggaggatttcctctccatcgcgtggatccggcagctcctcgaggcgttcctgctgtgccaggaggagtttcgggcggtggcggccgaagtgcggcgccgcggctgtggaggcgcgctggcggagaggctggtgggcgagtaccacgagcgcgcggtgaaggcgctcgacgtgtgcaacgccgcccgcgacggggttgaccaggtccggcgctgggggcggctcgccggcatcgcggcgtccgtgctgctcgcccccgaggagatccacgagggccagctccgccgcgcgaggaaggcgctgtccgacctctcgatcctcctcgtcgacgacgcggccgccgccgggggcgggggcggcgtcgcctccttcctggcctcacaccgcaaccgctccttcggccgcgggagccgcgcgtccccgtctcgcgcgtcctccgcctcctcctcgtcgtcctcctcctcgcacttccgctcgctctcgtggagcgtgtcccgcacgtggtcggcgtcgcggcagctgcaggccatcgggtccggcctggccgcgccgcgcgcgcacgaggcgggcctcgccgcgcccgtgtacgcaatgggatgcctgctgcacctcgcctcgtgggcgctcgtcgcggccgtcccgtgcccggaccgcgtcgcggcgctccaagcgcaccacctccccgcggcaccgccgcgtggggcattcgcgtgggcgccgccgctcctgacgctccaggaccgcctcaccgaggagggaaagcgcaaggacaggcgcaattcctgcggcctcctcaaggaaatccacgcgctcgagaagtgcgcacagaggctcgccgaggcgatcgacgcagcgcccatcccgctcaccggagagagggaggccgcggtgcgggaggccgccgcggagcttgccgccgtatgcagcgccatgaaggacggcctggagccgctggaaaggcaggtccgggaggtgttccaccgcattgtgcgcagccgcatggagggcctcgactcgccgatgcccaacgccgccgactgaaccatcaagaatccgcattttggccgcgcgctgcggcggcgataggtagcctcctgtccgtggtttttgatcacccgtgatctgtctcgcagtcagtagtagcaagtttaaaatgtgtatccttctgtaaaggaaaggggaaagggaaggaaccatctttctgcaaagatttattccttcttctcatgttttgatgctgcatttggtgtgtatcatcagatttttgttagtcgcctaccacatgtgcgcgcggctaattcttgagttacttgcgtctgtgagctctgcgatgtcgcttgctctgatcttagaatgtcatataaaaaaagaaaaaaaaaa

SEQ ID NO: 3854 - protein, 408 aa, Triticum aestivum
  misc_feature: PFam Name: FH2; PFam Description: Formin Homology 2 Domain
  misc_feature: PFam Name: MCPVI; PFam Description: Minor capsid protein VI
  misc_feature: PFam Name: Peptidase_S8; PFam Description: Subtilase family
  misc_feature: PFam Name: Extensin_2; PFam Description: Extensin-like region
  misc_feature: PFam Name: Transformer; PFam Description: Fruit fly
  misc_feature: GI Number: 62732989; NR Description: CAA303718.1 protein
  misc_feature: GI Number: 5777630; NR Description: CAA303718.1 protein
  misc_feature: GI Number: 21536674; NR Description: unknown [Arabidopsis thaliana]
  misc_feature: GI Number: 21593634; NR Description: unknown [Arabidopsis thaliana]
  misc_feature: GI Number: 66776103; NR Description: LigA [Anaeromyxobacter dehalogenans 2CP-C] >gi|66858140|ref|ZP_00402169.1| LigA
MPATDYQGSSSSSHSPFASFGRSLLSRSRDTPASPAMLPSSGEAEVEAFQRHVAVSLAELRDGEDFLSIAWIRQLLEAFLLCQEEFRAVAAEVRRRGCGGALAERLVGEYHERAVKALDVCNAARDGVDQVRRWGRLAGIAASVLLAPEEIHEGQLRRARKALSDLSILLVDDAAAAGGGGGVASFLASHRNRSFGRGSRASPSRASSASSSSSSSSHFRSLSWSVSRTWSASRQLQAIGSGLAAPRAHEAGLAAPVYAMGCLLHLASWALVAAVPCPDRVAALQAHHLPAAPPRGAFAWAPPLLTLQDRLTEEGKRKDRRNSCGLLKEIHALEKCAQRLAEAIDAAPIPLTGEREAAVREAAAELAAVCSAMKDGLEPLERQVREVFHRIVRSRMEGLDSPMPNAAD

SEQ ID NO: 3855 - DNA, 1554 bp, Triticum aestivum
  misc_feature (1)..(1554): Ceres cDNA ID no. 21665944
  misc_feature (1)..(1554): Ceres CLONE  ID no. 886426
  misc_feature (1)..(1554): Also known as  Ceres CDNA ID no. 24411222
agcttggtttttcccccttcagtcggcggcgcctctagggttttgacttctcatccttctgatgacttgtgttgctctgtccgatctgcacgtcggctgggacaaacagtctgtctgtgtccgcctatcacgcctatggcattaccgtggtggtttggagaatggacctgtcaaagttgtgcacatggttcttctggatgctcaggtcataaagaactgtttccacctaaacgacgagttcccggagtggacattccacttgactccaattaacgagctaccccctgcaaatgatactcctcagaactacatagatgttatcggagtcattgcggcaatctctcctatgaaagctattcgggtgcctcacacacttagccgagtattcaagcgacatgtactcctatctgatgataatggcaatgagcttgggataaccctttggggtgaaagagttgttcgatttaacggagaaagtgttcattttatgggtcaaacagaaccagctgtagtcatctttgttggcgccaccgtttttgttaatgaaggatctaaagaattgtctggaggatgtgcctgcaaatggtatgtcaaccatgatataccagatataagtgtatttaggagcaggctcccgccctcgttcccagcaattgagcaccttcctgcgccgtctaggattgtcctccaggcccaacatgatgatgtccttcctacgtcgttattaatccatctcatgaacattaatttatatcacaaggaggcaggtacgtttcgatgcaatgtgacggttacaagggtttcgcatttgaaaaaatggtgggccaccttctgtacagactgccactatatgtccatgccagctgcgacgtcactcagtcagcctgatgtatatacatgtggacgtcgtagatgttcatgtaccagtgcaacagtcgggtacacattatttgtccttgcaaaagaccgaagcggagaagccgagtttgagttgtttggagcaaaagggcagcagattgtcggtcgatctgctggccaggtcattcgcaacaacatgcgtcatgaccctactattcacaatgttcatgtggcggcctcgatggtcaggaaaattcctcctgaacttttaggcttgcttggcatgaaatgcacgtttcatgttcgtgcgtcatctgacggcttctttggaaggtggccggcgtttcatgtcaatgctattgaatcattcgaggctctgaagaccaacctctctgtcatggatctgcttaccccatcgtgaagccacaccgccgtgcaactgctcatgaaatcaatgtagatgttccatgcagttgatctgtaccctgctaactgccctcttgatcttttggcctaaacctttttattacgatgaatgtagatacaccagtatgtatggaccaccttatattagctacgcctttgttatcttttgccttaggctcaggctactctcaaaaagacgataagataaggcattttttcacattccagttggctggctgatcaatttattttccaaaaaaaaaaaaaaaa

SEQ ID NO: 3856 - protein, 405 aa, Triticum aestivum
  misc_feature: GI Number: 56784643; NR Description: helicase-like protein
  misc_feature: GI Number: 50920381; NR Description: Putative helicase [Oryza sativa (japonica cultivar-group)] >gi|24960752|gb|AAN65446.1|
  misc_feature: GI Number: 34915272; NR Description: DNA binding protein-like [Oryza sativa (japonica cultivar-group)] >gi|22831301|dbj|BAC16155.1| DNA binding protein-like [Oryza sativa (japonica cultivar-group)] >gi|24414047|dbj|BAC22296.1|
  misc_feature: GI Number: 57899664; NR Description: DNA binding protein-like [Oryza sativa (japonica cultivar-group)] gi|57899579|dbj|BAD87158.1| DNA binding protein-like [Oryza sativa
  misc_feature: GI Number: 34905810; NR Description: P0401G10.31 [Oryza sativa (japonica cultivar-group)] >gi|15289920|dbj|BAB63615.1| P0483G10.9 [Oryza sativa (japonica cultivar-group)] >gi|20146241|dbj|BAB89023.1| P0401G10.31 [Oryza sativa (japonica
MTCVALSDLHVGWDKQSVCVRLSRLWHYRGGLENGPVKVVHMVLLDAQVIKNCFHLNDEFPEWTFHLTPINELPPANDTPQNYIDVIGVIAAISPMKAIRVPHTLSRVFKRHVLLSDDNGNELGITLWGERVVRFNGESVHFMGQTEPAVVIFVGATVFVNEGSKELSGGCACKWYVNHDIPDISVFRSRLPPSFPAIEHLPAPSRIVLQAQHDDVLPTSLLIHLMNINLYHKEAGTFRCNVTVTRVSHLKKWWATFCTDCHYMSMPAATSLSQPDVYTCGRRRCSCTSATVGYTLFVLAKDRSGEAEFELFGAKGQQIVGRSAGQVIRNNMRHDPTIHNVHVAASMVRKIPPELLGLLGMKCTFHVRASSDGFFGRWPAFHVNAIESFEALKTNLSVMDLLTPS

SEQ ID NO: 3857 - DNA, 1141 bp, Triticum aestivum
  misc_feature (1)..(1141): Ceres cDNA ID no. 21665945
  misc_feature (1)..(1141): Ceres CLONE  ID no. 889016
  misc_feature (1)..(1141): Also known as  Ceres CDNA ID no. 24361169
agcagattactaggccgagaagatggaagcactccggccgttatccataacggccgtggcggcgcttctccgtgctccccccgtgccgatttctaccttcgttggtactggtagggaagtgggcggtaggcgagggaagagtgtgagagctggcgcaggctggctgtggggcctgctgggccggaagggcggcggcggtgcgcccacggcgatgacggtgacaccagggaccgtgaaggccggcgatcccgtgcttcacgagccggcacaggaggtgtcccctggggacgtgccttccgagaagatccagggcgtcatcgatcagatgatcgctgtgatgcgcaaagcccctggcgttggcctcgccgccccacagatcggcgtgcctttgaagattattgttctcgaggacacccaagaatacatcagctatgcttccaaggaggacatcgatgcacaggatcgccgttcctttgatcttcttgttgttatcaatcccaagcttaggaagacgagtaaaagaactgcacgtttctatgaaggatgtcttagtgtcgatggatatagagcggttgttgagcgtcatttggatgttgaggtttcgggtttcgaccgaaatggacatcccatgaaggtggaggcatcaggatggcaggcacgcattctgcagcatgagtgtgatcacctcgaaggcacattatatgttgacaagatggttccgaggacattcaggacagttgataacttgaatctgccacttgccactggatgtcctcctctaggtgcatgatagcattgatgacattctagtttttctattcaagtataggtaatcgtttgtagtatttgcaacttttttgctccagtgcaatatcataatatgtctttacccatttattgtcatggatgtacatcatgtggtgatacacatgcaaataattgctgctttgtaaatctagttgtcaaatgtcaaccaatgttgacactctttgaatgtaacatgatcggtacatgacttttgaaacaagaagttgccattttatctacatactaggtttttctatctcagttttgtccatcatttgaatgtgcaaaactgtacacctgaaaaaaaaaaaaaaaaaaaaaaaaaaaaaaaaaa

SEQ ID NO: 3858 - protein, 255 aa, Triticum aestivum
  misc_feature: PFam Name: Pep_deformylase; PFam Description: Polypeptide
  misc_feature: GI Number: 34913982; NR Description: peptide deformylase-like protein [Oryza sativa (japonica cultivar-group)] >gi|20146289|dbj|BAB89071.1| peptide deformylase-like protein [Oryza sativa (japonica cultivar-group)]
  misc_feature: GI Number: 17433049; NR Description: Peptide deformylase, mitochondrial precursor (PDF) (Polypeptide deformylase) >gi|11320968|gb|AAG33981.1| peptide deformylase-like protein
  misc_feature: GI Number: 22136570; NR Description: At1g15390/F9L1_34 [Arabidopsis thaliana] >gi|13605760|gb|AAK32873.1| At1g15390/F9L1_34 [Arabidopsis thaliana] >gi|17433051|sp|Q9FV53|DEFM_ARATH Peptide deformylase,
  misc_feature: GI Number: 11320952; NR Description: peptide deformylase-like protein [Arabidopsis thaliana] >gi|18394237|ref|NP_563974.1| peptide deformylase, mitochondrial / polypeptide deformylase 1A
  misc_feature: GI Number: 53804337; NR Description: polypeptide deformylase [Methylococcus capsulatus str. Bath] >gi|53758098|gb|AAU92389.1|
MEALRPLSITAVAALLRAPPVPISTFVGTGREVGGRRGKSVRAGAGWLWGLLGRKGGGGAPTAMTVTPGTVKAGDPVLHEPAQEVSPGDVPSEKIQGVIDQMIAVMRKAPGVGLAAPQIGVPLKIIVLEDTQEYISYASKEDIDAQDRRSFDLLVVINPKLRKTSKRTARFYEGCLSVDGYRAVVERHLDVEVSGFDRNGHPMKVEASGWQARILQHECDHLEGTLYVDKMVPRTFRTVDNLNLPLATGCPPLGA

SEQ ID NO: 3859 - DNA, 1209 bp, Triticum aestivum
  misc_feature (1)..(1209): Ceres cDNA ID no. 21665946
  misc_feature (1)..(1209): Ceres CLONE  ID no. 890485
  misc_feature (1)..(1209): Also known as  Ceres CDNA ID no. 23476113
ccacatcacacaagctcagtctagatcgagtaggtagaagcccactgatctactccacttagcattgtactccatccttgtccatggaaactcaccccaacttccatgctagtccattcgatggttccgtggaaaacactgagtttaagttcagtagcttgtacctgcaccacattttcagtggatcaaacccaacccaagcaaacatcatagttggagatgctaccactaagttgggcaggacatcagttcacgactgggccatatatgatggggttggcaccgacgccaagctagtgggccgtgcacaagggctgcatatcaacgctggtagttggcacaatacgttcaccattcgattcgagattgaaaggttcaagaagagcacacttcaggtaatgggagaatctgtagcccaagaaggtgagtgggctattgccggtgggacaggtgaactcgcaatggcatgtggtgttatacacaaaacatggcatcaggaaacagatggtggtaccataatccaacttaacatccatggattctgccgcatgaagctacccattctcacaaagagtggcccctggggtggcaaggagggttctgctgttggcatggaaaaaccctccaagattgcaagtatcgccatccactatcaagaaagaattgattcatttgaatataattactttgaccaatatggcaacagccgttacacaaatatttggggcactaagagtcccaatcgcgcagagattgtgttgggccctgaagaaattgtgaccgcaatgtctggaactgttatcgaacataataatatcaatgttatacagacattgaagtttaccactaacgaaagaacatacggaccttatggaaatactgaaaatatacaaggtggtacagtacacaatttcagcgctgtgatgccaaatggtcaagcaattgttggcttctttgggcatactgatatgacatgcttgaatggaataggtgtttacgtagcctaggtaatttcaagagattttatttcatccatatgtggtttaagttgagtgttccttcaactaaaataaaatggttaaggatatctgaccggttttctgattattttcccttttattcatctatgggtggtttgttgtcacctaccgtgtttctttatttgaataataataaagtttctttaaaaaaaaaaaaaaaaaaaaaaaa

SEQ ID NO: 3860 - protein, 307 aa, Triticum aestivum
  misc_feature: PFam Name: Dirigent; PFam Description: Dirigent-like protein
  misc_feature: PFam Name: Jacalin; PFam Description: Jacalin-like lectin domain
  misc_feature: GI Number: 16151819; NR Description: VER2 [Triticum aestivum]
  misc_feature: GI Number: 38455904; NR Description: jasmonate-induced
  misc_feature: GI Number: 1167953; NR Description: putative 32.6 kDa jasmonate-induced protein [Hordeum vulgare] >gi|7489385|pir||T04374 jakalin homolog - barley >gi|2465426|gb|AAB72096.1| 32 kDa protein
  misc_feature: GI Number: 1167955; NR Description: putative 32.7 kDa jasmonate-induced protein [Hordeum vulgare] >gi|7489383|pir||T04375 jacalin homolog - barley >gi|2465428|gb|AAB72097.1| 32 kDa protein
  misc_feature: GI Number: 9313027; NR Description: beta-glucosidase
METHPNFHASPFDGSVENTEFKFSSLYLHHIFSGSNPTQANIIVGDATTKLGRTSVHDWAIYDGVGTDAKLVGRAQGLHINAGSWHNTFTIRFEIERFKKSTLQVMGESVAQEGEWAIAGGTGELAMACGVIHKTWHQETDGGTIIQLNIHGFCRMKLPILTKSGPWGGKEGSAVGMEKPSKIASIAIHYQERIDSFEYNYFDQYGNSRYTNIWGTKSPNRAEIVLGPEEIVTAMSGTVIEHNNINVIQTLKFTTNERTYGPYGNTENIQGGTVHNFSAVMPNGQAIVGFFGHTDMTCLNGIGVYVA

SEQ ID NO: 3861 - DNA, 1696 bp, Triticum aestivum
  misc_feature (1)..(1696): Ceres cDNA ID no. 21665947
  misc_feature (1)..(1696): Ceres CLONE  ID no. 892120
  misc_feature (1)..(1696): Also known as  Ceres CDNA ID no. 24360378
acttctccaccgtgactgcgactgccactgcgactgcgactgctctctcctgactggagtcagtgtctcgggtgctgctgacccgccgtcttctccgcttgccgtgccgccatcgccatggatggggtttcgacggagcctcgccacccgctcctgcaggccgttctcgacggcgacctccgcctcctcaaagagatggcgggcgtcgtggcggcggacgtcggcatcagggcgcgcgcgctgactgtggcggtcatggaagggcggctggacatctgtaggtgcctcgtcgaggaccacggcgtcgatgtcaaccagcgcaccttcacaggtgacactcctctggccatttctacgacttatgggacgcctgctaccaccagatatcttctggatcgtggtgctgatccaactttagctggtgccctgtggccacctcttcatgctgctgcaatttttggacaatgtgagatagtggaattgctgctttcaactggaattgatgtggatcatttcgattctgtgtatgggaccgcattgcatgttgccgctactaatggtcaagatggctcgatgaatattttgttgcagcatcatgcagatcccaataaggttttccgccttgatagtaccccgttaaggctggccatgatttctgaatcactggaatgtgtgaagctactcattaaggctggcgctgatgtgaataaaattgactatactggtgttacttacttgatgatagcagcgggcaatggcttatctgataccctgaaatgcttactagatgctggcgctaacccagatattgatgatgggtttggtacaactccaatcgaaattgccgccctccaagccagatgggatatggttgcgatgttatttcctttaacttctcccatttcaagattgccggattggagtgttgatggaattatttctcatgtgcaatctttcggtttgaagccgagggatatacatctatgtgaagcgaaaagagctgaactaaagttgcaagctacagaggcttttaagagaaaggaatatatcatagcaggagacctatatacttgtgcaatgagttttcagcctagtccaaaaggtcttgcaaacctgctagcacataggagtttctgtatgttgcacgcgggaataggaaaagaggctctctccgactctgctaggtgcacagtgctacgacctctttggcccaaaggttactatcgactaggagcagcctttatgttgctacaggactatggaaaagcagctcagacgttcgaagctggcttgaaactggaccctacaaatgcggatatggcaaacgctttaagggaagcccaagagacggcgaggaatcctcctcgcaccagggggctggagtgccttcacccatttggaatgagacgttcctggagtgattgaggcgctgtttcgttgctatgtccagtccagggtatgcatgcctgcctgttattctcttttcctatgtccagtccaaggtatgcgtgcctgttattctctggagagactgagactctgtttcgttgcttaagactctgttttgtgttgaaccgtccaagagtactgatctcatgtgctatattgtagaccgtgtaaacatggctatctgtacattgtggttatatgtcgtctccgtgaaccattgtggttatatacaaaaaaaaaaaaaaaa

SEQ ID NO: 3862 - protein, 435 aa, Triticum aestivum
  misc_feature: PFam Name: TPR_2; PFam Description: Tetratricopeptide repeat
  misc_feature: PFam Name: TPR_1; PFam Description: Tetratricopeptide repeat
  misc_feature: PFam Name: Ank; PFam Description: Ankyrin repeat
  misc_feature: GI Number: 50898666; NR Description: ankyrin repeat protein E4_8-like [Oryza sativa (japonica cultivar-group)] >gi|47497788|dbj|BAD19887.1| ankyrin repeat protein E4_8-like
  misc_feature: GI Number: 50898646; NR Description: ankyrin repeat protein-like [Oryza sativa (japonica cultivar-group)] >gi|47496993|dbj|BAD20103.1| ankyrin repeat protein-like [Oryza
  misc_feature: GI Number: 50908589; NR Description: putative ankyrin-like protein [Oryza sativa (japonica cultivar-group)] >gi|47848270|dbj|BAD22094.1| putative ankyrin-like protein [Oryza
  misc_feature: GI Number: 27542768; NR Description: ankyrin-like
  misc_feature: GI Number: 50898656; NR Description: ankyrin-like protein [Oryza sativa (japonica cultivar-group)] >gi|47497783|dbj|BAD19882.1| ankyrin-like protein [Oryza sativa
MDGVSTEPRHPLLQAVLDGDLRLLKEMAGVVAADVGIRARALTVAVMEGRLDICRCLVEDHGVDVNQRTFTGDTPLAISTTYGTPATTRYLLDRGADPTLAGALWPPLHAAAIFGQCEIVELLLSTGIDVDHFDSVYGTALHVAATNGQDGSMNILLQHHADPNKVFRLDSTPLRLAMISESLECVKLLIKAGADVNKIDYTGVTYLMIAAGNGLSDTLKCLLDAGANPDIDDGFGTTPIEIAALQARWDMVAMLFPLTSPISRLPDWSVDGIISHVQSFGLKPRDIHLCEAKRAELKLQATEAFKRKEYIIAGDLYTCAMSFQPSPKGLANLLAHRSFCMLHAGIGKEALSDSARCTVLRPLWPKGYYRLGAAFMLLQDYGKAAQTFEAGLKLDPTNADMANALREAQETARNPPRTRGLECLHPFGMRRSWSD

SEQ ID NO: 3863 - DNA, 883 bp, Triticum aestivum
  misc_feature (1)..(883): Ceres cDNA ID no. 21665948
  misc_feature (1)..(883): Ceres CLONE  ID no. 892703
  misc_feature (1)..(883): Also known as  Ceres CDNA ID no. 24357351
gttcgttccccagcagaggaagatacaacccagggagagaagagaaggggtccgagaagagaggagaagagaagagaatccaaggaacgagccggcggcgatggcgtggcgggcgagcctatcccggaacgtgaaggagatccgcttcctcttcttcttcttcgttctcttcagatccccggaagcgccagacccggagcaactgagcagcaagttctcgggcatggacgacgacggcgactggatcgcggcgaggtacctcctctcctccatcctcggccggaacccgctcgtggtcgaccacgtcgacgaggagtccttcccggtcgaccacgcccccgccgccgccgcccgcggcgggccggcggaggcgccggtgtggcagcagccgccggctgtgttcgcggtgccgagcctggccggcactgtttgcgcggtgtgcacggaggagatcgcggtggcggaccccgtggtgcggctgccgtgcgcgcactggtaccacgccggctgcatcgcgccctggctcgggatccggagcacctgccccatgtgccgcgccgagctgccggccagggaggaggccggcggggccggcgccgtcggccgcgagaagcccccgcgcgccgaggccgggaccagcgccgccggcgtgcggcgggacgcgtcgtcgtacggggggtacgtcgccgccgggggcgtcctgtccggctgatggacgggcgagcgggccgtggtggaccgcgtcgtcgtgcgcgcgccatggcttttgtctatttttttcttcgccggaggagtgctgctcgatacctgttgtacaaatgaaaaaatggttaattattaacatgatgttgattcttgaaaaaaaaaaaaaaaaaaaaaaaaa

SEQ ID NO: 3864 - protein, 203 aa, Triticum aestivum
  misc_feature: PFam Name: CPSase_sm_chain; PFam Description:
  misc_feature: GI Number: 50911977; NR Description: putative carbamoyl-phosphate synthetase small subunit [Oryza sativa (japonica cultivar-group)] >gi|41053164|dbj|BAD08106.1| putative carbamoyl-phosphate synthetase small subunit [Oryza sativa
  misc_feature: GI Number: 19387248; NR Description: putative carbamoyl phosphate synthetase small subunit [Oryza sativa (japonica
  misc_feature: GI Number: 50911975; NR Description: putative carbamoyl-phosphate synthetase small subunit [Oryza sativa (japonica cultivar-group)] >gi|41053163|dbj|BAD08105.1| putative carbamoyl-phosphate synthetase small subunit [Oryza sativa
  misc_feature: GI Number: 21535793; NR Description: putative carbamoyl
MAWRASLSRNVKEIRFLFFFFVLFRSPEAPDPEQLSSKFSGMDDDGDWIAARYLLSSILGRNPLVVDHVDEESFPVDHAPAAAARGGPAEAPVWQQPPAVFAVPSLAGTVCAVCTEEIAVADPVVRLPCAHWYHAGCIAPWLGIRSTCPMCRAELPAREEAGGAGAVGREKPPRAEAGTSAAGVRRDASSYGGYVAAGGVLSG

SEQ ID NO: 3865 - DNA, 993 bp, Triticum aestivum
  misc_feature (1)..(993): Ceres cDNA ID no. 21665949
  misc_feature (1)..(993): Ceres CLONE  ID no. 893139
  misc_feature (1)..(993): Also known as  Ceres CDNA ID no. 24357253
atcgccgtctcaaagctcaagctcacacaacaacatcacaaagatcaccacaaacctagtataaaatggggctctgcatgtctagcggcggcgcggcggcggcggtgcgggcagacgggcagcctgcctccacggctatggtactgctgccaaccggggagctgcgggagtacccgcgcccggccacagcggcagaggcgctcgatgacaactcggtggctggggacgccggctggttcttgtgcgacgccgacgcgatggggttcgagggccccgtggccgccgtggccggggccgaggagctccgcccggggcagatctacttcgtgctccccgccgaggcccgtaagaacgggctacggcgcgaggacctcgccgcgctcgccgtcagggcgtccgcggcgctcgtcagcaaggccaacgccaacgcctccggcagcggcgggcggaggaggcgcgccggctctgtttcgccgctcgtgttcgccccgccgccggaggtggacgggacccttgcctacaagaccgtgccggcgctggcggcgaagaggcggccggtggcgcgcgcgaagagtgccgggaggatgcagcgctttgcacctgatctgaccgccattcccgagtgcgagtgaaccaacacaacacaatggcgtcgccgtcgcggatggatcgatctccgagttcccatgcaagaccgctcgaatatggaaaaaatggaatatggaggggctccgacgattccggaaacagagcaaaggaaggtgacgccagctatgggattttgattggatgggcggtgtttgtttgcacttgcgggcgatggccgatggggaggttgattagatagagtctgtaatttgtaggagcaaaattttggtcggtttagtcgagtttgtggtctcaagtctcgagagacaacgaaatgtgaatataaatcccggaggtccccacattttgcccaaaaaaaaaaaaaaaagaaaaaaaaaaaaaaaa

SEQ ID NO: 3866 - protein, 188 aa, Triticum aestivum
  misc_feature: GI Number: 13699079; NR Description: TMV response-related
  misc_feature: GI Number: 21592697; NR Description: unknown [Arabidopsis thaliana]
  misc_feature: GI Number: 21553860; NR Description: unknown [Arabidopsis thaliana]
MGLCMSSGGAAAAVRADGQPASTAMVLLPTGELREYPRPATAAEALDDNSVAGDAGWFLCDADAMGFEGPVAAVAGAEELRPGQIYFVLPAEARKNGLRREDLAALAVRASAALVSKANANASGSGGRRRRAGSVSPLVFAPPPEVDGTLAYKTVPALAAKRRPVARAKSAGRMQRFAPDLTAIPECE

SEQ ID NO: 3867 - DNA, 1052 bp, Triticum aestivum
  misc_feature (1)..(1052): Ceres cDNA ID no. 21665950
  misc_feature (1)..(1052): Ceres CLONE  ID no. 894286
  misc_feature (1)..(1052): Also known as  Ceres CDNA ID no. 23731827
caagcacactgacgcacttccatggccgccgcctcctcctcgtccccccctcccagctccgcttcctcgcaccatttacggactttgcgggcgtgcgtctggtagggtggatcgtgcgagagcagaggcgtacgtcttggtttgtcggttaagggaggagctaggctgtggtgtggggtggagctaggtgggggaacgcgatgaggcgaacgacgagcttgagggaggtcgcgccgccgtccgtgttggcggtggtgttggaggacgaggacgaggacgagcaggccaaggcggtggtgcaggccgaagaaggtggcgccggcggggggcaggactggctggcggccctaggcggcggcagcggggcccccgggacggactggctcgcggcgtaccgcgcgcgcgcggcgccggcgcgggcggggctccggcgcaactcggccgactactccaaggtcgagacggccgcgttcctccgccactgcggcctctgccgccgcctcctcggccccggccgcgacaccttcatgtacaagggcgaggcggccttctgcagcctggagtgccggcagcagcacataacgcacgaggagtggaaggacaagtgcacgccaaggtccatgagcgaggcggcggcgccggcgaccagccgcggccgctccggcaagaccgacaccggcggcacggtggcggcggcctaacctgacggcgcacgagaggcaggcacgctatcatcttccgaagctacctgccggccagtagctctggaagctctcgcttctcaccgcccgctacgcatgtattactctcgtacgtagtacgtacgaacgcctccaatatgaatcgctggtaatctgtgcaggccgtcagccaccgctggtcgatcgatcgaccatcgcctcagtacaactgcatagctttttatcaattgtatgtacacttggagctcgaatccgtttatgagatcgttccttcctacggtcctccactactgatcgattagttaattgcatcacctcacggatcttatcttgtcaaaaaaaaaaaaaaaa

SEQ ID NO: 3868 - protein, 166 aa, Triticum aestivum
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MRRTTSLREVAPPSVLAVVLEDEDEDEQAKAVVQAEEGGAGGGQDWLAALGGGSGAPGTDWLAAYRARAAPARAGLRRNSADYSKVETAAFLRHCGLCRRLLGPGRDTFMYKGEAAFCSLECRQQHITHEEWKDKCTPRSMSEAAAPATSRGRSGKTDTGGTVAAA

SEQ ID NO: 3869 - DNA, 1255 bp, Triticum aestivum
  misc_feature (1)..(1255): Ceres cDNA ID no. 21665951
  misc_feature (1)..(1255): Ceres CLONE  ID no. 902026
  misc_feature (1)..(1255): Also known as  Ceres CDNA ID no. 24356656
agatcggatcgatcgagtcggctagccagctcctccacgtctgtctacgcgcgcgtccgcgggaaagcgatggcgggcgacacggaggcgccgcacgtcgtggaggactgccgcggcgtgctgcaggtgctcagcgacgggacgaccgtgcgctccgccgcggcgccgtacacggtggaggaccgcgacgacgggcgcgtcgagtggagggacgccgtgtaccacccggcccacggcctcggcgtgcgaatgtaccggccggcgcgccgggaggggaaggggaaggagcggctgccggtgctggcctacttccacggcggcggcttctgcattggcagccgcgcctggccctccgtgcacgcctgctgcctccgcttcgcccacgagctccccgccctcgtgctctccttcgactaccgcctcgcgcccgagcaccgcctcccggccgcccacgaggacgccgccgccgccctcgcctggctccgcgaccgcctcgcccccgggcctgctgacggatctgggtctgacgaggacgtccgctcctggctcgcggactctggcgccgacacggggaggctcttcgtgtccggcgactccgccggcgccaacatcgcgcaccacatggccgcgcgcttcggcgcggcgggactcggccccgtcaggatcgctgggtacgccctcctcatgccggcgttcacctccgaggcgccgacgcagtccgagctgggctcgcggggcagcgcgttcctgagccgggacgtggccgagcggtacaaccggctcgccctgccggccggcgccaacaaggactacccgctgatgaacccgctcggaccggacagcccgggcctgggacttgtggacggccgcgtgctcgtcgtcgtgggcggcgacgacatgctgaaggacaaccaggtccggtacgtggagcggatgaaggccgtggggaacgacgtggagctcgccgtgttcgcgggcaaggagcacggcttcttctcgagggacccgtggtcggagaccagcggcgaggtcgtgcgagtcgtcggccggttcatgggcagagacgcagccgattcaacaggcgccgacggtcaggactaagttgtgattaatgtgctagtaatctgttcggcatgcaatgagtgctttagaggaaacatcaggtgataccatcactatgctccatgctaccaatttgaaaaaaattatattaaatgattcgaaaaattcggagaaaagaaaaaaaaaaaaaaaa

SEQ ID NO: 3870 - protein, 343 aa, Triticum aestivum
  misc_feature: PFam Name: Abhydrolase_3; PFam Description: alpha/beta
  misc_feature: PFam Name: COesterase; PFam Description: Carboxylesterase
  misc_feature: PFam Name: FH2; PFam Description: Formin Homology 2 Domain
  misc_feature: PFam Name: Mucin; PFam Description: Mucin-like glycoprotein
  misc_feature: PFam Name: Pkinase; PFam Description: Protein kinase domain
  misc_feature: GI Number: 34899924; NR Description: putative cell death associated protein [Oryza sativa (japonica cultivar-group)] >gi|22831101|dbj|BAC15963.1| putative cell death associated protein [Oryza sativa (japonica cultivar-group)] [Oryza sativa
  misc_feature: GI Number: 34899936; NR Description: putative cell death associated protein [Oryza sativa (japonica cultivar-group)] >gi|23617085|dbj|BAC20768.1| putative cell death associated protein
  misc_feature: GI Number: 34899932; NR Description: putative cell death associated protein [Oryza sativa (japonica cultivar-group)] >gi|23617083|dbj|BAC20766.1| putative cell death associated protein
  misc_feature: GI Number: 50919067; NR Description: putative esterase [Oryza sativa (japonica cultivar-group)] >gi|27819508|gb|AAO24912.1|
  misc_feature: GI Number: 34895938; NR Description: P0030H07.40 [Oryza sativa (japonica cultivar-group)] >gi|13872965|dbj|BAB44070.1| P0030H07.40 [Oryza sativa (japonica cultivar-group)] >gi|15528618|dbj|BAB64639.1| P0011G08.10 [Oryza sativa (japonica
MAGDTEAPHVVEDCRGVLQVLSDGTTVRSAAAPYTVEDRDDGRVEWRDAVYHPAHGLGVRMYRPARREGKGKERLPVLAYFHGGGFCIGSRAWPSVHACCLRFAHELPALVLSFDYRLAPEHRLPAAHEDAAAALAWLRDRLAPGPADGSGSDEDVRSWLADSGADTGRLFVSGDSAGANIAHHMAARFGAAGLGPVRIAGYALLMPAFTSEAPTQSELGSRGSAFLSRDVAERYNRLALPAGANKDYPLMNPLGPDSPGLGLVDGRVLVVVGGDDMLKDNQVRYVERMKAVGNDVELAVFAGKEHGFFSRDPWSETSGEVVRVVGRFMGRDAADSTGADGQD

SEQ ID NO: 3871 - DNA, 1313 bp, Triticum aestivum
  misc_feature (1)..(1313): Ceres cDNA ID no. 21665953
  misc_feature (1)..(1313): Ceres CLONE  ID no. 905933
  misc_feature (1)..(1313): Also known as  Ceres CDNA ID no. 24360400
atccacatcacaaaaattacaacaccaatctcacccatttcaaaaaaaggccgttagtgttactattcgtaaaatggccactcttgttctttaccaattctttctcaaactcttgctcctaatttcagtctttcagctttcctttgctgctaggagactcaaccagctggttcaggaccagtcacagttactccattaccacaacggtcctcttctatacggcaaaatcgccgtgaacctaatctggtatggtcacttcaaaccatcccaaaaggccatcatcaccgatttcgttacctcactgtcatccccatcgtctcagagcagccagccatctgttgccacgtggtggaaaaccacggagaagtactaccacctgagtcccaagaacaagaaggctgcttcttctctttctctatcactgggcgatcagtttctcgacgagggtttctcgctggggaagtcactaaccagcaagaacctcgtcgagctggcatccaaagggggacagaggaacgccatcaacgttgttctgacatccgctgacgtggcagtcgaaggtttctgtatgagccgatgtgggacccacggctcctcctcttctgcatctcacgtgaagaagaacaacaacggcaagaactacaagttcgcttacatctgggtcggaaactccgaaacccaatgcccggggcaatgcgcttggccattccaccaacccatttatgggccccagagcccacccttggttgctcccaacaacgatgtgggacttgacggaatagtcataaacctcgctagcctccttgccggaaccgccaccaacccattcggaaacggttacttccagggtcccgcggaggctccgctcgaagctgcgtcggcttgccctggggtttatgggaaaggggcttaccctggttatgctgggaacttgctggttgactctgccactggtgctagctacaatgtggagggggataatgggaggaagtaccttgttcctgctctgtatgatccttctacatcgtcttgctcaacgcccgtctgagaaggaggattattatggtgatgccgatcgttcagttctcactgctgctgctagcctgctactacgatgatgttagaaaccacggattagggagtgtacaaaacttctaataacccattttgtaggattatttcattgatttgtttgtttatatcatctggatatgtacgcggattaaggatcttatgtaagtagaagcaactgttcttccgtttgcttttaaataatattgaaatattactcttcgctaaaaaaaaaaaaaaaa

SEQ ID NO: 3872 - protein, 324 aa, Triticum aestivum
  misc_feature: PFam Name: Put_Phosphatase; PFam Description: Putative Phosphatase
  misc_feature: GI Number: 50901932; NR Description: P0025A05.29 [Oryza
  misc_feature: GI Number: 26986126; NR Description: putative phosphatase [Lycopersicon esculentum] >gi|26986116|emb|CAD30861.1| putative phosphatase [Lycopersicon esculentum] >gi|11837862|gb|AAG40473.1|
  misc_feature: GI Number: 26986124; NR Description: putative phosphatase [Lycopersicon esculentum] >gi|26986118|emb|CAD30862.1| putative
  misc_feature: GI Number: 26986120; NR Description: putative phosphatase
  misc_feature: GI Number: 34910680; NR Description: P0690B02.4 [Oryza sativa (japonica cultivar-group)] >gi|18461219|dbj|BAB84416.1| P0690B02.4
MATLVLYQFFLKLLLLISVFQLSFAARRLNQLVQDQSQLLHYHNGPLLYGKIAVNLIWYGHFKPSQKAIITDFVTSLSSPSSQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGIVINLASLLAGTATNPFGNGYFQGPAEAPLEAASACPGVYGKGAYPGYAGNLLVDSATGASYNVEGDNGRKYLVPALYDPSTSSCSTPV

SEQ ID NO: 3873 - DNA, 1381 bp, Triticum aestivum
  misc_feature (1)..(1381): Ceres cDNA ID no. 21665954
  misc_feature (1)..(1381): Ceres CLONE  ID no. 906458
  misc_feature (1)..(1381): Also known as  Ceres CDNA ID no. 24360497
acctcatcggcgagctaggcagctagagctagctcgaccctcggccgaaacaatggggatctcactgctccacacgcagtggcacctactcgcccagctgccccagcaatggcagctcctcctccttctcgctggcctcctcctccccgtggtctcgtacccgctgctgataacgaggggcaatgttgagggaggacggctgaggctgccgcccggccctgcgcgggtgccggtgctcggcaacctgcaccagctgggcccgctgtcgcaccgcagcctgcgcgacctggcccagcagcacggccccgtcatgctgctccccctcggcaccgtgccgacgctggtggtctcgtctgctgctgcggcgcgcgacgtgatgaaggcgcacgacgccgactgctgcagccgattcgcgtctccaggccccgcgcggctctcctacgacggcaagagcatcgcctcctcgccctacggcccctactggcaggacatgcgcaggctctttgtcgccgagctcttcggcccgcggggcgtccgctccgtatgggacgcgcgtcggcagcaggttgacaggctcatggccaccctgggcacggcggcagcgacggcggctccggtggcgatggaccagcacgtgttccgcgtcgccgacggcatcatcggcaccgtggcgtacgggcgcatctacgccgcggaggcgttcgcgcgcaagtacgagcagttccagcacgtgctagaggaggccatggccatgtcggccagcttctcggccgaagacttcttccccaacgccgccggccgcctcgtcgaccggctcgccggcatcatcgcgcggcgagagagaatctttagggacctcgacgccttcttcgaggcggtgctggagcagcacctggaccccgcgcgccccaagccagagagcggcgacggcgacctggtagacgccttcgtcagcgcctgtgaggagcacggcttcacgagggaccacgtgaaggccatgctcctggacgcgttcctcggcggcgttgacggcagctctatcacgatcgtgtgggtgatggcggagctgatccataacccgacggcgctgaagaaggcacaagatgagatcagggccgcggtggccgccagcgatgtttcgccgccgggctcggggttgccggtccagccggacgacctgcccaagctaacctacctgaagatggtcgtcaaagagaccatgcggctgtattgagtatgtattttgtattgcacgtgtattggagttgtggcccacttcctagttctgtataattaaggtagaggccttccctgtattatatatacgtgcatcggcacccatcaatacatcatcattgtattgccaaaaaaaaaaaaaaaa

SEQ ID NO: 3874 - protein, 393 aa, Triticum aestivum
  misc_feature: PFam Name: p450; PFam Description: Cytochrome P450
  misc_feature: GI Number: 5915841; NR Description: Cytochrome P450 71E1 (4-hydroxyphenylacetaldehyde oxime monooxygenase) >gi|7430623|pir||T14640 cytochrome P450 CYP71E1 - sorghum >gi|2766452|gb|AAC39318.1| cytochrome P450 CYP71E1 [Sorghum
  misc_feature: GI Number: 34897434; NR Description: putative cytochrome P450 [Oryza sativa (japonica cultivar-group)] >gi|27573338|gb|AAO20056.1| putative cytochrome P450 protein [Oryza sativa (japonica cultivar-group)]
  misc_feature: GI Number: 37788136; NR Description: cytochrome P450 protein
  misc_feature: GI Number: 50936051; NR Description: putative cytochrome P450 71E1 [Oryza sativa (japonica cultivar-group)] >gi|27817968|dbj|BAC55732.1| putative cytochrome P450 71E1 [Oryza sativa (japonica cultivar-group)] >gi|50509544|dbj|BAD31248.1|
  misc_feature: GI Number: 16507125; NR Description: cytochrome P450 [Citrus
MGISLLHTQWHLLAQLPQQWQLLLLLAGLLLPVVSYPLLITRGNVEGGRLRLPPGPARVPVLGNLHQLGPLSHRSLRDLAQQHGPVMLLPLGTVPTLVVSSAAAARDVMKAHDADCCSRFASPGPARLSYDGKSIASSPYGPYWQDMRRLFVAELFGPRGVRSVWDARRQQVDRLMATLGTAAATAAPVAMDQHVFRVADGIIGTVAYGRIYAAEAFARKYEQFQHVLEEAMAMSASFSAEDFFPNAAGRLVDRLAGIIARRERIFRDLDAFFEAVLEQHLDPARPKPESGDGDLVDAFVSACEEHGFTRDHVKAMLLDAFLGGVDGSSITIVWVMAELIHNPTALKKAQDEIRAAVAASDVSPPGSGLPVQPDDLPKLTYLKMVVKETMRLY

SEQ ID NO: 3875 - DNA, 1286 bp, Triticum aestivum
  misc_feature (1)..(1286): Ceres cDNA ID no. 21665955
  misc_feature (1)..(1286): Ceres CLONE  ID no. 906713
  misc_feature (1)..(1286): Also known as  Ceres CDNA ID no. 24360393
agtttctagtaccaatcatattagagcatctatacgtacaacgtgaatcataagacacccaagatattatcatctctaccgcaggctgcgcgcaggcgaagtcgaccaaacaagtgcacgccccaccccttgatgcgctgcacgtctcgcaagttcgccgccagtttcgtagcgattggcgatacgcatgcgtatatataagcatccccgtacgcgcactaatcttagccctccctgtatctccacagcttttccttgtcccgcaggccacattctttggagttagctgagcaccggatttactaatggggcggaggctgccggcgttgtgccgcggccgggcggcgacgcgggtcaggaagcgagtgcagcgcctgagctactgctccccctcctcgttgtcctccaagctgccgccttcggtgaccagcaaggtaaggagtgacagtggagcaggaaacggacgctgttacggcggcggcaatggcgcgtcgatggttgacgtcgtgggcggcaagaaggacggcggcgggcggcgggtgatggtggtcgctgatgggcgggcggaggcggtgggcgcgctcgagtgggcgctgtcgcagaccgtacggagcaatgacgccgtcgtccttctcgccgtcgtcaagccggccccggcagatgcggatgattcatcctgcgtgaagatatcagggacaagatgctacgaaaaccttaatgccatgaggagcctgtgtgagtcgaccaggccagaggtgaaggtggaggtgtgcgtgaccgaggcggaggagcgcgcgccggcggtggtggacgccgcgaggcggcacggcgcgtcgctgctcgtgctcggccagcgccggcgggcggccacgacgcggtggatcctgggcctgtggccggcggcggagcgtcggtgcggcaggcggtggcagaggggcctggtggagtactgcatcgagcacgcgccgtgcgaggcgctgggcgtgcgccggcggaactccggcgggtacctcgtctccagcaggcgccacagggacttctggctcctcgcttagttcttcagtccatcggttcaaccgtcgtcgctgctgctggtgctgctgctagcagttaaagtaggagggaatcgagagattgaagaatacatttctaaggatatacgtgatggattggaaccatgcattgctgctagctgaagtatcgtatctctgtactgccttggtgggttctgctcccactctcctttgtgaacaaaatacccattaaagcgaaaaaaaaaaaaaaaa

SEQ ID NO: 3876 - protein, 249 aa, Triticum aestivum
  misc_feature: PFam Name: Usp; PFam Description: Universal stress protein family
  misc_feature: GI Number: 6730651; NR Description: F4N2.5 [Arabidopsis thaliana] >gi|18409190|ref|NP_564951.1| universal stress protein
  misc_feature: GI Number: 21592322; NR Description: unknown [Arabidopsis thaliana]
  misc_feature: GI Number: 42572035; NR Description: universal stress protein
MGRRLPALCRGRAATRVRKRVQRLSYCSPSSLSSKLPPSVTSKVRSDSGAGNGRCYGGGNGASMVDVVGGKKDGGGRRVMVVADGRAEAVGALEWALSQTVRSNDAVVLLAVVKPAPADADDSSCVKISGTRCYENLNAMRSLCESTRPEVKVEVCVTEAEERAPAVVDAARRHGASLLVLGQRRRAATTRWILGLWPAAERRCGRRWQRGLVEYCIEHAPCEALGVRRRNSGGYLVSSRRHRDFWLLA

SEQ ID NO: 3877 - DNA, 1234 bp, Triticum aestivum
  misc_feature (1)..(1234): Ceres cDNA ID no. 21665956
  misc_feature (1)..(1234): Ceres CLONE  ID no. 909358
  misc_feature (1)..(1234): Also known as  Ceres CDNA ID no. 24360396
cagaacagagcatcctcgtgcctttgtgcaccatcgccggccactcgagagctccaggcgcgctctaggctctagctagctagggtggcggtgacaatggcggcggcgacgttggtgttggtgatgctcgtggtgacggttggcgtcgcggtggcgatggcggagggcgggaagctgcggcaggggtactacgagcagagctgcccgcgggcggagcagatcgtgaagcactacgtggagcggcacgtcccgcacgcgccctccgtcgccgccaccctcatccgcacccacttccacgactgcttcgtcagggggtgcgacgcgtcggtgctgctgaacgcgacgaccggcggcggcgaggcagagaaggacgcgacgcccaacctgacgctgcgcggcttcgccttcctggaccgcgtcaaggcgctcctcgagcaggagtgccccggcgtcgtctcctgcgccgacatcctcgcgctcgcctcccgcgacgccgtcggcgtcatcggcgggccgttctggcgcgtgccgacggggcgtcgcgacggcagggtgtcgatcaagcaggaggcgctggaccagatcccggcgcccaccatgaacttcaccgacctcctcacctccttccgtgccaagggcctcgacctcgccgacctcgtctggctctcaggggcacacaccatcggcatctcacactgcaactccttcaccgagcggctatacaactttaccggccgtggaggacccggggacgcggatccatctcttgatgcggagtatgctgccaacctccgcaggaccaagtgcaccacgcccacggacaacaccaccatcgtggagatggaccctgggagcttcctcacctttgacactagctactaccgtggcctcctaaagcgtcggggactcttccagtccgatgccgcgctcatcaccgatgctgcagcaagggccgacgtcgagagcgtggccaagggtccgtcggaggtgttcttccaggtgttcgcacggtccatggtgaggatgggcatgatagaagtgaagaccggtggcgagggggagatcagacggcattgtgccgttgtcaacagctagtgtcgtgcgttggtggcatgtggacgattgtttttgtatgtttagttacatttcctttttcctttttgtgtatgtattttgtctattttccttgtttgtaaggtggttttcaagttgtggtctaaaaaaaaaaaaaaaa

SEQ ID NO: 3878 - protein, 332 aa, Triticum aestivum
  misc_feature: PFam Name: peroxidase; PFam Description: Peroxidase
  misc_feature: GI Number: 52076880; NR Description: putative peroxidase
  misc_feature: GI Number: 55701045; NR Description: TPA: class III
  misc_feature: GI Number: 50905409; NR Description: putative peroxidase [Oryza sativa (japonica cultivar-group)] >gi|49389250|dbj|BAD25212.1| putative peroxidase [Oryza sativa
  misc_feature: GI Number: 55700915; NR Description: TPA: class III
  misc_feature: GI Number: 51511062; NR Description: peroxidase a [Eucommia
MAAATLVLVMLVVTVGVAVAMAEGGKLRQGYYEQSCPRAEQIVKHYVERHVPHAPSVAATLIRTHFHDCFVRGCDASVLLNATTGGGEAEKDATPNLTLRGFAFLDRVKALLEQECPGVVSCADILALASRDAVGVIGGPFWRVPTGRRDGRVSIKQEALDQIPAPTMNFTDLLTSFRAKGLDLADLVWLSGAHTIGISHCNSFTERLYNFTGRGGPGDADPSLDAEYAANLRRTKCTTPTDNTTIVEMDPGSFLTFDTSYYRGLLKRRGLFQSDAALITDAAARADVESVAKGPSEVFFQVFARSMVRMGMIEVKTGGEGEIRRHCAVVNS

SEQ ID NO: 3879 - DNA, 1393 bp, Triticum aestivum
  misc_feature (1)..(1393): Ceres cDNA ID no. 21665958
  misc_feature (1)..(1393): Ceres CLONE  ID no. 912462
  misc_feature (1)..(1393): Also known as  Ceres CDNA ID no. 24360485
atttttcggtttgagtttcaaatctctctgtctcacgcgcaacgttagtgccgcccccctgcgaaaccctaaccctagccaccaccagcgcgctccctcactcgatcctcatgtccgattccgaagcatccccgacgcccgcggctgcggttgcggcagcggaggcggcgacgggcgagaactccccgtctccggcgaggagtgaggagctgctgccggtggcggagaagatctcggaattaaatgaatcacagtcagagcttttgggaagacttcgaggtcttaaggaggatttgcagagctggagaagcaatttagacacccaagtgcagaaatacaaaacagaaatctccgatatcaaaactgcacttaatagtgaaatagaccagctgaaatcagatttccaagaactgaggaccacccttaagaagcaacaggaagatgtgactattagcttgaagaatttggggctagaagatgctaccgaaactgatgggaacaaaggaactggagaggaaaatacaagtgagggtgcattagcaaacatgggggacctgaaactagaagattctaccgaaactgatgggaacaaaggaagtgtggaggaaaatacaagtgagggtgcattagcaaacatgggggacctgaaattggaggataatccagaaaataatgatgaaggcagtggggttgaggaggaaaagaatcaggaggcccctgaagaagatggcatggcgggcatagaaggtacgaagacggaagatgacatggcgggcatagaaggtaccaagacggaagatgacacggcgggcaaagaaggtaccaagacggaagatgacacggtgggcaaagaaggtacgaagacggaagatgacatggcgggcatagaaggtaccaagacggaagatgacatggcgggcatagaaggtaccaagacggaagatgacacggcgggcaaagaagataccaagacggaagatgacatggcgggcatagaaggtacgaagacggaagatgacatggcgggcatagaaggtaccaagacggaagatgacacggcgggcatagaaggtaccaagacggaagatgagacggtgggcatagaaggtaccaagacggagaatccgagcaacgaataaatcagtgcatgaacggagagtagaaatggcgtcacttctttggtggccccgcagtagaaacttaaagagcagtggtagatcggttcctctacaagggaggcccatgctctgtgtgatcatctggtcgtgtagcgtggtctttctcgaacgctgctgcaacgagtgggctccagcactcgggaattgttgcaacctctttaactaccttattaatgtaagagtgtccgcatgaaaaaacaaaaaaaaaaaaaaaa

SEQ ID NO: 3880 - protein, 342 aa, Triticum aestivum
  misc_feature: GI Number: 29370843; NR Description: unknown [Oryza sativa
  misc_feature: GI Number: 3335680; NR Description: hyosophorin [Cyprinus carpio]
  misc_feature: GI Number: 21592347; NR Description: unknown [Arabidopsis thaliana]
  misc_feature: GI Number: 16611639; NR Description: spore wall protein 2
  misc_feature: GI Number: 9367038; NR Description: secreted antigen SagBb
MSDSEASPTPAAAVAAAEAATGENSPSPARSEELLPVAEKISELNESQSELLGRLRGLKEDLQSWRSNLDTQVQKYKTEISDIKTALNSEIDQLKSDFQELRTTLKKQQEDVTISLKNLGLEDATETDGNKGTGEENTSEGALANMGDLKLEDSTETDGNKGSVEENTSEGALANMGDLKLEDNPENNDEGSGVEEEKNQEAPEEDGMAGIEGTKTEDDMAGIEGTKTEDDTAGKEGTKTEDDTVGKEGTKTEDDMAGIEGTKTEDDMAGIEGTKTEDDTAGKEDTKTEDDMAGIEGTKTEDDMAGIEGTKTEDDTAGIEGTKTEDETVGIEGTKTENPSNE

SEQ ID NO: 3881 - DNA, 1233 bp, Triticum aestivum
  misc_feature (1)..(1233): Ceres cDNA ID no. 21665959
  misc_feature (1)..(1233): Ceres CLONE  ID no. 913143
  misc_feature (1)..(1233): Also known as  Ceres CDNA ID no. 24361463
atccatcccggcggcccgacagcttcgcctcgccgacgccgtggccgccccgagcttttccggtccccgtccaggtcctcagtaaaagcttccgcatgcggcatctccccctcccggcacctctccaacgccaagcatctcttcccgctgcccaagccctgagccccagcgcaagctccggtccccagatccccgctgtgcccatggcggcgcggacgcaggcgtggcagttcgcggccgccttggccttcttccacggctccgagtacgtcctcgctgccgccttccacggccacagcaacgtcaccgccacctcacttcttatcagcaagcagtatgttttggcaatgagttttgcaatggtggaacacctgacagaaagtcttttcttcccagaaataaaagggtatctgtttgtcagtaatattggccttctgatggtgcttgttggtgaaattattcgtaaaattgctgttgtaacagctggacgtgcctttacacatgttatacggattcagtatgaagaccagcatcagttggtaactcatggaatttatagatttatgcggcatcctgggtattcaggctttcttctatgggcagttggaacgcaggttatgctgtgcaatccagtatctacagttgtatttgcattggtgttgtggcgtttctttgcaaagcggataccatatgaagaatttttcttgaggcaattttttggctctcaatatgaagaatatgcacggaaagtgcactcggggttaccatttataaactgagtgtttcaaacttgcaaagcaacgcttaccccctgctgtcctcatcattgatatgtctaagaaaagcactttacaacatggacttgagagatgccaaacgagcaagctatgtcatggattttatacacaatacaacacaaatctggaatttcatcaagctgaagagtcattcctcagctcgtcaatctggggcgaatgctaagaactgttgctgatgtaaatgggttcgcttacagctagtttttctggaagctctgccattcattagattcgaacagaatagtttccgctttttctggaggacatcgaacatttccagtaggttcgctgtgtgaaagcctttgtagtacaactgtatcaagtgtgcctaaacatatatgctacaactgtacaactgtatcaagtgtgcagaagaaaagaaacccccggtttgttcctaaaaaaaaaaaaaaaa

SEQ ID NO: 3882 - protein, 1233 aa, Triticum aestivum
  misc_feature: PFam Name: ICMT; PFam Description: Isoprenylcysteine
  misc_feature: GI Number: 10177821; NR Description: farnesyl cysteine carboxyl methyltransferase-like protein [Arabidopsis thaliana] >gi|15237283|ref|NP_197723.1| isoprenylcysteine carboxyl methyltransferase family protein / ICMT family protein
  misc_feature: GI Number: 48735059; NR Description: LOC397717 protein
  misc_feature: GI Number: 5381291; NR Description: farnesyl cysteine carboxyl methyltransferase [Rattus norvegicus] gi|14548071|sp|Q9WVM4|ICMT_RAT Protein-S-isoprenylcysteine O-methyltransferase (Isoprenylcysteine carboxylmethyltransferase)
  misc_feature: GI Number: 19114175; NR Description: protein-s isoprenylcysteine o-methyltransferase (EC 2.1.1.100) [Schizosaccharomyces pombe] >gi|14548108|sp|P87014|MAM4_SCHPO Protein-S isoprenylcysteine O-methyltransferase (Isoprenylcysteine
  misc_feature: GI Number: 50759141; NR Description: PREDICTED: similar to Protein-S isoprenylcysteine O-methyltransferase (Isoprenylcysteine carboxylmethyltransferase) (Prenylcysteine carboxyl methyltransferase) (pcCMT) (Prenylated protein carboxyl
ATCCATCCCGGCGGCCCGACAGCTTCGCCTCGCCGACGCCGTGGCCGCCCCGAGCTTTTCCGGTCCCCGTCCAGGTCCTCAGTAAAAGCTTCCGCATGCGGCATCTCCCCCTCCCGGCACCTCTCCAACGCCAAGCATCTCTTCCCGCTGCCCAAGCCCTGAGCCCCAGCGCAAGCTCCGGTCCCCAGATCCCCGCTGTGCCCATGGCGGCGCGGACGCAGGCGTGGCAGTTCGCGGCCGCCTTGGCCTTCTTCCACGGCTCCGAGTACGTCCTCGCTGCCGCCTTCCACGGCCACAGCAACGTCACCGCCACCTCACTTCTTATCAGCAAGCAGTATGTTTTGGCAATGAGTTTTGCAATGGTGGAACACCTGACAGAAAGTCTTTTCTTCCCAGAAATAAAAGGGTATCTGTTTGTCAGTAATATTGGCCTTCTGATGGTGCTTGTTGGTGAAATTATTCGTAAAATTGCTGTTGTAACAGCTGGACGTGCCTTTACACATGTTATACGGATTCAGTATGAAGACCAGCATCAGTTGGTAACTCATGGAATTTATAGATTTATGCGGCATCCTGGGTATTCAGGCTTTCTTCTATGGGCAGTTGGAACGCAGGTTATGCTGTGCAATCCAGTATCTACAGTTGTATTTGCATTGGTGTTGTGGCGTTTCTTTGCAAAGCGGATACCATATGAAGAATTTTTCTTGAGGCAATTTTTTGGCTCTCAATATGAAGAATATGCACGGAAAGTGCACTCGGGGTTACCATTTATAAACTGAGTGTTTCAAACTTGCAAAGCAACGCTTACCCCCTGCTGTCCTCATCATTGATATGTCTAAGAAAAGCACTTTACAACATGGACTTGAGAGATGCCAAACGAGCAAGCTATGTCATGGATTTTATACACAATACAACACAAATCTGGAATTTCATCAAGCTGAAGAGTCATTCCTCAGCTCGTCAATCTGGGGCGAATGCTAAGAACTGTTGCTGATGTAAATGGGTTCGCTTACAGCTAGTTTTTCTGGAAGCTCTGCCATTCATTAGATTCGAACAGAATAGTTTCCGCTTTTTCTGGAGGACATCGAACATTTCCAGTAGGTTCGCTGTGTGAAAGCCTTTGTAGTACAACTGTATCAAGTGTGCCTAAACATATATGCTACAACTGTACAACTGTATCAAGTGTGCAGAAGAAAAGAAACCCCCGGTTTGTTCCTAAAAAAAAAAAAAAAA

SEQ ID NO: 3883 - DNA, 1658 bp, Triticum aestivum
  misc_feature (1)..(1658): Ceres cDNA ID no. 21665960
  misc_feature (1)..(1658): Ceres CLONE  ID no. 913549
  misc_feature (1)..(1658): Also known as  Ceres CDNA ID no. 24361199
ccatcttttcctcctctctgttccagtgaatttcactcgcacaaacctgaaatcgaacctgaaatcaaaccaagatcgagcggaagcacggcagcaagcaatggaggcgctgctggagctagagaaggtgcagagggtgctctccctcatgggctcccgcggcctctccgactccgacggcagcggcggcggggaccgcttcctcgcccacttcctcctcttcctggcgcaaccgtttgattcacttgccattgagaagaaggtcgtattaatctctgagcttttgagagaggttaattctgatacactcaaagaagttcaacgtctagccagtctggaaggtactaatagggaagatgaaagattatgtcctttaatatcgagccagccaactaagaagttcaagacggatgccgagaaattaaccattcaggatgcgcctatgattggattcgatgccatgatgagagccaattccacacttgaagatttttgcaggtcatacttcatatttcatggtttggatgttaacagaccacactctgttttcaagtttcttcctttactttcttttacagagagctacatataccagttagatgcttcaaatgaagacagtttgctattagttccagacaacaactcttcttcaacagtattggaaaggaaaatacaaggttctagtcagatgtccttgtctgacatgcttgacccccttgataattttcttcaatgccaggggttaatgacagatcaattgcgaaatgaactcaaatctggcatccaatattggtctctagagaggaagctttgtcaagcattatcaagaaacgataagatatctatcgaagatgttatggaagcaatccatctcaaatcatttgactatcgagtccttaatctgatgatgtatcggcttactggtcagcaggtcaatgacttgcatatggagttcttgtctgtctcagaatttttagttgagatatgtgatgacctgtatgattatgaggatgatgtggttaacaatacttttaacatcctccgcatgtttgctgtgatatatggacctttagatgcaccaaagatgctggccaagtgcatcggtgaagctgaggaaaaatatgagagcttctcaaagaaattggaccctagcatctcaagaagttactggagaagatgtgaggaggctacaaaggaaggtggaaaaatatcaggccatgcgtatggcacatggaatatccctcctttgataagagatgaaggatcatttcgccttgatagattgaacagaggtgatgcttctgccatgaccatcagatgacagataccatgctctgagcatcttaaaaaggaggcttagttatcattgctagtaaatgccttgcaagcaaatttcgcaagattttgcataagctcttcttaatttactagagatcttgtgctgttgcaagcatgttatttgggaggatgcgagccaatgcaactatattttgtgctttgattgaaactcaagctcaatcaagccaaaactgcactagttgacccaaattccattaacccactcttttgctgcatatttgcaagagataagggctaaatccttttatggccgtgcaaagttgaaaaaaaaaaaaaaaaaaaaaaaaaaaaaaaaaaaa

SEQ ID NO: 3884 - protein, 406 aa, Triticum aestivum
MEALLELEKVQRVLSLMGSRGLSDSDGSGGGDRFLAHFLLFLAQPFDSLAIEKKVVLISELLREVNSDTLKEVQRLASLEGTNREDERLCPLISSQPTKKFKTDAEKLTIQDAPMIGFDAMMRANSTLEDFCRSYFIFHGLDVNRPHSVFKFLPLLSFTESYIYQLDASNEDSLLLVPDNNSSSTVLERKIQGSSQMSLSDMLDPLDNFLQCQGLMTDQLRNELKSGIQYWSLERKLCQALSRNDKISIEDVMEAIHLKSFDYRVLNLMMYRLTGQQVNDLHMEFLSVSEFLVEICDDLYDYEDDVVNNTFNILRMFAVIYGPLDAPKMLAKCIGEAEEKYESFSKKLDPSISRSYWRRCEEATKEGGKISGHAYGTWNIPPLIRDEGSFRLDRLNRGDASAMTIR

SEQ ID NO: 3885 - DNA, 1631 bp, Triticum aestivum
  misc_feature (1)..(1631): Ceres cDNA ID no. 21665962
  misc_feature (1)..(1631): Ceres CLONE  ID no. 920955
  misc_feature (1)..(1631): Also known as  Ceres CDNA ID no. 0
aaacacacaaacaaacccagttggccctaactgaacacctcgggtgtccggcgaccggagcgccttcactgctcggtccgccatggcgtccctcgtcccccggctccttggccgccggactctgcaccccgccgtcgctctacgctctccacgcgatgcttggatgcgattccacggcgcaaatcccccacgcccctgcccgctgttccggccttccctgggggttgatggatgcgcgggagctgcgcggagatggtggtttctctcgccggtaaggcaccggagcacggcggtgacgctgaacacggacggtggctttgcgcggttctcggtcggagatctggacacgaagcagaatggagtgcagaatcagccgccggcgaagaagaagatgtccaagaagtccaaggtcaaccagctcaagtggttccgcctcaaggccaaaaagaagatgaagtcgcccaaccccgaagtcaggataagatacaagctcggaaaggccaagaggaaagaagaatggctgattgagaaactcaggaagtatgaggccccgagggctccagagccggttcacgaccctgagattctgaccgaggaggagaagttctatctgaaacggactggggagaagaaaaagaactatgttcctgttgggaggagaggggtgtttggtggtgtggttctcaacatgcacctccactggaagaagcatgagactatgcaagtagtctgcaagccctgtcgacctgggcaagtgtatgagtacgcagaggagctggcgaggctcagcaaagggacagttattgatattaaacctaataataccattatcttttatcgtggaaagaattatgtgcagccaaaggttatgtcacctcctgatactctttctaagcagaaggccttggagaaatataggtatgaacagtctcttgaacataccagtaaatttattgagcagctggaacaggagcttgaagattaccagaagcatgttgctttatttaagaagcgtgaaggggctatttctgagcaaatcagtaatgaagactctgctgtggatgacctcacaactagctcagataccgattgaattgccttcttcctcaattgacatctcatattctttccgcaatgaagggttctcatgcttcctcataaaatggaaaaagggacagttagtagttcaagagctattatactgctggagtaccatgaacccagaggagcaatacctatgaggaatcaagtaccataaacatatttatgggatgctcacattgagagttagtaaagtttatggtttgaagatttaaggtagtagtggatgctgatggtggaggagatgagttgaactttttgagagagatgggcttgcttgttgcttcaatactgagaaatcaacttgggttatctgctgcaaaggaagcctctcaaatggaaactggtaagctcttacctggatctcaacgagtagattatagcatacataagattgatgttttcagattagaatttacttttgtaagattagttactatactgtcggtgaagtcaagataatgtcaaatgaataaattatggtttgcagtagcaaacttatatagttcataccaaaaaaaaaaaaaaaa

SEQ ID NO: 3886 - protein, 336 aa, Triticum aestivum
MASLVPRLLGRRTLHPAVALRSPRDAWMRFHGANPPRPCPLFRPSLGVDGCAGAARRWWFLSPVRHRSTAVTLNTDGGFARFSVGDLDTKQNGVQNQPPAKKKMSKKSKVNQLKWFRLKAKKKMKSPNPEVRIRYKLGKAKRKEEWLIEKLRKYEAPRAPEPVHDPEILTEEEKFYLKRTGEKKKNYVPVGRRGVFGGVVLNMHLHWKKHETMQVVCKPCRPGQVYEYAEELARLSKGTVIDIKPNNTIIFYRGKNYVQPKVMSPPDTLSKQKALEKYRYEQSLEHTSKFIEQLEQELEDYQKHVALFKKREGAISEQISNEDSAVDDLTTSSDTD

SEQ ID NO: 3887 - DNA, 1862 bp, Triticum aestivum
  misc_feature (1)..(1862): Ceres cDNA ID no. 21665963
  misc_feature (1)..(1862): Ceres CLONE  ID no. 922631
  misc_feature (1)..(1862): Also known as  Ceres CDNA ID no. 23435065
catcaaaggttcaaacttctgtgggcttcatccttttcttctattactctacattggcttactggatgcatctttttgatactacgctccaaattgtccagtcttcttcgcccgatactgaggccaggagttagtattccatttttccatcttgctgaagagcataatgtgaaaccatgcatgcgcgaaccattctatattatctctttcaagaagcttcctcgtctttttgttggcattatcaatgttggtatggtctttcttgttcctgttcaaatcgctggtggattggcacctaagttgttcccattagatatcatctacttcgatccacctactaagggcacatcattttggcaagcgccacggacctacgcagagttactttctggcattgtccttctgaggtttctcatttgcaatacactcaaataccttcaacctcgcaaactggtggagaagatactgcgaaattggtttgccactactggacaagctcttggtctattagatttgttgattgtccagcctgacggagcatctggacatgaggttagtaatagtgtcgcaccaaatgaccagtatggcagcacttacgaagctatggctaataggagatctgttgcagttcgaatgacactacttgtagtgctagcatggttgactgttgtgatactcaacactgttgtgcttatctttccaatctcagttgggcgtgcattattgttggccatccctcagctgccagtagcaggtggattgaagtccaatgatctgtttgcgtttgctgttggattttgcaccatatcaactattattgccgcctctagagattcatttgtctacatgacatctgggagaacatgcattctagcttctgttatctgcaagtggggtataactgctctgaagagctctcctcttttgttcatatggattgttatcattcccattctaataggattgctggttgattttctcctgatatcacccttcaagttcctggttgattttctggtgatgtcacccttcattgtgccctctgatgacattccagttctagacttcttcagcatttggttcctggggatgctattgctgaaattctggactaatttggctcattggacaagggacgcgcctttcctggctcatttcattgatggaagatgggactggaagcttactcgggcaaaggatgatggctttgcagggttgagggcaaagtgggtcttgcaagatatattgatgcctatcaccatgaagctagtgattgttctgtgtgttccttatgtgcttgcgaagggccttttcccaaggtttggctactctgctgcggtgaactcgacggtgtaccatttcgcatggctgggcagcctcgccttatatgcgctctgctaccttgccaaggtattctggggtgtcctggtgaaactccacgattctatcagggatgagcgctatattatcgggcagaggctgcaagactacactgacaacagctgaaggcccttctccttgcaactcagttttctatagtagttaggtttaaacataacaacagtcggcatcaggaagcgaagaggccgtgttacagatggagatgatacagtgagatgtcggagaggtagtttgcttgtaaatatggatgtagttttagttgccatcacctgttggtcacgatcttttgtgccggttcggtaggttgctgagtcttgagaatttgatcgtaatcgtggttgtaatagcctatggtttttaggaatctcagacaccttttgcaatcgtcattacatgagggccttggtctggtgctgattcgggcaatgttatcaaattctgagataaaaaaaaaaaaaaaa

SEQ ID NO: 3888 - protein, 441 aa, Triticum aestivum
  misc_feature: GI Number: 51535585; NR Description: zinc finger (C3HC4-type RING finger)protein-like [Oryza sativa (japonica cultivar-group)] >gi|51536350|dbj|BAD37481.1| zinc finger (C3HC4-type RING
  misc_feature: GI Number: 30689919; NR Description: zinc finger (C3HC4-type
  misc_feature: GI Number: 28175092; NR Description: F830029L24Rik protein
  misc_feature: GI Number: 57109764; NR Description: PREDICTED: similar to
  misc_feature: GI Number: 29179417; NR Description: F830029L24Rik protein
MREPFYIISFKKLPRLFVGIINVGMVFLVPVQIAGGLAPKLFPLDIIYFDPPTKGTSFWQAPRTYAELLSGIVLLRFLICNTLKYLQPRKLVEKILRNWFATTGQALGLLDLLIVQPDGASGHEVSNSVAPNDQYGSTYEAMANRRSVAVRMTLLVVLAWLTVVILNTVVLIFPISVGRALLLAIPQLPVAGGLKSNDLFAFAVGFCTISTIIAASRDSFVYMTSGRTCILASVICKWGITALKSSPLLFIWIVIIPILIGLLVDFLLISPFKFLVDFLVMSPFIVPSDDIPVLDFFSIWFLGMLLLKFWTNLAHWTRDAPFLAHFIDGRWDWKLTRAKDDGFAGLRAKWVLQDILMPITMKLVIVLCVPYVLAKGLFPRFGYSAAVNSTVYHFAWLGSLALYALCYLAKVFWGVLVKLHDSIRDERYIIGQRLQDYTDNS

SEQ ID NO: 3889 - DNA, 1365 bp, Triticum aestivum
  misc_feature (1)..(1365): Ceres cDNA ID no. 21665964
  misc_feature (1)..(1365): Ceres CLONE  ID no. 922793
  misc_feature (1)..(1365): Also known as  Ceres CDNA ID no. 24361480
cacgtcaactgtcactcgcgcgcgccaccgccacctccccacccaccaaccggcgacgggagctccctcgcaccctccaaaaccgcatcccaccaccacgcgcgcacgcaaccgcggccagatccgtcgacgcctccacccgcaaccatccaatcccgcacacagcgatggaagtgaagcggcacgcggcgcggacgctggtgggccggctgcggggcgcggcggcggtgcgggacgcgggcgccacggcggcggccgtcgcggagctgcgccgcgcctccaaggacgacccggaggtgcgcgcgccgctggcggacgccggggcggtgccgttcctcgcgtcgcagctcacggcgccctccacctccgccgccgccgaggacgcggccgccgcgctgctcaacatctccctctccgcgcgggagcagctcatgtcggccccggggatcctcgacgcgctcgcccgggccatccgggccgaggactacgaggcggcccaccacgccgccgccgtcgtcgccagcctgctctgcgtcgacgcctaccgccccatcgtcggcgccaagcgggcgctgctgtccgcgctcgtctcgctgctcctcccctccaaggcccgcggcacgcgcgccaccaaggacgccctcaaggcgctcttcggcgtcgcgctctacccgctcaaccgcgccgcgctggtggagctcggcgtcgtgcgggcgctcttcgggctcgtgatgacggacggccgcacgggcatcgtcgaggacgccaccgccgtcgtcgcgcaggtggccggctgcgccgagagcctcgacgccttcgccgcggtgtccggggttcggatcctcgcggacctcgtcgagcccgggggcgccgccacggggcgggcgagggagaacgcggcagccgcgctgctcaacctcgtcatggccggcggcgagcgcgccgtggcggaggtgctggacgtgggcggcgccgaggaggccgtgagggagctggcggaggacggcgaggccagccccagggggaaggccaaggcggaggcgctgctcagggccctcgaggagggcgccgccggcgccaggcggcggcatgagcaccggttcgcggatttcctcaacgggctcgtggtgtccgacccctacttctcgtcgccggcgtcggccaccacgcacgacgacgcgtcacgcgttacgcttggctgaccctgcacgcacgtacgtacgtgtctaattaatttgcacgctggtggtattatacttccgtgttggtgatcagctgatgtaaatactacagtactgtagtagtgtgtacactaatggttatttgaggagattcttctgtgctttcacaaaaaaaaaaaaaaaa

SEQ ID NO: 3890 - protein, 344 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Arm; PFam Description:
  misc_feature: PFam Name: Pkinase; PFam Description: Protein kinase domain
  misc_feature: GI Number: 50904547; NR Description: B1139B11.16 [Oryza sativa (japonica cultivar-group)] >gi|20161875|dbj|BAB90788.1|
  misc_feature: GI Number: 57900187; NR Description: armadillo/beta-catenin
  misc_feature: GI Number: 30680596; NR Description: armadillo/beta-catenin
  misc_feature: GI Number: 21593574; NR Description: unknown [Arabidopsis thaliana]
  misc_feature: GI Number: 6579203; NR Description: T23G18.19 [Arabidopsis
MEVKRHAARTLVGRLRGAAAVRDAGATAAAVAELRRASKDDPEVRAPLADAGAVPFLASQLTAPSTSAAAEDAAAALLNISLSAREQLMSAPGILDALARAIRAEDYEAAHHAAAVVASLLCVDAYRPIVGAKRALLSALVSLLLPSKARGTRATKDALKALFGVALYPLNRAALVELGVVRALFGLVMTDGRTGIVEDATAVVAQVAGCAESLDAFAAVSGVRILADLVEPGGAATGRARENAAAALLNLVMAGGERAVAEVLDVGGAEEAVRELAEDGEASPRGKAKAEALLRALEEGAAGARRRHEHRFADFLNGLVVSDPYFSSPASATTHDDASRVTLG

SEQ ID NO: 3891 - DNA, 1898 bp, Triticum aestivum
  misc_feature (1)..(1898): Ceres cDNA ID no. 21665965
  misc_feature (1)..(1898): Ceres CLONE  ID no. 926246
  misc_feature (1)..(1898): Also known as  Ceres CDNA ID no. 24361456
gttaactactcgctcgacaccacaccacccggcggcaggcagcctctctctcacacacacagagcccggtggttgactactacctacccactactctactcactgagcagagcagctttcggggcgcgatccaggaagccaggaacggcaagccggcgccgcggcggcggctccatcgcgacgacaagaaatggccaccgccctccgccctccccggctcccagcagtcccggagcaagcttcctcgcttcatcgcttacccaagcacagagttgctgtcactgggcgtaggagcttcgccgccagggccggctcgtatccaggcaacgtgggcgtcccgaagcaatggtacaacctcatcgccgacctgccggtgaagccgccgccgatgctgcacccggggacgcaccagccgctcaaccccagcgacctggcccctctcttccccgacgagctcatcaggcaggagctcacggaggagcgcttcatcgacatacccgacgaggtccgggatgtctacgagctctggcgcccgacgccgctgatcagggccaagaggctggagaagctgctcggcacgccggcgaagatctactacaagtacgaaggcactagcccggcggggtcgcacaagggcaacaccgccgtgccgcaggcgtggtacaacgccgcggcgggggtcaagaacgtggtcaccgagaccggcgccggccagtggggcagcgcgctctccttcgccagcaccctcttcggcctcaactgcgaggtgtggcaggtgcgcgcgtcctacgaccagaagccgtaccggaggctgatgatggagacgtggggcgccaaggtgcacccgtcgccgtcggacgtgacggaggccggcaggaggctcctggcggcggacccgagcagcccggggagcctcgggatggccatctccgaggcggtggaggtcgcggccaccaacgccgacaccaagtactgcctcggcagcgtgctcaaccacgtcctgctgcaccagaccgtcatcggcgaggagtgcctggagcagctggcggccatcggcgacacaccggacgtcgtcatcggctgcaccggcggcggctccaacttcggcgggctcgccttccccttcatgcgcgagaagctggccggcaggatgaacccgcagttcaaggccgtggagcccgccgcgtgccccacgctcaccaagggcgtctacgcctacgactacggcgacacggccgggctgacgccgctgatgaagatgcacaccctcggccacgactttgtccccgatcccatccatgcaggtgggcttcgctaccatggaatggcgcctctgatctcccatgtgtacgagctcgggttcatggaggccatgtccatacagcaaactgagtgcttcgaagctgcattgcaatttgcacggacggagggcatcatcccagcgccggagccgacgcacgcgatcgcggcggcgatcagggaagcgctggagtgcaagaggaccggggaggagaaggtcatcctcattgccatgtgcggccacggccacttcgacctcgccgcctacgaccggtacctgagaggcgacatgattgatctctcacactccgctgagaagctcaaggagtctctgggtgccattcccaaagtctgatgttagagattcagagatttatagaagaacggtgtgggaagtgggaatacaataagatgaacaatgtggcgctttcttggtgcatggcacaaataaatttgatcaataaatggccgaagcataagaatgtttctagaaacttttggaaacgagccgaaagtaaaaagtcgtgtgtaccaaaagccttatcccaaacactttgatgcagttttgtatccttaaggttacaaaaaaaaaaaaaaaa

SEQ ID NO: 3892 - protein, 487 aa, Triticum aestivum
  misc_feature: PFam Name: PALP; PFam Description: Pyridoxal-phosphate
  misc_feature: GI Number: 41724750; NR Description: COG1350: Predicted alternative tryptophan synthase beta-subunit (paralog of TrpB)
  misc_feature: GI Number: 48845507; NR Description: COG1350: Predicted alternative tryptophan synthase beta-subunit (paralog of TrpB)
  misc_feature: GI Number: 23013468; NR Description: COG1350: Predicted alternative tryptophan synthase beta-subunit (paralog of TrpB)
  misc_feature: GI Number: 48764401; NR Description: COG1350: Predicted alternative tryptophan synthase beta-subunit (paralog of TrpB)
  misc_feature: GI Number: 53766227; NR Description: COG1350: Predicted alternative tryptophan synthase beta-subunit (paralog of TrpB)
MATALRPPRLPAVPEQASSLHRLPKHRVAVTGRRSFAARAGSYPGNVGVPKQWYNLIADLPVKPPPMLHPGTHQPLNPSDLAPLFPDELIRQELTEERFIDIPDEVRDVYELWRPTPLIRAKRLEKLLGTPAKIYYKYEGTSPAGSHKGNTAVPQAWYNAAAGVKNVVTETGAGQWGSALSFASTLFGLNCEVWQVRASYDQKPYRRLMMETWGAKVHPSPSDVTEAGRRLLAADPSSPGSLGMAISEAVEVAATNADTKYCLGSVLNHVLLHQTVIGEECLEQLAAIGDTPDVVIGCTGGGSNFGGLAFPFMREKLAGRMNPQFKAVEPAACPTLTKGVYAYDYGDTAGLTPLMKMHTLGHDFVPDPIHAGGLRYHGMAPLISHVYELGFMEAMSIQQTECFEAALQFARTEGIIPAPEPTHAIAAAIREALECKRTGEEKVILIAMCGHGHFDLAAYDRYLRGDMIDLSHSAEKLKESLGAIPKV

SEQ ID NO: 3893 - DNA, 1643 bp, Triticum aestivum
  misc_feature (1)..(1643): Ceres cDNA ID no. 21665966
  misc_feature (1)..(1643): Ceres CLONE  ID no. 927900
  misc_feature (1)..(1643): Also known as  Ceres CDNA ID no. 25088343
ccctttgggggccacggataatcctgcaacccccgcataacaaaatgatttcctcctgatcggcgcctccctcctccgtcggccatccccacctccccgtccccttttaaaccccccacaaaatctcccaatttgaagccatctcgtacggaccccacagctcccagcaggccagcacgaccaccagcgagctccccaaccccatggcaggcggcggcgggaaggtggcctgcgcagcgtggatccggcgccgggaggacaaggccacccgcgtcttcgcggtgcacggccggccctccccgccggccctggaggtcctcggcttcgactccgggagctgctcgctctccgaggaggccctggcgagaatcgtgctcggggaggacccagacgacgcgccgctcgctgtcgcggtgcaccccaccggcgacgagctcgtgtgcgccacggccaaggggtgcaggctatttaaactgatttttgaagagttcaccgttcgctttattgaaagtaaagctccagcgatcgaatctgttggactgcagaaatgtcttgccttcagcacagatggtgctaaatttgctattggtggtgagtatgggcatctaagaatatttcattggccaagcatgaaggtgctcctagatgaacccaacgctcataaatccttcagagacatggatatcagcttagattcagagtttttagtttcatcgtctactgatggtactgcaagaatttggaagataaatgagggggtaccattggtcaacttgactcgatcttcggacgagaggattgagtgttgccgcttttctagggatggcatgaaaccgttcctgttttgcacagttgcaaaaggtagcaaagctgtcactgttgtttggaacataagtgattggtctagaattgggtacaaaagactactgggaaaacctgtctccacactttcagttagcttggatgggaagtttctggctttaggaagccacgatggtgatttttgtgttgtggatgtaaaggagatggagatttctcactggagcaagaaggttcatcttggttccccagtatacggaattgaattttgtcctactgaaagagttgtaatctccacatcgccgcaatggggagcagagctgacaagactgaatgtgcctgctgactggaaagaatggcaaatctggctcatacttttggcgctcttccttgcatcagccgtcctgttctacgtattctaccagaactccggttccttctggagcggaacgccccgacgggacgtcatcgacctaccaagccatgcagagttctgaacgagcctccgccgtctcctgaacaccgaaactcctggtgaaactgttcaccggtgattctctttcaggcaacccagtcctgcagtgtgttatttatttcattcataccgagagctttttctttctttacgagtgtagtcgatgttgtaccaatccagttgcgtgcctatctatctggcgacgtcagtatttatcggggaacactgtaaaatgacactgtaaatgataatagttcgagaatgtcatcgagtgttagtgagacattcaagatcgccaactgaagtcgactcctcgacacaagttttctcgtcaaaaaaaaaaaaaaaa

SEQ ID NO: 3894 - protein, 370 aa, Triticum aestivum
  misc_feature: PFam Name: WD40; PFam Description: WD domain, G-beta repeat
  misc_feature: GI Number: 50934809; NR Description: transducin / WD-40 repeat protein-like [Oryza sativa (japonica cultivar-group)] >gi|34394605|dbj|BAC83907.1| transducin / WD-40 repeat protein-like
  misc_feature: GI Number: 34897162; NR Description: putative membrane protein [Oryza sativa (japonica cultivar-group)] >gi|28209528|gb|AAO37546.1| putative membrane protein [Oryza sativa
  misc_feature: GI Number: 9758764; NR Description: St12p protein [Arabidopsis thaliana] >gi|22327692|ref|NP_680414.1| WD-40 repeat family protein / St12p protein, putative [Arabidopsis thaliana]
  misc_feature: GI Number: 8777388; NR Description: protein transport protein
  misc_feature: GI Number: 11358859; NR Description: St12p protein [imported]
MAGGGGKVACAAWIRRREDKATRVFAVHGRPSPPALEVLGFDSGSCSLSEEALARIVLGEDPDDAPLAVAVHPTGDELVCATAKGCRLFKLIFEEFTVRFIESKAPAIESVGLQKCLAFSTDGAKFAIGGEYGHLRIFHWPSMKVLLDEPNAHKSFRDMDISLDSEFLVSSSTDGTARIWKINEGVPLVNLTRSSDERIECCRFSRDGMKPFLFCTVAKGSKAVTVVWNISDWSRIGYKRLLGKPVSTLSVSLDGKFLALGSHDGDFCVVDVKEMEISHWSKKVHLGSPVYGIEFCPTERVVISTSPQWGAELTRLNVPADWKEWQIWLILLALFLASAVLFYVFYQNSGSFWSGTPRRDVIDLPSHAEF

SEQ ID NO: 3895 - DNA, 725 bp, Triticum aestivum
  misc_feature (1)..(725): Ceres cDNA ID no. 21665967
  misc_feature (1)..(725): Ceres CLONE  ID no. 929982
  misc_feature (1)..(725): Also known as  Ceres CDNA ID no. 23731447
aaccacttcttcaccaagaaacaaggaagatctatcccctcaaaaaagatccccgcatcctccaattccattggcatacagattttcgcaagctgattttagttttagcatggagaggttcgccgctatggtcgccggccgccgtgccggtgccgctccgaagcccgcttccgccgccgaggaggggggcgaggagtacctgcggatccagctggaggagatcgtcatcgtcaaggacgacacctacgacgccctcgccgccgccacggccgccgcgcagtcccgcgccaacgccaacggccaatgcggcggcggcggcgccaccaccacgggcacggcgtccaccgccatggagaactgcgcgagggcggccgcggcggcgcgcgttgagagctcgacgaggcctgcggccgcgcagggcgcgtggaccacggcggcgaggggcgtcggcttcgactaggcgtcgaccaccccgacgcgctcctttcccatcggtgggtgggtggttatccgtacgcgtccttgttcctatccagcatcgaagtcgaagatcgggttgatgaactccagtctagttatttttttcgtttttgcttgattactcgttggtgaggttggtggagaggggatcggttgtatagtagtagcttggatcgtcaaatcggttctctggttgatcctgttgctatatagcatgccaatttatctcaaaaaaaaaaaaaaaa

SEQ ID NO: 3896 - protein, 116 aa, Triticum aestivum
  misc_feature: PFam Name: 7tm_1; PFam Description: 7 transmembrane receptor
  misc_feature: GI Number: 57900284; NR Description: putative Ser/Arg-related
  misc_feature: GI Number: 53792137; NR Description: zinc knuckle containing protein-like [Oryza sativa (japonica cultivar-group)] >gi|53791906|dbj|BAD54028.1| zinc knuckle containing protein-like
  misc_feature: GI Number: 34905768; NR Description: P0401G10.10 [Oryza sativa (japonica cultivar-group)] >gi|20146220|dbj|BAB89002.1|
  misc_feature: GI Number: 53792395; NR Description: zinc knuckle containing protein-like [Oryza sativa (japonica cultivar-group)] >gi|53792363|dbj|BAD53097.1| zinc knuckle containing protein-like
  misc_feature: GI Number: 66777827; NR Description: MaoC-like dehydratase [Anaeromyxobacter dehalogenans 2CP-C] >gi|66856398|ref|ZP_00400464.1| MaoC-like dehydratase
MERFAAMVAGRRAGAAPKPASAAEEGGEEYLRIQLEEIVIVKDDTYDALAAATAAAQSRANANGQCGGGGATTTGTASTAMENCARAAAAARVESSTRPAAAQGAWTTAARGVGFD

SEQ ID NO: 3897 - DNA, 952 bp, Triticum aestivum
  misc_feature (1)..(952): Ceres cDNA ID no. 21665968
  misc_feature (1)..(952): Ceres CLONE  ID no. 930916
  misc_feature (1)..(952): Also known as  Ceres CDNA ID no. 23484080
cccagcgattcatccccaaactcccgatagcaccgagacagacatcgccatagccgcatcacatgcgacgggaggagctcccaccgcacttgtccttgtcggaggatcctccgggaagtggagtgcccggcgcgacgctgttggagacgccatttgcgagcccaagcgcggtcgggctccacgcgccggcacggcggcctcggccgcggccgcttgaaggcgaagccaacggcgggctggagagggtggccggtgtcagggatggtagacgcggtgcttcggcatcaataaccccatggttggaggaacaagaggccagcgcgtcgcgggcggcgacctcgacgaccgcggggtcggagatgcagcggcggtggcgcggcttcctccacgaccggctcggtcctgacgtccaagttgtactgatgtagggggcatacgacctagacgtgtaccgagcactaaaatagcagcggcggcatggccagcgccgggtcatcctcgagccttggtgctgccgggccggtgagaagccaggcgggcacatcgggctacagaggcgcaggtggctgcacaggctggttcgacggccccgcaccgtttggtggtggcgacgaagatcctggtggcgctagtttcgacctccacgccgaaaacgacgaaggtcgcgcacacgacggtggaagcggcgacatccgctcacaccgtggcgacagttgcgtgcgatgaagcggcggcgacggctggcggcgcgagccaggcgaagaagaaaaaagacaggaaaccaggcatttttcttctcaccttttgcctgttcttccgcttcttctcgtcggaatcgctctcgcgagcagtgctgataacgtgttgcaagttgattgtaaaggaacgagagagacaaccatcagagagacaaatgaatcgaagtatcctttatcgaaaaaaaaaaaaaaaa

SEQ ID NO: 3898 - protein, 121 aa, Triticum aestivum
  misc_feature: PFam Name: TT_ORF1; PFam Description: TT viral orf 1
MRREELPPHLSLSEDPPGSGVPGATLLETPFASPSAVGLHAPARRPRPRPLEGEANGGLERVAGVRDGRRGASASITPWLEEQEASASRAATSTTAGSEMQRRWRGFLHDRLGPDVQVVLM

SEQ ID NO: 3899 - DNA, 1625 bp, Triticum aestivum
  misc_feature (1)..(1625): Ceres cDNA ID no. 21665969
  misc_feature (1)..(1625): Ceres CLONE  ID no. 934651
  misc_feature (1)..(1625): Also known as  Ceres CDNA ID no. 24405812
gcctcatctccctccctctctcagttcctcgctcgcgcaccaactctttcaaaatcccccactttctcgcgtgcctgcgtcgattccgtccgtcgtgctcgccgccggttcggggggcgcctggatgaggcggccccgctgaccggagccgaatccgccgcgcgccgcccatggcgcagccgcagccgcagcagcgggtctaccaagcttggaaagggaataataggttcttcctcggagggagattgatattcgggcccgatgccaagtccctgctcgtctcggttgcgctcatcgtggtgccggttctcgtcttctgcgccttcatcgcaccgcacctgcttcaccgattctccgactacaacgcaggatacgcgattcctgcggtggcagtcgggttcatgatctatgtgcttctgttgctgctgatcacctcggctcaggatcctggtatcgtgccccgtgcatcgcatccaccagaggaagattttgcgtatggcaatccgttagctggggaaacaccgggcaggctgcagtttccccgtataaaggaagtgatggttaatgggatgcttgtgaagataaagtattgcgacacctgcatgatttaccggcctcctcggtgctcgcactgttcgatatgcaacaactgtgtggagcgattcgatcatcattgcccctgggttggacaatgcattggtcagcgcaattaccgatactttttcctatttgtttcttcctcgactcttctttgcatttatgtctttgccatgtcggctctacacatcaagtttctcatggacggagactatcctacagtatggaaggctttcaaacactctccagcttgcttggtgcttatgatatattgtttcattgctctctggtttgttggtgggctcactggatttcattcatatctcattagcactaaccagacgacatacgagaattttcggtacagagcagacagcaggcccaacgtctatgaccgaggatgtctgaataacttcctggaagtcctgtgcagcaaggggaaaccttccaagcacaggttccgagcctatgttcaagaggaggtacgcgctccagtggttaacttcggtaggcagatggaggaggaaccagctggcggccctcgcgcaaaggtagaagacgatcctgagattggcagcgatctcctgaagatctctcggcggcgcaactacgaggacgttgacgtcgaaatggggaaccaggacgacggtgagaaggaaggcatgggcgacgccaaactggcggcgggttcgggatcgcagatccctgcggtcgggagcgaggtgcgggtgcggcactcgagctgggaccggaggagtgggaactgggacatgtcgtcggacgtgatcggaaggagcgcatcggatgtgcttggaagaagcgcttcgctcaccgaggctgcgccgcggtctcaaagagaaactcactagtagccaatatgtgtgaattcttctgaactttgtgttggcgggctgggttctgtgattgtttactgatggtgacacaccgggagaagagagaaggacaatggctgtgacccattttgacttttgacatgccatgttttggtatcaaaaaaaaaaaaaaaa

SEQ ID NO: 3900 - protein, 431 aa, Triticum aestivum
  misc_feature: PFam Name: zf-DHHC; PFam Description: DHHC zinc finger domain
  misc_feature: GI Number: 56784777; NR Description: putative NEW1 domain
  misc_feature: GI Number: 34908626; NR Description: P0677H08.13 [Oryza sativa (japonica cultivar-group)] >gi|29365512|dbj|BAB89798.2|
  misc_feature: GI Number: 30688566; NR Description: zinc finger (DHHC type)
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
MAQPQPQQRVYQAWKGNNRFFLGGRLIFGPDAKSLLVSVALIVVPVLVFCAFIAPHLLHRFSDYNAGYAIPAVAVGFMIYVLLLLLITSAQDPGIVPRASHPPEEDFAYGNPLAGETPGRLQFPRIKEVMVNGMLVKIKYCDTCMIYRPPRCSHCSICNNCVERFDHHCPWVGQCIGQRNYRYFFLFVSSSTLLCIYVFAMSALHIKFLMDGDYPTVWKAFKHSPACLVLMIYCFIALWFVGGLTGFHSYLISTNQTTYENFRYRADSRPNVYDRGCLNNFLEVLCSKGKPSKHRFRAYVQEEVRAPVVNFGRQMEEEPAGGPRAKVEDDPEIGSDLLKISRRRNYEDVDVEMGNQDDGEKEGMGDAKLAAGSGSQIPAVGSEVRVRHSSWDRRSGNWDMSSDVIGRSASDVLGRSASLTEAAPRSQRETH

SEQ ID NO: 3901 - DNA, 1002 bp, Triticum aestivum
  misc_feature (1)..(1002): Ceres cDNA ID no. 21665970
  misc_feature (1)..(1002): Ceres CLONE  ID no. 937078
  misc_feature (1)..(1002): Also known as  Ceres CDNA ID no. 24361669
atgcgcagaccgtgggtgggaggcccacgcgtctgtgagattacgtgatatttcggccaagaatccacctacgcgtagttctgccgcacgttacgtggataaaaaggcaggaccgttcggggggcgaagaattgcgcacagcaaccaaccgtgtcagggaaggaattgaggcgagcgagagagaaccccacatcacatggcgaacggcgtgggctcggcgaaggcggagatctgcgccgggctgggcatgccgatggcggagctggagcaggtgttccggcgctacgacgccaacggcgacggcaagatctcggcggacgagctggcgtccgtgctgctcgcgctgggcgcgcccccggggccaggggaggtgcagagcatgatggaggagatggacgccgacagggacggcttcgtcgacctccacgagttcgccgccttccactgcgggccctgcaagggcggcgcggccgcagacgccaaggagcaggaggccgccacggaggcggagctcaaggaggccttccggatgtacgacgccgaccgcaacgggctcatctccgcgcgggagcttcaccgcgtgctccgccagctcggggagaagtgctccgttgctgactgctcgcgcatgattcgatccgtcgacgccgacggcgacggcagcgtcaacttcgaggaattcaagaagatgatgggcggcggagggaggagctaggtcggtaagggccggccatgagcaaacaatgctgcatctgcatgcctcgttgagggttttgttcctccatggtgcttaatttaatttaattaatctcaaagtgaaaggcttaggctccccgtaatgcgaatactaatgatgatgcgggtgaagtgattaattatgtaaatctaatcttctagtagtagtagtactactaatgatgatgggtgtactaagaaatttggtctggggttgtttgcaatgaattagaactcgtttgaaactcttcaaaaaaaaaaaaaaaa

SEQ ID NO: 3902 - protein, 172 aa, Triticum aestivum
  misc_feature: PFam Name: efhand; PFam Description: EF hand
  misc_feature: GI Number: 29367367; NR Description: calmodulin-related
  misc_feature: GI Number: 50904487; NR Description: B1147A04.10 [Oryza sativa (japonica cultivar-group)] >gi|19386815|dbj|BAB86193.1|
  misc_feature: GI Number: 14589311; NR Description: calcium binding protein
  misc_feature: GI Number: 25403253; NR Description: protein F21J9.28 [imported] - Arabidopsis thaliana >gi|15221781|ref|NP_173866.1| polcalcin, putative / calcium-binding pollen allergen, putative [Arabidopsis thaliana] >gi|9743349|gb|AAF97973.1| F21J9.28
MANGVGSAKAEICAGLGMPMAELEQVFRRYDANGDGKISADELASVLLALGAPPGPGEVQSMMEEMDADRDGFVDLHEFAAFHCGPCKGGAAADAKEQEAATEAELKEAFRMYDADRNGLISARELHRVLRQLGEKCSVADCSRMIRSVDADGDGSVNFEEFKKMMGGGGRS

SEQ ID NO: 3903 - DNA, 1250 bp, Triticum aestivum
  misc_feature (1)..(1250): Ceres cDNA ID no. 21665971
  misc_feature (1)..(1250): Ceres CLONE  ID no. 940427
  misc_feature (1)..(1250): Also known as  Ceres CDNA ID no. 24360432
aagaaaaatttagagccttgcgtgcccacaccgcccttgaccacaccccaccaccaaccgccctccccttggcgatccccacacacttgcccaaccaaccacacttgtcccacgcctctcctcctcctctcctctcgccttgtacgagtctcaccttgctgcgtccatccacccaccgaccatccaccacttcccccaaagtctcctcctttctcccttctcagccaagcaaccaagcgatctcgccgatgaagagggagggcttccagcacggcgccgtccgggtcaaccgcaacaagctgctgcgggtcgccggcggcaccaacggcgacgcggcggccgcggcgctggagctcgccggcgtcgcctacgccagggcgccgtccaagccgaccaacgcgtccagggacacgggccggtgccggcggccccggtgcgcgggctgccacgtgcaccccgccgccaaggcccgggacaaggccaagggcgcccacaagctgcgcgcctccgacgtcgccctcaaccaccgcctcgtctcctggcgcctcgtcgacggggaccccgccgccgccgccgcccgcaccggcggcgtgcccgactacaagggcgcctccgcgtccgccgtgctcgcctacctcgccggcggcaacagctggcaccaggaggaggaggaggacgatgaggaccaggacggcgccgatcttcaggcccccccaagggggatctccgacctgtacgacctcatcgtcggcctccaggcccgcgcggcccctgcgccgggcggcccagaagacgacgccgatggcacggcagcagtaacacccagcgatgaaatcgaggaattgcagggtgctgaaatcactgacgacgccgacgaggaggaggaggacgacggattctgcatggtgcagggcatcaccatcgcgctcgagttctccgacggggaggaggactggatcgtggtctgatctcattcagtttgcaaataataagacgtgcaacagaggtcagccgtccgcatccctccgcctctgctgccgctgcgcaattcccttccatccgcgtctgctctgttcctgttaattgatggtcgtgtccctgtgtgtatactgctctgttgtcatgttaattggtcgtgtccctgtgtatatatctggtgactgtctgtctaatttgtcaaaaattcatggattatcatgacctgaatctatcaatcatgtgtgaataaaattaaaaaaaaaaaaaaaaaa

SEQ ID NO: 3904 - protein, 239 aa, Triticum aestivum
  misc_feature: PFam Name: FH2; PFam Description: Formin Homology 2 Domain
  misc_feature: PFam Name: Pyr_redox_2; PFam Description: Pyridine
  misc_feature: PFam Name: Pkinase; PFam Description: Protein kinase domain
  misc_feature: PFam Name: 7tm_1; PFam Description: 7 transmembrane receptor
  misc_feature: PFam Name: Extensin_2; PFam Description: Extensin-like region
  misc_feature: GI Number: 21536928; NR Description: unknown [Arabidopsis thaliana]
  misc_feature: GI Number: 5305335; NR Description: proline-rich mucin
  misc_feature: GI Number: 228938; NR Description: Hyp-rich glycoprotein
  misc_feature: GI Number: 227614; NR Description: Thr rich extensin
  misc_feature: GI Number: 4007865; NR Description: Hydroxyproline-rich Glycoprotein (HRGP) [Zea mays] >gi|82698|pir||JQ0985 hydroxyproline-rich glycoprotein precursor - maize >gi|257041|gb|AAB23539.1| hydroxyproline-rich glycoprotein; HRGP
MKREGFQHGAVRVNRNKLLRVAGGTNGDAAAAALELAGVAYARAPSKPTNASRDTGRCRRPRCAGCHVHPAAKARDKAKGAHKLRASDVALNHRLVSWRLVDGDPAAAAARTGGVPDYKGASASAVLAYLAGGNSWHQEEEEDDEDQDGADLQAPPRGISDLYDLIVGLQARAAPAPGGPEDDADGTAAVTPSDEIEELQGAEITDDADEEEEDDGFCMVQGITIALEFSDGEEDWIVV

SEQ ID NO: 3905 - DNA, 1522 bp, Triticum aestivum
  misc_feature (1)..(1522): Ceres cDNA ID no. 21665972
  misc_feature (1)..(1522): Ceres CLONE  ID no. 942224
  misc_feature (1)..(1522): Also known as  Ceres CDNA ID no. 24361441
attcacttcatcctctcctctcctcctctgaagcgctctgctctcctctgcaaaattggatcttcatcacatcctcctgtgccccgccctgccctgcctgcattccctccctccctttagatcgatcgatcgatccgattagatccgcgcaagcaaagcaaagcaattgcaattgatattggatcggcatccgcagagaattgcgctcctctccgatccacccaattgcaatcgcaaaattgcgtcctccgtcctggatcgccggccggccattgctcacctggatccgccccaccacatcagagcagagcagtttcagcaggcagggagacgacatcagtcaggccggtgaagcagtatgatgatggggaccgatgtgtgttcttcgcggatgctgtcgctgccccgttacgagagcggcgacgaggagctcaccgtgctgcccaggcacaccaaggtcgtcgtcaccggtaacaaccggacaaagtccgtgctcgtcggcctgcagggtgtggtcaagaaggctgttggccttggaggctggcactggctgcaggttctcaagaatggtgtggaggtgaagttgcagaggaatgccctgagtgtcttggaagctccgactggcaacgaggacgacgacgagatcgatggcggtaacagctccttctgcggcagcttcgacatgggagacaaagacatgaactactcaagcatcgagtaccagaagccaacaaagccgagggtccggcacacaaggccatggtcttcctgcacgacgacgtccagcagccgggccaacaaccttcactcgacctcgaagctgcgagcgagagtgaacctgacaaagcttggaacacccacactatggagatactggaagcacttcaaccttgtgagcatgaacccgactccatcagaggagcagctgttccatggggtccagcagcatttccagtcgcagcaattggatgagttgcaggtgatcttggggttcatccagacggcaaagaggctcaagaccctgtacaagaacagctcctagcccagccttccttcattcctcagatgcatacatacatatgcttcaccttcaccttcaccagtggtttcagttgctgttagtagagagaaagagagagagagagagagagggagagaagaggttagatgatgatgcatcatgtggttaagtaagtaagtaagttattaatcttagtctcctccactttaatgggaagcaagttgtgaacagagagggatttgtactggcacatttgatcagtacagattcttagcttctcttcttcttcttcttactccttgtaatgatgagagagagagagcaaaaatgatggatgctgaatcatgtaaccccagaccagaccccttgctgctgctgctgctgtttgttataactgaccatcaaaccaaaccaatctcagttatttggagagatactaaatactagcaagtattatagttaattaattaataattagttaatgtaaaaaaaaaaaaaaaa

SEQ ID NO: 3906 - protein, 1522 aa, Triticum aestivum
  misc_feature: GI Number: 38567956; NR Description: OSJNBb0115I21.12 [Oryza
  misc_feature: GI Number: 25372870; NR Description: protein F18O14.5 [imported] - Arabidopsis thaliana >gi|8778446|gb|AAF79454.1|
ATTCACTTCATCCTCTCCTCTCCTCCTCTGAAGCGCTCTGCTCTCCTCTGCAAAATTGGATCTTCATCACATCCTCCTGTGCCCCGCCCTGCCCTGCCTGCATTCCCTCCCTCCCTTTAGATCGATCGATCGATCCGATTAGATCCGCGCAAGCAAAGCAAAGCAATTGCAATTGATATTGGATCGGCATCCGCAGAGAATTGCGCTCCTCTCCGATCCACCCAATTGCAATCGCAAAATTGCGTCCTCCGTCCTGGATCGCCGGCCGGCCATTGCTCACCTGGATCCGCCCCACCACATCAGAGCAGAGCAGTTTCAGCAGGCAGGGAGACGACATCAGTCAGGCCGGTGAAGCAGTATGATGATGGGGACCGATGTGTGTTCTTCGCGGATGCTGTCGCTGCCCCGTTACGAGAGCGGCGACGAGGAGCTCACCGTGCTGCCCAGGCACACCAAGGTCGTCGTCACCGGTAACAACCGGACAAAGTCCGTGCTCGTCGGCCTGCAGGGTGTGGTCAAGAAGGCTGTTGGCCTTGGAGGCTGGCACTGGCTGCAGGTTCTCAAGAATGGTGTGGAGGTGAAGTTGCAGAGGAATGCCCTGAGTGTCTTGGAAGCTCCGACTGGCAACGAGGACGACGACGAGATCGATGGCGGTAACAGCTCCTTCTGCGGCAGCTTCGACATGGGAGACAAAGACATGAACTACTCAAGCATCGAGTACCAGAAGCCAACAAAGCCGAGGGTCCGGCACACAAGGCCATGGTCTTCCTGCACGACGACGTCCAGCAGCCGGGCCAACAACCTTCACTCGACCTCGAAGCTGCGAGCGAGAGTGAACCTGACAAAGCTTGGAACACCCACACTATGGAGATACTGGAAGCACTTCAACCTTGTGAGCATGAACCCGACTCCATCAGAGGAGCAGCTGTTCCATGGGGTCCAGCAGCATTTCCAGTCGCAGCAATTGGATGAGTTGCAGGTGATCTTGGGGTTCATCCAGACGGCAAAGAGGCTCAAGACCCTGTACAAGAACAGCTCCTAGCCCAGCCTTCCTTCATTCCTCAGATGCATACATACATATGCTTCACCTTCACCTTCACCAGTGGTTTCAGTTGCTGTTAGTAGAGAGAAAGAGAGAGAGAGAGAGAGAGGGAGAGAAGAGGTTAGATGATGATGCATCATGTGGTTAAGTAAGTAAGTAAGTTATTAATCTTAGTCTCCTCCACTTTAATGGGAAGCAAGTTGTGAACAGAGAGGGATTTGTACTGGCACATTTGATCAGTACAGATTCTTAGCTTCTCTTCTTCTTCTTCTTACTCCTTGTAATGATGAGAGAGAGAGAGCAAAAATGATGGATGCTGAATCATGTAACCCCAGACCAGACCCCTTGCTGCTGCTGCTGCTGTTTGTTATAACTGACCATCAAACCAAACCAATCTCAGTTATTTGGAGAGATACTAAATACTAGCAAGTATTATAGTTAATTAATTAATAATTAGTTAATGTAAAAAAAAAAAAAAAA

SEQ ID NO: 3907 - DNA, 1138 bp, Zea mays
  misc_feature (1)..(1138): Ceres cDNA ID no. 21665973
  misc_feature (1)..(1138): Ceres CLONE  ID no. 987363
  misc_feature (1)..(1138): Also known as  Ceres CDNA ID no. 24358368
agactggggcacgcaactctatcgatctccgcccacctcgtccctcacttgccctctccctgccaggcttgccggaaccctagcctcatcgcccctcccctcccggcccgatctccctatcgccggattcgtgctgcgggatggactccgacgtggagatgaacgccgccagcgacgaggaggtgatggacgatgaggattactacgactactgctacagcgacgtgggtgacgacggcgacggcgggagcgaggaggagctggtgcccgtggactacgacgagggccttgaggccgagggtaccgacgaggtggtgtccagacgcgagcagacatttgtggttctaaatgaagaagttatatctgagcgtcaagaggaagatgtaagcaaggtatcagccgtgttactgattacaagggaagaggcatgtgccctcctgcatcactataaatggaacatcagcaagttgagtgatgaatggtttgcagatgaagaaaaagtccgccatactgttggcttacttttgaatggaaatcatgagcccggctctaggaagctaacctgtggaatatgttttgaagggtattcttctgatacgatgagctctgctggttgtgctcatttttattgccatgaatgttgggaaggctacattagcgctgcaataggtggtggtccaggatgtttgtctttgcgatgtcctgatccatcatgtagtgctatggttcttcaagggatggttaatgaattagctaaagatgaggacaaagcaaagtacgcacgatttctcttacgtgcatacgttgaaggtagcaagaagactaaatggtgtccagctcctgactgtacatgtgctgtggagtttcttggtgatgaaaactatgatgtctcatgcaattgcaagttcagcttttgctggaattgcactgaggaagctcatcgaccagtgaactgcgagactgtttctaagtggatattaaagaatagtgcagaatctgaaaatatgaactggtttgtcgcaggctcaggactagcgtttgatatgtggtcttcaagtttctgtttttgttgataccatctttagttaagacatggcatataaataaggagttccttgatttaaaaaaaaaaaaaaaa

SEQ ID NO: 3908 - protein, 310 aa, Zea mays
  misc_feature: PFam Name: IBR; PFam Description: IBR domain
  misc_feature: GI Number: 50948087; NR Description: putative ariadne [Oryza sativa (japonica cultivar-group)] >gi|38636670|dbj|BAD03091.1| putative ariadne [Oryza sativa (japonica cultivar-group)] >gi|50725684|dbj|BAD33150.1| putative ariadne [Oryza sativa
  misc_feature: GI Number: 40850577; NR Description: ARIADNE-like protein
  misc_feature: GI Number: 50725349; NR Description: ARIADNE-like protein
  misc_feature: GI Number: 29125025; NR Description: ARIADNE-like protein
  misc_feature: GI Number: 6850317; NR Description: Contains similarity to Ariadne-2 protein from Drosophila melanogaster gb|AJ010169 and contains an IBR PF|01485 and a zf-C3HC4 (RING finger) PF|00097 domain. ESTs gb|AA585849, gb|T42014 come from this gene.
MDSDVEMNAASDEEVMDDEDYYDYCYSDVGDDGDGGSEEELVPVDYDEGLEAEGTDEVVSRREQTFVVLNEEVISERQEEDVSKVSAVLLITREEACALLHHYKWNISKLSDEWFADEEKVRHTVGLLLNGNHEPGSRKLTCGICFEGYSSDTMSSAGCAHFYCHECWEGYISAAIGGGPGCLSLRCPDPSCSAMVLQGMVNELAKDEDKAKYARFLLRAYVEGSKKTKWCPAPDCTCAVEFLGDENYDVSCNCKFSFCWNCTEEAHRPVNCETVSKWILKNSAESENMNWFVAGSGLAFDMWSSSFCFC

SEQ ID NO: 3909 - DNA, 1136 bp, Zea mays
  misc_feature (1)..(1136): Ceres cDNA ID no. 21665974
  misc_feature (1)..(1136): Ceres CLONE  ID no. 988020
  misc_feature (1)..(1136): Also known as  Ceres CDNA ID no. 24358376
acggatcaatcacgtaaaggcgagaccgcaaggacaccgagctacttcgaatacgaatacgagctcagcctgttccgagatggacgacgagagcgaggcgagagcaatgccgcggcggcccacgccgccgtcgccacccccgtgggaggcgctccacctcgtcgcgccgttcctcgacgccgcatccctcgcggcggcgtcctgcgtgtccacctcgtggcacaccgccttcgccgcggacgacctctgggcgcggctctgcgcgcagcacttcccctccgcgctgggcctcctccccgacaccgacagcgaccggcggtgctcctccccaccccaccgacgcctgttcaagctgttccgctccgcgtccgtccgctgccgcgcgctcccggccccgcgcctcgccctcgcggacgtctcgttcgccgtcgacgtcgtcacggccggcggcgacagcacgctgtccttcctggtagccgcggacaaggccgcccacgtcgagaattccgcggggctgttcctgttcggggtcgacctgagcggtcggaacggggcgatcgggccaggggagtggcgcgtcaggtggacggcggtgcggacggcggcgcgccgcggcgaggaacccgcggcggtcctgatgatggacgccaaggtgccggcggcaagggcggcaggagccgtcgccttcggcggcagaggtgaggcgggggtctcggcgaggctgcccgcgcccggctgcggcggcgccaagctggacgcggaggtggtggtagagctggctggggaggagaaggccgtcgggaaggtgaggctcggagtgatgtgcgagtgtcggtacgtgtgcgccgacgaggggctccggtacctgcagcatttcctcgtgtgatgtaaaacgcacgtgattcttcgatgatctcgtgcacgcggtcgaatgagaactccgcttgagggaagcagagtagtgtagctgtggaggtagtgcaatgaactgaaccccgaagtctcatttgttgttttcgccgtttaataatggtttcatcttgtagttgttcatatactttttcggacatctttgtgtgtgtgtgatgattctcagattaaagcatcttcaagagttcccaaaaaaaaaaaaaaaa

SEQ ID NO: 3910 - protein, 268 aa, Zea mays
  misc_feature: PFam Name: Cupin_1; PFam Description: Cupin
  misc_feature: PFam Name: 7tm_1; PFam Description: 7 transmembrane receptor
  misc_feature: GI Number: 34908946; NR Description: P0691E06.25 [Oryza sativa (japonica cultivar-group)] >gi|19570989|dbj|BAB86416.1| P0003D09.10 [Oryza sativa (japonica cultivar-group)] >gi|20804741|dbj|BAB92427.1| P0691E06.25 [Oryza sativa (japonica
  misc_feature: GI Number: 58743286; NR Description: At5g04010 [Arabidopsis
  misc_feature: GI Number: 33150824; NR Description: Ser/Arg-related nuclear matrix protein [Homo sapiens] >gi|3005587|gb|AAC09321.1|
  misc_feature: GI Number: 23274133; NR Description: Serine/arginine
  misc_feature: GI Number: 42542379; NR Description: serine/arginine repetitive matrix 1; Ser/Arg-related nuclear matrix protein; plenty
MDDESEARAMPRRPTPPSPPPWEALHLVAPFLDAASLAAASCVSTSWHTAFAADDLWARLCAQHFPSALGLLPDTDSDRRCSSPPHRRLFKLFRSASVRCRALPAPRLALADVSFAVDVVTAGGDSTLSFLVAADKAAHVENSAGLFLFGVDLSGRNGAIGPGEWRVRWTAVRTAARRGEEPAAVLMMDAKVPAARAAGAVAFGGRGEAGVSARLPAPGCGGAKLDAEVVVELAGEEKAVGKVRLGVMCECRYVCADEGLRYLQHFLV

SEQ ID NO: 3911 - DNA, 728 bp, Zea mays
  misc_feature (1)..(728): Ceres cDNA ID no. 21665975
  misc_feature (1)..(728): Ceres CLONE  ID no. 988444
  misc_feature (1)..(728): Also known as  Ceres CDNA ID no. 24365136
atacctaaagatttagcctgaatagaagtgcatggaaaacaactattcatgtgtctgaatcttaatcgtggtttctattggtttttaactctagcctaccctaacttgcttgagataaaagactttgttgttgttgttatagacttatagtgttaacttttcatgttgtatccatgttattttcataaacctgtcgtagatgtcactgggcttgcatgtagagatttttgttatgtttgttttcttgttgcagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcctaactgctgacaggcccatctgcagtcgtccaatttgttcatctcctctctttccctaggcccccaaccttgcagaatgcaataatacagtgtacttgtcttaaaaaaaaaaaaaaaa

SEQ ID NO: 3912 - protein, 137 aa, Zea mays
  misc_feature: PFam Name: NUDIX; PFam Description: NUDIX domain
  misc_feature: GI Number: 50540762; NR Description: putative NUDIX hydrolase
  misc_feature: GI Number: 50882190; NR Description: MutT-like protein [Oryza sativa (japonica cultivar-group)] >gi|38175436|dbj|BAC16411.2| MutT-like protein [Oryza sativa (japonica cultivar-group)] >gi|50508904|dbj|BAD31700.1| MutT-like protein [Oryza sativa
  misc_feature: GI Number: 15231598; NR Description: MutT/nudix family protein [Arabidopsis thaliana] >gi|30688456|ref|NP_850636.1|
  misc_feature: GI Number: 50909011; NR Description: MutT-like protein [Oryza sativa (japonica cultivar-group)] >gi|49389075|dbj|BAD26313.1|
  misc_feature: GI Number: 8698735; NR Description: Contains similarity to AP2/EREBP-like transcription factor from Arabidopsis thaliana gb|AF216581 and contains Bacterial mutT protein PF|00293 and AP2 PF|00847 domains >gi|25518008|pir||E86262 F13K23.14 protein -
MSLGLHVEIFVMFVFLLQGGWENDETVEEAAAREAIEEAGVRGDIVHFLGLYDFKSKTHQDACCPEGMCRAAVFALHVKEELASWPEQSTRQRTWLTVPEAASSCRYQWMQEALLTGFSDWHDKWSRGGGGTNCDPA

SEQ ID NO: 3913 - DNA, 990 bp, Zea mays
  misc_feature (1)..(990): Ceres cDNA ID no. 21665976
  misc_feature (1)..(990): Ceres CLONE  ID no. 988808
  misc_feature (1)..(990): Also known as  Ceres CDNA ID no. 24362718
attcgcccccgcgctacagattatcttcgttgtcgctctctccgttgcctcttcgtcctcgcgctctgccgctccgtgctacagttccctctcatcctcgatctctccgccgtttcttcctccctctcacggccgccgcacattctgctcatccgcttcggcggcatcgttttgttcagggttttctcgcctttgtggctttagggttcgtgttcttcaccagaatccatccggaaaaatgccctttccccttacattttcgactggaggttgtgtattgaagaaccttatccagttcgacgtcagtgccgccaatgctttcctcgacacccacgccgcacatcggcatcggtagctccgctgtcagccactacaactcctcgctgatccataccggccttcatcatcttcgtctttggccgtcactatcgcgcgttgctccaactgcaccaccatcggcatcgaatgttatgattgaaggacatcttcacgctactactttgggtgacaaaaaaggccaattgttgttcacgaaatcacgctgggaactctgggacaacttcacgctactaactctgggaactcaggttgtcgttgaaggatatatttatgctgctacctctacgagctctgtgaaaaaagccaattgttcttcacgctggggactttaagaactctgtgacatcttcacgctgccaactctggaaactcaggtaactattttgcatacctatgatgagcatcatcacttttggagcatgaatgcttttgtgtacatataaccaaaccgctaaaacatttgcagctctgtttttatttaagcgttccgtagctcttcaattactgatgtactctataaatttgtatgaccatgtcggttgactcaacaactactataagcgctagaattatcatctctgaacattgtatgactttttaatcactagaacttggttaaatttggctttgcgcttaaaaaaaaaaaaaaaa

SEQ ID NO: 3914 - protein, 118 aa, Zea mays
MLSSTPTPHIGIGSSAVSHYNSSLIHTGLHHLRLWPSLSRVAPTAPPSASNVMIEGHLHATTLGDKKGQLLFTKSRWELWDNFTLLTLGTQVVVEGYIYAATSTSSVKKANCSSRWGL

SEQ ID NO: 3915 - DNA, 1044 bp, Zea mays
  misc_feature (1)..(1044): Ceres cDNA ID no. 21665977
  misc_feature (1)..(1044): Ceres CLONE  ID no. 988988
  misc_feature (1)..(1044): Also known as  Ceres CDNA ID no. 24364870
acgatcggcacccggccatctctactacttgctagcagctccatcccctcctcggctcctcttccagtccagtaatgggctctgcttcatcagatggtctccgggagcacttgctggacgtggacggcggcgaagcggtggcggcgcccaagatacgggtgcgcgggctgcggcgccgcgcggacgcgaccggcgaggagatcctccgcggcgtccacctcgacgtgccgcgcggggccgtcatgggcgtcatcggccccagcggcagcggcaagtccacgctgctccgcgcgctcaaccgcctctgggagcccgcgcccggcgccgtgctcctcgacggcgccgacatctgcgccctcgacgtcctcgccctgcgccgcaaggtcggcatgctcttccagctccccgccatgttcgacggaaccgtggctgacaacgtacgatacgggccgcagttgcgcggcaagaagctaaccgaggccgaagtgaagagcctgctgcacctggccgacctggaccctgctctgtgctccaagccggcgtccgagctgtcggtcgggcaggcacagcgcgtcgccctggcccggaccctcgccaacgaccccgaggtgctcctgctggacgagccgaccagcgcgctggaccccatctcgacgcagaacatcgaggaggccatcgtgcggctgaagaagacgagggggctcaccacggtgatcgtctcccacagcgtgaagcagatccagcgcatcgccgacctggtgtgcctcgtcgtcgccggcgaggtcgtggaggtgctcgcgccgtccgacctgtccgacgccaagcacccgatggccaggcgtttcttggagctcagcggctgaaagcccgcctgctcgctgctgcttcgttggatttcgaaactcttctacctaatcggatgctttcgagctgttctggatggaaaggatcggacgtgtggttatctttccaatcgcctatcatgttctctacttttgttctcgtgtatacatacaatctgttaaagtaaaaaaaaaaaaaaaa

SEQ ID NO: 3916 - protein, 262 aa, Zea mays
  misc_feature: PFam Name: ABC_tran; PFam Description: ABC transporter
  misc_feature: GI Number: 53791838; NR Description: putative multidrug
  misc_feature: GI Number: 21554406; NR Description: putative ABC transporter [Arabidopsis thaliana] >gi|26450485|dbj|BAC42356.1| putative ABC transporter [Arabidopsis thaliana] >gi|28827588|gb|AAO50638.1| putative ABC transporter ABC transporter; 66585-65723
  misc_feature: GI Number: 4586576; NR Description: multidrug resistance
  misc_feature: GI Number: 49235314; NR Description: COG1117: ABC-type phosphate transport system, ATPase component [Moorella
  misc_feature: GI Number: 20806837; NR Description: ABC-type phosphate transport system, ATPase component [Thermoanaerobacter tengcongensis] >gi|20515304|gb|AAM23612.1| ABC-type phosphate transport system, ATPase component [Thermoanaerobacter
MGSASSDGLREHLLDVDGGEAVAAPKIRVRGLRRRADATGEEILRGVHLDVPRGAVMGVIGPSGSGKSTLLRALNRLWEPAPGAVLLDGADICALDVLALRRKVGMLFQLPAMFDGTVADNVRYGPQLRGKKLTEAEVKSLLHLADLDPALCSKPASELSVGQAQRVALARTLANDPEVLLLDEPTSALDPISTQNIEEAIVRLKKTRGLTTVIVSHSVKQIQRIADLVCLVVAGEVVEVLAPSDLSDAKHPMARRFLELSG

SEQ ID NO: 3917 - DNA, 651 bp, Zea mays
  misc_feature (1)..(651): Ceres cDNA ID no. 21665978
  misc_feature (1)..(651): Ceres CLONE  ID no. 989449
  misc_feature (1)..(651): Also known as  Ceres CDNA ID no. 24365104
ccacacttccagacttggtaaccccaacggctacaagagaagagaagagcagcagagcagagcaggcagcacgcgaaagagagagagagacaactcgggcgcgatggacgtgtacatcgcggaggagtacgtggcccagcggcgcgccgagaggagggccgcgcgcgtcgccgcggctgcacgctgcggagaggagaaggcgcgggcggacagcgagcagaagcggcggtggacggaggacggcaagcggcctgccgacggcggcgatgccggcggtggcgccgccgccgccgcctggctgcaggcaggggaggacgccgttctcagctacttgtcggcttaggacacgtgcgtgcggtacgggcggacgtgtctccctgcgtgcgtacgtccagctaggcaatgcaaatagacacacatacacacacacatgcgccaatgccatgcacaatttgcgtggattgcgtttggtggagccaagtcagtcgcgtgcatgtggttgctgggcgataccagttcagctcatccacccttttttttttttttgccatggccaattggccgccaccgcgccacgtctcgcggatatagaagttcatgtctggcagtaaaaataaactggcctcgcttgatctaaaaaaaaaaaaaaaa

SEQ ID NO: 3918 - protein, 651 aa, Zea mays
CCACACTTCCAGACTTGGTAACCCCAACGGCTACAAGAGAAGAGAAGAGCAGCAGAGCAGAGCAGGCAGCACGCGAAAGAGAGAGAGAGACAACTCGGGCGCGATGGACGTGTACATCGCGGAGGAGTACGTGGCCCAGCGGCGCGCCGAGAGGAGGGCCGCGCGCGTCGCCGCGGCTGCACGCTGCGGAGAGGAGAAGGCGCGGGCGGACAGCGAGCAGAAGCGGCGGTGGACGGAGGACGGCAAGCGGCCTGCCGACGGCGGCGATGCCGGCGGTGGCGCCGCCGCCGCCGCCTGGCTGCAGGCAGGGGAGGACGCCGTTCTCAGCTACTTGTCGGCTTAGGACACGTGCGTGCGGTACGGGCGGACGTGTCTCCCTGCGTGCGTACGTCCAGCTAGGCAATGCAAATAGACACACATACACACACACATGCGCCAATGCCATGCACAATTTGCGTGGATTGCGTTTGGTGGAGCCAAGTCAGTCGCGTGCATGTGGTTGCTGGGCGATACCAGTTCAGCTCATCCACCCTTTTTTTTTTTTTTGCCATGGCCAATTGGCCGCCACCGCGCCACGTCTCGCGGATATAGAAGTTCATGTCTGGCAGTAAAAATAAACTGGCCTCGCTTGATCTAAAAAAAAAAAAAAAA

SEQ ID NO: 3919 - DNA, 778 bp, Zea mays
  misc_feature (1)..(778): Ceres cDNA ID no. 21665979
  misc_feature (1)..(778): Ceres CLONE  ID no. 991572
  misc_feature (1)..(778): Also known as  Ceres CDNA ID no. 24364864
ccccatccttaagtccagaggcaggctcgacctggacccgagtagctgctccaccaccccagccgatgcctccccgatccccatggcgccgcgcgtcgtcggggccctactgaccgccaccgccctcctcgccccgctgctcctctcctcccagcttccttccctgcccagagcggccgccgcgggctcaccggcccccgcgccggcgccggcgccggcgtcccaccaccacttgcccccgccacgccgcgtcccgtcgcccgcgaacaacggagcccacgcccgacagccgccgccgccgccgaggcatcagcgagacggtgccgcacgccatgctccccctccgacggtgaggccgtcagcgtggtggcgccagctcaacttcggcgagcggttcggggtcgcgctcgccgccgtggccgccgcaatgcaggtggcgctcgtcgcgctcctgctggtcctgcgcgcgcggcagctgcggcgagcggcggccgcggggaaggccgaggaggaggagcaggaggctgcatccgctgctgcgtcgcggcccgcgccagcgtgaccgacagctacggttgttcggtgagctgacggggcaacatcacactgtcacttgctgccgctgggcttccttgttcccactgtacagtacagtggtgtccgtctgtatacattctctaaatagttttcccttttttttcgagcctagtacgtgctgagagatgtacgaaaaaggataagggagtgaattgatttctttccaaaaaaaaaaaaaaaa

SEQ ID NO: 3920 - protein, 159 aa, Zea mays
  misc_feature: PFam Name: Extensin_2; PFam Description: Extensin-like region
  misc_feature: PFam Name: FH2; PFam Description: Formin Homology 2 Domain
  misc_feature: PFam Name: Pyr_redox_2; PFam Description: Pyridine
  misc_feature: PFam Name: LMBR1; PFam Description: LMBR1-like membrane protein
  misc_feature: PFam Name: GATase_2; PFam Description: Glutamine
  misc_feature: GI Number: 21992; NR Description: extensin [Volvox carteri]
  misc_feature: GI Number: 50938941; NR Description: putative diaphanous homologue [Oryza sativa (japonica cultivar-group)] >gi|27817931|dbj|BAC55695.1| putative diaphanous homologue [Oryza
  misc_feature: GI Number: 6523547; NR Description: hydroxyproline-rich
  misc_feature: GI Number: 20420; NR Description: extensin [Prunus dulcis] >gi|99861|pir||S20790 extensin - almond >gi|445616|prf||1909363A
  misc_feature: GI Number: 50940371; NR Description: putative pherophorin-dz1 protein [Oryza sativa (japonica cultivar-group)] >gi|42408241|dbj|BAD09398.1| putative pherophorin-dz1 protein
MAPRVVGALLTATALLAPLLLSSQLPSLPRAAAAGSPAPAPAPAPASHHHLPPPRRVPSPANNGAHARQPPPPPRHQRDGAARHAPPPTVRPSAWWRQLNFGERFGVALAAVAAAMQVALVALLLVLRARQLRRAAAAGKAEEEEQEAASAAASRPAPA

SEQ ID NO: 3921 - DNA, 737 bp, Zea mays
  misc_feature (1)..(737): Ceres cDNA ID no. 21665980
  misc_feature (1)..(737): Ceres CLONE  ID no. 992489
  misc_feature (1)..(737): Also known as  Ceres CDNA ID no. 24396480
tataggtggctgaggtatcctcttatcaacatctgtacatttttactacaatgactatgtaatagattgttcacggacatgacaagattgatatttgagatgatttatcgcatggcaccttctatagttgccttgttgcacgcccagtttggtggttctcaaacttcagtagtcggtcccttttatgttctaacttctaatgaggaaaaaaattgcaaaccatttcatgagatcactgctgagtttaaacatcccatggatttttactgctgtttaagatatcgttttggaatctggtgatcaaatgtgttcagcattcaattcacgtgcatctctcttatttggaatcaggtgtgcagaatttcctcatgtcgaatatgagccaataaaatggatttgccaactgctgggttgctgcctggttttacctgaacgaccatgaaaaagttctctgatgcaatggaccaaactctttccgagtggtttaaacattagaggaggaagtggagtgtattggtcactgcagtcatacaatttagatccgtatacttgaacaaatgaacagtgtcacagaaactcactcagtcttcgcgtgccaaggtgttttggttgtgtacttgtatgttgtatgctcataatgtcacgttgtgtaagctctcttttgagatctcaccgtttgtgaattaaactgctaccttgagatcaatcgcaaaaaaaaaaaaaaaaaaaaaaaaaaa

SEQ ID NO: 3922 - protein, 73 aa, Zea mays
  misc_feature: PFam Name: Arv1; PFam Description: Arv1-like family
  misc_feature: PFam Name: Ras; PFam Description: Ras family
  misc_feature: PFam Name: Nsp1_C; PFam Description: Nsp1-like C-terminal region
  misc_feature: GI Number: 32416700; NR Description: predicted protein [Neurospora crassa] >gi|28925626|gb|EAA34645.1| predicted protein
  misc_feature: GI Number: 51895885; NR Description: Unknown (protein for
  misc_feature: GI Number: 31218028; NR Description: ENSANGP00000024948 [Anopheles gambiae] >gi|30176091|gb|EAA44246.1| ENSANGP00000024948
  misc_feature: GI Number: 32450149; NR Description: Unknown (protein for
  misc_feature: GI Number: 45825067; NR Description: LP04080p [Drosophila
MTRLIFEMIYRMAPSIVALLHAQFGGSQTSVVGPFYVLTSNEEKNCKPFHEITAEFKHPMDFYCCLRYRFGIW

SEQ ID NO: 3923 - DNA, 678 bp, Zea mays
  misc_feature (1)..(678): Ceres cDNA ID no. 21665981
  misc_feature (1)..(678): Ceres CLONE  ID no. 992518
  misc_feature (1)..(678): Also known as  Ceres CDNA ID no. 24364799
atctacctatctggtgtccgctttaatttctttcctcggtccctccaccccccttcgccctttccgacgcgccgcccgaaaccctagccccactgattctctccagcccagcccagccaaggggaggggatgtcggcggcgccagcggcgggagggcagggtggcgggggcattgacgccgcgctcctcgacgacatcatccgccgcctgctcgaggtgcggaccgcgcgcccagggaagcaggtgcagctctctgagtcggagatccgccagctgtgcaccgtctcccgcgccatcttcctcagccagcccaacctcctcgagctcgaggcgcccatcaagatctgcggtgcgtacctcacctccctctttctcgtctccggccggccgtggcggtagatctggtctgtttgcgccgccagtgggtgaagcttacgtctcgtgggaaactggcgttcgtgtctctatgaagcactggagtaattgtaccattaatctgggctgttctggatttaatgattttttttgctggtatatggatgtgttttatgagacccttttattttcctgggttttaatttgattatgaatggatgtttatgtcattaccatgctggtggtttatttgcaacgagaaaatttgggtaaaaaaaaaaaaaaaaaaaaaaaaaaaaaaaa

SEQ ID NO: 3924 - protein, 678 aa, Zea mays
  misc_feature: GI Number: 34902038; NR Description: putative SERINE/THREONINE PROTEIN PHOSPHATASE PP1 [Oryza sativa (japonica cultivar-group)] >gi|29893635|gb|AAP06889.1| putative SERINE/THREONINE PROTEIN PHOSPHATASE PP1 [Oryza sativa (japonica
  misc_feature: GI Number: 5917726; NR Description: serine/threonine protein
  misc_feature: GI Number: 2642169; NR Description: putative serine/threonine protein phosphatase PP1 isozyme 4 (TOPP4) [Arabidopsis thaliana] >gi|1346758|sp|P48484|PP14_ARATH Serine/threonine protein phosphatase PP1 isozyme 4 >gi|15225576|ref|NP_181514.1|
  misc_feature: GI Number: 7209508; NR Description: type 1 protein
  misc_feature: GI Number: 3176078; NR Description: protein phosphatase 1, catalytic epsilon subunit [Medicago sativa] >gi|7435134|pir||T09550 phosphoprotein phosphatase (EC 3.1.3.16) 1, catalytic epsilon chain
ATCTACCTATCTGGTGTCCGCTTTAATTTCTTTCCTCGGTCCCTCCACCCCCCTTCGCCCTTTCCGACGCGCCGCCCGAAACCCTAGCCCCACTGATTCTCTCCAGCCCAGCCCAGCCAAGGGGAGGGGATGTCGGCGGCGCCAGCGGCGGGAGGGCAGGGTGGCGGGGGCATTGACGCCGCGCTCCTCGACGACATCATCCGCCGCCTGCTCGAGGTGCGGACCGCGCGCCCAGGGAAGCAGGTGCAGCTCTCTGAGTCGGAGATCCGCCAGCTGTGCACCGTCTCCCGCGCCATCTTCCTCAGCCAGCCCAACCTCCTCGAGCTCGAGGCGCCCATCAAGATCTGCGGTGCGTACCTCACCTCCCTCTTTCTCGTCTCCGGCCGGCCGTGGCGGTAGATCTGGTCTGTTTGCGCCGCCAGTGGGTGAAGCTTACGTCTCGTGGGAAACTGGCGTTCGTGTCTCTATGAAGCACTGGAGTAATTGTACCATTAATCTGGGCTGTTCTGGATTTAATGATTTTTTTTGCTGGTATATGGATGTGTTTTATGAGACCCTTTTATTTTCCTGGGTTTTAATTTGATTATGAATGGATGTTTATGTCATTACCATGCTGGTGGTTTATTTGCAACGAGAAAATTTGGGTAAAAAAAAAAAAAAAAAAAAAAAAAAAAAAAA

SEQ ID NO: 3925 - DNA, 862 bp, Zea mays
  misc_feature (1)..(862): Ceres cDNA ID no. 21665982
  misc_feature (1)..(862): Ceres CLONE  ID no. 992521
  misc_feature (1)..(862): Also known as  Ceres CDNA ID no. 0
atgccgcctccggttctcgtgcaaatcatcaaatcaaagtaaccatggacggcggatcgtccacaccggcgagcaccccacctacggcggcggagatggagtaccggaactggaagaggaatgcggttgtgctttacgacctcgtcatctcccacccgctcgagtggccgtcgctcaccgtgaagtggctcactcgctcccatcgaagtcctcggctcgtcgtgggcactcacacctccgacgaggctcatggtcttggacgcggtgcttccgctcccacctcgcctcgctgcagccgccgctgcctcgggcggcgccgtcctgttcccgtccatgtccgtctccagcgtggcgccacatgccgtgcgaggtcaaccgcgcgcgctgcatgccgcaggccgcagcgtccctatacggtgccgaccaaaatgtgcgtcgacgaggtgcacgtgtaccatctcggcgatggctacgacaacggaaagagcgacgccgctgttgtgctcagggggcatgagtcggaggattatggcttgtcatggagcccgacgaaggaggggttatgaacagaagatttgcttgtggggtctcttctctaggagtggagctctgttctggatgcacaacatgtgtttgaggtaatgtcccgttggatgctcctgtttcaattaatgtgctcagtgctctttattcactgtccccgcattttcggctcatatagttacagtaacttgattatagtgtgacttgatgcactggagcaatttgatttgtacttcttttcttttcctaatgatactatgtgcatttgtttgtattatattaaatgaaaaatgggattagaacaaaaaaaaaaaaaaaa

SEQ ID NO: 3926 - protein, 173 aa, Zea mays
MDGGSSTPASTPPTAAEMEYRNWKRNAVVLYDLVISHPLEWPSLTVKWLTRSHRSPRLVVGTHTSDEAHGLGRGASAPTSPRCSRRCLGRRRPVPVHVRLQRGATCRARSTARAACRRPQRPYTVPTKMCVDEVHVYHLGDGYDNGKSDAAVVLRGHESEDYGLSWSPTKEGL

SEQ ID NO: 3927 - DNA, 955 bp, Zea mays
  misc_feature (1)..(955): Ceres cDNA ID no. 21665985
  misc_feature (1)..(955): Ceres CLONE  ID no. 996949
  misc_feature (1)..(955): Also known as  Ceres CDNA ID no. 24358396
gttgacacacctcccgagccccgcccgccgcgcgccccccctgcaccggtgcgcggtgcgccctgctgcccgattcgtcggggggcgcgggaatggagctggagctggaggcggcggcccggcgcttccacctctggttccgcgggctgcgctcgctgcgccgggacctggcgtcggcccggtggtcggacgacccgacggcccagctccccgcgcaggtgggccgcttcgtggcccacctggagtcgtactgtgccgcgcgtgccgggctggacccggtgtggacgctgtcggcgccgtgggccacccccgcggagcgcggcgccgcgtactggctcgccgggtggcgccccaccacgctggtccacctgctgtacaccgagtccgggcgccgcctcgaggcgcagctgccggacctcctcctcggcgtgcggtcggggaaccttggcgacctcacccccgcgcagctggcgcaggtcgacgacctgcagcgccgcacggtggccgaggaggacgcgctggcaagggagatggcgctggtgcaggagggccacggcgtcgtcgtgctgccggcggcgccggacgggtccggcggactcgacgtggccggcctcgtgcgcagggccagggcggtgctggacagggccgacgcgctgcggctgcgcaccgtgaagcgggcggtggagatactggagccggcacaggcggccgagctgctcgtcgccgccgccgacctggagatcgggttccgggagttcgggctcaagcacgggtcgggacgaatgacatgactgccccagtttttttcgagctcccctgcacttcccgccattttatttttctttctttttttttctcctcacgattttgccgagttgtacccggctgggccgtcgtgacagggcacggaaacacgaataaaaaatgcacgagattgacttaaaaaaaaaaaaaa

SEQ ID NO: 3928 - protein, 232 aa, Zea mays
  misc_feature: PFam Name: DivIVA; PFam Description: DivIVA protein
  misc_feature: PFam Name: GATA-N; PFam Description: GATA-type transcription
  misc_feature: GI Number: 15231945; NR Description: DNA-binding
  misc_feature: GI Number: 8777471; NR Description: tumor-related
  misc_feature: GI Number: 688423; NR Description: tumor-related protein
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
MELELEAAARRFHLWFRGLRSLRRDLASARWSDDPTAQLPAQVGRFVAHLESYCAARAGLDPVWTLSAPWATPAERGAAYWLAGWRPTTLVHLLYTESGRRLEAQLPDLLLGVRSGNLGDLTPAQLAQVDDLQRRTVAEEDALAREMALVQEGHGVVVLPAAPDGSGGLDVAGLVRRARAVLDRADALRLRTVKRAVEILEPAQAAELLVAAADLEIGFREFGLKHGSGRMT

SEQ ID NO: 3929 - DNA, 1193 bp, Zea mays
  misc_feature (1)..(1193): Ceres cDNA ID no. 21665986
  misc_feature (1)..(1193): Ceres CLONE  ID no. 997341
  misc_feature (1)..(1193): Also known as  Ceres CDNA ID no. 23874067
gttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggcgacgtcgcgacggaggcggacgacgagttcatgatgcacgagttcaaggtgcggcggtgcgcgcgcgcgcggagccacgactggacggcgtgcccctacgcgcacccgggggaggccgcgcggcggcgggacccgcgccgcgtggcctacgcgggggagccgtgcccggacttccggcgccgcccgggcgcgggcgccgcgtgcccgcgcggggccgcctgcccgctcgcgcacggcaccttcgagctgtggctccacccgtcccgctaccgcacgcgcccctgccgcgcgggcgctgcctgccgccgccgcgtctgcttcttcgcgcacgccgcggccgagctccgcgccggcgccggcgccggcgccggcgccgccaaggacggctgctcgccgctcgcgctgtcgctctcgcccaagtcgacgctggcgccgccctgggagtcgccgccggtgtcgccggtggagggccggaggtgggtcgacgagccggcggacgccgaggtggaggagctgttgctcgcgatgcgggagctcggattcaggaaggccaaggcgtcgtcgtcggcgccggtcctgcctgcggctgcggtcacggaggacgacgggccggacttgggatgggtgtcggagctggtgatgtaggcgtccaagatgtggtggatgccgatctgcgatctccttcgctcgctgctgccggcgtcgtcaacggaacagcttcgttaagcaatattgatcgtaccattttctttcatgaatttgcatcattcttcttgtggatataaaccaaacctggtgcaactattaatactgcaatctgtaagcgtggcgtgctgctgtacatggttctcgttcgttcgatcattactaccagtgtatatacaaagtgtagttgccttcgctgccaaaaaaaaaaaaaaaa

SEQ ID NO: 3930 - protein, 262 aa, Zea mays
  misc_feature: PFam Name: zf-CCCH; PFam Description: Zinc finger
  misc_feature: PFam Name: IER; PFam Description: Immediate early response
  misc_feature: GI Number: 34909344; NR Description: OSJNBb0021A09.18 [Oryza sativa (japonica cultivar-group)] >gi|14090337|dbj|BAB55496.1| P0638D12.4 [Oryza sativa (japonica cultivar-group)] >gi|20160515|dbj|BAB89466.1| OSJNBb0021A09.18 [Oryza sativa
  misc_feature: GI Number: 56605376; NR Description: putative CCCH
  misc_feature: GI Number: 60460512; NR Description: putative CCCH-type zinc
  misc_feature: GI Number: 34899294; NR Description: zinc finger transcription factor-like protein [Oryza sativa (japonica cultivar-group)] >gi|23307508|dbj|BAC16644.1| zinc finger transcription factor-like protein [Oryza sativa (japonica
  misc_feature: GI Number: 1800279; NR Description: putative Cys3His zinc
MVSRENLHLVLDPASLGAPWADPSAAEIPPQLLAALGEYLSSTRAEGGDVATEADDEFMMHEFKVRRCARARSHDWTACPYAHPGEAARRRDPRRVAYAGEPCPDFRRRPGAGAACPRGAACPLAHGTFELWLHPSRYRTRPCRAGAACRRRVCFFAHAAAELRAGAGAGAGAAKDGCSPLALSLSPKSTLAPPWESPPVSPVEGRRWVDEPADAEVEELLLAMRELGFRKAKASSSAPVLPAAAVTEDDGPDLGWVSELVM

SEQ ID NO: 3931 - DNA, 636 bp, Zea mays
  misc_feature (1)..(636): Ceres cDNA ID no. 21665987
  misc_feature (1)..(636): Ceres CLONE  ID no. 997521
  misc_feature (1)..(636): Also known as  Ceres CDNA ID no. 24365140
aaaaggaaaaagagaatctggggtgaaggagacggaagatagattgaataatatcaaatggcgacatcgaggcttcaagctctgtggaatcaccctgccggacctaaaaccattcatttctgggcgccaacgttcaagtggggaatcagcattgctaacattgcagactttgctaaacctactgacaaaatttcctaccctcaacagattgctgttacatgcactggagttatctggtctcgctacagcatggttatcactcccaaaaactggaacctctttagcgtcaatgttgctatggctgggactggcatgtaccagcttgctcgtaaaatcaaaaacgattttgcatctgatgtggagcctgttgttgctaaagaatgattacgacgaaaaacaagaagatgaaaacatcaaaaggaaagatgtgatatcatcatcatcatcatcatcatattgcttgtgtttgaaaatctagtttcaagatatttgatttttcttttcactcccagatcgtaagggtcgaattaccaaataagttttctttttaatacccaatatcgaaactttgcgacagtgagctcctcctgcggctgtgataagaaccttttaagctaaagaaaaaaaaaaaaaaaa

SEQ ID NO: 3932 - protein, 108 aa, Zea mays
  misc_feature: PFam Name: UPF0041; PFam Description: Uncharacterised
  misc_feature: GI Number: 21593026; NR Description: light induced protein
  misc_feature: GI Number: 50944531; NR Description: light induced protein like [Oryza sativa (japonica cultivar-group)] >gi|38637023|dbj|BAD03281.1| light induced protein like [Oryza
  misc_feature: GI Number: 50936751; NR Description: light induced protein like protein [Oryza sativa (japonica cultivar-group)] >gi|33146465|dbj|BAC79573.1| light induced protein like protein
  misc_feature: GI Number: 32401369; NR Description: probable light-induced
  misc_feature: GI Number: 7268175; NR Description: light induced protein like [Arabidopsis thaliana] >gi|2244825|emb|CAB10248.1| light induced protein like [Arabidopsis thaliana] >gi|7488128|pir||F71409
MATSRLQALWNHPAGPKTIHFWAPTFKWGISIANIADFAKPTDKISYPQQIAVTCTGVIWSRYSMVITPKNWNLFSVNVAMAGTGMYQLARKIKNDFASDVEPVVAKE

SEQ ID NO: 3933 - DNA, 902 bp, Zea mays
  misc_feature (1)..(902): Ceres cDNA ID no. 21665988
  misc_feature (1)..(902): Ceres CLONE  ID no. 997534
  misc_feature (1)..(902): Also known as  Ceres CDNA ID no. 23869654
acgtcggcgtcttccatcgaagtggccttttcggcggcgagtgagagggcgaggaataaaactcgcgtcgcgcacgcaccgcaacaataatatccttccacgcgaatattcgccgcttcccacctcccccgccccgcatatccttccgtccgtccgttcgtctcccccctttcccttcccctctatttcaccaccccatcagccgcccgccaccgcgacgatcaccggcgcaatccgttcaccccaccactcatccactccccctccgcgaatctcatttctttactgcggctaggaggaggcggcggcggcgatgaagttcggcaagagcctgagcggacagatcgtggagacgctcccggagtggcgcgacaagttcctgtcctacaaggatctcaagaagcgcctcaagctcatcggcgccgggaacggggctgagcggcagccgaagcgggcccgccgcgacgactccggggaggctgacgcggccgcggccgcggcggcaatgacgccagaggaggcggagttcatgcagctcctggaggctgagctcgacaaattcaactcttttttcgtcgagaaagaggaggagtacatcatccgtcagaaggagctgcaggaccgggtggccagggcggccgggcgggagtccaaggaggagctcatgcgggtgcgcaaggagattgtcgacttccacggcgagatggtgctgctggagaactacagcgccctcaactacacagctagtagcaacttagcctggactgtggctgtgaattagggatgaagcctctagattcctggggctaacaatcagtgtttgccatagctaacatgggtcaaataaagagacgaattgctgtgttgcttgtcagcaagggacaataaaaaaaaaaaaaaaa

SEQ ID NO: 3934 - protein, 155 aa, Zea mays
  misc_feature: PFam Name: SPX; PFam Description: SPX domain
  misc_feature: GI Number: 51090894; NR Description: putative ids-4 protein
  misc_feature: GI Number: 50906075; NR Description: putative SPX (SYG1/Pho81/XPR1) domain-containing protein [Oryza sativa (japonica cultivar-group)] >gi|46390397|dbj|BAD15861.1| putative SPX (SYG1/Pho81/XPR1) domain-containing protein [Oryza sativa
  misc_feature: GI Number: 21592813; NR Description: ids4-like protein
  misc_feature: GI Number: 23507805; NR Description: At5g20150/F5O24_40 [Arabidopsis thaliana] >gi|19715595|gb|AAL91621.1| AT5g20150/F5O24_40 [Arabidopsis thaliana] >gi|15241275|ref|NP_197515.1| SPX (SYG1/Pho81/XPR1)
  misc_feature: GI Number: 50830973; NR Description: IDS4-like protein
MKFGKSLSGQIVETLPEWRDKFLSYKDLKKRLKLIGAGNGAERQPKRARRDDSGEADAAAAAAAMTPEEAEFMQLLEAELDKFNSFFVEKEEEYIIRQKELQDRVARAAGRESKEELMRVRKEIVDFHGEMVLLENYSALNYTASSNLAWTVAVN

SEQ ID NO: 3935 - DNA, 1100 bp, Zea mays
  misc_feature (1)..(1100): Ceres cDNA ID no. 21665990
  misc_feature (1)..(1100): Ceres CLONE  ID no. 998598
  misc_feature (1)..(1100): Also known as  Ceres CDNA ID no. 24360956
attagtatgcccctcgcctctctgctcccgtgaccacccctgcgcccgcgcaagccgcgaccacaacgctcgatccctcgcctccccgcggtgaaaccaccctcgcgcctgacgccgagaaacccgctcgcgatgcccccacgcccgtcgtacccccctggcggtccctgttctcgccgtcgcccgtggcccgttccagcagtcggcatcaccctcagccacgacctccgaccaccgcctatcgtccggcctcagatccttgcaacagcaagcaagcgacgcgcggggcctcgggtggcctccgcctccgcgaagtcggcgaggcgctagagcgtgacgttgagcgtcttggcggacacgatggcgaagcagacgcggaaccacccgggctcactgcagtggcaggaggagcccgggggtcgagcccgacctgaaacaccagcttcctccacaactcaatctcgccctgaaacaccagcttcctccacaactcaatctcgccctcgaacgaagtcgcggggccccgcaccaggcgccgcatgtcggcccagcagaagagccccgcgctgccctccaggcacgcgacgccggccgccgcgaggcccgccgccagccgcgccccgcgccccgatccgccgcgcgttctccgcgatgtaccactatgtgaagcccccgtcgcccaggagcgacgccagcaggtgctgcgtctgcgacgacaccaggccgaagctcgacatcttggtggccgccgacacgacgccagcgttggacgagtagatggcgcccacgcggaaccccgacagtgtgatgtcaaaaaaaccaggggaaaattcattcaaatgtagcatccaattttcgtcttattatttccttagttatcttaattatgacagacaaaatttactgatgaacctgtacaggtttatgagatcatacactagataataccttcccataatccatttatccatttctggtacagcagaccttgtggagggtgttctgcaaggtaggaatgggacagtagatgtttgtgattccaatttataatgatgtagaataatgcatggaaacattatatttgtaaaaaaaaaaaaaaa

SEQ ID NO: 3936 - protein, 138 aa, Zea mays
  misc_feature: PFam Name: Pyr_redox_2; PFam Description: Pyridine
  misc_feature: GI Number: 29829093; NR Description: putative translation initiation factor IF-2 [Streptomyces avermitilis MA-4680] >gi|39931258|sp|Q82K53|IF2_STRAW Translation initiation factor IF-2
  misc_feature: GI Number: 27375632; NR Description: blr0521 [Bradyrhizobium japonicum USDA 110] >gi|27348769|dbj|BAC45786.1| blr0521
  misc_feature: GI Number: 29611414; NR Description: synapsin 2A [Takifugu
  misc_feature: GI Number: 91207; NR Description: proline-rich protein - mouse (fragment) >gi|200545|gb|AAA40003.1| proline-rich salivary
  misc_feature: GI Number: 4206769; NR Description: myosin I heavy chain kinase [Acanthamoeba castellanii] >gi|3858883|gb|AAD09141.1| myosin
MAKQTRNHPGSLQWQEEPGGRARPETPASSTTQSRPETPASSTTQSRPRTKSRGPAPGAACRPSRRAPRCPPGTRRRPPRGPPPAAPRAPIRRAFSAMYHYVKPPSPRSDASRCCVCDDTRPKLDILVAADTTPALDE

SEQ ID NO: 3937 - DNA, 930 bp, Zea mays
  misc_feature (1)..(930): Ceres cDNA ID no. 21665991
  misc_feature (1)..(930): Ceres CLONE  ID no. 1000501
  misc_feature (1)..(930): Also known as  Ceres CDNA ID no. 24364933
atctggtgccatataagtgccaaattatctgccctcgcctcgctccttcgctttcattcctcggcctccgcagctagcgcaacgcaaaggcagttccggcgggggcggactgggaacacatgggaatgagatgagatcattgctcggtcgtgctggcctgggccgtcggcgcgcgttgatcttgcatgtgttctcaggtcgcccccggagggccttccttgctgctgtgttccgctagacctggagtatctcgacgacggtggcaggcacacgcagtgacggcaccactacgtctgttccgccacgagagcctatgtaacgcactagcaaggctcgtgatgtcggcatcgagggcagaccagcgggggactcatggtgggaggcgcaacaagccggtgggggagtctgacgacactgacggaggccagcatgctggagggcaggccagtgggggaatgacgacgggaggcaggcgggggattaacgtcggagggtaggccagcagggtcccttgtcccatcaagccggcagtggcgccgtgcctctgtgctagtctcgagtgtataaggcatggatgacgggagggtggagaggaagtgggtcgaaatggttcgtttgtttttaaggaatccctagaacccacattttcaagaagtattttgacccagaaccaacctaacccacgagcattttgaaccaaacgtgggttgttgtgggttgaactcgttccaacctgcatcaacccactaaccaaacacaaactccgagtgtatgttgtatttggttgagtagagtgggagaatagagttgctccattccatttttggatgtttggtttctaacaaaatgagagcggagtggctcctagatcttcatatgaaaatttattataaatagttggaaaaaaaaaaaagaaaaaaaaaaaaaaaa

SEQ ID NO: 3938 - protein, 103 aa, Zea mays
MCSQVAPGGPSLLLCSARPGVSRRRWQAHAVTAPLRLFRHESLCNALARLVMSASRADQRGTHGGRRNKPVGESDDTDGGQHAGGQASGGMTTGGRRGINVGG

SEQ ID NO: 3939 - DNA, 1044 bp, Zea mays
  misc_feature (1)..(1044): Ceres cDNA ID no. 21665992
  misc_feature (1)..(1044): Ceres CLONE  ID no. 1000539
  misc_feature (1)..(1044): Also known as  Ceres CDNA ID no. 24365057
cactcatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgagatcaagtcaggcctgtggacgagcccgcacgtggcggggctgctggagaaggcggagctggaccacatggccgccacgttcggcaagttctggtgcacctggcaggtggaccgcggcgaccgcctgccgctgggcgcccccgcgctcatggtgtccccgcaggccgaccccgccgcagccgtgcgccccgacctggtccggaagcgagacgacaggtacggcctctccacggaggagctccgcgccgctagggccgacgtcgaggcgcccgccgaggagcacccgggccaggccgactactggctccgccaccgcaagggcttcgcggtggacgtcgtgccgcacgagatgaagcgtcacgcgccgtttccgtgagccgtgaccaaccggtgttttacagtggcgcatgtgtaataaaaccaaacgatccagcaggcgtctccgtccgaactcgtgaatggcacgcgtttatttgtttttcagttcatgatgttcaaatcggcagtacgcatgtgttatggatgcgtgtgtattggatgaagtggatcggtgagaacagactttagcctcgcaggtgttaaactagaaaaaaaaaaaaaaaa

SEQ ID NO: 3940 - protein, 252 aa, Zea mays
  misc_feature: GI Number: 34910820; NR Description: P0456A01.15 [Oryza sativa (japonica cultivar-group)] >gi|12328500|dbj|BAB21159.1| P0456A01.15 [Oryza sativa (japonica cultivar-group)] >gi|15289812|dbj|BAB63510.1| P0435H01.3 [Oryza sativa (japonica
  misc_feature: GI Number: 21617913; NR Description: unknown [Arabidopsis thaliana]
  misc_feature: GI Number: 34909516; NR Description: P0481E12.28 [Oryza sativa (japonica cultivar-group)] >gi|14209547|dbj|BAB56043.1|
  misc_feature: GI Number: 51038130; NR Description: putative embryo-specific
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPAEEQRLWHSHAHEIKSGLWTSPHVAGLLEKAELDHMAATFGKFWCTWQVDRGDRLPLGAPALMVSPQADPAAAVRPDLVRKRDDRYGLSTEELRAARADVEAPAEEHPGQADYWLRHRKGFAVDVVPHEMKRHAPFP

SEQ ID NO: 3941 - DNA, 1573 bp, Triticum aestivum
  misc_feature (1)..(1573): Ceres cDNA ID no. 21665993
  misc_feature (1)..(1573): Ceres CLONE  ID no. 1000722
  misc_feature (1)..(1573): Also known as  Ceres CDNA ID no. 0
gcgcctgctgaacagggcgaagactgccaaaacctgacctcccagccggccggccgtacccgacgacggagtcaaggcgtacggacggccatggagggcgacgaccggagcgccccgctgctggccaacggcgccggccggccgtcgctccggcggcgcgactcggcgcggtcgctgcgcagcagcttcctgcgccggctgccggacaagatgcgcaccgagctggaccccgagcgcggcgccgacgtcgacgtcgcccgcgtcaaggacctctcccaaggtgagagggagtactacaggaagcagctcgccgcgctgaagaccttcgaggaggtggaggccctgtgcatgcccggcgagttcggctcggacgacgacggcgaccccgacgccgacgacgccgacgacgaggagcagaagcagagcgagctcgccatgaagatttccaactacgccaacatcgtcctcctggccttcaaggtgtatgccacgatcaggacggggtccatggcgatcgcggcgtccacgctggactcgctgctggacctgatggccggcggcatcctctggttcacgcacctctccatgaagaaggtgaacatctacaagtaccccatcggcaagctgcgcgtccagccggtggggatcatcgtcttcgccgccatcatggccactctaggcttccaggtcctggtgcaggcgatcgagcagctggtggagaacgagcccggcgacaagctgacctcggagcagctgatatggctctactccatcatgctctcggccaccgccgtcaagctcgccctctggttctactgcaggagctccgggaacagcatcgtccgggcgtacgccaaggaccactacttcgatgtgatcaccaacgtcgtcggcctggtggccgccgtcctgggagacaggttcctgtggtggatcgaccccgccggagccgtgctcctcgcggtgtacaccattgcgaactggtccgggaccgtgcttgaacaagcagtctcgctggtggggcggagcgctccgccggagatgctgcagatgctgacctacctcgccatgaagcacgacgcgcgcgtgcagcgggtcgacacggtccgggcctacagcttcggcgccctctacttcgtcgaggtcgacatcgtgctctcggaggacatgcggctgcgggaagcgcacgccatcggggagtcgctgcaggagaggatcgagaagctgccggaagtggagcgggcgttcgtccatgcggacttcgagaccacccataagccggagcacacggtccggagcaggctgccggcgaccgagccctgacgatggcaccttccgctccagcattcgccagatcttgtacagcgaaaatacacgcctgaagctgcagtgttcttgttgtttttctcttgcgctgaccccgaaaaacacagcgacagagccatctagaagatggatgtctctgtggaataatacaggattcgccatttttatgggagctgttccttctttctgtcactttttccccttctgaatgattctgttttcttgctttgcaaaaaaaaaaaaaaaa

SEQ ID NO: 3942 - protein, 410 aa, Triticum aestivum
MEGDDRSAPLLANGAGRPSLRRRDSARSLRSSFLRRLPDKMRTELDPERGADVDVARVKDLSQGEREYYRKQLAALKTFEEVEALCMPGEFGSDDDGDPDADDADDEEQKQSELAMKISNYANIVLLAFKVYATIRTGSMAIAASTLDSLLDLMAGGILWFTHLSMKKVNIYKYPIGKLRVQPVGIIVFAAIMATLGFQVLVQAIEQLVENEPGDKLTSEQLIWLYSIMLSATAVKLALWFYCRSSGNSIVRAYAKDHYFDVITNVVGLVAAVLGDRFLWWIDPAGAVLLAVYTIANWSGTVLEQAVSLVGRSAPPEMLQMLTYLAMKHDARVQRVDTVRAYSFGALYFVEVDIVLSEDMRLREAHAIGESLQERIEKLPEVERAFVHADFETTHKPEHTVRSRLPATEP

SEQ ID NO: 3943 - DNA, 2116 bp, Triticum aestivum
  misc_feature (1)..(2116): Ceres cDNA ID no. 21665994
  misc_feature (1)..(2116): Ceres CLONE  ID no. 1000957
  misc_feature (1)..(2116): Also known as  Ceres CDNA ID no. 24361665
gtcataggtgctaattctactaggttggtgtttctgtgcgtgttttggtcccggtgcttccctgccggtgacgatggcgttgctgccggaattcgatccagcggacgtgggcgccggccgcggcctcatcgaccgcctcaccgccgacgccgcggcgctgcagagggacgtcctcacggagatactcaggcggaactcccacaccgagtacctccgcggcttcctggatcgcgtaccaccaggcgcctcagccgccgacctccgcgaggccttcaaggagcgcgtgcccgtctccgagtatgaggacatcaagccgtacgtgcgctgcatcgcctccggcgagccgtccagcatcctctgctccgagcccatcacccacctcctcacaagctccggcacatccggcgggcagctgaagctctttccatccaccgcggagaagctcgatcagaggctgttctacaatggcgtccaggcactcttgaggaagatgcatcttcatcctgatcagggggacagacgtggcaaggggatgtacctcatgttcatcttccctggaagcctgacctcgtccggcctgcctatcatggcatccagcagtgcctactaccacagcagccagttccgggagcacgacattggcgggttcggcaggtgcaccagccccatcgaggcggtcctctgcccagatggcaggcagagcatgtactgccagctgctctgcggcctacttgaccgcggagtcgtcgaccatgtcggcggcacctttgctaacgctttcatcagaggcatccagttcctggaagacaactgggaggagatgtgctccaacatccgcactgggcgtctcagcgactggatagcacatgctcctctgcgtgatgccgtggctgcgcgtcacctgcgaggacctgacccggcactggccgacgagatcgcatctgagtgtgccaggaagccctgggatgggatagtcaggaggctctggccaggagcacggtacatcctcgccattgtcaccggctcgatgtcgcagtacattccggttcttgagagttatggtgctgggctgccattggtgtcgcccatgtatgtgtgtacagagtgcgccgcggggatcaatctgaaccctcttgatctaccttctgctgtgtcgtacgcattgcttccaaacattgcctacttcgagtttgcagaggtcacgcatggtgacgatgaaaaggtgcaagcaagtactggtttgtatgacaatttgggcaagttgaagcttgtcgatcttgtggatgtcaaaattggtcggcgctacgagctggttgtcaccacctttgcaggtctttacagataccgagtgggtgaccttcttactgtgagcggattctacaacgcaacgccactgttccgcttcactggacggtgtggtgtcatcttaaaaatagactacgagagtataagcgaggaggatctcctgaaggccatttcacaagcatacgagctgcatcttaggcctcttggttacatgcttggtggcagcactgcatatgcagacatatccaccttgcctggccactacgtcctgttctgggagctagccactgcagagggtaaccatgtcgcgactgacatcgatcgaactgtcatggagaattgctgtttggccgtggaggaatgctttgatcagatgtaccgcgaaagcaggcgccgagggtcgatcacagcactcgagataagggtacttgagcgcggcgcatttgatgctctcatggacttgtttctgtccagaggcacatcggccagtcagtacaagactccaacggctattcgatcagaacaagcgctgctggtgttggaggagagggtgtcaggaaagtactttagccaagagactcccaacggccctttgtagtacgactatacgagaggaaatggcgctggttagtaggtgtgcaggacgtatataggatttacatggtgccccattacccaaggattctgcaaggctaagcctaggaggcaggaaggaggccaagtccttgttggcatgttgctgtgggtctgaacttgaacacttacaatttaacatgcttgttagtagtatgattcaaaaaaaaaaaaaaaa

SEQ ID NO: 3944 - protein, 609 aa, Triticum aestivum
  misc_feature: PFam Name: GH3; PFam Description: GH3 auxin-responsive promoter
  misc_feature: GI Number: 52076796; NR Description: putative auxin-responsive GH3 [Oryza sativa (japonica cultivar-group)] >gi|52076488|dbj|BAD45367.1| putative auxin-responsive GH3 [Oryza
  misc_feature: GI Number: 52076797; NR Description: putative auxin-responsive GH3 [Oryza sativa (japonica cultivar-group)] >gi|52076489|dbj|BAD45368.1| putative auxin-responsive GH3 [Oryza
  misc_feature: GI Number: 7543905; NR Description: auxin reponsive-like protein [Arabidopsis thaliana] >gi|11281347|pir||T48585 auxin-regulated protein GH3 homolog T22N19.30 - Arabidopsis
  misc_feature: GI Number: 7543904; NR Description: auxin reponsive-like protein [Arabidopsis thaliana] >gi|11281348|pir||T48584 auxin-regulated protein GH3 homolog T22N19.20 - Arabidopsis
  misc_feature: GI Number: 42567818; NR Description: auxin-responsive GH3
MALLPEFDPADVGAGRGLIDRLTADAAALQRDVLTEILRRNSHTEYLRGFLDRVPPGASAADLREAFKERVPVSEYEDIKPYVRCIASGEPSSILCSEPITHLLTSSGTSGGQLKLFPSTAEKLDQRLFYNGVQALLRKMHLHPDQGDRRGKGMYLMFIFPGSLTSSGLPIMASSSAYYHSSQFREHDIGGFGRCTSPIEAVLCPDGRQSMYCQLLCGLLDRGVVDHVGGTFANAFIRGIQFLEDNWEEMCSNIRTGRLSDWIAHAPLRDAVAARHLRGPDPALADEIASECARKPWDGIVRRLWPGARYILAIVTGSMSQYIPVLESYGAGLPLVSPMYVCTECAAGINLNPLDLPSAVSYALLPNIAYFEFAEVTHGDDEKVQASTGLYDNLGKLKLVDLVDVKIGRRYELVVTTFAGLYRYRVGDLLTVSGFYNATPLFRFTGRCGVILKIDYESISEEDLLKAISQAYELHLRPLGYMLGGSTAYADISTLPGHYVLFWELATAEGNHVATDIDRTVMENCCLAVEECFDQMYRESRRRGSITALEIRVLERGAFDALMDLFLSRGTSASQYKTPTAIRSEQALLVLEERVSGKYFSQETPNGPL

SEQ ID NO: 3945 - DNA, 1390 bp, Triticum aestivum
  misc_feature (1)..(1390): Ceres cDNA ID no. 21665995
  misc_feature (1)..(1390): Ceres CLONE  ID no. 1001054
  misc_feature (1)..(1390): Also known as  Ceres CDNA ID no. 0
aaaaactcctccccctctctctctcgattcttccgccgaagggttccgttccccatcgccggttccaatttccgttgggggagatccgatcgattcctcgcctgggccggtccgtcgttcgagtccatggccacctcgggcgatcagtcgggcggctgcgggtctgcggccgcgaaggggtccaaactgcggtacccgctgcggtcggcgggccgggggaagctcgagccgccggcggcggcagatgctgctcctagcggccctgcttcgcgaagggccaaaccatcttcagatgtcaccaagagctgtgctctcgatctttccgccgtgaaggataaatcagctaaacctccgcggaggcactcaataccaacaaagccaggtgttagtccaaggcctactcctactggaactattactccagtgtcaggggttcgctccaggaggtcagacagccttgggaggttggataccccgacatctgaagcatccatgtctacagcaaggcgcaagttcagtacactctcctcggtctcatattggatgacacagattaggcttgcagaggctgcttccaagcactctatctccctgggcttcttcaagcttgcccttgagtcagaatgcgagcctctggataggatgagagaagaactaaagacttatgtggccaggcatggccttgcaacagaattggaggagccggtgaaggagattcttcaggtttatgatatcatggaagattttgagaagctaaagatctctctggactcctcactggagccaaaaaagtctgacaaggctgctcttggtgctgccaatgtgactccaaagggtaatctgaaacccaggtctctgaactctgttgcaactcagagtaaagatggcaagaaagagaacattcagaaggagaagcctgatgccaagatcagaggttcctataaccggaatccggccaagaatgctcctgcaaaagaagttgccaaaaataccgccaagaaaaccaagaagcaggctaaggagcagcaagaagattgtaatggaggcagtgaggttttgccggttgacgcagatcaagaatctgttgatgtggtgaaggagatcacatatgaagataaggagaacatgggggatgctgagatggcaatagatgctggcaacgccatagcccaagaagtctagaaccgacggaccgacttcagattcaaaccttttgtttgctgaatatgaagtattgagtgtgtggtgcttgttttctttcgcccttgttgatatgtcattagcacttgtctttccggttgtcaagccgcaacatgtctttaagcgtgtgtattatggtttgctgggtgagactgctcgcttgtattccctttgtcaagccaaaaaaaaa

SEQ ID NO: 3946 - protein, 351 aa, Triticum aestivum
MATSGDQSGGCGSAAAKGSKLRYPLRSAGRGKLEPPAAADAAPSGPASRRAKPSSDVTKSCALDLSAVKDKSAKPPRRHSIPTKPGVSPRPTPTGTITPVSGVRSRRSDSLGRLDTPTSEASMSTARRKFSTLSSVSYWMTQIRLAEAASKHSISLGFFKLALESECEPLDRMREELKTYVARHGLATELEEPVKEILQVYDIMEDFEKLKISLDSSLEPKKSDKAALGAANVTPKGNLKPRSLNSVATQSKDGKKENIQKEKPDAKIRGSYNRNPAKNAPAKEVAKNTAKKTKKQAKEQQEDCNGGSEVLPVDADQESVDVVKEITYEDKENMGDAEMAIDAGNAIAQEV

SEQ ID NO: 3947 - DNA, 1651 bp, Triticum aestivum
  misc_feature (1)..(1651): Ceres cDNA ID no. 21665996
  misc_feature (1)..(1651): Ceres CLONE  ID no. 1004604
  misc_feature (1)..(1651): Also known as  Ceres CDNA ID no. 24357647
cgtttccttcccttgtactcacaacaccactcccgaaatcctcaaaaccccttccaccgccgctgctcccgcggtggcgctggtttcgccttgctgttttggggagtttttctgtgccgttttacagtttagcccggggtttaatgtgctgtgtttcgtgcagacgagaaggacgaaatggcgagcgcggactccgtcaagttccagtccgtcatctcgcaggtggagaccctgcacctccatgttcacaatcccagggagcaggtagctgatgcagaggcattgctggacattgccagcagtttggcggcgtctgtaaggtcccagtcagcactaggaatcacgccttctcatttagttgctgcactcctcaacaagtttggggtgcaaggggatgccgatggcgagggtgcctcgttgagatggtctgatgttgggcttgctgcgtctcatgtcttcatggctgtgcctggatgctgcaccatgtttggtcccatgacgacagaagtgaagccacggagaacacataccagtagaaggaggactgccaggccgagtagaaatgattgcactgaacagcttgcagatccagagacaacaacgactgatacagacaggaacatggctgctctgtttaatgttctgaggaagaagaaaaaagcaagactcgaaaaccttgttttgaacagaatgtcctttgcccaaacggtggagaacatatttgctttgtcattcctagttaaagatggcagagtggaaatgaatgtgaatgacgatggccatcatatcctctctccaagaaatgcacctgctgctggtgcaattgcctcaggagaagtgaaatacagccattttgtcttcagatacgattttaatgactggcagctcatgaaagggatcgtcgcggagggggaagaactgatgctgcacaggccgccttctctcagcacgtctggaggaaatacccaggcggagatgccttctcgcagcacgcctggaggaaatcccaaggtggagatgcctgcacacagcacgccgggaggcaacgaggatcctgcgacacctgcgcatggcatgtccggggaaaacaacgagcctgagatgtacgcgcacacaacttcaatcaggaagcactgcaggaaccggggcctggtcacacaagcgcggcaagacgaggcgacagccatggacaatacgcagggagccatggaggataagcagcaggcggatgcgcaggatgaggcgatccgcacggtggtcaagcgggaggacatggagatgggcaaggacaggccggagatggtccagacgtacaagcgcaagcgatctgatcgccatccacccgccggcggccaccgtgcacatgcgtcttgcggttcctttggtgtcggtaaagagtttacccggctctagctctagctttatccgactaacctagctctagcttttgagaggacttttgtaggggtgggcaagtccagaggtatgatttggatgctgtgtaaagtagtctgggttagagaaatgttgatcagtgttatgagtttgcagtgttggtttactgctgcatttgtaagcagttctcttgagctacctggctcgttatacagctcttatgctttcagctgcttgattaaaaaaaaaaaaaaaa

SEQ ID NO: 3948 - protein, 411 aa, Triticum aestivum
MASADSVKFQSVISQVETLHLHVHNPREQVADAEALLDIASSLAASVRSQSALGITPSHLVAALLNKFGVQGDADGEGASLRWSDVGLAASHVFMAVPGCCTMFGPMTTEVKPRRTHTSRRRTARPSRNDCTEQLADPETTTTDTDRNMAALFNVLRKKKKARLENLVLNRMSFAQTVENIFALSFLVKDGRVEMNVNDDGHHILSPRNAPAAGAIASGEVKYSHFVFRYDFNDWQLMKGIVAEGEELMLHRPPSLSTSGGNTQAEMPSRSTPGGNPKVEMPAHSTPGGNEDPATPAHGMSGENNEPEMYAHTTSIRKHCRNRGLVTQARQDEATAMDNTQGAMEDKQQADAQDEAIRTVVKREDMEMGKDRPEMVQTYKRKRSDRHPPAGGHRAHASCGSFGVGKEFTRL

SEQ ID NO: 3949 - DNA, 1332 bp, Triticum aestivum
  misc_feature (1)..(1332): Ceres cDNA ID no. 21665997
  misc_feature (1)..(1332): Ceres CLONE  ID no. 1004743
  misc_feature (1)..(1332): Also known as  Ceres CDNA ID no. 24357412
gtactgaccctgctctactgtactgcacctctgctgctacataccacttcagagagtcgagcagagtagaggcgaacagagtgagcggcgatcaccacgcagacgcgccatggccgccgccgtgccgttgccggtgatgctccttgtcgcggtggccgtcatgctcgtcggcgccggcgcaggcgcggcaggggtgcgcggcgggcggcggcagcagcagcagcagctgaggatggggttctacgacaagagctgcccggcggcggagcggatcgtgggcgactacgtccggcagcacgtccggcgcgtgcccaccgtcgcgcccgcgctgctccggacgcactaccacgactgcttcgtcaggggctgcgacgggtccatcctgctcaactccaccgccgccggcgcggcggagaaggacgcgccgccgaacctgacgctgcgcgggttcgacctcatcgaccgcgtcaagggcctcgtcgagcaggcctgccccggcgtcgtctcctgcgccgacgtcctcgcgctcgccgcccgggacgccgtcgccgccattggcgggccgtcgtggcgcgtgccgacggggaggagggacggcacggtgtcgaccatgcaggaggcggtccgcgagctgccgtcgccgtcgatgaccttcccgcagctcgtcgccctgttcgccggcaagggcctcgacgtgcgcgacctcgtctggctgtcaggtgcgcacaccatcggcatcgcccactgctcgtccttcgcggaccgcctctacagctaccccagcgccggcaacggcaccgggaccgtcccgcccctcgacgccgcctacgcggccaacctgcggcagcgcaagtgcaggatgggcggccgcgacaccacggtggagatggaccccggcagcttcctgacgttcgacctcggctactaccacactgtgctgaagcacagggccctgttccggtccgacgccgcgctggtcaccgatcccgcggcgcgggccgacatcgccggcgtcgtgtccagcccgccggaggtgttcttccaggtgttcgcgcggtccatggcgaggctgggcgccgtgcaggtcaagaccggctctcagggggagatcaggaagcactgcgccgtcgtcaacagctagatcgaacagagatgctgtgattttgctcttattctttcgtcatctgtaaccagtgttattttgatcatatttttgttgagaatggtggtagaataactgagtctgcaggttaactgcgaacacagaagatatgacatgtgtatgcactacttataagattgatgaagttgtatccaaaaaaaaaaaaaaaa

SEQ ID NO: 3950 - protein, 343 aa, Triticum aestivum
  misc_feature: PFam Name: peroxidase; PFam Description: Peroxidase
  misc_feature: PFam Name: HlyD; PFam Description: HlyD family secretion protein
  misc_feature: GI Number: 50905409; NR Description: putative peroxidase [Oryza sativa (japonica cultivar-group)] >gi|49389250|dbj|BAD25212.1| putative peroxidase [Oryza sativa
  misc_feature: GI Number: 55700915; NR Description: TPA: class III
  misc_feature: GI Number: 52076880; NR Description: putative peroxidase
  misc_feature: GI Number: 55701045; NR Description: TPA: class III
  misc_feature: GI Number: 4204759; NR Description: peroxidase precursor
MAAAVPLPVMLLVAVAVMLVGAGAGAAGVRGGRRQQQQQLRMGFYDKSCPAAERIVGDYVRQHVRRVPTVAPALLRTHYHDCFVRGCDGSILLNSTAAGAAEKDAPPNLTLRGFDLIDRVKGLVEQACPGVVSCADVLALAARDAVAAIGGPSWRVPTGRRDGTVSTMQEAVRELPSPSMTFPQLVALFAGKGLDVRDLVWLSGAHTIGIAHCSSFADRLYSYPSAGNGTGTVPPLDAAYAANLRQRKCRMGGRDTTVEMDPGSFLTFDLGYYHTVLKHRALFRSDAALVTDPAARADIAGVVSSPPEVFFQVFARSMARLGAVQVKTGSQGEIRKHCAVVNS

SEQ ID NO: 3951 - DNA, 1898 bp, Triticum aestivum
  misc_feature (1)..(1898): Ceres cDNA ID no. 21665998
  misc_feature (1)..(1898): Ceres CLONE  ID no. 1004920
  misc_feature (1)..(1898): Also known as  Ceres CDNA ID no. 24361516
atcagctcgatcatcatcgtctcctcaaggccctagctagctagctccgctatacataccaccgagggcgcatggcgctgacgagtcacctcctggtcgtcctcctcggcatcgcagtgccgctgctcttcttctcccgtgcagaggggggccaggtaggcgtgtgctatgggaggatggcgactaacctgcctgacccgacgtccgtggtgaaactgctcaagaagaacagcatcaccatggtgaggatctacgacactgacccgacggtgctgcgctcgctggccagcaccggcatcaatgtcacggtggagctaaccaacgaggagctgccctccgctgccgcggaccaaaatttcgctgatcaatgggtgcagaacaatgtgaaggcctactacccggccacgcagatcaacggcgtgacgatcgggaacgaggtcttcaaagaggctagtcagctcaactctcagctcgtcccggccatgaagaaggtgcaagcggcgctggctcgcctgggcctggcggacgccgtgaaggtgaccacgcccatcgcgttcgacgctctcaagatgtcgttcccgccgtccgagggcgcgttccgtgacgacatcgccttgtcggtgatgagccccatggtcgacttcttgcaggaaaccgggtcgtacctcatgatgaatatctacccgtaccttgcgtacctgagcactcccggcatgtccatcgactatctcttgttccgccccaacgctggcattcttgataagaatagcaagcaaacgtacttcagcctcctcgacgcgcagcttgacgctgtgtactatgcgatggagaagctgccgtcctccagcctgcgtgctggagggatgaggaagctcacagcagggggcggaatactggaggtgaagcttggtgagagtcaccacccaaccagaggccaccatggcgtgggaacaacagccaacgcccaagcattcaccgatggtctcatgagcaaagtgcgtggcggtaactccggcaccacctcaaacagatataaccggctcgccaccagtgctgtcggcaccccgcaccgtcccaacgccgatcttgacgtgtacatcttcgaactcttcaacgaggacaacaagcccgaagacgagcaggactttgggttgttctacccgaaccagcagcccgtgtatcaagtcgactttgtccatggtgccggccccgtgcaaccgagctactgtgccgcgaaggccacggccggggacgcggccttgcaggctgcgctggactacgcgtgcggccacggggcggactgcagcgccatccagccaggcaagccctgctacgagcccaacaccaagctcgcgcacgcgtcctacgccttcaacgactactaccagaagaacggccaggccagcagcgcgtgcgacttcagtggtgctgccaccattgtcaaccaggcaccatcaggccggtgcgacccgagcccgagctggtgtgtggcgaacgcggcggtgggcgccgcgcggctgcagaatgcactggactacgcctgcggccacggcgcggactgcacggacatccaacccggagcacggtgcttcgatcccgacaccaaggtcgcgcatgcgtctttcgcgttcaatgactattaccagcgccatggccggggcgccggaacgtgcgccttcgccggtgccgctaccattgtccggcaggcaccaaagataggcaactgcgtgctgccgtcaagggcctgaactgaagaaactgtagccaaagcgaagctttactaccacgagattaagcaataatcccgacagattaccgtctgcggccggcaaagtctagttttcaaatgtaaaactagataaataaatccatggttttcaacaaaaaaaaaaaaaaaa

SEQ ID NO: 3952 - protein, 558 aa, Triticum aestivum
  misc_feature: PFam Name: Glyco_hydro_17; PFam Description: Glycosyl
  misc_feature: PFam Name: X8; PFam Description: X8 domain
  misc_feature: PFam Name: Mucin; PFam Description: Mucin-like glycoprotein
  misc_feature: GI Number: 51963468; NR Description: PREDICTED P0458H05.105
  misc_feature: GI Number: 51963466; NR Description: PREDICTED P0696F12.25 gene product [Oryza sativa (japonica cultivar-group)] >gi|50938075|ref|XP_478565.1| putative beta-1,3-glucanase [Oryza sativa (japonica cultivar-group)] >gi|34394950|dbj|BAC84500.1|
  misc_feature: GI Number: 50942837; NR Description: putative beta-1,3-glucanase (EC 3.2.1.-) precursor [Oryza sativa (japonica cultivar-group)] >gi|40253222|dbj|BAD05183.1| putative beta-1,3-glucanase (EC 3.2.1.-) precursor [Oryza sativa
  misc_feature: GI Number: 50938049; NR Description: putative beta-1,3-glucanase [Oryza sativa (japonica cultivar-group)] >gi|34394937|dbj|BAC84487.1| putative beta-1,3-glucanase [Oryza sativa (japonica cultivar-group)] >gi|50508397|dbj|BAD30397.1|
  misc_feature: GI Number: 50938083; NR Description: putative beta-1,3-glucanase [Oryza sativa (japonica cultivar-group)] >gi|34394953|dbj|BAC84503.1| putative beta-1,3-glucanase [Oryza
MALTSHLLVVLLGIAVPLLFFSRAEGGQVGVCYGRMATNLPDPTSVVKLLKKNSITMVRIYDTDPTVLRSLASTGINVTVELTNEELPSAAADQNFADQWVQNNVKAYYPATQINGVTIGNEVFKEASQLNSQLVPAMKKVQAALARLGLADAVKVTTPIAFDALKMSFPPSEGAFRDDIALSVMSPMVDFLQETGSYLMMNIYPYLAYLSTPGMSIDYLLFRPNAGILDKNSKQTYFSLLDAQLDAVYYAMEKLPSSSLRAGGMRKLTAGGGILEVKLGESHHPTRGHHGVGTTANAQAFTDGLMSKVRGGNSGTTSNRYNRLATSAVGTPHRPNADLDVYIFELFNEDNKPEDEQDFGLFYPNQQPVYQVDFVHGAGPVQPSYCAAKATAGDAALQAALDYACGHGADCSAIQPGKPCYEPNTKLAHASYAFNDYYQKNGQASSACDFSGAATIVNQAPSGRCDPSPSWCVANAAVGAARLQNALDYACGHGADCTDIQPGARCFDPDTKVAHASFAFNDYYQRHGRGAGTCAFAGAATIVRQAPKIGNCVLPSRA

SEQ ID NO: 3953 - DNA, 1254 bp, Triticum aestivum
  misc_feature (1)..(1254): Ceres cDNA ID no. 21666000
  misc_feature (1)..(1254): Ceres CLONE  ID no. 1019245
  misc_feature (1)..(1254): Also known as  Ceres CDNA ID no. 25088172
agaatagccattgttttgtgttcatctcgcgtccaggaagacaagctcaagctgtacaagtagcgccaacaccagacctcttttgttcctggtcatcctcttcctcctgattcttgttgtgacggccgtcttcttgctcccaccagcgatcatgtcttcgtcttcctcctccgtgacgttcgagaatccgaggaaggtggtgaagaaggtgctgtcattgtcccagtccgagggggacggcgccaccgtccgccggagcatcggccggcacgagctccggaacctggacccgttcctcctgctcgacgagttctccgtctccaagcccgccggcttccacgaccaccctcaccgtggcttcgagaccgtcacctacatgctcgatggggccttcacccaccaggacttctcggggcgcaagggcaccatcaggaccggagatgtgcagtggatgacggcggggcgtggcatcgtgcactcagagatgccggcagcagacggagtgcagaaaggcctgcagctctggatcaacctcgcctccaaagacaagatgatcgagccgcggtaccaggagctcgagagcaaggacattagccaggccgagaaggacggcgtggcggtgcggatcatcgctggggaagcatttggggtgcggtcgccggtctacacgcgtacgccaaccatgtacatggacttcacaatgcaaccaggttcgcagctccaccagccaatccccgagggctggaacgccttcgtgtacgtcatcgagggggagggcgtgttcggcaaggagaatgcagcgccggcgagcacgcaccactgccttgtgcttggcgcgggggacgggctcagcgtgtggaataggtcaggcgcaccgctgcggttcacccttgcggcggggcagccgctgaacgagccggtggtgcagcaggggccctttgtcatgaactcgcgtgcccagatccagcaggccatggaggactactactacggccgcaacggcttcgagaaggccagccagtggagctccgcctgattctcatcggtgtctcgccgtgatgatgatcaacatctggtgcattgttgtgcaaaatattgggagggaaagggaaattgcattgtaccattatatttatgcctttgtgtagaacgtagaactagtcttgtttttctttgattttttttacttgtttataaaagaatctgatgcaataaaagtgtgtaatgaggaggaacttaaaaaaaaaaaaaaaa

SEQ ID NO: 3954 - protein, 294 aa, Triticum aestivum
  misc_feature: PFam Name: Pirin_C; PFam Description: Pirin C-terminal region
  misc_feature: PFam Name: Pirin; PFam Description: Pirin
  misc_feature: PFam Name: Mucin; PFam Description: Mucin-like glycoprotein
  misc_feature: GI Number: 50920071; NR Description: putative pirin-like protein [Oryza sativa (japonica cultivar-group)] >gi|41469639|gb|AAS07362.1| putative pirin-like protein [Oryza
  misc_feature: GI Number: 6651245; NR Description: pirin [Lycopersicon
  misc_feature: GI Number: 49066057; NR Description: Putative pirin-like
  misc_feature: GI Number: 30689259; NR Description: pirin, putative
  misc_feature: GI Number: 14195009; NR Description: Putative pirin-like protein At1g50590 >gi|15223592|ref|NP_175474.1| pirin, putative [Arabidopsis thaliana] >gi|9454553|gb|AAF87876.1| Putative pirin
MSSSSSSVTFENPRKVVKKVLSLSQSEGDGATVRRSIGRHELRNLDPFLLLDEFSVSKPAGFHDHPHRGFETVTYMLDGAFTHQDFSGRKGTIRTGDVQWMTAGRGIVHSEMPAADGVQKGLQLWINLASKDKMIEPRYQELESKDISQAEKDGVAVRIIAGEAFGVRSPVYTRTPTMYMDFTMQPGSQLHQPIPEGWNAFVYVIEGEGVFGKENAAPASTHHCLVLGAGDGLSVWNRSGAPLRFTLAAGQPLNEPVVQQGPFVMNSRAQIQQAMEDYYYGRNGFEKASQWSSA

SEQ ID NO: 3955 - DNA, 1013 bp, Triticum aestivum
  misc_feature (1)..(1013): Ceres cDNA ID no. 21666001
  misc_feature (1)..(1013): Ceres CLONE  ID no. 1019512
  misc_feature (1)..(1013): Also known as  Ceres CDNA ID no. 24357730
cccggtgaaccccacttcccaccctcgatccccactcccacatcccacggccgccacggccctcgccgccggcgcgtgtcccaccaccaccatctcccacgggcgccaagttccctgctgcaggcgcgcgcgccaccgccaccccctcccacaggagcaatggttcctgccgccggcgcacgcgccaccgccaccacctcccgcaggcgccatggtccctgccgccggcgcggcgccaccgtcaccacctcccacagccgtcgcggaccccgccgcctgtgcgcgccccgccatctccacctcccacagcctccatggccccgtcgtcggggcgcgccccgccacaaccaccgccgttggacgccgtcgccgtgccccagtgcctccgagacctcgtccgacatgaccgttgcatccctgaactgccaagcgccgcccaccgcccggcttcttcccctgaccatcgccggcctcctgccccgggcaaaccccttctcttccttccgggcgcaaccgcgatctccttctcagttcaaaacgagctctagccgatgtccaagtcgattcccattcgtgggacaagtccgactacctgtggtacacgacctagagattgaccggagcgagcaattcctcaagtccggccagtggctgcagctcaccatcaactccgccggccactcgctgtaggtgttcgtcaacggccaatccttcggaattgaggcttcgccaaggaacaagactggtaactagcgcaaaggagactatgtcgagaggtggcactgctagacttgctgatgtgtagttatggcataaaaaggatgaaaaaaatggtgtcttgtatgattccataagatgtacgtagcaaatcttcccatgtggatcagtacaacttatgtacggccttgagttcacaaatcttatagtaatctttgtagtactcttcgtaacactttgtaaagcaagagtagcccttttttgtgagcaacaattcaagaaaaaaaaaaaaaaaa

SEQ ID NO: 3956 - protein, 176 aa, Triticum aestivum
  misc_feature: PFam Name: FH2; PFam Description: Formin Homology 2 Domain
  misc_feature: PFam Name: Pyr_redox_2; PFam Description: Pyridine
  misc_feature: PFam Name: Drf_FH1; PFam Description: Formin Homology Region 1
  misc_feature: PFam Name: GATase_2; PFam Description: Glutamine
  misc_feature: PFam Name: LMBR1; PFam Description: LMBR1-like membrane protein
  misc_feature: GI Number: 6523547; NR Description: hydroxyproline-rich
  misc_feature: GI Number: 41581244; NR Description: basic proline-rich
  misc_feature: GI Number: 66850169; NR Description: verprolin [Aspergillus
  misc_feature: GI Number: 50940371; NR Description: putative pherophorin-dz1 protein [Oryza sativa (japonica cultivar-group)] >gi|42408241|dbj|BAD09398.1| putative pherophorin-dz1 protein
  misc_feature: GI Number: 27375632; NR Description: blr0521 [Bradyrhizobium japonicum USDA 110] >gi|27348769|dbj|BAC45786.1| blr0521
MVPAAGARATATTSRRRHGPCRRRGATVTTSHSRRGPRRLCAPRHLHLPQPPWPRRRGAPRHNHRRWTPSPCPSASETSSDMTVASLNCQAPPTARLLPLTIAGLLPRANPFSSFRAQPRSPSQFKTSSSRCPSRFPFVGQVRLPVVHDLEIDRSEQFLKSGQWLQLTINSAGHSL

SEQ ID NO: 3957 - DNA, 1227 bp, Triticum aestivum
  misc_feature (1)..(1227): Ceres cDNA ID no. 21666003
  misc_feature (1)..(1227): Ceres CLONE  ID no. 1031344
  misc_feature (1)..(1227): Also known as  Ceres CDNA ID no. 24360443
attaagggccgtcgtggtcccgtccaggccatcgccgtggattcgccttgcaggcaggcaggtctccgctcgccgcgccgcccgccgccccgccggtcgccgctcccccgaggtttcaaccgttaagaagctcaagatgtccgccaatgttggggaatcagcggcagttggtggcagcagcagcgatgcagctggagggagctttgagtgcaacatatgctttgagttgccacaggagccaatagtaactctctgtggccacctattctgctggccgtgcctctacagatggctgcacatgcacgccaacacaccagagtgccctgtgtgcaaggccattgttgaagaagacaagcttgtccccctttatggccgtggcaaggaccgcgtcgacccaaggtcaaagaacacgcctggagccgacattcctcagcgcccagctggacagaggcccgcaacagcccaacaggctgatcctaacaacaatttcggcaacgcccatgcaaatccatggttcatgggcatggggggcgcgggggcgggtgtcccgctggcgaatggacggtggggcaactatgcgttctcggctgcgttcgggggcctgttccctatgctcagcttccaaatgcatgggtttccagatccagctgcatatgcccagcctgctgggtttcactatgggtttggtcacggccatggattccatggcgggcatatggggcacgcccacggcgtcccccgccaagggccgctcgggcagcagcagcagcaggcagatgtctacctgaaggcccttcttatcatggtcggggttcttgtgatcgcaagcctcctcgcagcttaaattggttactgctatcatcaaaattgtggtggtgtttggtaggagttgccagagcataccttggtgtaggcttatctctaccaaattggaggcaagttctgttcgttcgaaggtttgtatgaagtgtccatggagtttctgtatctagatttggatggtcttcctctgctgcatgatgcatcatcctgtgttttgtagttttgactcctttggtttgataaaccctgcgtggtgtacaattgttgggaggtcatctcctcgtgtctgtaacctgtatcaatctagattggacagtgtagatgagtacatttacatgtaataattctcatgcttgcacaaagtgacagttcgtgtaccttttgacagcaaaaaaaaaaaaaaaa

SEQ ID NO: 3958 - protein, 235 aa, Triticum aestivum
MSANVGESAAVGGSSSDAAGGSFECNICFELPQEPIVTLCGHLFCWPCLYRWLHMHANTPECPVCKAIVEEDKLVPLYGRGKDRVDPRSKNTPGADIPQRPAGQRPATAQQADPNNNFGNAHANPWFMGMGGAGAGVPLANGRWGNYAFSAAFGGLFPMLSFQMHGFPDPAAYAQPAGFHYGFGHGHGFHGGHMGHAHGVPRQGPLGQQQQQADVYLKALLIMVGVLVIASLLAA

SEQ ID NO: 3959 - DNA, 1083 bp, Triticum aestivum
  misc_feature (1)..(1083): Ceres cDNA ID no. 21666005
  misc_feature (1)..(1083): Ceres CLONE  ID no. 1031715
  misc_feature (1)..(1083): Also known as  Ceres CDNA ID no. 24357738
aaacaaaaaaaacgtgacttgagaggattggatgaggcgcgccgcgtgcggtggccgacggcgagaaggcgcaagcaagcaagcagcgacacgccctcgcactcgcggcggcggattcgtggacagcatcgccagacaggggctcgcggcgaggcggccggcggtctgcggcatccgtcgcccggcgctccgcgtcctccgcggtgcggcgctgcagcaggacgggagctctgacgcagcgaccaacataaggaaaattcacagggtgtgaatcttgtggccaccggctagcgggacggagccgtggcaccttgcgcgcgacctgttcgacaaattgccctggccgagctggtctcctcgtgctgtggcaatggcgttgctaggcgccaccctcggccggccaccattgtcgtgtccctccacccccagctcgctgccattcaggcctaactgcttccagttccctcgtccgtgccacacaggcgtggtggcacaccggcgcagagcgtacccaaggatcgaggccacggcgaggcacggcgcgcggaaggagaacgccaaggtcagaaaccgccggctgcagaaaaagtacaatggcacggcgaccaagcccaggctgtcagtcttctgctccaacaggcagctctacgccatgctcgtcgacgaccacggcaagaagatcctcttctacgccagcaccctgcaggaagacatctgcggcgaccctccatgcagcaccgtggaggcctctcggagggtcggggaggagctggtcaaggcgtgcaaggagctggacatctccgaggtctcgtgctacgaccgcaacggcttcgctcgaggggagaagatgatggcgttcgaggatccggtcgcgcagcacgggttcctgcccagatagcaaaattatgagatccttgggaggcttgcaccagctgctcaacgtagcaggctatttggtgaagagtaggagtgtagcctgcaggaagttctttgctctgtgaattgcttgatgtatgattcagagcatatagctcggactacttggtatttcacagcatgttattaacaaaaaaaaaaaaaaaa

SEQ ID NO: 3960 - protein, 175 aa, Triticum aestivum
  misc_feature: PFam Name: Ribosomal_L18p; PFam Description: Ribosomal
  misc_feature: GI Number: 50919875; NR Description: putative ribosomal protein [Oryza sativa (japonica cultivar-group)] >gi|19071629|gb|AAL84296.1| putative ribosomal protein [Oryza
  misc_feature: GI Number: 51091395; NR Description: ribosomal protein-like [Oryza sativa (japonica cultivar-group)] >gi|51091345|dbj|BAD36080.1| ribosomal protein-like [Oryza sativa
  misc_feature: GI Number: 22329550; NR Description: ribosomal protein L18
  misc_feature: GI Number: 34897318; NR Description: putative ribosomal protein L18 [Oryza sativa] >gi|18855047|gb|AAL79739.1| putative
  misc_feature: GI Number: 12484209; NR Description: putative ribosomal protein L18 [Arabidopsis thaliana] >gi|5733872|gb|AAD49760.1| Similar to 50S Ribosomal protein L18 from Thermotoga maritima gb|AE001798. ESTs gb|AI993387, gb|T75951 and gb|T22182 come from
MALLGATLGRPPLSCPSTPSSLPFRPNCFQFPRPCHTGVVAHRRRAYPRIEATARHGARKENAKVRNRRLQKKYNGTATKPRLSVFCSNRQLYAMLVDDHGKKILFYASTLQEDICGDPPCSTVEASRRVGEELVKACKELDISEVSCYDRNGFARGEKMMAFEDPVAQHGFLPR

SEQ ID NO: 3961 - DNA, 1547 bp, Triticum aestivum
  misc_feature (1)..(1547): Ceres cDNA ID no. 21666006
  misc_feature (1)..(1547): Ceres CLONE  ID no. 1032569
  misc_feature (1)..(1547): Also known as  Ceres CDNA ID no. 24361637
gacctcttgcccagccgcagccatcgatctagggttttcttcttcgctcatagagtagatcggcggcggaggtcaggagaatcgaagcggaggaagggaagggcgatggcgaccaggatgtcaaaggaggagctggcggcgtatcagccgaggccgggggtgcgctgtgagaaggcggcggcggaattctttgcgaggaggaagaaggagatggagtccgagcctgaggagtcccgcaccgacataaacgcgtacgaagcaggcctctaccgtgtgttctgggagcagatgttcggcaagaacggttcccgctacgaggacatcacaatgatccctcccatggctttcactgatcatggctgcaagtttgccggcgtccagtccactatacagattttttccgtcaaagtcgaggagacaacgggagggttggtgtggcccttgcatgtctacggtatggttgcggtccgtgacgtcgttgaccacaaccgaaatgttatcttccatcgtgaaagggataactgccaaatcattaccacaatggatccatatctggcactaacgggtcctacccggggtgttgtggtgtctgttcatcctgtgtactttgaagttcatcttaaggtgaaaggtcagaaggaatctgaagacaaagacctagcctttctggcaggctgttacagcagtaatggcccatggagatcctgtttgtttgataggtcttggaccagcaagctcagcacactgaagtttacttgtggccacttggttgactcagtggaggccacagtgagcgtgaaactcattggagggacgttgccgcatggctatcgcggtgtattcaaggctgagacgtccggtattcctgagaagtccgtgatgctacttgattgtcgtgatggcaaactgcctgttgatggcgatggtcacgtgaagttttcgcggcgcgttgtttgcgttgaggttgctcctttggatgagctttgtgtcactaatctgaaagtatcgatagaggcagtgcgtatcaaagggaagaaagaaaaagtcaaagagaagataaggaaacatacggtgaagcttgaggctgattttctgcccaagaaaaagggtagaagccgggagattgtagaggttctctcatgtgaaatggaagtggaggttgcgtggtctcttctgtcgaccttcaaggccagctataagagggccattgctgatcatctggagagtctaaacttggtttagatgctggtggtgtagtggctgtgagaactgtctgttggaaactatgattatcgtatctatgttatcatgtggcatgtatgcacttattaactagtatagtgtagtggatgtttaatttatgcactggagcagtagttaaatttggtgtactgactaagctgaagtatgttggagcagcaactaaggatgtactactgtgctttagtatcaggtggtggcatgtatggacaaagttaattgcttccctcggtctctgtgcatttattatatgacatgctggttatgtgacaaaaaaaaaaaaaaaa

SEQ ID NO: 3962 - protein, 378 aa, Triticum aestivum
  misc_feature: GI Number: 50902240; NR Description: P0408G07.8 [Oryza sativa (japonica cultivar-group)] >gi|20161235|dbj|BAB90162.1| P0408G07.8
  misc_feature: GI Number: 5777618; NR Description: CAA30376.1 protein [Oryza
  misc_feature: GI Number: 38345621; NR Description: OSJNBb0003B01.17 [Oryza
  misc_feature: GI Number: 58531987; NR Description: OSJNBb0003B01.20 [Oryza
  misc_feature: GI Number: 21913313; NR Description: csAtPR5 [Aegilops tauschii]
MATRMSKEELAAYQPRPGVRCEKAAAEFFARRKKEMESEPEESRTDINAYEAGLYRVFWEQMFGKNGSRYEDITMIPPMAFTDHGCKFAGVQSTIQIFSVKVEETTGGLVWPLHVYGMVAVRDVVDHNRNVIFHRERDNCQIITTMDPYLALTGPTRGVVVSVHPVYFEVHLKVKGQKESEDKDLAFLAGCYSSNGPWRSCLFDRSWTSKLSTLKFTCGHLVDSVEATVSVKLIGGTLPHGYRGVFKAETSGIPEKSVMLLDCRDGKLPVDGDGHVKFSRRVVCVEVAPLDELCVTNLKVSIEAVRIKGKKEKVKEKIRKHTVKLEADFLPKKKGRSREIVEVLSCEMEVEVAWSLLSTFKASYKRAIADHLESLNLV

SEQ ID NO: 3963 - DNA, 1335 bp, Triticum aestivum
  misc_feature (1)..(1335): Ceres cDNA ID no. 21666007
  misc_feature (1)..(1335): Ceres CLONE  ID no. 1033156
  misc_feature (1)..(1335): Also known as  Ceres CDNA ID no. 24357717
atgccgccggtcgatcgtctgctagcttcgccttcctcctctcgattgagaccgccgtcgccgtgtaatcaaccagcagccaacagacattgccatcgccggccggtgtgttcagcttgctcccagtcccagtacaagtacagtacgttcaaagccatggcggacggcgaccagaaccagcagccgccgcgctactggttcccctactggagcccggtgcgcccgcagctgtcgcgccgcctctccccgccctcctcgcccgcagtgccgtcctcgccgcgccgcccgtcgccctcccacccacgccaacccactcctcctcgtgcggcccacagccaggcgtcctcccgcccgtccccgtccccgtccccgtccccgtcccgggcctcgccgctcgcgcccatccgagaccgagagccgcccaacaccaactccaacgccggtgctactgccaggccgcctcctaagccggtcgctctacccgcgacgcccaagcccaaggatgtcgacgtcgtcccgcagacggagaaagccgccgtgcacccgactcctgctgcggctgagaccaagcacggcaaggccgcccaacaccaccacaaggagaaggaggctgacaaggacgagcacaagagcaaggacaagaagcaccacgccggcgaggacggcaagcacaaggacaaggagaagaagcaccacgccgacgccggcgaggagagcaagcacaaggagaagaagcaccatgcggacgccggcgacgagggcaagcacaaggggaaggagaaggaggccaaggcggagcacgggaagctgcacggcgagctcaaggccgacatggtgcgcagggccaccggctccgggcacgggcagggggcgagcgtgatcacgctggccggggagaacaagggcgcgtccatgaaggtgggcggcaagggcaaggacggctcgtggaaggagcaccacggcggccaccggctggacgggaagccggtggacgggcagaagaagcaggggatgatgacggcgctgatcaacagcaacgtgcaggtgatcaacaactcgctgctgctgcacagctcatgcaacggcggcgaccccggcgtgcacctcaacctctccgccaagtccgccaacaaagacaagcagaagcatgccgctgcaaagaaatgagcgccgtcgacgactcatctgagccgtccagttgtaactatattatgcaaataagagcaattctaacagatcatgccccaaggcaattgggaaccacaccacaattgttatgattcccaagctactttctccagaaaaaggtattgcagttcaaaaaaaaaaaaaaaa

SEQ ID NO: 3964 - protein, 1335 aa, Triticum aestivum
  misc_feature: PFam Name: Glutenin_hmw; PFam Description: High molecular
  misc_feature: PFam Name: Dehydrin; PFam Description: Dehydrin
  misc_feature: PFam Name: Pyr_redox_2; PFam Description: Pyridine
  misc_feature: PFam Name: MARCKS; PFam Description: MARCKS family
  misc_feature: PFam Name: TolA; PFam Description: TolA protein
  misc_feature: GI Number: 34894102; NR Description: P0005A05.16 [Oryza
  misc_feature: GI Number: 66776452; NR Description: Protein-glutamate O-methyltransferase [Anaeromyxobacter dehalogenans 2CP-C] >gi|66857760|ref|ZP_00401802.1| Protein-glutamate
  misc_feature: GI Number: 66778264; NR Description: LigA [Anaeromyxobacter dehalogenans 2CP-C] >gi|66856061|ref|ZP_00400131.1| LigA
  misc_feature: GI Number: 66776103; NR Description: LigA [Anaeromyxobacter dehalogenans 2CP-C] >gi|66858140|ref|ZP_00402169.1| LigA
  misc_feature: GI Number: 28317062; NR Description: RE04347p [Drosophila
ATGCCGCCGGTCGATCGTCTGCTAGCTTCGCCTTCCTCCTCTCGATTGAGACCGCCGTCGCCGTGTAATCAACCAGCAGCCAACAGACATTGCCATCGCCGGCCGGTGTGTTCAGCTTGCTCCCAGTCCCAGTACAAGTACAGTACGTTCAAAGCCATGGCGGACGGCGACCAGAACCAGCAGCCGCCGCGCTACTGGTTCCCCTACTGGAGCCCGGTGCGCCCGCAGCTGTCGCGCCGCCTCTCCCCGCCCTCCTCGCCCGCAGTGCCGTCCTCGCCGCGCCGCCCGTCGCCCTCCCACCCACGCCAACCCACTCCTCCTCGTGCGGCCCACAGCCAGGCGTCCTCCCGCCCGTCCCCGTCCCCGTCCCCGTCCCCGTCCCGGGCCTCGCCGCTCGCGCCCATCCGAGACCGAGAGCCGCCCAACACCAACTCCAACGCCGGTGCTACTGCCAGGCCGCCTCCTAAGCCGGTCGCTCTACCCGCGACGCCCAAGCCCAAGGATGTCGACGTCGTCCCGCAGACGGAGAAAGCCGCCGTGCACCCGACTCCTGCTGCGGCTGAGACCAAGCACGGCAAGGCCGCCCAACACCACCACAAGGAGAAGGAGGCTGACAAGGACGAGCACAAGAGCAAGGACAAGAAGCACCACGCCGGCGAGGACGGCAAGCACAAGGACAAGGAGAAGAAGCACCACGCCGACGCCGGCGAGGAGAGCAAGCACAAGGAGAAGAAGCACCATGCGGACGCCGGCGACGAGGGCAAGCACAAGGGGAAGGAGAAGGAGGCCAAGGCGGAGCACGGGAAGCTGCACGGCGAGCTCAAGGCCGACATGGTGCGCAGGGCCACCGGCTCCGGGCACGGGCAGGGGGCGAGCGTGATCACGCTGGCCGGGGAGAACAAGGGCGCGTCCATGAAGGTGGGCGGCAAGGGCAAGGACGGCTCGTGGAAGGAGCACCACGGCGGCCACCGGCTGGACGGGAAGCCGGTGGACGGGCAGAAGAAGCAGGGGATGATGACGGCGCTGATCAACAGCAACGTGCAGGTGATCAACAACTCGCTGCTGCTGCACAGCTCATGCAACGGCGGCGACCCCGGCGTGCACCTCAACCTCTCCGCCAAGTCCGCCAACAAAGACAAGCAGAAGCATGCCGCTGCAAAGAAATGAGCGCCGTCGACGACTCATCTGAGCCGTCCAGTTGTAACTATATTATGCAAATAAGAGCAATTCTAACAGATCATGCCCCAAGGCAATTGGGAACCACACCACAATTGTTATGATTCCCAAGCTACTTTCTCCAGAAAAAGGTATTGCAGTTCAAAAAAAAAAAAAAAA

SEQ ID NO: 3965 - DNA, 1350 bp, Glycine max
  misc_feature (1)..(1350): Ceres cDNA ID no. 21666008
  misc_feature (1)..(1350): Ceres CLONE  ID no. 1042501
  misc_feature (1)..(1350): Also known as  Ceres CDNA ID no. 24366472
aggtattgccgttggtttagagagagaaagtgttgtgttgagaacgcctctatatgacccataagggggtctgcgtgtaaagtcccaagcatttgtcatcactcaaagagtggacaagtccggtcaaaattgctgcaccttggcctgcaccttccttgctccgtcccttctttctctaattcttcaccctcttaattaaaaccttctccctcgttccccttgtgaccacaacacacaacaacacatcacatatatagttatttcttttgcaacaaaccctcatatattataagctgagccaggattagaattggatcattcattccaacatgggtttttcctcaaaagaagagaagtccaaaagaatattgaggggcttgaagactctcttcttcttgatcactatggttatatcgcttcttcttttctccgccccggttctccttgttattgccgatgcacttgttccttctgctctgctctcctcgctttctcaatcttctttctccatggaaactctcgcttcccatttccacaactacgattttcgatactctctcattgatattccccttgtgtcaataatacgatccttcatcatcttctgtgtttatagtttgtgtgatggaccaaggctttcgcatggaccttatttggggatcacgaccatgtgctctgttttgtctctgatgtttgtgtcgttcaaagcagtttacatcttcagtgtttcgggtattgatcgaagtgggtatgttcgtgccaccgaaatagctctgttcgtgtgttcttgtgcgttggccgtggggcatgttgtggtggcctacagaacaagttgcagggaaagaagaaagcttttggtctacaaaattgatattgaagctatttcagcttgcaaaaatgggtatcctaggtatctgaagattcctcaagaagaaagaatcaaatgaagtcactgtgccactacaacattaaaggatatatcaatatcaatttatacgtatatatgatatttttcaactaacagagctacagctattcatcatattatgtccttgcgtgcgtcaagggatgctacggtttatccaaaggatgccagtaaccttgacacctaacttttctaacctcggatactgtcatagaagtttacactctaccgcagccatgatacataaagttgttgaatggtgtttaggtataattactaattaatatatgtacaatagagcttcatctttggcgatttatgtataactattttgttttgttattcttattttccccttgcaattgtttcgtgtatatcttcttgtatatataaaaattaagggattgttataaaaaaaaaaaaaa

SEQ ID NO: 3966 - protein, 1350 aa, Glycine max
  misc_feature: GI Number: 55296870; NR Description: alpha/beta hydrolase-like [Oryza sativa (japonica cultivar-group)] gi|55296846|dbj|BAD68190.1| alpha/beta hydrolase-like [Oryza sativa
  misc_feature: GI Number: 34911750; NR Description: P0038D11.18 [Oryza sativa (japonica cultivar-group)] >gi|21328020|dbj|BAC00606.1| OJ1316_H05.1 [Oryza sativa (japonica cultivar-group)] >gi|21901991|dbj|BAC05542.1| P0038D11.18 [Oryza sativa (japonica
  misc_feature: GI Number: 42562713; NR Description: hydrolase, alpha/beta
AGGTATTGCCGTTGGTTTAGAGAGAGAAAGTGTTGTGTTGAGAACGCCTCTATATGACCCATAAGGGGGTCTGCGTGTAAAGTCCCAAGCATTTGTCATCACTCAAAGAGTGGACAAGTCCGGTCAAAATTGCTGCACCTTGGCCTGCACCTTCCTTGCTCCGTCCCTTCTTTCTCTAATTCTTCACCCTCTTAATTAAAACCTTCTCCCTCGTTCCCCTTGTGACCACAACACACAACAACACATCACATATATAGTTATTTCTTTTGCAACAAACCCTCATATATTATAAGCTGAGCCAGGATTAGAATTGGATCATTCATTCCAACATGGGTTTTTCCTCAAAAGAAGAGAAGTCCAAAAGAATATTGAGGGGCTTGAAGACTCTCTTCTTCTTGATCACTATGGTTATATCGCTTCTTCTTTTCTCCGCCCCGGTTCTCCTTGTTATTGCCGATGCACTTGTTCCTTCTGCTCTGCTCTCCTCGCTTTCTCAATCTTCTTTCTCCATGGAAACTCTCGCTTCCCATTTCCACAACTACGATTTTCGATACTCTCTCATTGATATTCCCCTTGTGTCAATAATACGATCCTTCATCATCTTCTGTGTTTATAGTTTGTGTGATGGACCAAGGCTTTCGCATGGACCTTATTTGGGGATCACGACCATGTGCTCTGTTTTGTCTCTGATGTTTGTGTCGTTCAAAGCAGTTTACATCTTCAGTGTTTCGGGTATTGATCGAAGTGGGTATGTTCGTGCCACCGAAATAGCTCTGTTCGTGTGTTCTTGTGCGTTGGCCGTGGGGCATGTTGTGGTGGCCTACAGAACAAGTTGCAGGGAAAGAAGAAAGCTTTTGGTCTACAAAATTGATATTGAAGCTATTTCAGCTTGCAAAAATGGGTATCCTAGGTATCTGAAGATTCCTCAAGAAGAAAGAATCAAATGAAGTCACTGTGCCACTACAACATTAAAGGATATATCAATATCAATTTATACGTATATATGATATTTTTCAACTAACAGAGCTACAGCTATTCATCATATTATGTCCTTGCGTGCGTCAAGGGATGCTACGGTTTATCCAAAGGATGCCAGTAACCTTGACACCTAACTTTTCTAACCTCGGATACTGTCATAGAAGTTTACACTCTACCGCAGCCATGATACATAAAGTTGTTGAATGGTGTTTAGGTATAATTACTAATTAATATATGTACAATAGAGCTTCATCTTTGGCGATTTATGTATAACTATTTTGTTTTGTTATTCTTATTTTCCCCTTGCAATTGTTTCGTGTATATCTTCTTGTATATATAAAAATTAAGGGATTGTTATAAAAAAAAAAAAAA

SEQ ID NO: 3967 - DNA, 1564 bp, Glycine max
  misc_feature (1)..(1564): Ceres cDNA ID no. 21666009
  misc_feature (1)..(1564): Ceres CLONE  ID no. 1043558
  misc_feature (1)..(1564): Also known as  Ceres CDNA ID no. 24356354
atctcttaataaagattagaaatcgacatatggggggagcaaagagttactcttgttttgcagtaatagctgtggccttggttttgctacttctgaatgtggctgtggtttgcaatggaggcaagacaagcacattcattaggaaggttgagaaaactgaggacatgccccttcatagtgatgtatttgttgccccttctggctataatgctcctcagcaggttcatataacacaaggtgaccaagtgggaagggccatgatcgtgtcatgggtgactgtggacgaaccaggaaagagtctagtgcattactggagtgacgccagccagcacaagagagtggccaagggaaatcatgtcacatatagatacttcaattattcttctggttttatacatcactgcacccttagagatttagagtttaacacaaaatattattatgaagttggaattgggcatactactaggcaattttggtttgtgactcctcctgaagttcaccctgatgcgccttatacatttggtctcattggtgatctgggtcaaacttttgattcaaacaagacccttgttcactatgaatcaaaccctcacaaaggacaagctgtgttgtatgttggagacctctcttatgcagataatcacccaaatcatgataacgttaggtgggatacgtggggaagattcgtagaaagaagtactgcttatcaaccttggatatggactacagggaaccatgaacttgactatgctcctgaaattgatgaaacagaacctttcaagcctttccgccaccgttactatgtgccttacaaagcatccggaagtactgaacccttttggtattctgtcaagatagcttcggcacacatcatagttttggcttcatattcagcttatggcaaatatactccccaatatgaatggcttgaggcagagctaccaaaggttgatagaaccaagaccccttggttgattgttcttgtgcattctccatggtataatagttacaactatcattacatggaaggggaaaccatgagggtaatgtttgagccttggtttgtgaagtacaaggttgatgttgtgtttgctggtcacgtccatgcctatgaacgaagtgaacgaatctccaacactggatacaacattaccaatggtcgatgcaggcctttgaaggaccagtcagctcctgtatacataaacattggtgatggagggaacattgaaggcttggcaagcaacatgacaaatccacagcccgagtattctgcatacagggaagcaagttttgggcatgccattttggaaataaagaacagaacacatgctcactatagctggcaccgaaatgaagatgaatatgctgttacagctgactctatgtggtttttcaacagatactggcatcctgttgatgactccacaaccaagtgaactaataggatagttctgcagagttttcctatctaaaaatatccgttttataatgtattgttgggtgatgtacacttgttattgaagtaaattcaatgttttctttggtaaaaaaaaaaaaaaaa

SEQ ID NO: 3968 - protein, 469 aa, Glycine max
  misc_feature: PFam Name: Metallophos; PFam Description: Calcineurin-like
  misc_feature: GI Number: 31376393; NR Description: At2g16430 [Arabidopsis thaliana] >gi|20257483|gb|AAM15911.1| purple acid phosphatase [Arabidopsis thaliana] >gi|20260674|gb|AAM13235.1| putative purple acid phosphatase precursor [Arabidopsis thaliana]
  misc_feature: GI Number: 5360721; NR Description: acid phosphatase [Lupinus
  misc_feature: GI Number: 47716655; NR Description: purple acid phosphatase
  misc_feature: GI Number: 4160280; NR Description: purple acid phosphatase [Ipomoea batatas] >gi|11262827|pir||T51094 acid phosphatase (EC
  misc_feature: GI Number: 27597227; NR Description: purple acid phosphatase
MGGAKSYSCFAVIAVALVLLLLNVAVVCNGGKTSTFIRKVEKTEDMPLHSDVFVAPSGYNAPQQVHITQGDQVGRAMIVSWVTVDEPGKSLVHYWSDASQHKRVAKGNHVTYRYFNYSSGFIHHCTLRDLEFNTKYYYEVGIGHTTRQFWFVTPPEVHPDAPYTFGLIGDLGQTFDSNKTLVHYESNPHKGQAVLYVGDLSYADNHPNHDNVRWDTWGRFVERSTAYQPWIWTTGNHELDYAPEIDETEPFKPFRHRYYVPYKASGSTEPFWYSVKIASAHIIVLASYSAYGKYTPQYEWLEAELPKVDRTKTPWLIVLVHSPWYNSYNYHYMEGETMRVMFEPWFVKYKVDVVFAGHVHAYERSERISNTGYNITNGRCRPLKDQSAPVYINIGDGGNIEGLASNMTNPQPEYSAYREASFGHAILEIKNRTHAHYSWHRNEDEYAVTADSMWFFNRYWHPVDDSTTK

SEQ ID NO: 3969 - DNA, 1270 bp, Glycine max
  misc_feature (1)..(1270): Ceres cDNA ID no. 21666010
  misc_feature (1)..(1270): Ceres CLONE  ID no. 1043829
  misc_feature (1)..(1270): Also known as  Ceres CDNA ID no. 23708949
aaaagccccattataaacctaacgcattgggttcggaggtgttgagtggaagtggaaggtgaagaagaagaatatggaggatttcaagaagagaaagctggagctggacgaagcaggtggcgacggtgatttttcttccaaggaagagcttcgcttcctcatcgaacctctcgctaaaccccagctcgtcgatcttcttgccaaactagggtcccaatatccttcaattgcagaagaaataaaaagtattgcaagtgcagatcctgcccatcgaaagctttttgtccgtggcttggcctggaataccacttcagaaactttgcgtgctgcatttcaagagcatggagaaattgaggaaggagctgtgatctatgataaagtgacaggaaaatcccgtggctatggatttataactttcaaaaatatggaatcaactcagcaagcattgagagcccctagcaagttaatcgatgggagattggctgtctgtaatctagcttgtgagagtctaagtggaacaagtagtgctcctgatctttccctgaggaagctttacattggaagcttatcaccagaagtcacaagtgaaattctccttaactattttgcaaggcatggtgaaatagaggaaggttcagttgcatatgacagggatacaaatgaatcacgtggttttggctttgtcacatacaagacagcggaggctgcgaagaaggccatagatgacctagaaaagacacttgggggaagaaatatagttgtaaaatatgctgattcccaaaaaggtaaaactggccagccaccatttcctgctggagtggttccgatggcagcattacctatgaacccaggatatatgcagcagcctggaaaagctaatgttagttcaaggcccccaatcaattacagttacccccaaactgtagcaccatattctgcacttccttatccaaaccctcccactgctccctctccttatccgacacaagggcagattccttatcctcaagtttctgcaaagaaagaccgacatgggtttctgcctactcaacctgtaggaatgaacaactacccttattactatcccaagcaatgaatgtatttttaaaactaaagatgatgattttggtactcctttctttgctttccttttcaaatctttttagcccctagttatctcttccatgcagcttttgatctcttgtagaattttgacattcttatgttacttgtaatattgagtagaattttttttataaaaaaaaaaaaa

SEQ ID NO: 3970 - protein, 340 aa, Glycine max
  misc_feature: PFam Name: RRM_1; PFam Description: RNA recognition motif.
  misc_feature: GI Number: 34912640; NR Description: P0410E01.24 [Oryza sativa (japonica cultivar-group)] >gi|11034579|dbj|BAB17103.1|
  misc_feature: GI Number: 21666573; NR Description: RNA-binding protein
  misc_feature: GI Number: 22137136; NR Description: At2g41060/T3K9.17 [Arabidopsis thaliana] >gi|3402711|gb|AAD12005.1| putative RNA-binding protein [Arabidopsis thaliana] >gi|16612302|gb|AAL27512.1| At2g41060/T3K9.17 [Arabidopsis
  misc_feature: GI Number: 23613686; NR Description: RNA-binding protein, putative [Plasmodium falciparum 3D7] >gi|23505068|emb|CAD51850.1|
  misc_feature: GI Number: 23483711; NR Description: UBP1 interacting protein
MEDFKKRKLELDEAGGDGDFSSKEELRFLIEPLAKPQLVDLLAKLGSQYPSIAEEIKSIASADPAHRKLFVRGLAWNTTSETLRAAFQEHGEIEEGAVIYDKVTGKSRGYGFITFKNMESTQQALRAPSKLIDGRLAVCNLACESLSGTSSAPDLSLRKLYIGSLSPEVTSEILLNYFARHGEIEEGSVAYDRDTNESRGFGFVTYKTAEAAKKAIDDLEKTLGGRNIVVKYADSQKGKTGQPPFPAGVVPMAALPMNPGYMQQPGKANVSSRPPINYSYPQTVAPYSALPYPNPPTAPSPYPTQGQIPYPQVSAKKDRHGFLPTQPVGMNNYPYYYPKQ

SEQ ID NO: 3971 - DNA, 1324 bp, Glycine max
  misc_feature (1)..(1324): Ceres cDNA ID no. 21666011
  misc_feature (1)..(1324): Ceres CLONE  ID no. 1045033
  misc_feature (1)..(1324): Also known as  Ceres CDNA ID no. 0
aaaagtgccctcaacttaaatttccaaagcaccaccaagacttagaaagaaagaaaaaataatgaaaatggcacgcttgccagtgatttttttcccatttttgaccctgctcctgatatctgtctcgacgaatattaatgtacttggggagctaccgttttcagcaatgtttgtgttcggagattcattagtggacagtggaaataacaactatctcaactccttggcaagagccaatttcgtgccttatggcattgatttctcagagggtccaactgggaggttttccaacggcaaaacagtcacagacatcctcggggaaattataggtcttcctttactaccagcttttgcagataccctgataaaaagcagaaacatttcctggggagtgaactatgcttcagctgctgctgggatccttgatgagacagggcaaaatttgggagaacgcattagctttcggcagcaggtgcaagattttaatacaaccgtaaggcagatgaagatccaaatggagcacaaccaattgagtcagcacttagcaaattcattgacagtagtgatccatggcagtaatgattacataaacaactatttcttgcctgaacaatatacttcaagcttcaactatgacccaaaaaactatgcagatcttctcattgaggtttacaaaaggcacattttgagtcttcatgatttgggactcagaagattcttactggcaggacttgggccacttggttgcatacctagacaattagccttaggctctgtccctcgaggagagtgtagacctcacatcaatgacattgtcgacatgttcaatgttttgttgaaatctttggtggatcaactgaatgcggagcaccatggttcagtttttgcgtatggcaacacttacggagttttcaatgatctgattaacaacgcaaaaacctacggtttcacagtaactgatagtgggtgctgtggtattggaagaaatcaagcacagataacatgcttatttgcgttgtttccttgcctggatagagacaaatatgtgttctgggatgccttccataccactcaagcagtgaacaatattgttgctcataaggcttttgctggacctccttctgattgctacccaattaacgtcaaacagatggcacaaatgtgggtgttaccatccggtcaaaacaaaacttcagtgccgtccattgtatcaaaaaattagagttttgtctaaaatttgcctgcttatgaacgaatgcttaataaattgcaaagtataaatatattaattatgatgaataaaaaaacaaaaaaaaaaaaaaaa

SEQ ID NO: 3972 - protein, 386 aa, Glycine max
MKMARLPVIFFPFLTLLLISVSTNINVLGELPFSAMFVFGDSLVDSGNNNYLNSLARANFVPYGIDFSEGPTGRFSNGKTVTDILGEIIGLPLLPAFADTLIKSRNISWGVNYASAAAGILDETGQNLGERISFRQQVQDFNTTVRQMKIQMEHNQLSQHLANSLTVVIHGSNDYINNYFLPEQYTSSFNYDPKNYADLLIEVYKRHILSLHDLGLRRFLLAGLGPLGCIPRQLALGSVPRGECRPHINDIVDMFNVLLKSLVDQLNAEHHGSVFAYGNTYGVFNDLINNAKTYGFTVTDSGCCGIGRNQAQITCLFALFPCLDRDKYVFWDAFHTTQAVNNIVAHKAFAGPPSDCYPINVKQMAQMWVLPSGQNKTSVPSIVSKN

SEQ ID NO: 3973 - DNA, 1287 bp, Glycine max
  misc_feature (1)..(1287): Ceres cDNA ID no. 21666012
  misc_feature (1)..(1287): Ceres CLONE  ID no. 1046893
  misc_feature (1)..(1287): Also known as  Ceres CDNA ID no. 24356351
cactcactattttgggttcaagctggatttgatcttagcaagcaagaaagaagctgtcttgatggcgaatcgttggtgggccgggagcgcgacggtgaagcccagtgaacaagataacggtgacaacaacggtactcccaccaacagtgggaacagtaacaccaaagttaacgcggttctcgaggacgacgcaaacaccaacgagcgcgacggcgaagagcagaccctcagcggcgggcggcggccgcgtggcaggccgccagggtcaaagaacaagccaaagccgccggtggtgataacgaaagagagccccaacgcgctctgcagccacatccttgagatcagcgacggcagcgacgtggctgagtgcattgctatcttcgccacgcgccgccaccgcggcgtctcagtcctcagcggcaacggtttcgtcaccaacgtcacgctccggcagccggcggcccctggaggggtcatcaccctccaggggcggttcgagattctctccctctccggcgcgttcctgccggcgccttcgccgccggaggccaccggactcaccgtgtacctcgccggcgggcaggggcaggtggtcggaggaagcgtggtgggaccccttgtcacctcggggccggtgattgttgttgctgctactttcgctaatgctacctatgaaaggttgcctttggaggatgaaaaaggtgaagaggacatgcaagaggtgaatgaaggtgatggtggtggaacatcaccaccacaaccaccaccaccaccaccaccaccttcacaaggtgaacaacaggtttcaatgccggtgtataatttggtgcctaataatggtgatgtgttttgggggcctccatcttcaccttctaattattgaaaacttgaaacccttgttgtttacgtaattggcttatctgctgtctcgtgaccattcagaacgactcaatggttttgagggttgtgttaatatttaattgtgaaaatattaacacaattctcaaaacgacgtttgaagacgggatagcagagaagtcatgttcggaactactttccaccattgatcttgctgactgtatatgcgcagtgtgatcaaacggttactttgttttcgttgcaactcaggttagaacaacttagaacgtttttgaattttgatgatcatatcatatctgttgcatgttattttagtctctccggagaacttgttttgttgtctttgttattgtctctcttctgtttaatctacatagttagtaatttggttcaaaaaaaaaaaaaaaa

SEQ ID NO: 3974 - protein, 273 aa, Glycine max
  misc_feature: GI Number: 21593180; NR Description: putative DNA-binding
  misc_feature: GI Number: 7269128; NR Description: putative DNA binding protein [Arabidopsis thaliana] >gi|2827558|emb|CAA16566.1| putative DNA binding protein [Arabidopsis thaliana] >gi|15235815|ref|NP_194012.1| DNA-binding protein-related
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 50912085; NR Description: DNA-binding protein-like [Oryza sativa (japonica cultivar-group)] >gi|41052877|dbj|BAD07790.1| DNA-binding protein-like [Oryza sativa
  misc_feature: GI Number: 53828597; NR Description: At4g35390 [Arabidopsis thaliana] >gi|50198777|gb|AAT70422.1| At4g35390 [Arabidopsis thaliana] >gi|30690333|ref|NP_195265.2| DNA-binding protein-related
MANRWWAGSATVKPSEQDNGDNNGTPTNSGNSNTKVNAVLEDDANTNERDGEEQTLSGGRRPRGRPPGSKNKPKPPVVITKESPNALCSHILEISDGSDVAECIAIFATRRHRGVSVLSGNGFVTNVTLRQPAAPGGVITLQGRFEILSLSGAFLPAPSPPEATGLTVYLAGGQGQVVGGSVVGPLVTSGPVIVVAATFANATYERLPLEDEKGEEDMQEVNEGDGGGTSPPQPPPPPPPPSQGEQQVSMPVYNLVPNNGDVFWGPPSSPSNY

SEQ ID NO: 3975 - DNA, 1228 bp, Glycine max
  misc_feature (1)..(1228): Ceres cDNA ID no. 21666013
  misc_feature (1)..(1228): Ceres CLONE  ID no. 1047092
  misc_feature (1)..(1228): Also known as  Ceres CDNA ID no. 0
attaattaatttaactgaattttatgattctctgagtcagaagcgagatttttgccttaaaaaaaacaaaacgagatttttgcgttttgaagataaggatatatccgcagctaaattttgtgtaaatatattcggattttggagaagctgatgaagagaataggggtgatctggatcgtgttggtgcgttgatcagtgatttaataatgtggaaagatgtttcaaaatcgaccctttggtttggtttggggtgtctttgtttcttgtcttcttgcttcactaaaggggtcaactttagcattttctcggccatatcgcgattggcaattctcttgttgggtgtttcattcttctcaaactcagtttgtcaaagaaaccaggttgagaaaaggagttttgccaagctgaaagaagatgacattttacatctagcaaaattgattcttcctgcactaaattttgcaatttcaaagactagagaactgttttcaggagaaccgtgcatgaccctgaaagtggctcctttccttctactaggagcggagtatggtcatcttattacaatttggaggctttgtgccattggattttttgtcagcttcagtgtaccaaggctttattcttgttactctgctcagataaacctgcgagtcgagtgcttgaaattgcgattgttggacacatggagtgcttgcactcacaagaagatagtgattgcatcagtgcttattgcattctggaatctatctaccataaagactcgaatcttcacagcatttatattgcttgtaatactccgatatttccgggaaactataatgcaacctgtagaagatggtgaagctcaagtggcagagaaggaacagaagcaggcattggtggtggtggcagaacctgaggaagaggaaccgcagaaggcactagtggttgctgaaaaacagcgccaatgctagaaactttgttcatccggccatttctttacacagagcacgaataagtgtatcttgcgccctcagattgggtcatttctttgcagttagattaacaataaaaatatgtgcttgaagtcagccaatgttcaatatttgcaatcaaaaggcattttatagtcataatagtcagccagttgtctaaatatcttgcacctatagtctatagatggggcattcctttgtagctaggtgaaaaaaataataaatgtgctttcattgcaaaaaaaaaaaaaaaa

SEQ ID NO: 3976 - protein, 248 aa, Glycine max
MWKDVSKSTLWFGLGCLCFLSSCFTKGVNFSIFSAISRLAILLLGVSFFSNSVCQRNQVEKRSFAKLKEDDILHLAKLILPALNFAISKTRELFSGEPCMTLKVAPFLLLGAEYGHLITIWRLCAIGFFVSFSVPRLYSCYSAQINLRVECLKLRLLDTWSACTHKKIVIASVLIAFWNLSTIKTRIFTAFILLVILRYFRETIMQPVEDGEAQVAEKEQKQALVVVAEPEEEEPQKALVVAEKQRQC

SEQ ID NO: 3977 - DNA, 1159 bp, Glycine max
  misc_feature (1)..(1159): Ceres cDNA ID no. 21666014
  misc_feature (1)..(1159): Ceres CLONE  ID no. 1047211
  misc_feature (1)..(1159): Also known as  Ceres CDNA ID no. 24360051
aatgcttccagatgtaacgtagcaacgggggagagaagatctgtttcacttttcacaccaaaccccgatctgagatcttctcttgccctcccacaacaatgacatccccgacggcgctgaaggccgtgacgctgacgcacgtgcgctaccagaggggcgaccgcgtcggccacttcctggcctggatatcccttgtccccgtcttcatctccctgggcggcttcgtctctcacttcatcttccgccgcgaactccagggcatattcttcgccctcggcctcatcgtctcccaattcatcaaccaagtcatcaagacctccgtccagcaggcccgccccgccacctgcgccctccttgagatgtgcgactcccacggctggccctccagccactgccagtacatgttcttcttcgcctcctacctcaccctcctctccctcagaggcggcctctctttctggcacgtgcgcgacaacccccccctccacctcctcacgtggtccctcgcgctgctcaccatgtattcccgcgtctacttggggtaccatacgctggctcaggttttcgctgggaccgcgcttggggttttcctcggcgcggtttggttctgggttgtgaactccgttttgtatccgtactttccggttattgaagagagcgcgtttgggaggtggttctacgtgaaggacacttctcatatacctaatgtgttgaagtttgagtacgatatggccagggctgagagacggaaactggcatcgaattctaagtcggattgagttggcacattgctctgaatttttcttctaggatttgccttcacaagtatttatggcagtattattatagctttcttctctggagctttccactatagaagccatctggcttggctcagccgttcaggtataaatggtatctatgaagagggcagcagagcacactgatatggtactacgggtctatgatgcctgtgaaatagaactaatgtaacaatagatggttttacttgatgttatagatagacaaatgaatagtttgtcttgttttcttacatgggtttttgaccacatacattgacacaaataaaactgagggtttttttaaattattgataaatttataaatatttgttttgcccctaaaaaaaaaaaaaaaa

SEQ ID NO: 3978 - protein, 226 aa, Glycine max
  misc_feature: PFam Name: PAP2; PFam Description: PAP2 superfamily
  misc_feature: PFam Name: Mucin; PFam Description: Mucin-like glycoprotein
  misc_feature: PFam Name: FH2; PFam Description: Formin Homology 2 Domain
  misc_feature: PFam Name: Atrophin-1; PFam Description: Atrophin-1 family
  misc_feature: GI Number: 38564298; NR Description: At5g03080 [Arabidopsis thaliana] >gi|46402486|gb|AAS92345.1| At5g03080 [Arabidopsis thaliana] >gi|15242619|ref|NP_195928.1| phosphatidic acid
  misc_feature: GI Number: 31206587; NR Description: ENSANGP00000002778 [Anopheles gambiae] >gi|21296031|gb|EAA08176.1| ENSANGP00000002778
  misc_feature: GI Number: 20072969; NR Description: Dolichyl pyrophosphate
  misc_feature: GI Number: 34853220; NR Description: similar to contains transmembrane (TM) region and ATP binding region [Rattus
  misc_feature: GI Number: 62644867; NR Description: PREDICTED: similar to contains transmembrane (TM) region and ATP binding region [Rattus
MTSPTALKAVTLTHVRYQRGDRVGHFLAWISLVPVFISLGGFVSHFIFRRELQGIFFALGLIVSQFINQVIKTSVQQARPATCALLEMCDSHGWPSSHCQYMFFFASYLTLLSLRGGLSFWHVRDNPPLHLLTWSLALLTMYSRVYLGYHTLAQVFAGTALGVFLGAVWFWVVNSVLYPYFPVIEESAFGRWFYVKDTSHIPNVLKFEYDMARAERRKLASNSKSD

SEQ ID NO: 3979 - DNA, 1076 bp, Triticum aestivum
  misc_feature (1)..(1076): Ceres cDNA ID no. 21666015
  misc_feature (1)..(1076): Ceres CLONE  ID no. 1047659
  misc_feature (1)..(1076): Also known as  Ceres CDNA ID no. 24360467
actagcttccagcgcacacttgtcaccttcctccccgcaacgcatccagctaccccgtctcactcccgacccatcccaccagcaccaggacagacacggacaggacgatggagtcacccatggcggcccggaggctcctgcaggaggcggcgggcctgtccacgccgggcgcccggatcatcgccgacgacagggacatcgtcatcatcctcgcctcgctgctctgcgcgctcatcaccgtcctcggcatcggcctcgtcgcccgctggtgcgcgtgcggcggcgcggaagccagggcgcgcgccgccgccaaccggggcgtcaagaagtcggtgctccgcgccatccccaccgtcgcctacgtctccgccgacgccggcaagggcaagggcaaggaggcagaggaggccgccgcggcgccggagtgcgccatctgcctcgccgagttcgaggacggcgaggccatgcgcgtgctgccccagtgcggccacgccttccacgccgcctgcgtcgacaagtggctgcgcggccactcttcttgcccctcctgccgccggatcctcgccgtccagctgccggctgcccagcggtgccagcgctgcggcgcgcgccccgacccagccgtggcgacctggaagcctccggcccagtacggcgagatgccgcccttcttgccgtagcggctcgcgcgcgcgctcgatctccacagatctgggcgagagctagaagacgactagtagcagaggaaccagtcaaccaatcgatgagccttctgtttggtcaaatatctcggctgcttctcttaattaccttcctttgtttatctcatcatcagtagcagttcttcttaccgccgagctggaaatgcatagcatttctgaatttaggaccctggtatgcaggtgggtggtgatcaaggtgttgccactacatcttagcagctttgtacatttgtaaatagtaactataattactcctaaggagtaatcggcatcatcgattaggcttatctgaaactgtgaatacctttgctttccatgaatccatttggtcaattctgaaaaaaaaaaaaaaaa

SEQ ID NO: 3980 - protein, 1076 aa, Triticum aestivum
  misc_feature: PFam Name: zf-C3HC4; PFam Description: Zinc finger, C3HC4
  misc_feature: PFam Name: FH2; PFam Description: Formin Homology 2 Domain
  misc_feature: PFam Name: Pyr_redox_2; PFam Description: Pyridine
  misc_feature: PFam Name: Peptidase_S8; PFam Description: Subtilase family
  misc_feature: PFam Name: Atrophin-1; PFam Description: Atrophin-1 family
  misc_feature: GI Number: 50911567; NR Description: putative ring finger protein [Oryza sativa (japonica cultivar-group)] >gi|41052716|dbj|BAD07573.1| putative ring finger protein [Oryza
  misc_feature: GI Number: 2894379; NR Description: ring finger protein [Hordeum vulgare subsp. vulgare] >gi|7489432|pir||T04483 probable
  misc_feature: GI Number: 37536508; NR Description: putative ring finger protein [Oryza sativa (japonica cultivar-group)] >gi|12039329|gb|AAG46117.1| putative ring finger protein [Oryza sativa] >gi|31433314|gb|AAP54843.1| putative ring finger protein
  misc_feature: GI Number: 17065626; NR Description: putative RING zinc finger protein [Arabidopsis thaliana] >gi|13877953|gb|AAK44054.1| putative RING zinc finger protein [Arabidopsis thaliana] >gi|4914367|gb|AAD32903.1| putative RING zinc finger protein
  misc_feature: GI Number: 50916178; NR Description: RING zinc finger protein-like [Oryza sativa (japonica cultivar-group)] >gi|48716403|dbj|BAD23012.1| RING zinc finger protein-like [Oryza
ACTAGCTTCCAGCGCACACTTGTCACCTTCCTCCCCGCAACGCATCCAGCTACCCCGTCTCACTCCCGACCCATCCCACCAGCACCAGGACAGACACGGACAGGACGATGGAGTCACCCATGGCGGCCCGGAGGCTCCTGCAGGAGGCGGCGGGCCTGTCCACGCCGGGCGCCCGGATCATCGCCGACGACAGGGACATCGTCATCATCCTCGCCTCGCTGCTCTGCGCGCTCATCACCGTCCTCGGCATCGGCCTCGTCGCCCGCTGGTGCGCGTGCGGCGGCGCGGAAGCCAGGGCGCGCGCCGCCGCCAACCGGGGCGTCAAGAAGTCGGTGCTCCGCGCCATCCCCACCGTCGCCTACGTCTCCGCCGACGCCGGCAAGGGCAAGGGCAAGGAGGCAGAGGAGGCCGCCGCGGCGCCGGAGTGCGCCATCTGCCTCGCCGAGTTCGAGGACGGCGAGGCCATGCGCGTGCTGCCCCAGTGCGGCCACGCCTTCCACGCCGCCTGCGTCGACAAGTGGCTGCGCGGCCACTCTTCTTGCCCCTCCTGCCGCCGGATCCTCGCCGTCCAGCTGCCGGCTGCCCAGCGGTGCCAGCGCTGCGGCGCGCGCCCCGACCCAGCCGTGGCGACCTGGAAGCCTCCGGCCCAGTACGGCGAGATGCCGCCCTTCTTGCCGTAGCGGCTCGCGCGCGCGCTCGATCTCCACAGATCTGGGCGAGAGCTAGAAGACGACTAGTAGCAGAGGAACCAGTCAACCAATCGATGAGCCTTCTGTTTGGTCAAATATCTCGGCTGCTTCTCTTAATTACCTTCCTTTGTTTATCTCATCATCAGTAGCAGTTCTTCTTACCGCCGAGCTGGAAATGCATAGCATTTCTGAATTTAGGACCCTGGTATGCAGGTGGGTGGTGATCAAGGTGTTGCCACTACATCTTAGCAGCTTTGTACATTTGTAAATAGTAACTATAATTACTCCTAAGGAGTAATCGGCATCATCGATTAGGCTTATCTGAAACTGTGAATACCTTTGCTTTCCATGAATCCATTTGGTCAATTCTGAAAAAAAAAAAAAAAA

SEQ ID NO: 3981 - DNA, 1245 bp, Glycine max
  misc_feature (1)..(1245): Ceres cDNA ID no. 21666016
  misc_feature (1)..(1245): Ceres CLONE  ID no. 1051068
  misc_feature (1)..(1245): Also known as  Ceres CDNA ID no. 24360042
gaccagcagcccgtctcgccctgcccgtctctgtctccccgctcccgtcgccgccgggtccaaaccagaggagccgcgcccgtggaaacctagggttccgccctccccgccctcggaaggtttggagaagagctgtttatccagcaacatgaggccaattttctgtgggaaccttgactatgatgcccgccagtctgaaatcgagcgtcttttcggcaaatatggaagagtggagcgagttgacatgaagacaggatttgcgttcgtctacatggaagatgaacgtgatgctgaagatgctatccatagacttgacagaactgactttggtagaaaagggaggagactgagagtcgaatggacaaaggaggatcgcagtggtggtcggaaaggaaatgggaagcgatctccaagcagcgtgaaaccaaccaaaaccttgtttgtgatcaactttgatccaatcaacacaaggacaagagatttggagaagcactttgatctgtatggcaagattgcaaatatcagaatcagaaggaactttgcatttgtccagtatgaaacacaggaagatgctactaaagctctggacggtactaatggaagcactgtgatggacagggtcatctctgttgagtatgcacttcgtgacgacgatgaaaaaaggaacgggtacagtccagacaggagaggaggaggccgtgatagatctccggacagaagggacaaccgtggtaggtccgcaagtccttatggcagagggcgggaaaggggcagcccagactatggcaggggcagggagaggggcagcccggactatggcaaaggtggtgccagagatagtcctgactatgtccgtggtggaagcccatacggcagcaaaggggatgacagggctagccccaagtatgaccgtgaacgccgtgaagccagtcctgcctatgacaggcgccgcagccgctcgcctgcaaggtcgcctgcaagggaagatagggactgaaactgtgcatggttgtgctcaacgccacctgcttcggaccaaatggctgcacctgtcattagtgtgatgctcactcaagttggttatgttaagtagccagaaacttctgtaatatctctattagctagctctagctgaatgctttgtcaatttggtttgaactgtgatgattgttagcttaaactttgtccaaacggattctttcagtgagaccatttgcggagcgatgagcaaaaaaaaaaaaaaaa

SEQ ID NO: 3982 - protein, 1245 aa, Glycine max
GACCAGCAGCCCGTCTCGCCCTGCCCGTCTCTGTCTCCCCGCTCCCGTCGCCGCCGGGTCCAAACCAGAGGAGCCGCGCCCGTGGAAACCTAGGGTTCCGCCCTCCCCGCCCTCGGAAGGTTTGGAGAAGAGCTGTTTATCCAGCAACATGAGGCCAATTTTCTGTGGGAACCTTGACTATGATGCCCGCCAGTCTGAAATCGAGCGTCTTTTCGGCAAATATGGAAGAGTGGAGCGAGTTGACATGAAGACAGGATTTGCGTTCGTCTACATGGAAGATGAACGTGATGCTGAAGATGCTATCCATAGACTTGACAGAACTGACTTTGGTAGAAAAGGGAGGAGACTGAGAGTCGAATGGACAAAGGAGGATCGCAGTGGTGGTCGGAAAGGAAATGGGAAGCGATCTCCAAGCAGCGTGAAACCAACCAAAACCTTGTTTGTGATCAACTTTGATCCAATCAACACAAGGACAAGAGATTTGGAGAAGCACTTTGATCTGTATGGCAAGATTGCAAATATCAGAATCAGAAGGAACTTTGCATTTGTCCAGTATGAAACACAGGAAGATGCTACTAAAGCTCTGGACGGTACTAATGGAAGCACTGTGATGGACAGGGTCATCTCTGTTGAGTATGCACTTCGTGACGACGATGAAAAAAGGAACGGGTACAGTCCAGACAGGAGAGGAGGAGGCCGTGATAGATCTCCGGACAGAAGGGACAACCGTGGTAGGTCCGCAAGTCCTTATGGCAGAGGGCGGGAAAGGGGCAGCCCAGACTATGGCAGGGGCAGGGAGAGGGGCAGCCCGGACTATGGCAAAGGTGGTGCCAGAGATAGTCCTGACTATGTCCGTGGTGGAAGCCCATACGGCAGCAAAGGGGATGACAGGGCTAGCCCCAAGTATGACCGTGAACGCCGTGAAGCCAGTCCTGCCTATGACAGGCGCCGCAGCCGCTCGCCTGCAAGGTCGCCTGCAAGGGAAGATAGGGACTGAAACTGTGCATGGTTGTGCTCAACGCCACCTGCTTCGGACCAAATGGCTGCACCTGTCATTAGTGTGATGCTCACTCAAGTTGGTTATGTTAAGTAGCCAGAAACTTCTGTAATATCTCTATTAGCTAGCTCTAGCTGAATGCTTTGTCAATTTGGTTTGAACTGTGATGATTGTTAGCTTAAACTTTGTCCAAACGGATTCTTTCAGTGAGACCATTTGCGGAGCGATGAGCAAAAAAAAAAAAAAAA

SEQ ID NO: 3983 - DNA, 981 bp, Triticum aestivum
  misc_feature (1)..(981): Ceres cDNA ID no. 21666017
  misc_feature (1)..(981): Ceres CLONE  ID no. 1052808
  misc_feature (1)..(981): Also known as  Ceres CDNA ID no. 24369508
ctcctccacctcccatccccatctcgctctcgcggccgagagatcgaatcggagaagaagaaggagcggagaggcctctgctgccctagctccgccgcccccgcaccagccatggcgctcgccgctcgcctcgtatcccgctcccgccagttatattctgtccaagctgctttggccaatggaggtctcactcaagtccgctcatttgccaaggaggcagctcctgtcagcggagacgacctattgaagggcatcttttttgaggtgaagaaaaagtttgagaccgcacttggggtccttaagaaggagaagatcacgattgacccagatgacccaacagcagttgctaactatgcccaagtcatgaggactgtaagagaaaaggccgatcttcttaacgattctcagagaattaaatatactattgagactttcacgaagggcatccctgatgcaaggacgtacttggatacccttcagcaactcaggaaaaagagtggacttatagatgatatgggtattgaggatatgatgatggaagctctcgagaaagttgagaaggacattaagaagcctcttctgaggagtgacaagaagaacatgaatctcctcttggcagagtttgacaagataaacaaaaagcttggcattcggaaggaggatcttcccaagattgaggaaaatcttgaaatggaacttgccaaagctgagctgacggaactcaagaaggaagttgttgaagcaatggagggtcaactaaagagggaggagtttaaagatgaggtgatgcctgacgtcaggaagttggacattagaaacttcctctaggtccctgattgatgatagccctcagggcgaccgatctgtgatttttcttttcaagtgacggcaggtgctgtaagccacaccgaatggatgttattgttgcttttttttgtaataaaactgcaccgaaaatatgacagtcaaaaaaaaaaaaaa

SEQ ID NO: 3984 - protein, 238 aa, Triticum aestivum
MALAARLVSRSRQLYSVQAALANGGLTQVRSFAKEAAPVSGDDLLKGIFFEVKKKFETALGVLKKEKITIDPDDPTAVANYAQVMRTVREKADLLNDSQRIKYTIETFTKGIPDARTYLDTLQQLRKKSGLIDDMGIEDMMMEALEKVEKDIKKPLLRSDKKNMNLLLAEFDKINKKLGIRKEDLPKIEENLEMELAKAELTELKKEVVEAMEGQLKREEFKDEVMPDVRKLDIRNFL

SEQ ID NO: 3985 - DNA, 1488 bp, Glycine max
  misc_feature (1)..(1488): Ceres cDNA ID no. 21666018
  misc_feature (1)..(1488): Ceres CLONE  ID no. 1057718
  misc_feature (1)..(1488): Also known as  Ceres CDNA ID no. 24360075
acttaaggcacgccgagtgttagctacagagagagagagagagagagggagagtgagggcagcggcaagtgcaagcatcaattaaggtcaggcagggcagagcgaggaagccgtaagcaagaagagatagttaagggtccaagagagggagacaagcagctcctttagtagatggcaatgaggtcgagggggctgcggctgcggtcgcggcggcagagcgtgcttgtcgccgcggccgtcgtcctcggcgtgttgctgctggcgacggcggcgccgcgcgcggcggcggcggggctgagccggaactactacgcgaagacgtgccccaacgtggagaccctggtccgcggcgccgtggcccagaagctgcaggagaccttcaacgccgcgcccggcaccctccgcctcttcttccacgactgcttcgtcagggggtgcgacgcttcggtgctcatctccgggccgggcgacgagcacagcgcgggcgcggacacgacgttgtcgccggacgcgctggacctcatcacccgcgccaaggccgccgtggacgccgtcgccggctgctccaacaaggtctcctgcgccgacatcctcgcgctcgccacccgcgacgtcgtccagcaggcgggagggccgttctacccggtggagctggggcggctggacggcaaggtggggacgcgcgccgtggtgaagcacagcctccccggcgccggcttctccctggaccagctcaacaagctcttcgccgccaacggcctcacccagaccgacatgatcgccctctcaggggggcacacgatcggggtgacgcactgcgacaagttcgtgcggcggctgtacacgttcaagggggcgcggccgcagtacagcccgccgatgaacctggccttcctgcggcagatgcgggggacgtgcccgctcaactacagccccaccacggtggccatgctggacgccgtcacgcccaacaagttcgacaacggctactaccagacgctgcagcagcagaagggcctgctgtcgtcggaccaggtgctcttcgccgaccgccgctcccgggccaccgtcaaccacttcgccgccaaccagaccgccttcttcgacgccttcgtcgccgccatggccaagctcggccgcatcggggtcaagaccgccggctccgacgccgagatccgccgggtctgcaccaaggtcaactaatgttgcttagctctagctgccgtggtagcatcacacgtacattcagtagagagggtaaatggatggatgggccaatcaatcaattctgtcatgtgtctctcctcttctccctgcccatgctcgccccatatgctcacacaagtcatattgtcatagccgatttgttcaagcccgattcttttcttcaccatgtaataaagcatataaatgccgtgggataggaggcacagttacatccatgtaaatgttacgattggtccagttaatcgaaaaaaaaaaaaaaaa

SEQ ID NO: 3986 - protein, 1488 aa, Glycine max
ACTTAAGGCACGCCGAGTGTTAGCTACAGAGAGAGAGAGAGAGAGAGGGAGAGTGAGGGCAGCGGCAAGTGCAAGCATCAATTAAGGTCAGGCAGGGCAGAGCGAGGAAGCCGTAAGCAAGAAGAGATAGTTAAGGGTCCAAGAGAGGGAGACAAGCAGCTCCTTTAGTAGATGGCAATGAGGTCGAGGGGGCTGCGGCTGCGGTCGCGGCGGCAGAGCGTGCTTGTCGCCGCGGCCGTCGTCCTCGGCGTGTTGCTGCTGGCGACGGCGGCGCCGCGCGCGGCGGCGGCGGGGCTGAGCCGGAACTACTACGCGAAGACGTGCCCCAACGTGGAGACCCTGGTCCGCGGCGCCGTGGCCCAGAAGCTGCAGGAGACCTTCAACGCCGCGCCCGGCACCCTCCGCCTCTTCTTCCACGACTGCTTCGTCAGGGGGTGCGACGCTTCGGTGCTCATCTCCGGGCCGGGCGACGAGCACAGCGCGGGCGCGGACACGACGTTGTCGCCGGACGCGCTGGACCTCATCACCCGCGCCAAGGCCGCCGTGGACGCCGTCGCCGGCTGCTCCAACAAGGTCTCCTGCGCCGACATCCTCGCGCTCGCCACCCGCGACGTCGTCCAGCAGGCGGGAGGGCCGTTCTACCCGGTGGAGCTGGGGCGGCTGGACGGCAAGGTGGGGACGCGCGCCGTGGTGAAGCACAGCCTCCCCGGCGCCGGCTTCTCCCTGGACCAGCTCAACAAGCTCTTCGCCGCCAACGGCCTCACCCAGACCGACATGATCGCCCTCTCAGGGGGGCACACGATCGGGGTGACGCACTGCGACAAGTTCGTGCGGCGGCTGTACACGTTCAAGGGGGCGCGGCCGCAGTACAGCCCGCCGATGAACCTGGCCTTCCTGCGGCAGATGCGGGGGACGTGCCCGCTCAACTACAGCCCCACCACGGTGGCCATGCTGGACGCCGTCACGCCCAACAAGTTCGACAACGGCTACTACCAGACGCTGCAGCAGCAGAAGGGCCTGCTGTCGTCGGACCAGGTGCTCTTCGCCGACCGCCGCTCCCGGGCCACCGTCAACCACTTCGCCGCCAACCAGACCGCCTTCTTCGACGCCTTCGTCGCCGCCATGGCCAAGCTCGGCCGCATCGGGGTCAAGACCGCCGGCTCCGACGCCGAGATCCGCCGGGTCTGCACCAAGGTCAACTAATGTTGCTTAGCTCTAGCTGCCGTGGTAGCATCACACGTACATTCAGTAGAGAGGGTAAATGGATGGATGGGCCAATCAATCAATTCTGTCATGTGTCTCTCCTCTTCTCCCTGCCCATGCTCGCCCCATATGCTCACACAAGTCATATTGTCATAGCCGATTTGTTCAAGCCCGATTCTTTTCTTCACCATGTAATAAAGCATATAAATGCCGTGGGATAGGAGGCACAGTTACATCCATGTAAATGTTACGATTGGTCCAGTTAATCGAAAAAAAAAAAAAAAA

SEQ ID NO: 3987 - DNA, 929 bp, Glycine max
  misc_feature (1)..(929): Ceres cDNA ID no. 21666019
  misc_feature (1)..(929): Ceres CLONE  ID no. 1058205
  misc_feature (1)..(929): Also known as  Ceres CDNA ID no. 25891895
atctataaactatccctctctttttccactaatcaactgggtacatttgtgtatttgcattccgttcatggctgttctgtttctctatcttctcagtctcctcatggctggccattgtagtgccacatggtgtgtgtgcaaaacagggctgagtgactcagtgctacaaaggacactagactacgcatgtggaaatggagctgactgtaacccaactcacccaaaagggtcttgcttcaaccctgacaatgttagagctcattgtagctatgctgtcaatagcttctttcagaagaagagtcaagcttctgagtcttgtaatttcactggtaccgccactcctacaacccaggatcccagctattcaggatgtccattcccttctagcgttagtgtcactggaggtggtggcagcaccactggaggtggtggcagcaccactggaggtggtggcagcaccactggaggtggtggcagcaccactggaggtggtagcagcagcaccgtgacgccaggcaaaagcagtccaaaaggaaacagccctatcacaacatttcccggcggaaacagtccatacactggcagtccattcactggcacaccaaccactggactgctaggaggcaatatcactgatgctaccggaaccgggttaaaccccgattactcaaacgaaaacagcggtttcgtgctccgtaattccaacacttggttcctctgcttgtgttctgtcttgatgatgatctgaagatgatgaatggacttcctctctagtttactatccaaatatgctatgttcttgttttattttggacttctgtacgttcttatcaattttaaggaaaacaattaacaatgtaaaactgaatcgtttcgggacgaatttggtttctatttaatatctttaaatcttaaaaaaaaaaaaaaaa

SEQ ID NO: 3988 - protein, 929 aa, Glycine max
ATCTATAAACTATCCCTCTCTTTTTCCACTAATCAACTGGGTACATTTGTGTATTTGCATTCCGTTCATGGCTGTTCTGTTTCTCTATCTTCTCAGTCTCCTCATGGCTGGCCATTGTAGTGCCACATGGTGTGTGTGCAAAACAGGGCTGAGTGACTCAGTGCTACAAAGGACACTAGACTACGCATGTGGAAATGGAGCTGACTGTAACCCAACTCACCCAAAAGGGTCTTGCTTCAACCCTGACAATGTTAGAGCTCATTGTAGCTATGCTGTCAATAGCTTCTTTCAGAAGAAGAGTCAAGCTTCTGAGTCTTGTAATTTCACTGGTACCGCCACTCCTACAACCCAGGATCCCAGCTATTCAGGATGTCCATTCCCTTCTAGCGTTAGTGTCACTGGAGGTGGTGGCAGCACCACTGGAGGTGGTGGCAGCACCACTGGAGGTGGTGGCAGCACCACTGGAGGTGGTGGCAGCACCACTGGAGGTGGTAGCAGCAGCACCGTGACGCCAGGCAAAAGCAGTCCAAAAGGAAACAGCCCTATCACAACATTTCCCGGCGGAAACAGTCCATACACTGGCAGTCCATTCACTGGCACACCAACCACTGGACTGCTAGGAGGCAATATCACTGATGCTACCGGAACCGGGTTAAACCCCGATTACTCAAACGAAAACAGCGGTTTCGTGCTCCGTAATTCCAACACTTGGTTCCTCTGCTTGTGTTCTGTCTTGATGATGATCTGAAGATGATGAATGGACTTCCTCTCTAGTTTACTATCCAAATATGCTATGTTCTTGTTTTATTTTGGACTTCTGTACGTTCTTATCAATTTTAAGGAAAACAATTAACAATGTAAAACTGAATCGTTTCGGGACGAATTTGGTTTCTATTTAATATCTTTAAATCTTAAAAAAAAAAAAAAAA

SEQ ID NO: 3989 - DNA, 1632 bp, Glycine max
  misc_feature (1)..(1632): Ceres cDNA ID no. 21666020
  misc_feature (1)..(1632): Ceres CLONE  ID no. 1058597
  misc_feature (1)..(1632): Also known as  Ceres CDNA ID no. 24356350
atctatctcctctccactccaccaccgcttctccccgtcccgcggccgctccctctcctccctccctccggagaccggcccgccaccacggctcgcgcagccagagataagatgaggacgaggagcggctctctctatacctgcggaggtgttgtcgagccagcggctcccgtggccggccagaagaggaagcgctcgcccgccgccgccggcgaagtgtctggtgggcgccggaagcgccaggcttcggggccggactatttggatggcatccctgacgacctcgtgctctccatcttctccaaactcgccgcatctgcgaactcaccgtccgacctgctgtccgtccacctaacgtgcaagaggctgaacggcctgggacagcaggacatggtgttcgccaaggcctcgccggcgtcgctcgccgtcaaggcggcggcgtggtcggagcccgtgcagcggtttctcaagcgctgcgccgacgccggcaacctcgaggcttgctacattctaggcatgatccggttctactgccttggcagccggagcggtggagcggctctgctcgcgaaggcggcggtcggcgggcacccggcggcgctctactcgctggccgtcatccaattcaacgggagcggtggtgccaagtcggaccgcgacctccgcgccggggcggcgctctgtgcgcgctccgccgcgctgggccacgtcgacgcgctccgcgagctcgggcactgcctccaggacggctacggcgtgcgccgcgacccggccgagggacgccgcctcctcgtcgccgcgaacgcccgcgagctctccctcgcgctctccgccgcggcggccagcgcgacctaccccttcgcctccctccccatcggcgccgtcgcaggcggcgccgggggcgtcaccagctctcctctcctctccgacttcgggtggagcctgccggaggcggagccccacacggcgaaccagttcatgtcggactggtgggcgtcgcgtggcgtgcaggcatgcgccaagaagaccgacgcggcggccaccggcggagacggcgagggcgagctccggctgtgctctcacatgcggtgcgggcgcaaggagacgcggcggcacgagttccggcgctgctcggtgtgcggcgcggccaactactgctcccgtgcgtgccaggccctggactggaagcgcgcccacaaggcccagtgcgtgcccatggaccgctggctcgtcggcgccgccgccgccgccccccagcagtgacccgccccaacgggcaaccgccgcggcaacggcaacaagtagcagcaccggcgagtccatggcgcggccggtggaccgggcgtagcggagtgaacggcggtgatgaatgaggaagcgtttttctggcgttttgctttctttttgcggccgttgggtgtcgtcttgtcagatgtacgtactctactctactagggaagaggagcagacgagagattctaccgcggccaccaaaactctagccttgttttcttaattagtccctattttctttttttagggggaaattagtccctctttctttaaattaaattaagttactccgtaatatgaaaatcctggatccctctttgaacaaaaaaaaaaaaaaaa

SEQ ID NO: 3990 - protein, 1632 aa, Glycine max
ATCTATCTCCTCTCCACTCCACCACCGCTTCTCCCCGTCCCGCGGCCGCTCCCTCTCCTCCCTCCCTCCGGAGACCGGCCCGCCACCACGGCTCGCGCAGCCAGAGATAAGATGAGGACGAGGAGCGGCTCTCTCTATACCTGCGGAGGTGTTGTCGAGCCAGCGGCTCCCGTGGCCGGCCAGAAGAGGAAGCGCTCGCCCGCCGCCGCCGGCGAAGTGTCTGGTGGGCGCCGGAAGCGCCAGGCTTCGGGGCCGGACTATTTGGATGGCATCCCTGACGACCTCGTGCTCTCCATCTTCTCCAAACTCGCCGCATCTGCGAACTCACCGTCCGACCTGCTGTCCGTCCACCTAACGTGCAAGAGGCTGAACGGCCTGGGACAGCAGGACATGGTGTTCGCCAAGGCCTCGCCGGCGTCGCTCGCCGTCAAGGCGGCGGCGTGGTCGGAGCCCGTGCAGCGGTTTCTCAAGCGCTGCGCCGACGCCGGCAACCTCGAGGCTTGCTACATTCTAGGCATGATCCGGTTCTACTGCCTTGGCAGCCGGAGCGGTGGAGCGGCTCTGCTCGCGAAGGCGGCGGTCGGCGGGCACCCGGCGGCGCTCTACTCGCTGGCCGTCATCCAATTCAACGGGAGCGGTGGTGCCAAGTCGGACCGCGACCTCCGCGCCGGGGCGGCGCTCTGTGCGCGCTCCGCCGCGCTGGGCCACGTCGACGCGCTCCGCGAGCTCGGGCACTGCCTCCAGGACGGCTACGGCGTGCGCCGCGACCCGGCCGAGGGACGCCGCCTCCTCGTCGCCGCGAACGCCCGCGAGCTCTCCCTCGCGCTCTCCGCCGCGGCGGCCAGCGCGACCTACCCCTTCGCCTCCCTCCCCATCGGCGCCGTCGCAGGCGGCGCCGGGGGCGTCACCAGCTCTCCTCTCCTCTCCGACTTCGGGTGGAGCCTGCCGGAGGCGGAGCCCCACACGGCGAACCAGTTCATGTCGGACTGGTGGGCGTCGCGTGGCGTGCAGGCATGCGCCAAGAAGACCGACGCGGCGGCCACCGGCGGAGACGGCGAGGGCGAGCTCCGGCTGTGCTCTCACATGCGGTGCGGGCGCAAGGAGACGCGGCGGCACGAGTTCCGGCGCTGCTCGGTGTGCGGCGCGGCCAACTACTGCTCCCGTGCGTGCCAGGCCCTGGACTGGAAGCGCGCCCACAAGGCCCAGTGCGTGCCCATGGACCGCTGGCTCGTCGGCGCCGCCGCCGCCGCCCCCCAGCAGTGACCCGCCCCAACGGGCAACCGCCGCGGCAACGGCAACAAGTAGCAGCACCGGCGAGTCCATGGCGCGGCCGGTGGACCGGGCGTAGCGGAGTGAACGGCGGTGATGAATGAGGAAGCGTTTTTCTGGCGTTTTGCTTTCTTTTTGCGGCCGTTGGGTGTCGTCTTGTCAGATGTACGTACTCTACTCTACTAGGGAAGAGGAGCAGACGAGAGATTCTACCGCGGCCACCAAAACTCTAGCCTTGTTTTCTTAATTAGTCCCTATTTTCTTTTTTTAGGGGGAAATTAGTCCCTCTTTCTTTAAATTAAATTAAGTTACTCCGTAATATGAAAATCCTGGATCCCTCTTTGAACAAAAAAAAAAAAAAAA

SEQ ID NO: 3991 - DNA, 1387 bp, Glycine max
  misc_feature (1)..(1387): Ceres cDNA ID no. 21666021
  misc_feature (1)..(1387): Ceres CLONE  ID no. 1058744
  misc_feature (1)..(1387): Also known as  Ceres CDNA ID no. 24360055
actaccgtccgcgcgaagcgagacaaggcggcggcgaagagagccacccctcctcaggggatggccaccacggctgcgccggagggcgtcgcgcagccaccttccgctgccaaggggcccaaaggagaggcggagagaaaacagagcgacgcacagggaagaggaggaaacggcggtggtggtggtggcggcggcggcggtggtgcaggtggtgggggcggaggtagagggaagaagcggaagaacaagggaggtgccttcatctacggaaactacaggaactactacggctaccgaattgatcgtaacgttggtgaagatccccgccttgagatattcaagaaggagtggtttgcaggcaaggattgtctcgatattggatgcaaccaaggtttggtcacaatcggtatagcgacgaagtttgaatgtcgaagcatccttggagttgacatcgataaaggtttgattgaccttgctaactggaatttaagaaggatatctcgaacaggcaatgtggctccagaaagtgccaaggtccataactcgtcagactccacagctcagagctgtccagaagaagtggtatctgaaatgccaaatggaaatatttctaaggacgaacaacctgatctttttgaaattgtctcttttcggtctgaaaattttgtacagagcaaacacaaatatgcagaacagtatgacaccatcatgtgtttgagcgtgacaaaatggatccacctgaactggggtgatgatggcataatcactttgtttgtgaagatatggagtcttctaagaccgggagggatttttatcatggagcctcaaccttggacctcgtataggaaaaacagattagtgtcagagtttgccaaagaaaacttcaaatatatctgtatataccctgagaaattccgggaggtacttcttgataaggtaggattcaggtcagcagaggtgattaccaacagattggtcggatccgtcgctggttttgaccgcccaattgaagtttactacaaatgatggaatgagattaacgcctgcctcttgctcagaggctcatctgttgcttcgggcgcataagtttggtgctgcgggattcgtcaagcttcaccggtgctttctttggtacaaatatgatgatcaaggttttcacataactctggattagcaatttgtggaagtgtcattttcaacaagcgcccaaggaatggtatggatagggtggtggtggtattgccttcactaggtggttttcgatactttgccagagtttaagcgtctgtatagatgaatgttagatgccagagaaaaccttccagtgatttcgcttcctatgaacaggctagttttctcgcgctcttacagaaaaaaaaaaaaaaaa

SEQ ID NO: 3992 - protein, 1387 aa, Glycine max
  misc_feature: PFam Name: S10_plectin; PFam Description: Plectin/S10 domain
  misc_feature: GI Number: 21281207; NR Description: putative ribosomal protein S10 [Arabidopsis thaliana] >gi|14334536|gb|AAK59676.1| putative ribosomal protein S10 [Arabidopsis thaliana] >gi|4539292|emb|CAB39595.1| putative ribosomal protein S10
  misc_feature: GI Number: 34905824; NR Description: putative ribosomal protein S10 [Oryza sativa (japonica cultivar-group)] >gi|15289927|dbj|BAB63622.1| putative ribosomal protein S10 [Oryza
  misc_feature: GI Number: 40642980; NR Description: ribosomal protein S10
  misc_feature: GI Number: 50344474; NR Description: S10e ribosomal protein
ACTACCGTCCGCGCGAAGCGAGACAAGGCGGCGGCGAAGAGAGCCACCCCTCCTCAGGGGATGGCCACCACGGCTGCGCCGGAGGGCGTCGCGCAGCCACCTTCCGCTGCCAAGGGGCCCAAAGGAGAGGCGGAGAGAAAACAGAGCGACGCACAGGGAAGAGGAGGAAACGGCGGTGGTGGTGGTGGCGGCGGCGGCGGTGGTGCAGGTGGTGGGGGCGGAGGTAGAGGGAAGAAGCGGAAGAACAAGGGAGGTGCCTTCATCTACGGAAACTACAGGAACTACTACGGCTACCGAATTGATCGTAACGTTGGTGAAGATCCCCGCCTTGAGATATTCAAGAAGGAGTGGTTTGCAGGCAAGGATTGTCTCGATATTGGATGCAACCAAGGTTTGGTCACAATCGGTATAGCGACGAAGTTTGAATGTCGAAGCATCCTTGGAGTTGACATCGATAAAGGTTTGATTGACCTTGCTAACTGGAATTTAAGAAGGATATCTCGAACAGGCAATGTGGCTCCAGAAAGTGCCAAGGTCCATAACTCGTCAGACTCCACAGCTCAGAGCTGTCCAGAAGAAGTGGTATCTGAAATGCCAAATGGAAATATTTCTAAGGACGAACAACCTGATCTTTTTGAAATTGTCTCTTTTCGGTCTGAAAATTTTGTACAGAGCAAACACAAATATGCAGAACAGTATGACACCATCATGTGTTTGAGCGTGACAAAATGGATCCACCTGAACTGGGGTGATGATGGCATAATCACTTTGTTTGTGAAGATATGGAGTCTTCTAAGACCGGGAGGGATTTTTATCATGGAGCCTCAACCTTGGACCTCGTATAGGAAAAACAGATTAGTGTCAGAGTTTGCCAAAGAAAACTTCAAATATATCTGTATATACCCTGAGAAATTCCGGGAGGTACTTCTTGATAAGGTAGGATTCAGGTCAGCAGAGGTGATTACCAACAGATTGGTCGGATCCGTCGCTGGTTTTGACCGCCCAATTGAAGTTTACTACAAATGATGGAATGAGATTAACGCCTGCCTCTTGCTCAGAGGCTCATCTGTTGCTTCGGGCGCATAAGTTTGGTGCTGCGGGATTCGTCAAGCTTCACCGGTGCTTTCTTTGGTACAAATATGATGATCAAGGTTTTCACATAACTCTGGATTAGCAATTTGTGGAAGTGTCATTTTCAACAAGCGCCCAAGGAATGGTATGGATAGGGTGGTGGTGGTATTGCCTTCACTAGGTGGTTTTCGATACTTTGCCAGAGTTTAAGCGTCTGTATAGATGAATGTTAGATGCCAGAGAAAACCTTCCAGTGATTTCGCTTCCTATGAACAGGCTAGTTTTCTCGCGCTCTTACAGAAAAAAAAAAAAAAAA

SEQ ID NO: 3993 - DNA, 764 bp, Zea mays
  misc_feature (1)..(764): Ceres cDNA ID no. 21666022
  misc_feature (1)..(764): Ceres CLONE  ID no. 1061280
  misc_feature (1)..(764): Also known as  Ceres CDNA ID no. 24365033
atttttctgaatagctaggcctgacttaagtgtgggcctgactgcctactttattttttatttttgaaatacttttgttttttagtatcttcggaaaatttcgaaatttaaaatcggtaaattccgattaaattcggtaatcgaaggaaacggtcggtaaaaggctgtaccgatttcgataccgattccggtataaaattccgataaccgatttcgattccgaaaaataccgttattgttgaatctggtcggaaaaaatcgaaaacggtatccgaaaaaccgaaaaattccgaaaccgttttcaaccctaggtggaagactcctccaactctgaggagtggagcagcggcaaaagcaacggcgacgaggacgacggcagcggcaacaacgacgacggcaagggcggcggcgatggtgacggcgaagatggcgagggtgatggcgacggagatagcaagggcgacgacgacgacagtagcaagggcgacggcaagggcgatgacagcagcaagggcgatggcggcgagggcgacggcggcgacggcatggccagcgacataacgccgttggtgtaaatattagtataggtaacaatagtagtagtagtagaataaggtagtgttagttagtatcgtagtgtagtgtgagtagcagtgtagtgtactgtgatgtaatgacccaggggtgacgaggccgactcaagatgagttggtctcaagtttgtaatgatctccccttatgaatgaagacaaaaaaaaaaaaaa

SEQ ID NO: 3994 - protein, 49 aa, Zea mays
  misc_feature: PFam Name: S-antigen; PFam Description: S-antigen protein
  misc_feature: PFam Name: XAP5; PFam Description: XAP5 protein
  misc_feature: PFam Name: TT_ORF1; PFam Description: TT viral orf 1
  misc_feature: PFam Name: Protamine_P1; PFam Description: Protamine P1
  misc_feature: PFam Name: Collagen; PFam Description: Collagen triple helix
  misc_feature: GI Number: 66768426; NR Description: adsorption protein [Xanthomonas campestris pv. campestris str. 8004] >gi|66573758|gb|AAY49168.1| adsorption protein [Xanthomonas
  misc_feature: GI Number: 21231518; NR Description: adsorption protein [Xanthomonas campestris pv. campestris str. ATCC 33913] >gi|21231511|ref|NP_637428.1| adsorption protein [Xanthomonas campestris pv. campestris str. ATCC 33913]
  misc_feature: GI Number: 13359195; NR Description: KIAA1661 protein [Homo
  misc_feature: GI Number: 1173628; NR Description: glycine-rich protein
  misc_feature: GI Number: 66768433; NR Description: adsorption protein [Xanthomonas campestris pv. campestris str. 8004] >gi|66573765|gb|AAY49175.1| adsorption protein [Xanthomonas
MVTAKMARVMATEIARATTTTVARATARAMTAARAMAARATAATAWPAT

SEQ ID NO: 3995 - DNA, 1703 bp, Zea mays
  misc_feature (1)..(1703): Ceres cDNA ID no. 21666024
  misc_feature (1)..(1703): Ceres CLONE  ID no. 1062527
  misc_feature (1)..(1703): Also known as  Ceres CDNA ID no. 24358404
attactaccggttaacatttctaaggcaaccccacgaaacttcgttccatctctgcgagatctgccgtgcttctccccttgctccccgtaccgactcccggttcttttctccggttcctcggcgatggtcgtctgcaaatgccgcaaggcgacgagggtttattgcttcgtccaccaggttccggtctgtggcgagtgcatctgcttcccagaacatcaattatgcgtggtaaaaaactatgctgaatgggttgttaattctgattatgactggccacaacactgttctttgtgtaatttggttctagaagctgcaagtgaagaaactacacgattgggttgcctccatgtgatgcacacaaaatgcttgatatcacatgtccaaagttttcctgcacaaacagcaccagcaggatttgtctgcccctcatgttcaattcctatatggcctccttcgagtattaaagatacaggctccagcctccatgctaaactgaaggaagcagtagtccagactggtctggagaagaatgtatttgggaatcattttgtgacaatgcctaaagctgatgcctgcacaccccctacatttgcttcagacccccttaagcgtctatcatattctggtgaatctactgatgcaaacatgcttaactcttcgaaagatgcaactttatcatcagcagtactctcccagggggatacatatcctgctgggatgtactcttctgggactcttagccatgtggaaccagaaatagttgaaatagatggtcctagtaccatagcaacaaagttcccagagcaggagcccaatttcatcagaagtccaagcccgcacgggcctagtgccacgacaagaaaaggtgctaactatgttgagagacaaaattcagagatgtcttattatgctgatgatgaagatgcaaaccgcaaaaagtacactaaaaggggtacataccgtcacaaatttttaaggatgctgctacctttttggtctagtgccctgccaacattaccagttacagcaccccctaaaaaggaaaatgatgctccagaaggccggtcacgacatcagaggacgtcacgaatcgatcccacaaagatcttacttgcaatggcaatcatggcatgtatagcaacgatgggaattctctactaccggttgtcgcagcgcagtctttctgaaaactttgcccatgatgaggctcagtagtagagttgaaacttccaacttgcagtttgtttctggtactgccttgctgctgattcaagggttttaccctgcctgtattattttccatttccccctttttgggcctttcagggtggttgtggatgggaaggtggaggtagtgattatagttacataagagttatagcagactggttttatatgctgattcatctgttatcttataccagacgggaaattgttgaagttgtcaactattttcttattcctgttgtcgcgccttctgaactgctacaggtgttactttgatcgagccattctaaaacatcgctgtgttatttctccagtatttttcacttgtcacgatgatgctgggaaattataggcgtcttatgcacaacatggcaggagatcatgatattcttttagtttgcaaacgcagatgctgattaatttcagcaggaataaaagtgcaacaattatatatgacacaaaaaaaaaaaaaaaa

SEQ ID NO: 3996 - protein, 363 aa, Zea mays
  misc_feature: PFam Name: Fer2; PFam Description: 2Fe-2S iron-sulfur
  misc_feature: GI Number: 50919949; NR Description: putative ferredoxin [Oryza sativa (japonica cultivar-group)] >gi|40714664|gb|AAR88570.1| putative ferredoxin [Oryza sativa
  misc_feature: GI Number: 1360725; NR Description: non-photosynthetic ferredoxin [Citrus sinensis] >gi|2129915|pir||S62722 ferredoxin
  misc_feature: GI Number: 19569591; NR Description: ferredoxin precursor
MVVCKCRKATRVYCFVHQVPVCGECICFPEHQLCVVKNYAEWVVNSDYDWPQHCSLCNLVLEAASEETTRLGCLHVMHTKCLISHVQSFPAQTAPAGFVCPSCSIPIWPPSSIKDTGSSLHAKLKEAVVQTGLEKNVFGNHFVTMPKADACTPPTFASDPLKRLSYSGESTDANMLNSSKDATLSSAVLSQGDTYPAGMYSSGTLSHVEPEIVEIDGPSTIATKFPEQEPNFIRSPSPHGPSATTRKGANYVERQNSEMSYYADDEDANRKKYTKRGTYRHKFLRMLLPFWSSALPTLPVTAPPKKENDAPEGRSRHQRTSRIDPTKILLAMAIMACIATMGILYYRLSQRSLSENFAHDEAQ

SEQ ID NO: 3997 - DNA, 1257 bp, Zea mays
  misc_feature (1)..(1257): Ceres cDNA ID no. 21666025
  misc_feature (1)..(1257): Ceres CLONE  ID no. 1064953
  misc_feature (1)..(1257): Also known as  Ceres CDNA ID no. 24358400
gtgtcgctcgcatctccgcacgcaccgccgtcgccgcccgtgctcccttctcccccctcccccccgccgacggctatctgttactccggtcatctcgccccgccgaggaaggaagggcatggctctgcgagcggccgccgcgaggctggcgtcctccagcctccgccgccgccacggccacctcctgccggcggccgccagcgccagccacacggccttcctccactcccacgccaccagcttcggattcaagcaggtgcgcgaggacgagaagagcaagctggtcggcaacgtgttcagcagcgtcgcctccagctacgacgtcatgaacgacctcatgagcgctgggctgcaccggctctggaaggacaggctgatctcaaagctgaatccttttcctgggatgaagcacctcgacgtggccggtgggacaggggatgttgcgttccgtgtagtcgaaagaattaagagtgtgagccacagagctacgcagggtactcttactgatatggaagaagacactcacatttatgtttgtgacattaatccaaatatgctagaagttggaaagaagcgcgctgctgaaaaaggctacaatgaagagcagtgccttagttgggtacagggagatgcagaagctctttcttttgaggatgggtctatggatggctatactattgcattcgggatcagaaatgttacacacattgagaaagctctatcggaagcttacagagttctaaagaaaggaggaaggttcctatgcttggagttgagtcatgtagatgttccagtttttaaagacatttacgacatctattcattttctatgattccggctgtgggagagctagttgctggtgataggcagtcgtaccaatacttggtcgagagcattcgtcggtttccaaaacaggaaaagtttgctcagatgatccaggaagctggatttgaggcggtcgaatatgaaaatctggtgggcggtgtagttgccattcactctggagtgaaactgtagtgtatgtcaaatagcagcacggccgacagacgcttccgtgggcgatggtggatctgaatcaggcatttggggctaacaatttaccattttctttgtttaaaaaaatcatgtaactattattcctgtttatgtaattcaaaataaggacagacaatgatctggagaaaggtcttgttttttttcacaatttggtctctactatatatatatagtttgtgcaagtaaaaaaaaaaaaaaaa

SEQ ID NO: 3998 - protein, 299 aa, Zea mays
  misc_feature: PFam Name: Aminotran_3; PFam Description: Aminotransferase
  misc_feature: GI Number: 21243053; NR Description: pseudouridylate synthase [Xanthomonas axonopodis pv. citri str. 306] >gi|21108565|gb|AAM37171.1| pseudouridylate synthase [Xanthomonas axonopodis pv. citri str. 306] >gi|34098587|sp|Q8PK58|RLUB_XANAC
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 53749146; NR Description: At2g28670 [Arabidopsis thaliana] >gi|4580390|gb|AAD24368.1| putative disease resistance response protein [Arabidopsis thaliana] >gi|27754517|gb|AAO22706.1| putative fibroin protein [Arabidopsis
MALRAAAARLASSSLRRRHGHLLPAAASASHTAFLHSHATSFGFKQVREDEKSKLVGNVFSSVASSYDVMNDLMSAGLHRLWKDRLISKLNPFPGMKHLDVAGGTGDVAFRVVERIKSVSHRATQGTLTDMEEDTHIYVCDINPNMLEVGKKRAAEKGYNEEQCLSWVQGDAEALSFEDGSMDGYTIAFGIRNVTHIEKALSEAYRVLKKGGRFLCLELSHVDVPVFKDIYDIYSFSMIPAVGELVAGDRQSYQYLVESIRRFPKQEKFAQMIQEAGFEAVEYENLVGGVVAIHSGVKL

SEQ ID NO: 3999 - DNA, 877 bp, Glycine max
  misc_feature (1)..(877): Ceres cDNA ID no. 21666026
  misc_feature (1)..(877): Ceres CLONE  ID no. 1066503
  misc_feature (1)..(877): Also known as  Ceres CDNA ID no. 23473126
gacacaagtaacttctctgcatccaaaatgccaggtcttaccatcggagacactattcctgatcttcaagttgaaactaaccaaggcaaaatcaagcttcatcagttctgtgctgatggctggaccatccttttctctcacccaggtgatttcaccccggtttgtaccactgagcttggtaagatggctcagtatgctaaggagttttatcaacgaggagtgaagctcttaggtttatcttgtgatgatgtgcaatcccacaatgagtggatcaaagacattgaagcctacactccaggtgcgaaagtgaattatccaataattgctgatccgaagagagaaatcatcaagcaactcaacatggttgaccctgatgagaaagactccactggcaacctaccctcaagggctcttcatattgttggcccagatttgaagatcaagctgagttttctgtaccctgccactactgggaggaacatggatgaagtgctgagggtgatagagtcattgcagaaggcctcaaagttcaaggttgctaccccagcaaactggaagccaggggaccctgttgtcattacccctgatgtcaccaatgagcaagccaaggaaatgttccctcaagggttcgagagtgtgaaactccatcaaagaaggaatatttgcgcttaactaaagtttgatgatgttctgcttcaagtagtagaaccttcttcagctgtgccaaatctcaatgcaatctagtcatctatctaccctaatcaaactatatatatgttttgtttaagtacactattttgtggcactgcttttgttattataagaaagaatgtacagtttaattgatcttttgttgactgcaaaaaaaaaaaaaaaa

SEQ ID NO: 4000 - protein, 214 aa, Glycine max
  misc_feature: PFam Name: AhpC-TSA; PFam Description: AhpC/TSA family
  misc_feature: GI Number: 49618728; NR Description: 1-cys peroxiredoxin
  misc_feature: GI Number: 19423862; NR Description: 1-cys peroxiredoxin
  misc_feature: GI Number: 6466096; NR Description: 1-Cys peroxiredoxin
  misc_feature: GI Number: 1694833; NR Description: peroxiredoxin [Hordeum vulgare subsp. vulgare] >gi|471321|emb|CAA54066.1| HvB15C [Hordeum vulgare subsp. vulgare] >gi|2130029|pir||S60285 B15C protein - barley >gi|1710077|sp|P52572|REHY_HORVU Peroxiredoxin
  misc_feature: GI Number: 34539782; NR Description: 1-Cys-peroxiredoxine
MPGLTIGDTIPDLQVETNQGKIKLHQFCADGWTILFSHPGDFTPVCTTELGKMAQYAKEFYQRGVKLLGLSCDDVQSHNEWIKDIEAYTPGAKVNYPIIADPKREIIKQLNMVDPDEKDSTGNLPSRALHIVGPDLKIKLSFLYPATTGRNMDEVLRVIESLQKASKFKVATPANWKPGDPVVITPDVTNEQAKEMFPQGFESVKLHQRRNICA

SEQ ID NO: 4001 - DNA, 944 bp, Glycine max
  misc_feature (1)..(944): Ceres cDNA ID no. 21666027
  misc_feature (1)..(944): Ceres CLONE  ID no. 1073290
  misc_feature (1)..(944): Also known as  Ceres CDNA ID no. 24360164
ccgtgtttggttctttaacaatcctcccggcgatcctgagaagagagaaagagcgtaagcaaagagagaatgaaccgtacagcctttctgttcctcgtcttctttatcgggacgcaagtacatgcgcagctagtaccaccggcgaggctcgatggtttcgtatacccaccgggtcgtcgcgttgacccggatactatactaatcgaggcgttttttgacccggtttgcccggatagtagagacgcttggccgcctctgaagcaagtttttcaacgctacggatctcgcgttgcccttctccttcacctccttcctttaccgtaccatgacaatgcatatgtgagctctagggctttacacattgtgaatgctttgaacgcaaacgctaccttctgtttgctggaagccttctttgagcatcaggcattgttctacaacgcccaaacgcaactcctgtcaagacctgatgttgtggagaaaattgtcaagcttggaacaaccaccttgggaagctcgtatcgacatgttctcaaatccggcttcaccgacacgatatcagaccgtgcaaccagagtttcctttaagtatagcgcttcaagaggggtttatggaacaccaaccttctacgttaacgggttcgtattgtcagatgctggttctcccttagattttggaggatggagaaaagttattgatcctctggttcaaacacacaaggtagagaagcaagatgatctcctttccttcttttgatcagtgcttttgctgttttcacatccatatcaaaataaaaaatagtgctttaccagtttcatgggaactatctgtaaagtaaatatatacttgttcaaaacccatctgttgtacactgtaaactctctgtaatgtattatctctaaagtgatctgcgacatctttcaagtgttttaaaaaaaaaaaaaaaa

SEQ ID NO: 4002 - protein, 227 aa, Glycine max
  misc_feature: PFam Name: DSBA; PFam Description: DSBA-like thioredoxin domain
  misc_feature: GI Number: 8778813; NR Description: T4O12.23 [Arabidopsis thaliana]
  misc_feature: GI Number: 8778978; NR Description: Contains similarity to pigpen protein from Mus musculus gb|AF224264 and contains protein of unknown function DUF78 PF|01918 domain. ESTs gb|N38077, gb|BE037702, gb|AV442191, gb|AV441368, T20H2.2 protein -
MNRTAFLFLVFFIGTQVHAQLVPPARLDGFVYPPGRRVDPDTILIEAFFDPVCPDSRDAWPPLKQVFQRYGSRVALLLHLLPLPYHDNAYVSSRALHIVNALNANATFCLLEAFFEHQALFYNAQTQLLSRPDVVEKIVKLGTTTLGSSYRHVLKSGFTDTISDRATRVSFKYSASRGVYGTPTFYVNGFVLSDAGSPLDFGGWRKVIDPLVQTHKVEKQDDLLSFF

SEQ ID NO: 4003 - DNA, 990 bp, Glycine max
  misc_feature (1)..(990): Ceres cDNA ID no. 21666028
  misc_feature (1)..(990): Ceres CLONE  ID no. 1076138
  misc_feature (1)..(990): Also known as  Ceres CDNA ID no. 24356348
aaaagcagttagctcaggcccaccgccgcccagcactaccggtaacgtagcacgctagtgcgtagtccgtagctcgtctgtgcagtgcacttatggcggcttcgctaggacttaccagccatgaagcctgctgcacggtccaccccaccggctcctccttgtacaacttccaagccgatgaccccttcgtggcagcagcggacggtgccgcggagctgagcttcccggagctcgtggaagccgctcgggcctccgactactcgccgcttccggcgttcggcgtcgctggaggcgagacgatgaacatgtacgggcggagcgtcgtcttccctatgacgacctcgtactactgcgacggcgccgggatgttcgacggcgacgcttcggcgagggggagatggggagggatcggtgctatgaccgggcggccgtcggggaggatcgggttccggactcggtcggaggtggaggtgatggacgacgggttccggtggaggaagtacggcaagaaggcggtgaagagcagccccaacctgcggaactactaccggtgctccgccgaggggtgcggggtgaagaagcggatcgagcgcgaccgcgacgacccgcgctacgtcctcaccacctacgacggcgtccacaaccacgtcacccccggcagcacgtcgtcgagggcagcgccggcgtactcggcgccgacggcgcccgcttggacctggagcgagctgcatgcggcggcgcactcctcggagtcctactgaacggagctactgatcgaccagtacgtagctggttcccttagtttttacggtcgattttacggttcggatgaatgtatacgattcgttgcgccggtggtggtgtgccgtcaccgaataattcggttgctttccacgtccattgtgcacgctggaaacgccgatcgacggcgtgcatcatcgatctgtagaaagaaaataaattggtgcacgaacaaaaaaaaaaaaaaaa

SEQ ID NO: 4004 - protein, 222 aa, Glycine max
  misc_feature: PFam Name: WRKY; PFam Description: WRKY DNA -binding domain
  misc_feature: GI Number: 56797587; NR Description: putative WRKY
  misc_feature: GI Number: 56797589; NR Description: putative WRKY
  misc_feature: GI Number: 46394274; NR Description: TPA: WRKY transcription
  misc_feature: GI Number: 16798362; NR Description: WRKY transcription factor 51 [Arabidopsis thaliana] >gi|29839597|sp|Q93WU9|WR51_ARATH Probable WRKY transcription factor 51 (WRKY DNA-binding protein 51) >gi|22328061|ref|NP_568995.2| WRKY family transcription factor
  misc_feature: GI Number: 47176940; NR Description: WRKY1 [Nicotiana benthamiana]
MAASLGLTSHEACCTVHPTGSSLYNFQADDPFVAAADGAAELSFPELVEAARASDYSPLPAFGVAGGETMNMYGRSVVFPMTTSYYCDGAGMFDGDASARGRWGGIGAMTGRPSGRIGFRTRSEVEVMDDGFRWRKYGKKAVKSSPNLRNYYRCSAEGCGVKKRIERDRDDPRYVLTTYDGVHNHVTPGSTSSRAAPAYSAPTAPAWTWSELHAAAHSSESY

SEQ ID NO: 4005 - DNA, 544 bp, Glycine max
  misc_feature (1)..(544): Ceres cDNA ID no. 21666029
  misc_feature (1)..(544): Ceres CLONE  ID no. 1115625
  misc_feature (1)..(544): Also known as  Ceres CDNA ID no. 23709090
cactccggtctcttttccgttcaggatcagttgcgcgtgcttgttctcttcggagctaaggccgtatcggcgacttgcacattttgtattaggcatccaccctagtttacacccaaatacccacaatggccaccgactccgaactggcgtgcgtttattccgcactcatcctcgctgatgacgatgttgcagtcactggtgagaagatccagaccatcctgaaggctgcctccgtcgaggttgacccctactggccaggtctcttcgccaaggctctggagggtgtaagcatcaaggacctcatcaccaacgtgggttctggtgttggagccgcccccgcggctggtgctgcccctgccgctgctgccgccggcggtgccgccaaggaggaaaagaaagaggagaagaagaaggttgagagcgaccctgagactgacgatgacatgggcttcggtctcttcgactaactccattcctgacttcctttctgtacagttttattgtacaaataatattatgtgaaaacccaaaaaaaaaaaaaaaa

SEQ ID NO: 4006 - protein, 113 aa, Glycine max
  misc_feature: PFam Name: Ribosomal_60s; PFam Description: 60s Acidic
  misc_feature: GI Number: 18253043; NR Description: 60S acidic ribosomal
  misc_feature: GI Number: 38047823; NR Description: similar to Drosophila
  misc_feature: GI Number: 40642705; NR Description: acidic ribosomal protein
  misc_feature: GI Number: 49532890; NR Description: 60S acidic ribosomal
  misc_feature: GI Number: 62083409; NR Description: ribosomal protein P1
MATDSELACVYSALILADDDVAVTGEKIQTILKAASVEVDPYWPGLFAKALEGVSIKDLITNVGSGVGAAPAAGAAPAAAAAGGAAKEEKKEEKKKVESDPETDDDMGFGLFD

SEQ ID NO: 4007 - DNA, 855 bp, Glycine max
  misc_feature (1)..(855): Ceres cDNA ID no. 21666030
  misc_feature (1)..(855): Ceres CLONE  ID no. 1119152
  misc_feature (1)..(855): Also known as  Ceres CDNA ID no. 0
atatgaattaataaatttgaagtgagaaagcaaagcaaaggagagatggcgagactcttggtggttcgatccttggcgcttcggcatgtgataaagaataggggtcgcccactcttcttccaccgtcttcttctctctctcccttccaaatcctctctcttcgccaccaccgccaccgccactgcttcctctcggctctctctcctcccctcctttcaccactctcgctccctctcctccgccgcagctccttccgacgttgtccttgttaattctgaggaagagttcaacaatatcctcaccaaagtccaagatgactcgttgcatgccatcttctatttcactgcggcttggtgtggaccttgcaggtttatttctcctatagttggggagctcagtaagaagtaccctcatgtaacaacatataagatagacattgatcaggaagcaattcaaggcacactgggcaagctgcagatttcatctgtgccaacacttcatttctttcagaatgggaaaaaggctgatgagcttataggcgctgatgttgcgcgattgaaccatatcacagagaaacttttcaagaaggactgactttgaattttgagccgggaatgatgattgctgaatggacgatgaagagctgtggttgcttagagactgtctaggcgtcccttttgatatgctggcgtctatggcttggtttaatattgaagtgttttgtgtaggtctgtaagacatgggatatttgttatacgtaattttatatagaaggaatattgagaagttgaaaattcttaaaacttacatcattctaatttatcttctatattacccttaaaaaaaaaaaaaaaa

SEQ ID NO: 4008 - protein, 182 aa, Glycine max
MARLLVVRSLALRHVIKNRGRPLFFHRLLLSLPSKSSLFATTATATASSRLSLLPSFHHSRSLSSAAAPSDVVLVNSEEEFNNILTKVQDDSLHAIFYFTAAWCGPCRFISPIVGELSKKYPHVTTYKIDIDQEAIQGTLGKLQISSVPTLHFFQNGKKADELIGADVARLNHITEKLFKKD

SEQ ID NO: 4009 - DNA, 635 bp, Glycine max
  misc_feature (1)..(635): Ceres cDNA ID no. 21666031
  misc_feature (1)..(635): Ceres CLONE  ID no. 1120238
  misc_feature (1)..(635): Also known as  Ceres CDNA ID no. 23473387
aaaatcatttacttagaaaacaattaaaacaaaaatggcgtttgcttcaaagatcatcacatgcctcctcgtccttaaggtctacatggcagctccaacagagtcacacataacgtgtgggatagtgacatccacattggctcagtgcatgggctacttgaccaacttttttccagtgccatcagactactgctgcgcggaagtcaaagcattgaatcaaatggctcagaccactccggaccgccgacaagtatgtaagtgccttaaagcagtggctaaggaaaacaaaggattcattaacatcgagcttgtgggcacactccctaccatttgtggtgtttcagttccctacccatttaatttcagcaccaattgtgacactatatcgactgccgtgtgaaggagggtagctagagatgtacgactaatcaaagttgccagctttataacctagcatcataattattctgctttccattttatgacctcattgtcttattattagtagttgtccacttcatatggtaataacgacaaaggaactccctctctctttactgtcactttaatgtatgtacacgtaccgtaccatcagggtcagggataacacttacatcttaaaaaaaaaaaaaaaa

SEQ ID NO: 4010 - protein, 121 aa, Glycine max
  misc_feature: PFam Name: Tryp_alpha_amyl; PFam Description: Protease
  misc_feature: GI Number: 899224; NR Description: E2 [Brassica napus] >gi|7438306|pir||T07984 lipid transfer protein homolog E2 precursor
  misc_feature: GI Number: 6572080; NR Description: lipid transfer-like protein [Arabidopsis thaliana] >gi|15230531|ref|NP_190727.1| lipid transfer protein, putative [Arabidopsis thaliana] >gi|11273822|pir||T45790 lipid transfer-like protein -
  misc_feature: GI Number: 21592902; NR Description: lipid transfer
  misc_feature: GI Number: 4185505; NR Description: nonspecific lipid-transfer protein precursor [Brassica napus] >gi|11273803|pir||T51142 nonspecific lipid-transfer protein
  misc_feature: GI Number: 30102808; NR Description: At5g59310 [Arabidopsis thaliana] >gi|21593784|gb|AAM65751.1| nonspecific lipid-transfer protein precursor-like [Arabidopsis thaliana] >gi|16323386|gb|AAL15187.1| putative nonspecific lipid-transfer
MAFASKIITCLLVLKVYMAAPTESHITCGIVTSTLAQCMGYLTNFFPVPSDYCCAEVKALNQMAQTTPDRRQVCKCLKAVAKENKGFINIELVGTLPTICGVSVPYPFNFSTNCDTISTAV

SEQ ID NO: 4011 - DNA, 956 bp, Glycine max
  misc_feature (1)..(956): Ceres cDNA ID no. 21666032
  misc_feature (1)..(956): Ceres CLONE  ID no. 1120783
  misc_feature (1)..(956): Also known as  Ceres CDNA ID no. 24360136
agttagtcatcagaatcccttcttctctataatatctatgatccattcactctgagccgtaacagttctaaactccaccatttagtgacacccttaacatgatataatgccatcggtgcattcaagcccgggttactcgatggaaaacccggctttggcgtcgctactccgtcacacgacaggggaaaacaagcgtagcaataaattgtcgagcggaggagggcttttgaaaatgttgaagctgtttcctatgttgagttcgggatgcaaaatggtggcactgctgggaagaccacgaaagatgctgaaggacagtgcgacgaccgggacaatcttcggttaccggaaggggagggtgagtttggcgatacaggaggacactcgtcaaatgccggtatttctgatagagttgccgatgctggcgagcgccttgaacaaggagatggcgtcggacatagtgaggattgcgctggagagcgagaccaagagcaacaagaagaagcttctggaggagtacgtgtgggctgtgtattgcaatgggaggaaagttggctactccataaggaggaagcaaatgagcgacgatgagcttcacgtcatgcagcatttgagaggggtttccatgggagcgggggtgctccccacctcatcggatcataaggattgcgatggggaaatgacctacatgagggccaggtttgagagggtcgttggctccaaggattccgaagccttttatatgattaatcctgattctactgctcaaggccctgagttgagtatcttctttgttagacctcactagaataatcataatcataatcatatcttgtatctacctcttcctagcttacattgtatcattattattctaaccatgcatgtaagctcaaaactgccattcaatgaatagtccatctcatatgttaattgtttcttcaaaaaaaaaaaaaaaa

SEQ ID NO: 4012 - protein, 232 aa, Glycine max
  misc_feature: GI Number: 21618123; NR Description: unknown [Arabidopsis thaliana]
  misc_feature: GI Number: 34909066; NR Description: P0702B09.30 [Oryza sativa (japonica cultivar-group)] >gi|13872994|dbj|BAB44099.1|
  misc_feature: GI Number: 21593037; NR Description: unknown [Arabidopsis thaliana]
  misc_feature: GI Number: 34911646; NR Description: P0039G05.26 [Oryza sativa (japonica cultivar-group)] >gi|20161546|dbj|BAB90468.1| P0510C12.13 [Oryza sativa (japonica cultivar-group)] >gi|20805135|dbj|BAB92806.1| P0039G05.26 [Oryza sativa (japonica
  misc_feature: GI Number: 21593000; NR Description: unknown [Arabidopsis thaliana]
MPSVHSSPGYSMENPALASLLRHTTGENKRSNKLSSGGGLLKMLKLFPMLSSGCKMVALLGRPRKMLKDSATTGTIFGYRKGRVSLAIQEDTRQMPVFLIELPMLASALNKEMASDIVRIALESETKSNKKKLLEEYVWAVYCNGRKVGYSIRRKQMSDDELHVMQHLRGVSMGAGVLPTSSDHKDCDGEMTYMRARFERVVGSKDSEAFYMINPDSTAQGPELSIFFVRPH

SEQ ID NO: 4013 - DNA, 1251 bp, Glycine max
  misc_feature (1)..(1251): Ceres cDNA ID no. 21666033
  misc_feature (1)..(1251): Ceres CLONE  ID no. 1121617
  misc_feature (1)..(1251): Also known as  Ceres CDNA ID no. 0
acagaggttttgatgtttattgtttgtatcgccgtagaatcttaagcaaattcgacggctggtgaaccctaattaaattatgccatgattgacggtgcccttaattggtccctcttttccaaaccccaactgggtatcacaaagtttccaaattgaacgcaaaaacggaaatttcttcctcaaatgccttctgggtcgctcttctttgcatccagattacgaagtttttggtcgccagtaaggtctgtgattcaagtgctattttagcatttttttttttcctggacggtgagggtcaacttgcatgcacatgttagtgaaaaaccacaataagggggatggatctaagtccctcgccgatacactggcgaaatggaaagaatataatgcttggctggagtctaacaatgaagctgagaagccggctaggaaggtccctgccaagggatcaaagaaagggtgtatgaaaggaaaaggagggcccgagaactcacgctgtaactacagaggagttaggcaaaggacttggggaaaatgggttgctgaaatccgagagccaaacagaggaagtaggctctggttgggtacttttcccactgccattagcgctgctctcgcttatgatgaagcagcaagggcaatgtatggttcctgtgcgcgcctcaactttcccaacgttcaagtttcaactttgtctgaggaatcgtcgagaaattctccagctgctgctaaccggtcgagaaattctccagctgctagtcaatccggtcatgcgttgatgatattagagagttctgagtgcatgatattgccgaacaactctggtggagacgcagcagaggatgatgacatggaagacctttccttatccttaagtgtgaaacgtgtgaagcacgaggaaggggaggatgaatcagggaccagttcttcctatctttcattgtcttgatgtatgttccacatacactgatttggccgcggctagaaatcttagccttcatagcggtggatggattagcttaggatgaatggatcttgctattagtacctggagattagctgttgtaaaattcacttggttgagaagtgttccattcttctggaattgacctaatgcagctggatatcttgtcatgttgtaagatgtgaaatgtattctgccatgcatgatagatgactagtttcttgtgtctattttactttggataatgttatctagtctttgtttccctgctaaaaaaaaaaaaaaaa

SEQ ID NO: 4014 - protein, 1251 aa, Glycine max
ACAGAGGTTTTGATGTTTATTGTTTGTATCGCCGTAGAATCTTAAGCAAATTCGACGGCTGGTGAACCCTAATTAAATTATGCCATGATTGACGGTGCCCTTAATTGGTCCCTCTTTTCCAAACCCCAACTGGGTATCACAAAGTTTCCAAATTGAACGCAAAAACGGAAATTTCTTCCTCAAATGCCTTCTGGGTCGCTCTTCTTTGCATCCAGATTACGAAGTTTTTGGTCGCCAGTAAGGTCTGTGATTCAAGTGCTATTTTAGCATTTTTTTTTTTCCTGGACGGTGAGGGTCAACTTGCATGCACATGTTAGTGAAAAACCACAATAAGGGGGATGGATCTAAGTCCCTCGCCGATACACTGGCGAAATGGAAAGAATATAATGCTTGGCTGGAGTCTAACAATGAAGCTGAGAAGCCGGCTAGGAAGGTCCCTGCCAAGGGATCAAAGAAAGGGTGTATGAAAGGAAAAGGAGGGCCCGAGAACTCACGCTGTAACTACAGAGGAGTTAGGCAAAGGACTTGGGGAAAATGGGTTGCTGAAATCCGAGAGCCAAACAGAGGAAGTAGGCTCTGGTTGGGTACTTTTCCCACTGCCATTAGCGCTGCTCTCGCTTATGATGAAGCAGCAAGGGCAATGTATGGTTCCTGTGCGCGCCTCAACTTTCCCAACGTTCAAGTTTCAACTTTGTCTGAGGAATCGTCGAGAAATTCTCCAGCTGCTGCTAACCGGTCGAGAAATTCTCCAGCTGCTAGTCAATCCGGTCATGCGTTGATGATATTAGAGAGTTCTGAGTGCATGATATTGCCGAACAACTCTGGTGGAGACGCAGCAGAGGATGATGACATGGAAGACCTTTCCTTATCCTTAAGTGTGAAACGTGTGAAGCACGAGGAAGGGGAGGATGAATCAGGGACCAGTTCTTCCTATCTTTCATTGTCTTGATGTATGTTCCACATACACTGATTTGGCCGCGGCTAGAAATCTTAGCCTTCATAGCGGTGGATGGATTAGCTTAGGATGAATGGATCTTGCTATTAGTACCTGGAGATTAGCTGTTGTAAAATTCACTTGGTTGAGAAGTGTTCCATTCTTCTGGAATTGACCTAATGCAGCTGGATATCTTGTCATGTTGTAAGATGTGAAATGTATTCTGCCATGCATGATAGATGACTAGTTTCTTGTGTCTATTTTACTTTGGATAATGTTATCTAGTCTTTGTTTCCCTGCTAAAAAAAAAAAAAAAA

SEQ ID NO: 4015 - DNA, 808 bp, Glycine max
  misc_feature (1)..(808): Ceres cDNA ID no. 21666034
  misc_feature (1)..(808): Ceres CLONE  ID no. 1121766
  misc_feature (1)..(808): Also known as  Ceres CDNA ID no. 0
aaaaatgtcgcgatttatttcacttgctcaaaacgtctgagcccgtctcaccctctcacgcagcatttccctgcttaaaccctccagcagcctccaaacaaaaaccctaattcactaaccccatttcaaatcccaatcacgtttccgatcaatcatcaccttctccataatctctccgttcgcgtcgcaaatcgagcgagatagtgtcgagtcgaaccaacgatcgagaagatatagaagatggagttttgccccagttgtggtaacatgctacagtatgaattgccttatatgggtcgcccttcaagatttttttgttctgcttgcccatatgtttgccacattgagaatagggttgagatcaaaagaaagcaaaggttggtgagaaaagagatagagcctatattctccgaggatgacatgacaaatgcaccatcaactgaagcgacgtgcccattttgcggtcatggtaaagctgctttcaaagaatttcagactcgatcggctgatgagccagcaactctattttataagtgcttgaacaatgactgtaaaaaacaatggcgtgaaggttgacttcaaacatggccttatatttcttcattttgctgaggatagaaaagcttttgttgtaattgggccaatatgacagctaagagtgtttggatagtttttacattttcgctgacaataatctaagtgatacattttttttttctttctttattactatcgaagtttgttttagggattagaaaattgagatggtaagcattcctcgtgtttcatacgaaaaaaaaaaaaaaaa

SEQ ID NO: 4016 - protein, 111 aa, Glycine max
MEFCPSCGNMLQYELPYMGRPSRFFCSACPYVCHIENRVEIKRKQRLVRKEIEPIFSEDDMTNAPSTEATCPFCGHGKAAFKEFQTRSADEPATLFYKCLNNDCKKQWREG

SEQ ID NO: 4017 - DNA, 942 bp, Glycine max
  misc_feature (1)..(942): Ceres cDNA ID no. 21666035
  misc_feature (1)..(942): Ceres CLONE  ID no. 1121954
  misc_feature (1)..(942): Also known as  Ceres CDNA ID no. 23709213
atgatgtataggaaacttcgtggaaggtacccaggagtgagaaatggacctcccatggcgcccccatttaatcccctcaccttccactctctttcccctcaacccccactctttcttccttctccttctcttctctgcttctcttttcatctccgaaaacaatgaagctcattagcagcattaaccccaaaaatctcaaactcagtcccaaacgcttctttcgcaaaaaggaacgatctttagtctcacgctccgacccaccttcattcggatccggatcttcctccgacgactccaccacaaatcacaagccttccgccggtaaccaaactccgaccagcgtcctcccgggcgtctccggagactggtccgacgtcgccgccgtcgacgtgcggtgggacctcgcccaggccttccgcctcatcgaccgcgacaacgacggcgtcgtcacgcgccaggacctcgaggccctcctcacgtgcctcggcgcgtcgccgtgccccgacgacgtggcggtcatgctcggcgaggtcgacggcgacggcatcaccgtagaaaggctcatgagccacgtcgggtcgggtctgaaacccgggtcggatccggacgagctcaaggaggcgttcgaggtgttcgacacggatcgcgacgggaggatctcggcggaggagctgcttagggttttcaaggccatcggcgacgagcggtccacgttagaggagtgccggcgcatgatagagggtgtggacagaaatggggacgggttcgtctgcttcgaggacttttctcgtatgctggagctgcagcagcagcgatgatgatgacgtggttgtgattgtgatgatgtcagatgatgatcatgatcatgttatgacttatgatgtgaaaatatatataagaaggaaggcaacttcataattttttttaaaaaaaaaaaaaaaa

SEQ ID NO: 4018 - protein, 218 aa, Glycine max
  misc_feature: PFam Name: efhand; PFam Description: EF hand
  misc_feature: PFam Name: Mucin; PFam Description: Mucin-like glycoprotein
  misc_feature: GI Number: 6056210; NR Description: calmodulin-like protein [Arabidopsis thaliana] >gi|27808532|gb|AAO24546.1| At3g10190 [Arabidopsis thaliana] >gi|15228219|ref|NP_187630.1| calmodulin,
  misc_feature: GI Number: 21536925; NR Description: calmodulin-like protein
  misc_feature: GI Number: 15810637; NR Description: putative calmodulin protein [Arabidopsis thaliana] >gi|13430790|gb|AAK26017.1| putative calmodulin protein [Arabidopsis thaliana] >gi|3894183|gb|AAC78532.1| calmodulin-like protein [Arabidopsis
  misc_feature: GI Number: 16213; NR Description: calmodulin like protein [Arabidopsis thaliana] >gi|322474|pir||S29595 calmodulin-related
  misc_feature: GI Number: 50904487; NR Description: B1147A04.10 [Oryza sativa (japonica cultivar-group)] >gi|19386815|dbj|BAB86193.1|
MKLISSINPKNLKLSPKRFFRKKERSLVSRSDPPSFGSGSSSDDSTTNHKPSAGNQTPTSVLPGVSGDWSDVAAVDVRWDLAQAFRLIDRDNDGVVTRQDLEALLTCLGASPCPDDVAVMLGEVDGDGITVERLMSHVGSGLKPGSDPDELKEAFEVFDTDRDGRISAEELLRVFKAIGDERSTLEECRRMIEGVDRNGDGFVCFEDFSRMLELQQQR

SEQ ID NO: 4019 - DNA, 1619 bp, Glycine max
  misc_feature (1)..(1619): Ceres cDNA ID no. 21666036
  misc_feature (1)..(1619): Ceres CLONE  ID no. 1169119
  misc_feature (1)..(1619): Also known as  Ceres CDNA ID no. 25087604
attttcatatctcccaacccccaaatggcttcttcttctcgccactcccctcaattcacccccattctagaggagcgtgaatttgacgacttgagtggccatgacattataagccactccagaagctcccaccctccaacccccattgtccacaagcacactaaatccaatcacaacaaccacaagaaaaagagatcagattccgaggaagatggctccgtctcttgcaacaagtgcagacctcactcccgcgacaaaatcttcatccttcccttggatcactcctccaccaacaactctcacaaaccctcttccttactcgccagccccaacgatattttcaggtcccttgtttccaagctcacccgcaagagtcccatgtcttcttcttcatcccaagaccctctcccaccctccagagaggaacaatggaaaatggcagtcgccgaactctctcacaagctgctccacgccaccagaaaaagagacgaggctcttctagaagcttctagactcatgcactccatgagcgagttggagaagaagctcaacaagctcgaactctattgccacaccttgaaatctggcctcgaacaatgcaccaacaacaacattactacttcccctacttcccttttcaaatctcaaaccctcgaacaggacaccgtgattcaacacttcttggtctcggtgtcggaagcaagatcaagtgtgaggcttttgtctcgttccttaaccatgcaactgaggcacatgggaagcaaggtgtacgagaaagtctccttccttctccaaccatacgacataaaaatatccttctccaagagtccaacaagaagcttacttttctacctagaagcactcttgaacagaaccttctacgaggacttcgaaacaatagggttccagaagaacgcgtgcaacatgatactgaacccaaaggagcgatgcgaggcgagttacgagtcattcaacatggttcacgggctgacgtgggaggaggtgctgagcaaaggaacgaggcacttcagcgaggagttcagcaggttttgcgacaggaagatgagcgagatagtggcgatgttgggctggaaccgggcctggcccgaggcactcttgcaggccttctttggggcctcaaagagcgtgtggaaggtgcacttgttggccaactcgctgcacccgagtctgccgatatttagagtggagaaaggagtaaggtttgattcggtttacatggaggatatgggtggtggtggtggtgacaaggccacttccaacttggtccctgctctggtcagaataatgcttgcgccaggcttttatgtctatggcagtgcagtcaagtgtaaggtcctttgcaggtacttgagtactagtagtaacaaggaagacaaacccttaaccccaaccccttcttgactttggatgaatcactttctttctggttttgtttttttatgtcagctaatattgttcatgatgttgtatattattattatttagtattaagcaatgttggtgctgctgcatgcttgggttgggatggttccatggtggtggtactactatatcgagattttgggtcaaagtaaacaatttggcaaaaaaaaaaaaaa

SEQ ID NO: 4020 - protein, 465 aa, Glycine max
MASSSRHSPQFTPILEEREFDDLSGHDIISHSRSSHPPTPIVHKHTKSNHNNHKKKRSDSEEDGSVSCNKCRPHSRDKIFILPLDHSSTNNSHKPSSLLASPNDIFRSLVSKLTRKSPMSSSSSQDPLPPSREEQWKMAVAELSHKLLHATRKRDEALLEASRLMHSMSELEKKLNKLELYCHTLKSGLEQCTNNNITTSPTSLFKSQTLEQDTVIQHFLVSVSEARSSVRLLSRSLTMQLRHMGSKVYEKVSFLLQPYDIKISFSKSPTRSLLFYLEALLNRTFYEDFETIGFQKNACNMILNPKERCEASYESFNMVHGLTWEEVLSKGTRHFSEEFSRFCDRKMSEIVAMLGWNRAWPEALLQAFFGASKSVWKVHLLANSLHPSLPIFRVEKGVRFDSVYMEDMGGGGGDKATSNLVPALVRIMLAPGFYVYGSAVKCKVLCRYLSTSSNKEDKPLTPTPS

SEQ ID NO: 4021 - DNA, 1916 bp, Glycine max
  misc_feature (1)..(1916): Ceres cDNA ID no. 21666037
  misc_feature (1)..(1916): Ceres CLONE  ID no. 1169196
  misc_feature (1)..(1916): Also known as  Ceres CDNA ID no. 23710454
gtgttcttcacaaacaaagagaaagaaccacaaacacattctcttaggctcttttttttattctccggccaccggagactcgccggaggaatggaggagccgaactccgattgctggctgccaccaggttggactgtggaagtgagggtgagaaagaatggtaagagagacaagtattacttccccccctcaagtggactaaaattcaattccaaggtggaggtatttcgctatcttgacaatgctcagaacaaagtcagcatccagaaaatctctcctaatgttatagttgagaaagctattgcggaagggttaccaccaggatgggtgaaaaagaccagaatcacaacaaatggagattcagttagaagagatacgtcaacaagtgtaaccgtgaaaccaacattatcaattagcatgggtcaaagctcagacatggacatgatagctaatgaccaacagattccaagatctgcaagttctgaagaatatatgtctgtgcccatctctgaatgtatttccaatcagtgtgtcgtgggcgccaaactgaccagttcagttctatcactggctaaaagttcagataaaaaacaagggaaggttggtgtagctcaaagcgcttcagtttctggttgcactaacaaagatgccgaagaaaagcaacttcaaggaaattcagagacaaaacatggcactgaaaaagcccaggccaaagatccccagtgcaaaaacaagcacaagaaagagatcaatttgcctcgccgtgcttcaaagcgtcttgctggaattaaggttgatcctgttccggaacttaaaataagaaatagagcacgccgtgttgcagttaaacaatcagaggaggaggaaaccatcacaaatgtagataaatctgccaacagcttgcttgatggtctagcaaaacagaaattaaataacgaggatactgacaagactctagaagtgcaaagaagcgacaaggaaaaagaatgcttctctttttcgtctctggagaacaatgctactgtggaagagtgtgtgagagtcattgaaaatggagataaagttgatgctaagttagattacacccttgactttcccctcagagaactactaacagacccttgtattgcatttgccattcaaacactcactggagtaacattcgaagcctccaaagacttacaaactttttccgagttaaaaaacagccagcattccaaaacttctgcttctgccgccgccattggcgaaggcgatggtaagaaaagcaatgatgggttaggtggcaatgagttctcatctccagagaaccttgctattccaccagaacatgctggtgatgccaaaactgatttaaaggccaagaatgagaatgcaggaccatcttctgaaaagacacttgacatgtcatcatggatggatccatgcattgaatttgctataaaaactctcactggcaccatcccatcagactctgctgatcaaaatcccaagaactgcctccaacagcaactcagctcatcaaatagccaacacagtgagatggccttgtcaagtgtcagtttagataacatatacaaaactgactactcttgcagccaatactttgacacacagaaaccaatgtttaataaacagtcttttgtggatccatcactgcagcacaccagaaatataggtattggaaattctgctggatccagactctctcactgtggtgaaagatactagaaggaatgtttgttagatcagtaaaccatcttgtgcctgaactaacataaagattgtacagttaggaaaactaaaaaagcttcccaccccatgaaacctttaacctatctccttttgttgttatgttgttctgtgatactttaattagctgatcctatgtattttgtagaaaaaaaaaaaaaaaa

SEQ ID NO: 4022 - protein, 546 aa, Glycine max
  misc_feature: PFam Name: MBD; PFam Description: Methyl-CpG binding domain
  misc_feature: GI Number: 21554707; NR Description: unknown [Arabidopsis thaliana]
MEEPNSDCWLPPGWTVEVRVRKNGKRDKYYFPPSSGLKFNSKVEVFRYLDNAQNKVSIQKISPNVIVEKAIAEGLPPGWVKKTRITTNGDSVRRDTSTSVTVKPTLSISMGQSSDMDMIANDQQIPRSASSEEYMSVPISECISNQCVVGAKLTSSVLSLAKSSDKKQGKVGVAQSASVSGCTNKDAEEKQLQGNSETKHGTEKAQAKDPQCKNKHKKEINLPRRASKRLAGIKVDPVPELKIRNRARRVAVKQSEEEETITNVDKSANSLLDGLAKQKLNNEDTDKTLEVQRSDKEKECFSFSSLENNATVEECVRVIENGDKVDAKLDYTLDFPLRELLTDPCIAFAIQTLTGVTFEASKDLQTFSELKNSQHSKTSASAAAIGEGDGKKSNDGLGGNEFSSPENLAIPPEHAGDAKTDLKAKNENAGPSSEKTLDMSSWMDPCIEFAIKTLTGTIPSDSADQNPKNCLQQQLSSSNSQHSEMALSSVSLDNIYKTDYSCSQYFDTQKPMFNKQSFVDPSLQHTRNIGIGNSAGSRLSHCGERY

SEQ ID NO: 4023 - DNA, 1276 bp, Glycine max
  misc_feature (1)..(1276): Ceres cDNA ID no. 21666038
  misc_feature (1)..(1276): Ceres CLONE  ID no. 1169217
  misc_feature (1)..(1276): Also known as  Ceres CDNA ID no. 23710351
atttccattttccattcccatcgtaaaaatacaaaaatcataatcagtcatagcttcggcgacttcacgatattcctttcttcttctgattgagccaccgacagagcctgcgattaccgtggcggtttcagaatggcggacaagtacaacctcaagaaccccgccgtgaagcggatcctccaggagctcaaggagatgaactccaacccttccgacgatttcatgagcctccctctcgaggaaaatatatttgaatggcaatttgcgattagagggcctcgtgatactgaatttgagggtggtatttatcatggacggattcagttgccttcagagtatccattcaaacccccttcatttatgttgttgactcctaatggtcgtttcgagactcaaaccaagatttgcttgagcatatcaaatcatcaccctgagcattggcagccatcatggagcgtgaggactgctttagttgcattgattgcattcatgcctaccaacccaaatggtgcattgggatcgttagactacaagaaagaagagaggcgtacactggcagttaaatctcgtgaagctcctcctaaattcgggactcctgaacgtcaaaagctgatcgatgagatacacgagtacatggtaagcaaggcacctcctgttcctcaacctagcgccagtgaggcttctgaagagaaccccagaaatgaagaggctgagacacacgccaattcactgaatcctgagtctttaactgcaggagaggttattctagatcaagaagttgatggaattgtggaagaacaagaagaagtccttgcaaatgctaaccctgcaggagttgaagcttcaagggaggttcaacctagtgtttcaaggtatgaggtgctccaaaagtcagacacaagggttcagaatcctaagccagagacgagggttcagaaacctgatgatcggttgttcacattggcagctattggactcactattgcaattgttgtccttttgctcaaaaagttcattaaatctacccaacatggggcacttttctccgatggatcttaagacttttcgttgctgatgttggcttccgagattaaacttcttagccattatgcagtaaatagaaatatagagttcttctaaactcaaagaagtatttttctttttttaatttgattgtacttttattatactccatttgtaaatatggtaatatatatgtgctcttgcgataaattgaggaggagcatggctttgtttgttaaaaaaaaaaaaaaaa

SEQ ID NO: 4024 - protein, 308 aa, Glycine max
  misc_feature: PFam Name: UQ_con; PFam Description: Ubiquitin-conjugating enzyme
  misc_feature: GI Number: 66354472; NR Description: ubiquitinating enzyme
  misc_feature: GI Number: 45382103; NR Description: Non-Canonical UBiquitin Conjugating Enzyme 1 (NCUBE1) [Gallus gallus] >gi|7362937|emb|CAB83196.1| Non-Canonical UBiquitin Conjugating
  misc_feature: GI Number: 47550809; NR Description: zgc:63554 [Danio rerio]
  misc_feature: GI Number: 7363050; NR Description: Non-Canonical UBiquitin
MADKYNLKNPAVKRILQELKEMNSNPSDDFMSLPLEENIFEWQFAIRGPRDTEFEGGIYHGRIQLPSEYPFKPPSFMLLTPNGRFETQTKICLSISNHHPEHWQPSWSVRTALVALIAFMPTNPNGALGSLDYKKEERRTLAVKSREAPPKFGTPERQKLIDEIHEYMVSKAPPVPQPSASEASEENPRNEEAETHANSLNPESLTAGEVILDQEVDGIVEEQEEVLANANPAGVEASREVQPSVSRYEVLQKSDTRVQNPKPETRVQKPDDRLFTLAAIGLTIAIVVLLLKKFIKSTQHGALFSDGS

SEQ ID NO: 4025 - DNA, 1214 bp, Glycine max
  misc_feature (1)..(1214): Ceres cDNA ID no. 21666039
  misc_feature (1)..(1214): Ceres CLONE  ID no. 1169868
  misc_feature (1)..(1214): Also known as  Ceres CDNA ID no. 24360120
agttagcatcgtcgacgttgcgatggagaaggaagcgagtagcaccgacgacccttcttcgttcacgcttctagtgtcgtgtccttccggcctttcaccttcacaggtttctgtggcattcagcgacgcctacgaccggatcccccactctgacgtcatcttggagaacacgatttccgagatatggaagcagaggagtcagaagaacaattcgctcttcaatgggaagaagttcaggtatggagggtgtgttttgcatgccaaagatggatccgaccatgaatgtgaaccgcatttatgcctccatctaggtttgacagattacaggacttttgtggggacaaatttaagtcctttgtgggaaaggttcctggttccatcagaagatgattctgttctttgtcagcacacctccaatccactaggaaatggtgcagtggtggaaacaaatgacaacaaaatacttgtattacaacgaagtgataatgttggtgaatttcctggacattttgttttccctggaggccatcctgagcctcaagaaattggtataacatctcatcaatataacaaggagttaacagaatctattaacactaaggtttcacaggagatgtttgacagcattgttcgtgaagtagttgaagaaattggagtgccggcttcatcccttagcatcccggctttcattggtatatctcgcaggaacttgaatgttagaccagctgcatttttctttattaaatgcggtcttgactcaaaggaagttcggcagttttattcaagtgcacaagatggctatgagtcaactcagctatatgctgttccaatgattgaaatagaaaacatgacttctaggatgcctggctgtcatcgaggtggatttgccctctataaattgatggttgacaccaggaagattacttgatggaaatttgtagcactcacaggtgtcaagaatcgtagttgcttgccttcaaggatttttcctgcgtgatgtagtttgatgctgacattaccgagttgaacctccacttccccgcccaatgaaagagacataatttaaccgagtgcaaatcttcccactgaatagtgaatgctacagaatttctatttcattgcaatagattatactcatgcttgttttcaattcatacccaaataaaatgaggacaaaactaagatgcaattgtttaggaaaaaaaaaaaaaaaa

SEQ ID NO: 4026 - protein, 301 aa, Glycine max
  misc_feature: PFam Name: NUDIX; PFam Description: NUDIX domain
  misc_feature: GI Number: 38014572; NR Description: Unknown (protein for MGC:72981) [Rattus norvegicus] >gi|40018554|ref|NP_954521.1|
  misc_feature: GI Number: 18043850; NR Description: RIKEN cDNA 0610006K04
  misc_feature: GI Number: 53734046; NR Description: Unknown (protein for
  misc_feature: GI Number: 17976973; NR Description: P17F11 [Xenopus laevis]
  misc_feature: GI Number: 46250173; NR Description: P17F11 protein [Xenopus
MEKEASSTDDPSSFTLLVSCPSGLSPSQVSVAFSDAYDRIPHSDVILENTISEIWKQRSQKNNSLFNGKKFRYGGCVLHAKDGSDHECEPHLCLHLGLTDYRTFVGTNLSPLWERFLVPSEDDSVLCQHTSNPLGNGAVVETNDNKILVLQRSDNVGEFPGHFVFPGGHPEPQEIGITSHQYNKELTESINTKVSQEMFDSIVREVVEEIGVPASSLSIPAFIGISRRNLNVRPAAFFFIKCGLDSKEVRQFYSSAQDGYESTQLYAVPMIEIENMTSRMPGCHRGGFALYKLMVDTRKIT

SEQ ID NO: 4027 - DNA, 1919 bp, Glycine max
  misc_feature (1)..(1919): Ceres cDNA ID no. 21666040
  misc_feature (1)..(1919): Ceres CLONE  ID no. 1170507
  misc_feature (1)..(1919): Also known as  Ceres CDNA ID no. 24361151
actacttcaagcaacagtggcactgccaagagtttgaacgcacacaaaaatatttgtttgcacttacattaaatataataataataatcaatgatagtgcatttgaattgaaacctatcttagtgaggaagaagaggtgatgatgatgatggaagaggaagatatggaagtagaggcacaagtgttcgttgctcacgagattgatttggattacgagttcgacgcagttcgattcttcgatttcggtgcacaagaaactcccgctcaggctcgccaagccgaactctggtttcattccgccggaagctatcctccttctccttttgtggcgaagttagtggcgagagaggacgacgttagcgaatgtgcaaccaccgttcacgctgccaagtctaatgttccgtccgggattggattttctcgcacagtttttcaccatgacggttcaaaaggagggggtgggagtgggaacatttctgccttgctgagtggaattccgtacgatcttaatttgcaacttttacaagtaacctcaggaatgacctttagcagtaagacaattggtagcaatttgaattctaaggttaaatctgctgtgatgaagggttcaacactaatgagacctactgctagtctgttggctaagcaaaatcggccccatcaaattgttagctcaaggtttcagaaagtacaagatcataacaaaaaaatgaattcatctacctcttctgggatagagtgtcaagctgccaaacggcagaaattagaaggtggcagcttgcacaaggttgctgatgtgaagcagcaagttaattttgtccacaaggcacctaaaaaggttgcaactgttgatcaaaattctggacattccaagctgaagattactattcctagagagcctgacctagaaacagctcacagagcacaaaggattagacctaaacctgctgcagaggcagaagttgtgacagtggctgtccccagattcaaagcacgcccgttaaacagaaaaattctaaatgctccttcgtttccacttcccaagaggagcactccacgattgccagaatttctagaatttcatctcaggacacaagagagggccatgcagcatacatctgcgacttcatcgtcttcacttcattgcaatgattttgataaggatttggacaaacatacagctgtttctgctcaagaaaatagaatcagggatttgagaaggccatctgccctgggtgctccaaagcatgatggattggattttgctcattgttttaaagctcgtcctcttaataagaagattctttcaagtaaaggagatattgctgttttcctgaacagaaagcaggaaaccacggtgccaatggaatttaatttccatacggaaaagagggttcagcataacccaccaagcgaactctttagcaagatgtccctaacatccgaagtccagtcaaataatggatctcagttgaaactgcctcggcattccagagtgttcagagaggattcaaaagaaaatataggaagttcttttcatctggatgtgaaggaaacacctttcgtatttgggggaaggcaaattcacagtgggagggaaggttgcgacggtgacgctggtactatgttgacagcaaggaggagcttgggaattcgatgatgacgatacagacaaaggccaatatgcaacatagaaaatagtttctctgccagagttgaacttcgatagcaacatagctgaatctaacagtcgcctaacaactttctcagattttttttattggtacacagaatcttagaaaattactgttaggacagaagttagcatacaaaattctgcatcacttgtatcttgtacaactcccctctgggtcataatccaataataaaatcgttaataggcaaaaaaaaaaaaaaaa

SEQ ID NO: 4028 - protein, 1919 aa, Glycine max
  misc_feature: GI Number: 42561670; NR Description: targeting
  misc_feature: GI Number: 42571327; NR Description: targeting
ACTACTTCAAGCAACAGTGGCACTGCCAAGAGTTTGAACGCACACAAAAATATTTGTTTGCACTTACATTAAATATAATAATAATAATCAATGATAGTGCATTTGAATTGAAACCTATCTTAGTGAGGAAGAAGAGGTGATGATGATGATGGAAGAGGAAGATATGGAAGTAGAGGCACAAGTGTTCGTTGCTCACGAGATTGATTTGGATTACGAGTTCGACGCAGTTCGATTCTTCGATTTCGGTGCACAAGAAACTCCCGCTCAGGCTCGCCAAGCCGAACTCTGGTTTCATTCCGCCGGAAGCTATCCTCCTTCTCCTTTTGTGGCGAAGTTAGTGGCGAGAGAGGACGACGTTAGCGAATGTGCAACCACCGTTCACGCTGCCAAGTCTAATGTTCCGTCCGGGATTGGATTTTCTCGCACAGTTTTTCACCATGACGGTTCAAAAGGAGGGGGTGGGAGTGGGAACATTTCTGCCTTGCTGAGTGGAATTCCGTACGATCTTAATTTGCAACTTTTACAAGTAACCTCAGGAATGACCTTTAGCAGTAAGACAATTGGTAGCAATTTGAATTCTAAGGTTAAATCTGCTGTGATGAAGGGTTCAACACTAATGAGACCTACTGCTAGTCTGTTGGCTAAGCAAAATCGGCCCCATCAAATTGTTAGCTCAAGGTTTCAGAAAGTACAAGATCATAACAAAAAAATGAATTCATCTACCTCTTCTGGGATAGAGTGTCAAGCTGCCAAACGGCAGAAATTAGAAGGTGGCAGCTTGCACAAGGTTGCTGATGTGAAGCAGCAAGTTAATTTTGTCCACAAGGCACCTAAAAAGGTTGCAACTGTTGATCAAAATTCTGGACATTCCAAGCTGAAGATTACTATTCCTAGAGAGCCTGACCTAGAAACAGCTCACAGAGCACAAAGGATTAGACCTAAACCTGCTGCAGAGGCAGAAGTTGTGACAGTGGCTGTCCCCAGATTCAAAGCACGCCCGTTAAACAGAAAAATTCTAAATGCTCCTTCGTTTCCACTTCCCAAGAGGAGCACTCCACGATTGCCAGAATTTCTAGAATTTCATCTCAGGACACAAGAGAGGGCCATGCAGCATACATCTGCGACTTCATCGTCTTCACTTCATTGCAATGATTTTGATAAGGATTTGGACAAACATACAGCTGTTTCTGCTCAAGAAAATAGAATCAGGGATTTGAGAAGGCCATCTGCCCTGGGTGCTCCAAAGCATGATGGATTGGATTTTGCTCATTGTTTTAAAGCTCGTCCTCTTAATAAGAAGATTCTTTCAAGTAAAGGAGATATTGCTGTTTTCCTGAACAGAAAGCAGGAAACCACGGTGCCAATGGAATTTAATTTCCATACGGAAAAGAGGGTTCAGCATAACCCACCAAGCGAACTCTTTAGCAAGATGTCCCTAACATCCGAAGTCCAGTCAAATAATGGATCTCAGTTGAAACTGCCTCGGCATTCCAGAGTGTTCAGAGAGGATTCAAAAGAAAATATAGGAAGTTCTTTTCATCTGGATGTGAAGGAAACACCTTTCGTATTTGGGGGAAGGCAAATTCACAGTGGGAGGGAAGGTTGCGACGGTGACGCTGGTACTATGTTGACAGCAAGGAGGAGCTTGGGAATTCGATGATGACGATACAGACAAAGGCCAATATGCAACATAGAAAATAGTTTCTCTGCCAGAGTTGAACTTCGATAGCAACATAGCTGAATCTAACAGTCGCCTAACAACTTTCTCAGATTTTTTTTATTGGTACACAGAATCTTAGAAAATTACTGTTAGGACAGAAGTTAGCATACAAAATTCTGCATCACTTGTATCTTGTACAACTCCCCTCTGGGTCATAATCCAATAATAAAATCGTTAATAGGCAAAAAAAAAAAAAAAA

SEQ ID NO: 4029 - DNA, 1147 bp, Glycine max
  misc_feature (1)..(1147): Ceres cDNA ID no. 21666041
  misc_feature (1)..(1147): Ceres CLONE  ID no. 1170524
  misc_feature (1)..(1147): Also known as  Ceres CDNA ID no. 23489612
gaattgcaacccaagctataggtttaataaacgttgaaactattcctcctgcgccatctccattgctgttttctctctgcttgctattacaatccaattcaagaagttcgttcaactttgatgctcaagtctaacaacatatataaccattgacagatattcaaattcagcataattgtgattaaaattttggtccttccctggaatgaaaatactgtttgtcaataaatttgggagtgatttttgcggttatatttaatgggctgctactgttcaacttcaaagaaaaccgaagcacaaggttatgaggaacccactgttcttgcatctgtgacaccttgtgagtaccatgatccatcattgaatgttactgttagtgaagtagaggccttgcatgaactctacaagaagttgagcaattcaattattgaagatggtcttattcacagggaagaattccagctggcactattcaggaataaaaacaagaaaaatctgtttgcagataggatttttgacttatttgatctcaagcgcaacggggtcattgagtttggggaatttgttcgatcactgggtgtttttcacccaaatgcagcattagaagacaagattacctttgcttttaggttgtatgatctgaggcagacagggtttattgaacgagaggagttaaaggagatggtattggcacttttgcatgagtcggatcttgagctttcagatgatatgattgaaaccattgtggataagacttttagtgatgctgatataaacggtgatggaaggatcgatcaagatgaatggaaagcatttgtgtccaagcatccatccttgataaagaatatgacacttccatatctgaaggatattaccttggcttttcccagttttgtcacaggaacggatattgaagagtcagagatgtgactctgggaggttttggcttcaccaataatgatgctatacactagcatagtagtatttgagtcattttgaatacaaggttagaagtactcttgagaatttttctattggaaaaagttctatatttttaatagaaaagctctaaaaaacacttctggtttgtatccaaacataccatatatatctttgatttcgtctcttgataaaaaaaaaaaaaaaa

SEQ ID NO: 4030 - protein, 223 aa, Glycine max
  misc_feature: PFam Name: efhand; PFam Description: EF hand
  misc_feature: GI Number: 66765939; NR Description: calcium sensor
  misc_feature: GI Number: 20465717; NR Description: putative calcium sensor-like protein [Arabidopsis thaliana] >gi|17381074|gb|AAL36349.1| putative calcium sensor homolog [Arabidopsis thaliana] >gi|10177086|dbj|BAB10392.1| calcium sensor
  misc_feature: GI Number: 50907083; NR Description: putative calcineurin B [Oryza sativa (japonica cultivar-group)] >gi|47847964|dbj|BAD21753.1| putative calcineurin B [Oryza sativa
  misc_feature: GI Number: 50907095; NR Description: putative calcineurin B [Oryza sativa (japonica cultivar-group)] >gi|47847971|dbj|BAD21759.1| putative calcineurin B [Oryza sativa
  misc_feature: GI Number: 50932465; NR Description: putative calcineurin B-like protein 8 (CBL8) [Oryza sativa (japonica cultivar-group)] >gi|45680422|gb|AAS75223.1| putative calcineurin B-like protein [Oryza sativa (japonica cultivar-group)] (CBL8) [Oryza sativa
MGCYCSTSKKTEAQGYEEPTVLASVTPCEYHDPSLNVTVSEVEALHELYKKLSNSIIEDGLIHREEFQLALFRNKNKKNLFADRIFDLFDLKRNGVIEFGEFVRSLGVFHPNAALEDKITFAFRLYDLRQTGFIEREELKEMVLALLHESDLELSDDMIETIVDKTFSDADINGDGRIDQDEWKAFVSKHPSLIKNMTLPYLKDITLAFPSFVTGTDIEESEM

SEQ ID NO: 4031 - DNA, 1429 bp, Glycine max
  misc_feature (1)..(1429): Ceres cDNA ID no. 21666042
  misc_feature (1)..(1429): Ceres CLONE  ID no. 1172029
  misc_feature (1)..(1429): Also known as  Ceres CDNA ID no. 23709685
gagaatctcatttttcttttttccttttttgtgttgagcacttttccctaacaaagtaaataatatcctttacgtcacatcttcactatctggtcatcagttctaccgctttctagacaatatcgttggattgcatatttcaagtgtttctctttctctctccaaatcctattcatcctttccttcaccactcacaaatactcatattctcacaaatcattcaaaggaagcatcaataagaaatggataatagcaattcagctgcaacgaccggtgtctggaatgattttcggtcaattgatataataataacaatacttatgaacctcaatgttgtggaccttgcagttgcctcgctggtctgcaaaatgtggaacaaagcttgtcatgacccatctctttggcgcaaaattgatctgtccgaactcaataactcataccttttcaacatacaaaataataaaccgggagcttacaagcattcgagggggaaaattactcaattcttaaagtatgttttgagtctgagtaatggaaatacaaattgcttaatatttaactacaatgttgacttaacggatgagcagttcatcatagctgctgaaaagaccccaaatctgaaacgactagttctaccaaagacatgtgtcttttcaagaaaagcagtgcatacggcaatgaagtcatgggggggcctagagtccattaccatttccttcgatgaccccaataaatacatattttctgcaattgccaaatactgcaagaacataacagagatgaaatttagtcacggttgcctcctctttgaagaaaattatgttaaagcgctgcttaaatgtgcccctaacttgaaggctttgagcattcggtgcataatgacaagcatgggtgctttgtgcggtgtgttcacttccttccaacatttggaggcggtgaatatatgccatagctccattatagatgcaccatattctgattttggtgttgtggatattacttatgtacaaaagcatttgccgccatcgaattacggaaagcttatatactgtaaagaaggatcatgccttaggtgcaagaatgacaggagcattattcctgccggaattttccaaattacaagcattcttatccatgcctcagaggatttgtggcgggaggacgagataacctctcttgcacattaatttatctgaatatgtttgtttgtgctgcatcaaaccttgttaattatttgggtctcactcattttgtgcttcaagtaattaactttcatagacatttaattaccttttgttgattcctgtctaaacatgttttcttgtgctattagcctatccatttacttggataaaactttgattgttaattgttgatttgctataaggatgtataagctagtacttttgctggaaaaaaaaaaaaaaaa

SEQ ID NO: 4032 - protein, 314 aa, Glycine max
  misc_feature: PFam Name: F-box; PFam Description: F-box domain
  misc_feature: GI Number: 21618163; NR Description: unknown [Arabidopsis thaliana]
MDNSNSAATTGVWNDFRSIDIIITILMNLNVVDLAVASLVCKMWNKACHDPSLWRKIDLSELNNSYLFNIQNNKPGAYKHSRGKITQFLKYVLSLSNGNTNCLIFNYNVDLTDEQFIIAAEKTPNLKRLVLPKTCVFSRKAVHTAMKSWGGLESITISFDDPNKYIFSAIAKYCKNITEMKFSHGCLLFEENYVKALLKCAPNLKALSIRCIMTSMGALCGVFTSFQHLEAVNICHSSIIDAPYSDFGVVDITYVQKHLPPSNYGKLIYCKEGSCLRCKNDRSIIPAGIFQITSILIHASEDLWREDEITSLAH

SEQ ID NO: 4033 - DNA, 1148 bp, Glycine max
  misc_feature (1)..(1148): Ceres cDNA ID no. 21666043
  misc_feature (1)..(1148): Ceres CLONE  ID no. 1235754
  misc_feature (1)..(1148): Also known as  Ceres CDNA ID no. 24356368
actggaccgcaacgattaaaaggaaaaaaattataacatacaaaatagctccgatcgcaaatataaattatttgtggaattcccttttcactaaatttattgttttattcctctcttggttctcttgcaaaagcaaatcaatggcaaaagaatcgggatcatccaagattgaaatgttagagattagcaatgaagcaatggcagaagcacaatcatccaagattgaaatgttagagattaacaatgaagcaatggcagaagcacaatcatccaagacggtaacaatgaagcccgcggaggcagaagaatccaagacggaaacacagaaaatcaccgacgaagaatcaaagaacgttccgattgcggctacagaagaagaatcgaagaagctttcgatcactaaggtagaagaatcgaagaatgccgcaaccgcaacaaccgagggagagaaagaagaagcgaaggtttcgctaaagaccttagacggtgtcacctttgaggtggaagcgtggatcgcgaaggagatggagacggtgcaggcctacatcgatgacacctccgccgacacctccgccgccatcgcaattccgctccacaacgttgccggccgcgaactcgcccggatggtggagtactgcaaggagcaccgccgtgcctccgtctccgccggcaacctgaaggagttcgaggagcggttcgcggcggcgctgaacctctacgagatgaaggatctgatcatcgctgcgaattacctcaacacgaagaagctcctcgagtctctgagtcgttgcattgctaaagccatcaagaacaagagcgtggagttcgtgagggattattttggggttacgaacgattacacgacggaggaagaggcgcagtatcgcgaaacgaacgcctgggcctttcggaacgtcgatgaggattcaaggaattagggttttggtggttaaaatattgagattatagattgaagtttatctttaaaattaggggtttagtggtgaaaatactgagattattatagattaaaatttatcatcttcgcaattcgcaatatatagtagacaacatgaacttttcgtgattctttagaaggaataaatagtcctttttttcaaaaaaaaaaaagaaaaaaaaaaaaaaaa

SEQ ID NO: 4034 - protein, 265 aa, Glycine max
  misc_feature: PFam Name: Skp1; PFam Description: Skp1 family, dimerisation
  misc_feature: GI Number: 51292007; NR Description: SKP1 [Nicotiana tabacum]
  misc_feature: GI Number: 29468341; NR Description: SKP1 [Nicotiana benthamiana]
  misc_feature: GI Number: 3551838; NR Description: SKP1-like protein
  misc_feature: GI Number: 3548813; NR Description: E3 ubiquitin ligase SCF complex subunit SKP1/ASK1 (At14), putative [Arabidopsis thaliana] >gi|7488338|pir||T02709 probable kinetechore (Skp1p-like) protein
  misc_feature: GI Number: 50899298; NR Description: putative SKP1 [Oryza sativa (japonica cultivar-group)] >gi|49387820|dbj|BAD26413.1| putative SKP1 [Oryza sativa (japonica cultivar-group)] >gi|49388748|dbj|BAD25948.1| putative SKP1 [Oryza sativa
MAKESGSSKIEMLEISNEAMAEAQSSKIEMLEINNEAMAEAQSSKTVTMKPAEAEESKTETQKITDEESKNVPIAATEEESKKLSITKVEESKNAATATTEGEKEEAKVSLKTLDGVTFEVEAWIAKEMETVQAYIDDTSADTSAAIAIPLHNVAGRELARMVEYCKEHRRASVSAGNLKEFEERFAAALNLYEMKDLIIAANYLNTKKLLESLSRCIAKAIKNKSVEFVRDYFGVTNDYTTEEEAQYRETNAWAFRNVDEDSRN

SEQ ID NO: 4035 - DNA, 1291 bp, Glycine max
  misc_feature (1)..(1291): Ceres cDNA ID no. 21666044
  misc_feature (1)..(1291): Ceres CLONE  ID no. 1236970
  misc_feature (1)..(1291): Also known as  Ceres CDNA ID no. 23710477
agctgcaaactaaaccaattttcttcgtctgtgtaacaaacacttcaacaatctactctatacccgatttacaagatgagttcatttagccaaaatccctatgttttagttctgttcctcgttctcactgtgtggatatcccgtgtaatgtctcgcgggctcattacatctgagagacatgagaaatggatggcacaatatggtaaggtttacaaggatgctgcagagaaggagaaacgtttccaagtattcaaaaacaatgtgcagttcattgagtcattcaatgctgctggggacaaacctttcaaccttagcattaaccaatttgcggaccttcatgatgaagaatttaaggctttactaattaatgttcagaaaaaggcaagtagggtggagacagcaacagaaacatcgtttaggtatgagaatgtaactaagattccttctaccatggactggaggaaaagaggtgctgtcactccaatcaaggaccaaggctacacatgtggaagttgttgggcatttgcaactgtggctactgtcgagagtctccatcaaataactacaggtgaattggtgtccctatcagagcaagaactagtagattgtgttagaggtgacagtgaaggctgccgtggtggttatgtggaaaatgcctttgaatttattgctaataaaggtggaataacaagtgaagcatactatccttacaaaggaaaagatagaagttgtaaggttaagaaggagactcatggtgtggcacggattatagggtatgagagtgttccttctaatagtgaaaaggcactcctaaaagctgtggcaaatcaaccagtttcagtttatattgatgcaggagcaattgctttcaaattttactcaagtgggatttttgaagcaagaaattgtggaactcatctagaccatgctgttgcagttgttggttatggtaaacttcgtgatggtacaaagtattggctagtaaaaaattcatggagcactgcatggggtgagaaagggtacatgaggatcaagcgagacatacgtgccaagaaaggcttatgtggaattgcttcaaatgcctcttatccaatcgcttaataagtgttcttgataattcatataaatctgaaaaggtcattataatcgtatatatgcacgcatctaccaaaaaataaataatcgtatatgcacgcataggttgtgctagtactaaaattgcgtgtaaacttttatttcaaccatatataatgagaataagatattgctagtacgaaaaaaaaaaaaaaaa

SEQ ID NO: 4036 - protein, 341 aa, Glycine max
  misc_feature: PFam Name: Peptidase_C1; PFam Description: Papain family
  misc_feature: GI Number: 13491750; NR Description: cysteine protease
  misc_feature: GI Number: 50355621; NR Description: cysteine protease
  misc_feature: GI Number: 24285904; NR Description: cysteine proteinase
  misc_feature: GI Number: 40806498; NR Description: putative cysteine
  misc_feature: GI Number: 535454; NR Description: cysteine proteinase
MSSFSQNPYVLVLFLVLTVWISRVMSRGLITSERHEKWMAQYGKVYKDAAEKEKRFQVFKNNVQFIESFNAAGDKPFNLSINQFADLHDEEFKALLINVQKKASRVETATETSFRYENVTKIPSTMDWRKRGAVTPIKDQGYTCGSCWAFATVATVESLHQITTGELVSLSEQELVDCVRGDSEGCRGGYVENAFEFIANKGGITSEAYYPYKGKDRSCKVKKETHGVARIIGYESVPSNSEKALLKAVANQPVSVYIDAGAIAFKFYSSGIFEARNCGTHLDHAVAVVGYGKLRDGTKYWLVKNSWSTAWGEKGYMRIKRDIRAKKGLCGIASNASYPIA

SEQ ID NO: 4037 - DNA, 994 bp, Glycine max
  misc_feature (1)..(994): Ceres cDNA ID no. 21666045
  misc_feature (1)..(994): Ceres CLONE  ID no. 1240096
  misc_feature (1)..(994): Also known as  Ceres CDNA ID no. 24363652
actcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatccatagatccaaaaaaattattcagtgtttttttatatatttttttaagttatttgggattaatttgttcttgtacatatatagtacttgggccttattcgctagttttagcttttagattgtagtatacttttgacagtggtgattcaattcaattcatttatttttatttgtaaaaaaaaaaaaaaaa

SEQ ID NO: 4038 - protein, 233 aa, Glycine max
  misc_feature: PFam Name: zf-C2H2; PFam Description: Zinc finger, C2H2 type
  misc_feature: GI Number: 7228329; NR Description: putative TFIIIA (or
  misc_feature: GI Number: 4666360; NR Description: zinc-finger protein 1
  misc_feature: GI Number: 32441471; NR Description: zinc finger protein
  misc_feature: GI Number: 55734108; NR Description: zinc finger DNA-binding
  misc_feature: GI Number: 439493; NR Description: zinc-finger protein
MALEALQSPTTATPSFSPFEETSLSYLETPWTKGKRSKRSRTEQQLQHPSCTEEEYLALCLIMLARGGAGSVSTAKPAVSDNNSAPLSAAKLSYKCSVCNKAFSSYQALGGHKASHRKLAGENHPTSSAVTTSSASNGGGRTHECSICHKTFSTGQALGGHKRCHYEGGNSAVTASEGVGSTHTGSHRDFDLNLPAFPDFSARFFVDDEVTSPHPSKKSRFNLTIPKIEIPQY

SEQ ID NO: 4039 - DNA, 1471 bp, Glycine max
  misc_feature (1)..(1471): Ceres cDNA ID no. 21666046
  misc_feature (1)..(1471): Ceres CLONE  ID no. 1240189
  misc_feature (1)..(1471): Also known as  Ceres CDNA ID no. 24360144
aattcgtctctttcattcaaggaggttacatataatcactgtccccaacacatcaccatgagtccttgtatcaagaagaacactagaagtactgaaattgaattcgttgatcagttagaagctggtggagaagaattagcacatgcagatctagtttctcccatggacaacacaacattgcagctgcatgcagatcaaaagggtagcagtagcactaacaagaggtacattaacatcaacatcaatatgccccttttggtgattaactatgcatgtctctttgtgggttcactttcttctagtttgctatctaagtactatttcacccacaagggttcaagtagatgggtttcaacttgggttcaaaccgcaggatttcctcttttgttaatcccaatttgtgttccttatctctttaaattcaccaagagggtaccctttaatgatttcacaccaagaatgttgattatctcaatttcaatcggagttatgttaggattcaacaaccttttcttctcatggggaaactcctaccttcccgtttcaacctcagcacttttgctatcttcccaactactcttcaaccttctcttctctgtcatcatagtgaagcaaaaaataaccttttcaaacgtgaactgcgtgatccttctcaccctaagctccatccttatagccttggactctagccacgagagaccaaaagggctaactcaaaagaactacttcattggattcttttgcaccataggggcaggtttgatgtttgccttgtacttgccactaatggagaagatttacaagaaggtgaattgctaccaaatggtgatggaaatgcaagtgataatggagggtgcagcaacagcattggccatagttggcatgacatgggatggtggattttctgagatgaaggtagaaagccaaatggtctttgacaaaggaagcagagtttattgggtgacagtgatgggaaatgtggtgacttggcagctatgtttcatgggaactgcaggaatggtattcctgacatcttcattgactggggggatttgcatgacatttttgttgtccatgaatgtgttaggaggtgtcgtgttcttcagagatgcatttggtggtgtcaaagctgtgtccacttttctctgcattttggggttctgttcttatgtttatggcatctacaaggataaccaaatgggggaacacaaattagcttcaaccaggaacaagactattagtagtaatgcttcatccactgagatgatccacattgtgaattattgaactatatatgtgatatagttcacaatgtcatccgagtgtaattagctagattgacaagattgccaatcgttaattgtagatgtcaaaatgtcaatattctcctagttacatctatgtggatatcatgtacagtcgaaaaattgttgtgtataaatttactcttcagttaaaaaaaaaaaaaaaa

SEQ ID NO: 4040 - protein, 409 aa, Glycine max
  misc_feature: GI Number: 34911172; NR Description: putative purine permease [Oryza sativa (japonica cultivar-group)] >gi|20161112|dbj|BAB90042.1| putative purine permease [Oryza sativa (japonica cultivar-group)] >gi|21644687|dbj|BAC01243.1|
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 9795614; NR Description: purine permease [Arabidopsis thaliana] >gi|26450405|dbj|BAC42317.1| putative purine permease [Arabidopsis thaliana] >gi|28973199|gb|AAO63924.1| putative purine permease [Arabidopsis thaliana]
  misc_feature: GI Number: 7620007; NR Description: purine permease
MSPCIKKNTRSTEIEFVDQLEAGGEELAHADLVSPMDNTTLQLHADQKGSSSTNKRYINININMPLLVINYACLFVGSLSSSLLSKYYFTHKGSSRWVSTWVQTAGFPLLLIPICVPYLFKFTKRVPFNDFTPRMLIISISIGVMLGFNNLFFSWGNSYLPVSTSALLLSSQLLFNLLFSVIIVKQKITFSNVNCVILLTLSSILIALDSSHERPKGLTQKNYFIGFFCTIGAGLMFALYLPLMEKIYKKVNCYQMVMEMQVIMEGAATALAIVGMTWDGGFSEMKVESQMVFDKGSRVYWVTVMGNVVTWQLCFMGTAGMVFLTSSLTGGICMTFLLSMNVLGGVVFFRDAFGGVKAVSTFLCILGFCSYVYGIYKDNQMGEHKLASTRNKTISSNASSTEMIHIVNY

SEQ ID NO: 4041 - DNA, 1176 bp, Glycine max
  misc_feature (1)..(1176): Ceres cDNA ID no. 21666047
  misc_feature (1)..(1176): Ceres CLONE  ID no. 1241731
  misc_feature (1)..(1176): Also known as  Ceres CDNA ID no. 24356384
accagcttcagtgtctgcatgtgatttaggggttggatagcaagaaaccctgtaaaggtttcttaaccaagcaactcctaaaccttctggtcaaattttacttaaaaccctaaagcagacaaagagaggtcatggctctgaacagtcacaatcatttggctttagcttttggcatgctaggaaacgtcatttccttcatggtgtacttggcacccctgccaacattttaccgaatatacaaaaagaaatccacagaaggtttccaatcactgccttacctggtggcactcttcagttccatgctttggctatactatgcctcactcaagccagctgatgctactctcctcattaccattaattcattgggatgtgtcattgagattgtttacattgtcatgttcacaatctatgccaccaaggatgccaggaacttaaccgtcaaattatttatggtgatgaacgtgggttccttcgccttgatcttcctcgtcacctactttgctatacatggctccctacgtgtccaagtcgttggatgggtttgtgtatctattgcagttggtgtttttgcggcacctctcagcattgtggctcaggttattcgaaccaagaatgtcgagtttatgccgtttaacttgtcacttttcctcaccctaagtgccgtaatgtggtttttctatggcctcttactcaaggacatatgcattgctatcccaaatattcttggcttcacattgggactgcttcagatgttgctctatgcaatttacagaaatggtaaaactaacaataaggaagttgctacaaaggaggagaaagcactagaggcaataatgaaaaacgttgttgtggtgaacccgttgggaacgtgtgaagtgtacccagttatcaataaagagaataacaatggacaaggaatagaaggtgccaaagagaaggaatgcccagtgtgaaatggttttaatattatatatatatatatatatatatatatgctcagtgcaattgttacagacagaagcacttcgaagcatactaggaaatggtttttctctttataataatattgatatattatgtgtatacccgtttatgtcggtgatcaactgttatgttaaaatattctagtaatttattatgaatcatgttcgttctctaaaaaaaaaaaaaaaa

SEQ ID NO: 4042 - protein, 274 aa, Glycine max
  misc_feature: PFam Name: MtN3_slv; PFam Description: MtN3/saliva family
  misc_feature: GI Number: 1619602; NR Description: MtN3 [Medicago truncatula]
  misc_feature: GI Number: 21593422; NR Description: senescence-associated
  misc_feature: GI Number: 21281010; NR Description: putative senescence-associated protein SAG29 [Arabidopsis thaliana] >gi|15028293|gb|AAK76623.1| putative senescence-associated protein SAG29 [Arabidopsis thaliana] >gi|9955561|emb|CAC05445.1|
  misc_feature: GI Number: 20465523; NR Description: putative MTN3 protein [Arabidopsis thaliana] >gi|17979365|gb|AAL49908.1| putative MTN3 protein [Arabidopsis thaliana] >gi|6523105|emb|CAB62363.1| MTN3-like protein [Arabidopsis thaliana]
  misc_feature: GI Number: 21358848; NR Description: putative MtN3 protein [Arabidopsis thaliana] >gi|16323440|gb|AAL15214.1| putative MtN3 protein [Arabidopsis thaliana] >gi|15982723|gb|AAL09814.1| putative MtN3 protein [Arabidopsis thaliana]
MALNSHNHLALAFGMLGNVISFMVYLAPLPTFYRIYKKKSTEGFQSLPYLVALFSSMLWLYYASLKPADATLLITINSLGCVIEIVYIVMFTIYATKDARNLTVKLFMVMNVGSFALIFLVTYFAIHGSLRVQVVGWVCVSIAVGVFAAPLSIVAQVIRTKNVEFMPFNLSLFLTLSAVMWFFYGLLLKDICIAIPNILGFTLGLLQMLLYAIYRNGKTNNKEVATKEEKALEAIMKNVVVVNPLGTCEVYPVINKENNNGQGIEGAKEKECPV

SEQ ID NO: 4043 - DNA, 1394 bp, Glycine max
  misc_feature (1)..(1394): Ceres cDNA ID no. 21666048
  misc_feature (1)..(1394): Ceres CLONE  ID no. 1242419
  misc_feature (1)..(1394): Also known as  Ceres CDNA ID no. 24361163
aaaattataagaaaaagaaaggaaaaagaagtaaagcatgaacgaacacctcagaacttttgcacttcaactcagctactcaacaacgacgccaaaatcctcttccacaccgcacactgcttcttccgttctctcaaggtttctttacactgaaattcagtaagaaatttggaaaactggcataatggaagacaacgactacataaggagatgggaggatctggacatagatattttggtgaagatttttcagttgcttgacatttttgagttgacatccggcatctctcgtgtttgtagtgcatggcgcttggcatgttgtgatccacttctctggaaaacactagatttgtcgatgttaagatctaacttcatcaagatcccattagagccatttgtttatgttgatggacgatctgataggacattaacgcgtatattgaagatttccctgagtctcagccagcagagtataatgactttgatcttccatttcaacttgtacgtaagtgatgaacagttgacatacactgctgaaaggtgcccacagctcaggcgactcgttctgccagcttggaacagaatcaagaaaccaggaatgtgcaaagccattcgtggctggaaagagttagagtccctgacaatgccttgtatagcaaatccaccatatattttggaggaaatctcaacgcactgcaagaactttagcgaactcaagattatggggccatgtgacattttctttgcttcatcacttgctgcgtttcttccaaaattaagagtcttgagcctacgatgctcaatgctatataaggatgttctcattctcatccttgacagcttacaacacttggaagtgctcaacatatcacattgtgttctgatggaagccctcccagctcctcaacagaaaagaatcattaaagaaattgatgtgactattcgtcagaaggcttctcggttacgtgaatttctcacatgcatggaagactcatgtgtcatgtgccaacgaacaagaactgatgaaggactgattaggtggtacaagtacgaggaagggctttggaaaacagatgaggtgaggtctctctcactttaggcaatcggaagcgatctagttgttaatgctcatgtcacattttctgttgttaagtaatgctgccaccttaagtgtagatccaaataaacaaagtttaattcttacagatgaatgctgttgcaccctctaggagttagccaaatcttgtaactgtatataggaacaataagttttgtttctgtagttggtttcattttgagaagtgttctaaatcatgaaaatttgttaagacagtaattatggttctttatagaagtgtgatgagattagttttgggctaaaaaaaaaaaaaaaa

SEQ ID NO: 4044 - protein, 304 aa, Glycine max
  misc_feature: PFam Name: F-box; PFam Description: F-box domain
  misc_feature: GI Number: 21618163; NR Description: unknown [Arabidopsis thaliana]
  misc_feature: GI Number: 37535806; NR Description: putative Rhizobium-induced nodule development associated protein [Oryza sativa (japonica cultivar-group)] >gi|10140788|gb|AAG13618.1| putative Rhizobium-induced nodule development associated protein
  misc_feature: GI Number: 50907533; NR Description: putative N7 protein [Oryza sativa (japonica cultivar-group)] >gi|46389931|dbj|BAD15715.1| putative N7 protein [Oryza sativa
  misc_feature: GI Number: 5732065; NR Description: contains similarity to Medicago truncatula N7 protein (GB:Y17613) [Arabidopsis thaliana] >gi|30692594|ref|NP_849530.1| F-box family protein [Arabidopsis
  misc_feature: GI Number: 7267309; NR Description: N7-like protein [Arabidopsis thaliana] >gi|25376526|pir||A85069 N7-like protein [imported] - Arabidopsis thaliana >gi|18412951|ref|NP_567296.1|
MEDNDYIRRWEDLDIDILVKIFQLLDIFELTSGISRVCSAWRLACCDPLLWKTLDLSMLRSNFIKIPLEPFVYVDGRSDRTLTRILKISLSLSQQSIMTLIFHFNLYVSDEQLTYTAERCPQLRRLVLPAWNRIKKPGMCKAIRGWKELESLTMPCIANPPYILEEISTHCKNFSELKIMGPCDIFFASSLAAFLPKLRVLSLRCSMLYKDVLILILDSLQHLEVLNISHCVLMEALPAPQQKRIIKEIDVTIRQKASRLREFLTCMEDSCVMCQRTRTDEGLIRWYKYEEGLWKTDEVRSLSL

SEQ ID NO: 4045 - DNA, 1178 bp, Glycine max
  misc_feature (1)..(1178): Ceres cDNA ID no. 21666050
  misc_feature (1)..(1178): Ceres CLONE  ID no. 1243341
  misc_feature (1)..(1178): Also known as  Ceres CDNA ID no. 24356372
caaaaatccattactactagtgagtagtgactttttcattcaatttcctaacttttttctctttccattgttcttcttttttcactcccaacaccaatggcattccatgatttactcttcacacccaccatttccctcttcataattctattttctctcttttccaccccttcccattctgccctcacttgcgcttcccagaagctcaaccgcacctacgccaactgcaccaaccttcccaccctcggcgccaccctccacttcaccttcaacgccactaaccgctccctctccgtcgccttctccgccgagcctccctcccgctccggctgggtcgcctggggcctcaacctcgccggcgatggcatgcgcggcgccgaagccttcctcgccttcccctcctccgcctccgcctccgccatcaccctcggccgctacaacctcacctcctacaaagccatcgacgaagtcaaagcctttaccttcgactcgtgggacctcgcggccgaagaatccaacggcgccgtaaccatctacggctccgtcaagatccccgattcggcgaggaacgtcagccacgtgtggcaggtgggtcccgtggccgcgggcaagcctggggtccacagcttcgaaaagaagaatacggactccaaggccgcgttccctgtcgcgctggtggggcccaacacaactacaccagcgagtggcgaaaacgcgactgcgcccgcgagtggtggggacaagaagaacggtgctgctggggagagctttggggttgggttttacttttggttggttttcgcattgatgattggtgtcgttgctatttgatgtgattctttttcaccgttttaccttttaccccctggagcagggtcattcaataatttttactgtactgggacatttggatttttttttaatatttgttgtattgtaggttttttttttttttttaatctgtacgcgtcgttttgggggttttatttggggatggtagatccgtagatgggttgtgcctgttgtgttagaaattcaaattctgcttttagaatgaacatgtagttattggaatcggatttttcgttttaagggatattgtagttgctagccgtttcgtttcgatgatgttgatatgatgataacataccaattcctgtgtaaaaaaaaaaaaaaaa

SEQ ID NO: 4046 - protein, 244 aa, Glycine max
  misc_feature: GI Number: 50947767; NR Description: putative auxin-induced protein [Oryza sativa (japonica cultivar-group)] >gi|42407746|dbj|BAD08893.1| putative auxin-induced protein [Oryza sativa (japonica cultivar-group)]
  misc_feature: GI Number: 21592781; NR Description: putative membrane
MAFHDLLFTPTISLFIILFSLFSTPSHSALTCASQKLNRTYANCTNLPTLGATLHFTFNATNRSLSVAFSAEPPSRSGWVAWGLNLAGDGMRGAEAFLAFPSSASASAITLGRYNLTSYKAIDEVKAFTFDSWDLAAEESNGAVTIYGSVKIPDSARNVSHVWQVGPVAAGKPGVHSFEKKNTDSKAAFPVALVGPNTTTPASGENATAPASGGDKKNGAAGESFGVGFYFWLVFALMIGVVAI

SEQ ID NO: 4047 - DNA, 965 bp, Glycine max
  misc_feature (1)..(965): Ceres cDNA ID no. 21666052
  misc_feature (1)..(965): Ceres CLONE  ID no. 1245834
  misc_feature (1)..(965): Also known as  Ceres CDNA ID no. 23489901
cttcaatttcccttccgatcatcccgaatcctcgagatttctttcgattgaactcatttctctcttcttcgccacgcactcttgtctctgtaagcggtgattttggttctggacaatgtctcgtgtttatgttgggaatttagaccctcgagtcagtgagagggacctcgaagatgaatttcgtatatatggtgttcttaggagtgtctgggttgctcgaagaccaccgggatatgcatttattgagtttgatgataggagggatgcacttgatgcaattcaggccttggatggaaaaaatggttggcgtgtagagctttctcataattccaagggtggtggccgaggagggcgtgggcgtggaggtgaagacacaaaatgctatgaatgtggtgaacctggacactttgctcgggagtgccgattgcgcattggatcacgtggccttggaagtggaaggaggcgaagtccaagtccttatcggcgtcgtagaagtccgagttatggttatgatcgcagtagttatagccctcgtgggagaagatctccaagacgacgtagcatttcacctccctggggtcgcaactacagcaggtcccctccatatcgtcctcgccgtgattcaccttatgccaatgcagattaaaatcagaatgtgaacggagcaagtgctgaatagttgttaggatgttctctctgctatagtgtagttcctctaggattggttgagcataccacagacatgttagttatgttaatgtcatgacaatgggtattgttaagaacttggcttttgatggaactacatagggttgtagctggcaaaagggtgcgttggacactgttttgcattggctgtctctcttcagcttactgaaacctgaaggttgcttcagtcttccctactttatatagcatgttatgttaattgtttgtttttagtcttactaaaaaaaaaaaaaaaa

SEQ ID NO: 4048 - protein, 176 aa, Glycine max
  misc_feature: PFam Name: RRM_1; PFam Description: RNA recognition motif.
  misc_feature: PFam Name: zf-CCHC; PFam Description: Zinc knuckle
  misc_feature: GI Number: 3435096; NR Description: SRZ21 [Arabidopsis thaliana] >gi|42571621|ref|NP_973901.1| splicing factor RSZp21 (RSZP21) / 9G8-like SR protein (SRZ21) [Arabidopsis thaliana] >gi|18395314|ref|NP_564208.1| splicing protein 21 [validated] -
  misc_feature: GI Number: 2582643; NR Description: RSZp21 protein [Arabidopsis thaliana] >gi|25294319|pir||T52628 splicing factor
  misc_feature: GI Number: 51091721; NR Description: putative splicing factor, arginine/serine-rich 7 [Oryza sativa (japonica
  misc_feature: GI Number: 25294317; NR Description: protein T23E23.2 [imported] - Arabidopsis thaliana >gi|9369411|gb|AAF87159.1|
  misc_feature: GI Number: 51979265; NR Description: PREDICTED OJ1476_F05.20 gene product [Oryza sativa (japonica cultivar-group)] >gi|51964158|ref|XP_506862.1| PREDICTED OJ1476_F05.20 gene product [Oryza sativa (japonica cultivar-group)] (RSZP22) [Oryza
MSRVYVGNLDPRVSERDLEDEFRIYGVLRSVWVARRPPGYAFIEFDDRRDALDAIQALDGKNGWRVELSHNSKGGGRGGRGRGGEDTKCYECGEPGHFARECRLRIGSRGLGSGRRRSPSPYRRRRSPSYGYDRSSYSPRGRRSPRRRSISPPWGRNYSRSPPYRPRRDSPYANAD

SEQ ID NO: 4049 - DNA, 1203 bp, Glycine max
  misc_feature (1)..(1203): Ceres cDNA ID no. 21666053
  misc_feature (1)..(1203): Ceres CLONE  ID no. 1246182
  misc_feature (1)..(1203): Also known as  Ceres CDNA ID no. 23468965
attctccgtttctcagtcttcctttcctctctctctcgtttgcattcatgtgagggtgattttgcagagagttaacagcacaaaccactcactctcttaacttgaggttattttttttctttccccaaacccaaagaggcatgagttgcaacgggtgccgcgtccttcgaaagggttgcagcgagtcttgtatcctgcggccgtgtctacagtggatcgatacgcccgaagcacaaggccatgccactgtcttcgttgccaaattctttggccgtgccgacctcatgtccttcatttccaacgtccctgaaccccaaaggcccgctctgtttcaatctctgttgttcgaagcgtgtggaagaacggtgaaccctgtcaacggtgctgttgggcttttatggaccggaaactggcacgtgtgccaggcggcggttgagacggtgctccgcggcggcaccgtcaggcccatgccggagcttctcggcctagacgctcccactcccactgccgatgacgcttccgaaggggaagttacctgtaccgacaagtggagagtccgagatccgaacccgaatttcccgggaacccggttcccgggttcgaggtccgataaggccggttctggtggcaaacgcaagcgatttgaagagctcgccaagcttcagacggcgacgacggatctcaatctccggctgacgccgagttttctgcagaacgcggctagctacggctgccggcaggaaattcgctggccagggtcgccgtcaatgaattccgaggagtccgggacgacgacggcgtgcttggagagcgggatcggagatcactacgctcacgacggagaccggaaagtgctgaaccttttcatttgagagttctctttcgctctccgagattcgtgtttgagggttctcgctgacgcgtctttttgccttttttttataacgctttattttgagaaagaggttttcccggaattgaatccggtgagattttgtaagaataccggcacaggatttttctctctgttgttcttgctagacagggagagaaagatgagggttagtcggtgatgatttttccttttttcttttcttttttttcccctttgagctatcaaacatgttatgatggtgtgacatgaatgatgaaatattaaataacttaatacatagttcttttatattaaaaaaaaaaaaaaaa

SEQ ID NO: 4050 - protein, 243 aa, Glycine max
  misc_feature: GI Number: 21593577; NR Description: unknown [Arabidopsis thaliana]
  misc_feature: GI Number: 21553886; NR Description: unknown [Arabidopsis thaliana]
  misc_feature: GI Number: 21592894; NR Description: unknown [Arabidopsis thaliana]
  misc_feature: GI Number: 50938833; NR Description: putative lateral organ boundaries (LOB) domain protein 37 [Oryza sativa (japonica cultivar-group)] >gi|34394489|dbj|BAC83753.1| putative lateral organ boundaries (LOB) domain protein 37 [Oryza sativa (japonica
  misc_feature: GI Number: 34914608; NR Description: P0520B06.17 [Oryza sativa (japonica cultivar-group)] >gi|20804498|dbj|BAB92193.1|
MSCNGCRVLRKGCSESCILRPCLQWIDTPEAQGHATVFVAKFFGRADLMSFISNVPEPQRPALFQSLLFEACGRTVNPVNGAVGLLWTGNWHVCQAAVETVLRGGTVRPMPELLGLDAPTPTADDASEGEVTCTDKWRVRDPNPNFPGTRFPGSRSDKAGSGGKRKRFEELAKLQTATTDLNLRLTPSFLQNAASYGCRQEIRWPGSPSMNSEESGTTTACLESGIGDHYAHDGDRKVLNLFI

SEQ ID NO: 4051 - DNA, 1201 bp, Glycine max
  misc_feature (1)..(1201): Ceres cDNA ID no. 21666054
  misc_feature (1)..(1201): Ceres CLONE  ID no. 1247109
  misc_feature (1)..(1201): Also known as  Ceres CDNA ID no. 0
attttcatactaaattacatagacaaaaatgtccaatccttcttctttctctggtttttctgaaaggtatggagtgttttgacatctggaaaacgtcatggtgcactgtttagatggattaaagcagttgtatattgctgtaataaatttttgtgatgctgatttgtgcccagagcctagaggtttgcaacatccagaagtgctagcaagagaaacagtgtttagtgtaagtgagattgaagcactgtatgaactattcaagaagatcagcagtggagtaatggacaaaggattaattactaaggatgaatttcagttggccttattcaagacaaccaagaaagagagcttatttacagatagggtgtttgacttgtttgacacaaagcatagtggaatacttgatttcaaagagtttgcacttgctctctctgtctttcatcccagcgcatcaattgatgataagattgagttttcattccaattgtatgatctcaaacaacaaggatttattcagagacaggagttaaaacaaatggtggttgccactctagctgaatctggcatgaatcttgcagatgatgtgattgaaagcatcattgacaagactttcgaggaagttgatacaaaacatgatgggaagattgacaaggaagaatggcgaaaccttgtcttgcagcatccatcccttctaaaaaatatgactcttcagtatctcaaagatattacaactacatttcccagttttgtatttcactcacaagttgatgatgtttgaggcagctacatcatctatgtcagtttctctggtgttggctgagaaggttcttgtttcccttgagagtggtgaaattctgtgagaaggatatggttaaaatggaaatgggctatttatattttcattgaacagaacttttccttccctttttgggtagatgaggtttgtgtttcgaataaatggatttaattatttatttgcttcattattattaggaatgaaagtagcataggatagaatatacaggtgtttcagaaatagcactagaaacttttggatagaaatatattttgccattatggcttctaaacggctccagtgagcttaggtgcagagttaagaatttgtatggcaggtttcagcttttgtgccttaaaaaggctaaaaccaatatcgtcctttctattaaaaaaaaaaaaaaaa

SEQ ID NO: 4052 - protein, 226 aa, Glycine max
MVHCLDGLKQLYIAVINFCDADLCPEPRGLQHPEVLARETVFSVSEIEALYELFKKISSGVMDKGLITKDEFQLALFKTTKKESLFTDRVFDLFDTKHSGILDFKEFALALSVFHPSASIDDKIEFSFQLYDLKQQGFIQRQELKQMVVATLAESGMNLADDVIESIIDKTFEEVDTKHDGKIDKEEWRNLVLQHPSLLKNMTLQYLKDITTTFPSFVFHSQVDDV

SEQ ID NO: 4053 - DNA, 1189 bp, Zea mays
  misc_feature (1)..(1189): Ceres cDNA ID no. 21666056
  misc_feature (1)..(1189): Ceres CLONE  ID no. 1277411
  misc_feature (1)..(1189): Also known as  Ceres CDNA ID no. 24358413
gagtaggatcgtggatcgtacgagtagctcaagaaggaaacaaaacggcaggcttgcagttccaatccatcccgctggcatcgtctgttcttcgtccttccatgctctagactagctagcgttgcagtgcagagcatgacacaggcaggcatggagtagtgacatatagatggagctggcctggagctgctgctgcttcttgctcgccgcctgcgcgcgctctctccgtcgtctgctccagctccccgcgctcctctgctgcgaggccatggcgtgggcggtcaccttcctcgccttcccgctccgcatgctcaccgccgtcgagagggagcgcaagttggggtggctggttgcggagatgcaggcgcagatggacgacctggcgtgggagaacgcggcgctggaggacaggctgcgagcggcgctccgggagcgggaggccgtggaggcggtccttgatgacgtggaggacgagcacgaggacgccctcgccaggatccatgtcctcgacgcccagctcaaggcgctgaggcaggagaacgtgcggctgaacgagcacaagggcaagtccaggtgggacgacaagcccgcggcgcaggcgcaggcggcgtcccaccagtccgacgacaagctgaagccggcggccaagagggatcgggaagacgcggcggtggcgacgacagcccagtcagccaatcatgccggcggcggcccggcgtcggagccaccgccggtggacggctacgatgccctgcaggcgacggccgtggcgcggtgccgcagcctgttcagcctcggcatatcgctggcggtgggcgcggtggcgtggtcggccgacgcgccgtgcctgccgctgctggcggggctgttcgccgtcgtggccgtgtccatgcgcagcgtgtcgcggctgcgccggcgggccggggacgacggcgccgtcgcgctgctcggcctcaactggttcctcctcggcctgctcacctcgcccatgctgccggccgccctcggccccgcgctcacgtggctcgccgcaaccgcgcccctgtgacgtcccggccccggcccgctatttccgtttccgttcgatacacgtgtctgttgtaacttcttcacacgtactgtgctactgctgcctgcagtgtactactactgcatctctctttttcaagattccaaaaaaaaaaaaaaa

SEQ ID NO: 4054 - protein, 292 aa, Zea mays
  misc_feature: PFam Name: Sporozoite_P67; PFam Description: Sporozoite P67
  misc_feature: GI Number: 34905816; NR Description: P0483G10.12 [Oryza sativa (japonica cultivar-group)] >gi|15289923|dbj|BAB63618.1|
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 37575760; NR Description: circumsporozoite protein [Plasmodium vivax] >gi|40353695|gb|AAR84557.1| circumsporozoite protein [Plasmodium vivax] >gi|50295853|gb|AAT73179.1| circumsporozoite protein [Plasmodium vivax]
  misc_feature: GI Number: 52788769; NR Description: circumsporozoite protein [Plasmodium vivax] >gi|50295787|gb|AAT73146.1| circumsporozoite protein [Plasmodium vivax] >gi|50295777|gb|AAT73141.1|
MELAWSCCCFLLAACARSLRRLLQLPALLCCEAMAWAVTFLAFPLRMLTAVERERKLGWLVAEMQAQMDDLAWENAALEDRLRAALREREAVEAVLDDVEDEHEDALARIHVLDAQLKALRQENVRLNEHKGKSRWDDKPAAQAQAASHQSDDKLKPAAKRDREDAAVATTAQSANHAGGGPASEPPPVDGYDALQATAVARCRSLFSLGISLAVGAVAWSADAPCLPLLAGLFAVVAVSMRSVSRLRRRAGDDGAVALLGLNWFLLGLLTSPMLPAALGPALTWLAATAPL

SEQ ID NO: 4055 - DNA, 930 bp, Zea mays
  misc_feature (1)..(930): Ceres cDNA ID no. 21666057
  misc_feature (1)..(930): Ceres CLONE  ID no. 1287228
  misc_feature (1)..(930): Also known as  Ceres CDNA ID no. 23835209
gtacatacacatacaccacttgcccgagagtcgaaggtgccaagccaacgcaggtgcagatggcggccgagcaccacctcccgccggagcacgcggaccaccacagaggcgggaggaagggggtccgcgccgacgacctgaagccgggctggtggcgccgcagcccccggtacagctactactacggcgggggcgagggcgggggcgcggtccgcgccctctgcttcgccgtcctcgtcctgctcctggccgcggggatcaccctgctggtgctctacgtcgtgtaccgcccgtcccaccccaccttcgccgtcacctcggccgccgtgctggcgctgtacaacgccaccgccaacgtcgccgcgggcgcgggcgcgggcccggcgccggccaccgcgctggccgcgtcgttccagttcacgctggtgctcggcaacccgagcgggcggtcggcggcgcggtacgaccggctggcggcgtacgtggcgtaccgcggggaggccgtgacggcgccgacgcccatgcccccgctggcgcaggacgccggcaccgccgtggcggcggcgcccgtgctgggggcgggcgtcgcggcgcccgtgcccgtgtcgcccgacgccgcggcggcgctggcggcggacgtggccaacgccgtgctgccgctccgggtggtgctgctcggccgcgtccggttcgtgcacgaaccgttccaccgggggtggcgctcgctctacgcccgctgcgacctcctcatcggcgtccgcaagatcgggatcgggaacggcggcgccgccggcggtgtgcccctggcgccgcttcttggtgacccgagctgcaacgtcgacatgtgaatgtgtgatggatcccgtcgtgtagcaatctacgtgcatggtatatatgcgtgaatgttcgtctcgaaaaaaaaaaaaaaaa

SEQ ID NO: 4056 - protein, 262 aa, Zea mays
  misc_feature: PFam Name: Ribosomal_S8e; PFam Description: Ribosomal protein S8e
  misc_feature: PFam Name: GST_C; PFam Description: Glutathione
  misc_feature: GI Number: 7440236; NR Description: probable ribosomal protein S8 - rice >gi|968902|dbj|BAA07207.1| ribosomal protein S8 [Oryza sativa (japonica cultivar-group)]
  misc_feature: GI Number: 32489919; NR Description: OSJNBa0038P21.4 [Oryza
  misc_feature: GI Number: 3264759; NR Description: 40S ribosomal protein S8 [Prunus armeniaca] >gi|17367479|sp|O81361|RS8_PRUAR 40S ribosomal
  misc_feature: GI Number: 3355616; NR Description: ribosomal protein S8 [Hordeum vulgare subsp. vulgare] >gi|7440238|pir||T05908 probable
  misc_feature: GI Number: 3891608; NR Description: Chain B, Structure Of Glutathione S-Transferase-I Bound With The Ligand Lactoylglutathione >gi|3891607|pdb|1AXD|A Chain A, Structure Of Glutathione S-Transferase-I Bound With The Ligand
MAAEHHLPPEHADHHRGGRKGVRADDLKPGWWRRSPRYSYYYGGGEGGGAVRALCFAVLVLLLAAGITLLVLYVVYRPSHPTFAVTSAAVLALYNATANVAAGAGAGPAPATALAASFQFTLVLGNPSGRSAARYDRLAAYVAYRGEAVTAPTPMPPLAQDAGTAVAAAPVLGAGVAAPVPVSPDAAAALAADVANAVLPLRVVLLGRVRFVHEPFHRGWRSLYARCDLLIGVRKIGIGNGGAAGGVPLAPLLGDPSCNVDM

SEQ ID NO: 4057 - DNA, 1784 bp, Zea mays
  misc_feature (1)..(1784): Ceres cDNA ID no. 21666058
  misc_feature (1)..(1784): Ceres CLONE  ID no. 1291244
  misc_feature (1)..(1784): Also known as  Ceres CDNA ID no. 24358417
aaaaaccaccgaggatttttcacccgcgaagcgccacagccatgcgcctcctctgctgcttggccgctctcgtcgtcctcgctctccaacaccaatgccacggcctactcctcccgctcaccaacacgatgctctcctcgctccgcggggccaatggcaccgccacgcccgtgcatcacctcctccgcgcgtcgtccctccgctcggccgcgcgccacggccgccaccgcgcgcgcaggagcccgccatcgcctcccagccccggacgccaccgccagctctcgctcccactctccccaggcagcgactacacgctgtccctgtccgtggggccggcgtccgccgcggcgccggtgtccctcttcctcgacaccggcagcgacctcgtctggttcccctgcgcccctttcacctgcatgctctgcgagggcaagcccacgccgggacgttcggggccgctgcctccgccgccggactcccgccgcatcccatgcgcgtcgccgctctgctccgcggcgcacgcctcggcgccgccgtcggacctctgcgccgcggcgcggtgcccgctggaggacatcgagacgggctcgtgcggcgcgtcccacgcgtgcccgccgctgtactacgcgtacggggacgggagcctcgtggcgcacctgaggcgcggccgcgtcgcgctgggcgctggcgcgcgcgcgtccgtggccgtggccgtcgacaacttcaccttcgcgtgcgcgcacacggccctgggcgagcctgtcggggtggcagggttcggcagggggccgctctcgctgccgggccagctctccccgcagctctccggcaggttctcgtactgcctcgtgtcccactccttccgcgccgaccggctcatccggcctagccccctcatcctgggccgcagcccagacgacgccgacgccgccgccgccgagacggacggcttcgtgtacacgccgctgctccacaacccgaagcacccgtacttctactcggtggcgctggaggctgtctcggtaggcgcagcaaggatccaggcccggccggagctagcgcgcgtggaccgcgccgggaacggcgggatggtggtggactcgggaacgactttcaccatgctgcccaacgagatgtacgcgcgggtggccgaggcgttcgcccgcgcgatggccgcggcagggttcgcgcgcgccgagcgcgcggaggaacagacggggctcacgccctgctaccgctacgccgcgtcggaccgaggcgtgccgccgctggcgctgcacttccggggcaatgccacggtggcgctgccccggaggaactacttcatggggttcaagagcgaggacgcaggggccgggacgaggaaggacgacgtggggtgcctcatgctgatgaacggcggagacgcgtccggtgaggagggtgatggacccgccggcacgctgggcaactttcagcagcagggtttcgaggtggtgtacgacgtcgacgccggccgcgtcgggttcgcccgccgccgctgcacggacctgtgggactcgctgtctcgccggtgatgcttccactctctggcctctccacctgtatcatgcattacctagaccgctagctagacgtagctttgcatgtcctggctgttcttgtacagagccactgccacccgtgtgttgttcagtgccacgtagttgtatgtttagtgatacatctcgctttttttgtagtttttgtatcttcttccgtctcaatttgtctgtcaagcgctatgggaaaaaaaaaaaaaaaaa

SEQ ID NO: 4058 - protein, 504 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: Amelogenin; PFam Description: Amelogenin
  misc_feature: PFam Name: Cation_efflux; PFam Description: Cation efflux family
  misc_feature: GI Number: 18377815; NR Description: AT4g16560/dl4305c [Arabidopsis thaliana] >gi|15809800|gb|AAL06828.1| AT4g16560/dl4305c [Arabidopsis thaliana] >gi|18414692|ref|NP_567506.1| aspartyl protease family protein
  misc_feature: GI Number: 9758987; NR Description: chloroplast nucleoid DNA-binding protein-like [Arabidopsis thaliana] >gi|15242307|ref|NP_199325.1| aspartyl protease family protein
  misc_feature: GI Number: 16209647; NR Description: AT3g52500/F22O6_120
  misc_feature: GI Number: 21594980; NR Description: chloroplast nucleoid DNA
  misc_feature: GI Number: 50901910; NR Description: nucleoid DNA-binding protein cnd41-like protein [Oryza sativa (japonica cultivar-group)] >gi|15290061|dbj|BAB63755.1| nucleoid DNA-binding protein
MRLLCCLAALVVLALQHQCHGLLLPLTNTMLSSLRGANGTATPVHHLLRASSLRSAARHGRHRARRSPPSPPSPGRHRQLSLPLSPGSDYTLSLSVGPASAAAPVSLFLDTGSDLVWFPCAPFTCMLCEGKPTPGRSGPLPPPPDSRRIPCASPLCSAAHASAPPSDLCAAARCPLEDIETGSCGASHACPPLYYAYGDGSLVAHLRRGRVALGAGARASVAVAVDNFTFACAHTALGEPVGVAGFGRGPLSLPGQLSPQLSGRFSYCLVSHSFRADRLIRPSPLILGRSPDDADAAAAETDGFVYTPLLHNPKHPYFYSVALEAVSVGAARIQARPELARVDRAGNGGMVVDSGTTFTMLPNEMYARVAEAFARAMAAAGFARAERAEEQTGLTPCYRYAASDRGVPPLALHFRGNATVALPRRNYFMGFKSEDAGAGTRKDDVGCLMLMNGGDASGEEGDGPAGTLGNFQQQGFEVVYDVDAGRVGFARRRCTDLWDSLSRR

SEQ ID NO: 4059 - DNA, 1215 bp, Triticum aestivum
  misc_feature (1)..(1215): Ceres cDNA ID no. 21666059
  misc_feature (1)..(1215): Ceres CLONE  ID no. 1314835
  misc_feature (1)..(1215): Also known as  Ceres CDNA ID no. 24357800
agcatcgattccaactcaacgcaaaccgaaaatgtggcagtccaagccagtcctggtgctcctcctgctcgccgtctccacggcggcgaccctcggaaagccgctgctcaccaagatcaccaagggcggagcgtccaccgcgctctacacggcgcccctcagcgccggccgcccgctcgtcctcgacctctctgccccggccatcacgacgccgtgcagcgggcagacgacaaaagtgacgctctccgccaactccaccgacggcagcaacccgctgtccccggtctccttcgctgccaccgccacctgcgcggcggcaccctcaggcaccgtcggcgtcgccgggctcgcgcattccagcgcctcgttcccggcccaggtggccagcacgcagaaggtggccaactcgttcgcgctctgcctcccgagcgccggcgtgggcgcggccatcttcggcggcggcccgttcttcctcgcgcccccggcggaccggccggccatcacgacgctcctctccgatggcgtgccgctccgccagcccttctccgggaaccccggctacttcgtctcggccaccaacggcgtcgccatagacgggacgcgcgtggccgtctccggctccggcgcgctcgtggtcggcctctccaccactatcccctacgcgcagctccgcagcgacgtgtaccgccccttcatcacggccttcgaccgcgccatgggctcgagcgcgaaggtcgcggccgtggcgccgttcgagctgtgctacgactcgtccaagctctcgccgacgcggtcgggctactccgtcccgcaggtggacgtgatgctggagggcgggacgaacttcacggtggtgggcggcaactccatggcgcaggtgaacagcggcacggcgtgcttcgcgttcgtccaggcggggggcggcacggcgggcgggacgccggcggtggtgatcggagggttccaattggagagcaagctggtggtgctcgacaacgacaagaagacgctcagcttcaccccgtacctcccggcaatgggcttctcctgcagcaacttcaacttcacccgggcggggtagtgatccacaattccacatcgacatcggttcacggttccatggaccatagtgtgcgtgcgtgtatgaactgtgatgaaataaaataaataaaatcagtggaatatcaattaattcagataaaaaaaaaaaaaaaa

SEQ ID NO: 4060 - protein, 349 aa, Triticum aestivum
MWQSKPVLVLLLLAVSTAATLGKPLLTKITKGGASTALYTAPLSAGRPLVLDLSAPAITTPCSGQTTKVTLSANSTDGSNPLSPVSFAATATCAAAPSGTVGVAGLAHSSASFPAQVASTQKVANSFALCLPSAGVGAAIFGGGPFFLAPPADRPAITTLLSDGVPLRQPFSGNPGYFVSATNGVAIDGTRVAVSGSGALVVGLSTTIPYAQLRSDVYRPFITAFDRAMGSSAKVAAVAPFELCYDSSKLSPTRSGYSVPQVDVMLEGGTNFTVVGGNSMAQVNSGTACFAFVQAGGGTAGGTPAVVIGGFQLESKLVVLDNDKKTLSFTPYLPAMGFSCSNFNFTRAG

SEQ ID NO: 4061 - DNA, 802 bp, Triticum aestivum
  misc_feature (1)..(802): Ceres cDNA ID no. 21666061
  misc_feature (1)..(802): Ceres CLONE  ID no. 1319894
  misc_feature (1)..(802): Also known as  Ceres CDNA ID no. 0
gcataccaagctagcaaagccaacctagctcagccacaagccagtacactctcgctagctactacgtagcttcgtagcaatggcgccctccaagctcaccctcttcctcgccctgagcctggtcctcatgggaacctcgcacggttgcggatcgtgcggcaacacgccgtccgtgccagtcccaacgccgccgatcgccgtgccaccgccacccgtcccagtaccaaccccgccgatcgccgtgcccccgccggccgtcccagtaccaacccctggcggcggcggcacctgctcgatcaacacgttgaagctgagcgcgtgcgccaacgtacttaacctgctgaagctcaacctcggcgtgccggcgagcgagcagtgctgcccgctgctgagcggcctcgccgacctcgacgccgccgtgtgcctctgcaccgccatcaaggccaacgttctcggcatcaagctcaacgtccccgtcgacctcgtgctgcttctcaaccagtgcggcaagacctgccccgccgacttcacctgccctagctaaatccaggatacatcgatcgatctaaatatcacaaaccatgcattttatacttatatatgcatgcgtagtcgtcgctcgtgcatgcatgcatgcatgcttacgctttgtttcttgcactgactatgtataagctagtcatccgtcattgtatcccgtacgttatggtatctagatgattcgcatatttgtaaaattatatacttgtacacgtacgtgaataataagtttgttcaagttgtgtcaaaaaaaaaaaaaaaa

SEQ ID NO: 4062 - protein, 154 aa, Triticum aestivum
MAPSKLTLFLALSLVLMGTSHGCGSCGNTPSVPVPTPPIAVPPPPVPVPTPPIAVPPPAVPVPTPGGGGTCSINTLKLSACANVLNLLKLNLGVPASEQCCPLLSGLADLDAAVCLCTAIKANVLGIKLNVPVDLVLLLNQCGKTCPADFTCPS

SEQ ID NO: 4063 - DNA, 1096 bp, Triticum aestivum
  misc_feature (1)..(1096): Ceres cDNA ID no. 21666063
  misc_feature (1)..(1096): Ceres CLONE  ID no. 1321446
  misc_feature (1)..(1096): Also known as  Ceres CDNA ID no. 0
ttttttccccaccccacacggcgcaacagaaccaagcgctcgcctccaaaggccccaatcctgccgctcacgccccacgaacccatcaaaccctagcgtcaccacccccctcgagatggacggccgggacgccacggcggacctgcaggagtgggagctcctcctcgcctcccccaccgccgccgcggcgcccgggccgtacgccgccggcggggaggcggtggtggaggacgacgccgccggggccatcaagtacgactacttcgacctcggctccgacgccaagtacgccaggagggcgtccctgtcggcgggggccgaggaggaggccggcgaggcgagctgggtggagccgcaccccggcgccctcgccttccccgcccgcgaccgcgccgcgctctggtccgactcgtcgtcggacggggagcggcgcgaggacgccgaggccaccgagccgctggtggagacgccccgggaggcggcgggggtggacgagggggcggtggcgaagggagggcccgcggcggcggcggcgcggtggtggaggctgcccgtggaggtgctgcggctgtgggcggcgcgcgcggcgaggagcgcctggtcggtgcccgttgccgtcgcgctgctcgggatcgccgtgctcggccgccggctgtaccggatgcggcggcagagcaaggccgtggcgcgcgtgcggctcgtccttgacgataagaaggcatctcaattcaaggcccagccgatgttacggcgagctccgatgataaagcctatgcttcccggcaatggagtgaccccatggcctgtgctggggcacctgtgagtctgtgagatgtgagatcgacatagagctagaaatacagttggcttgtgagcatactatgcagtcccctgcagatttatcataccctacttgaagtgcgtacttgtgaaagacaaaatgatgcttaagtgactcatctagtacatcttttctgcttgatgcttgtaatgcacctgtgtgtatatttttcttctgtagccctgttttacctatgtgcctgaacaatgtggctgtgtatattatgacacaaagtatctaaaaaaaaaaaaaaaa

SEQ ID NO: 4064 - protein, 235 aa, Triticum aestivum
MDGRDATADLQEWELLLASPTAAAAPGPYAAGGEAVVEDDAAGAIKYDYFDLGSDAKYARRASLSAGAEEEAGEASWVEPHPGALAFPARDRAALWSDSSSDGERREDAEATEPLVETPREAAGVDEGAVAKGGPAAAAARWWRLPVEVLRLWAARAARSAWSVPVAVALLGIAVLGRRLYRMRRQSKAVARVRLVLDDKKASQFKAQPMLRRAPMIKPMLPGNGVTPWPVLGHL

SEQ ID NO: 4065 - DNA, 1188 bp, Triticum aestivum
  misc_feature (1)..(1188): Ceres cDNA ID no. 21666064
  misc_feature (1)..(1188): Ceres CLONE  ID no. 1322681
  misc_feature (1)..(1188): Also known as  Ceres CDNA ID no. 24726582
ataaggttttttttgggttctgaacccctcttcccttctcttccgccccagcatcggcggctctagcgagctgctaaagccgcgccccccgacgccataatccctgaacgatccccagagcagagccatcctctctctcctcgggagccctcacaagcgagaggcgagagaccagagatgggcggcggcaactgcaaccccaaggacttcggcgccgccgcctactgggaggcccgctactcctctccctccactggcggcaagggcggcggcggtggcgggttcttcgactggtaccagtcgtactcggcgctccgccccctcctccgcgcctgcgtgcccacttcctcccgggtcctcatgctcggctgcggcaactcccttctgtcggaggacatggtaaaggatggttaccagaacatagtaaacatagacatctcatcagttgtaatcgagcagatgaaagagaagcacatggatatcccacggcttacatatatgcagttggatgtcagagatatgagcttctttggagatggatcatttgattgtatcatcgacaaaggaactttggatgctatgatgtgtggcgatgatgcccctcatggtgcttacaaaatgctagcagaagtggcaaggcttatgaggcctggtgggatttacatgttgataacatatggtgcccctaaggaacgcctgacacttctgaatcaagtccaatgctgttgggaagttgagctttacattatgccagccacacctgaataccagctgaaatggagcaacggtgctgcacacgccatgatggagaaagttgcactgacagtggatcgccaactgccacctgactacgttctcaaggatccagagtcacatttcatttatgtttgttacaagtcagatatagtgactgaagataattccatggttgctggtcaagatgatgccatgacttcattttaatagagtccgaccacaattaccgaattaattattgccatgacttcaaaatgatttgcttctcatccttggtctgaatggtagattgttaccgttgattatgaaaactcatacccttttgtgccattatctggcgtgagtaagagtgatgagtgtgctttgtggaagttggaggatttaagaaatatagttgttgtgtgtttctatctgccaaaaaaaaaaaaaaat

SEQ ID NO: 4066 - protein, 261 aa, Triticum aestivum
  misc_feature: PFam Name: TPMT; PFam Description: Thiopurine
  misc_feature: PFam Name: Ubie_methyltran; PFam Description: ubiE/COQ5
  misc_feature: PFam Name: MTS; PFam Description: Methyltransferase small domain
  misc_feature: GI Number: 46228382; NR Description: methylase
  misc_feature: GI Number: 61826751; NR Description: PREDICTED: similar to
  misc_feature: GI Number: 50510673; NR Description: mKIAA0859 protein [Mus
  misc_feature: GI Number: 21536262; NR Description: RIKEN cDNA 5630401D24 [Mus musculus] >gi|15990392|gb|AAH14872.1| RIKEN cDNA 5630401D24
  misc_feature: GI Number: 62658158; NR Description: PREDICTED: similar to
MGGGNCNPKDFGAAAYWEARYSSPSTGGKGGGGGGFFDWYQSYSALRPLLRACVPTSSRVLMLGCGNSLLSEDMVKDGYQNIVNIDISSVVIEQMKEKHMDIPRLTYMQLDVRDMSFFGDGSFDCIIDKGTLDAMMCGDDAPHGAYKMLAEVARLMRPGGIYMLITYGAPKERLTLLNQVQCCWEVELYIMPATPEYQLKWSNGAAHAMMEKVALTVDRQLPPDYVLKDPESHFIYVCYKSDIVTEDNSMVAGQDDAMTSF

SEQ ID NO: 4067 - DNA, 830 bp, Triticum aestivum
  misc_feature (1)..(830): Ceres cDNA ID no. 21666067
  misc_feature (1)..(830): Ceres CLONE  ID no. 1325709
  misc_feature (1)..(830): Also known as  Ceres CDNA ID no. 24357757
agttcacgagcgtcagtgtagtcagcgtcaggcgaacaaccaccaccagcaagccatgaccttccgcggctcatccctcctcctcttcctcctccttgcgctagcgccggccatccaagtccaagccgctcccaccgccggcgcgccggtcgtcgacacggtggcggactcgtgcaacgcgatccgcgacttcgtggactacgccttctgcgccgccgcgctgcggtccagcgggccgggcgcctccacggcggaccgccacgtgcacctcctcgtcgcggcggacctcgccgcggcgcgcgggacgtcggcgcgggacgccgccaccgcgatggcgcgcgacgagcgggacccgggcgcgcgcgacgggttggaggcgtgcgggatcctctacggggccacctccgtcccggcgctgcagttcatgcgcggctacgcggcggcgcgggcgtgggaccgggcgcgctcgctgctgtcgctcaccgggcaggccgggatcggctgcgaggcggcgctcgccggcgcgccggaggccaaggggaggatggccgccgccaaccgcgagtttgaccagctcagcaccatggccaccgcgctgctcaacagggtcgatcgtcaggggtgacgtggcagcatgccaccgccgtcgaccggcgcaccgtagttcttcttgtgttaataaccagagttccttgtgttgattattactacgtactactagttccttgatcaaactagtaagcccgcgcatgtaaaatttaaattatgaatactcaaggctcacagtttgagttcacatgaagctaccttttcgaaaaaaaaaaaaaaaa

SEQ ID NO: 4068 - protein, 189 aa, Triticum aestivum
MTFRGSSLLLFLLLALAPAIQVQAAPTAGAPVVDTVADSCNAIRDFVDYAFCAAALRSSGPGASTADRHVHLLVAADLAAARGTSARDAATAMARDERDPGARDGLEACGILYGATSVPALQFMRGYAAARAWDRARSLLSLTGQAGIGCEAALAGAPEAKGRMAAANREFDQLSTMATALLNRVDRQG

SEQ ID NO: 4069 - DNA, 1042 bp, Triticum aestivum
  misc_feature (1)..(1042): Ceres cDNA ID no. 21666069
  misc_feature (1)..(1042): Ceres CLONE  ID no. 1329993
  misc_feature (1)..(1042): Also known as  Ceres CDNA ID no. 0
acacttgcagcccacacacatacggagtagtacacaggaagaacccggcggtgctagatagctcaagaaatggcgcagctgccgccgagagcgccgagcgcgggggagcaggactggccggtggcaggcgagttcctcgggttcgctgcggcgcgacggggcgtgcaccggcgctcggccagcgatccggcggctttcctggaggccgtgccaatggaccacatcctcagcggcggcggcggcgacgacgagttcgacaggctcgacgacgagcagctcatgtccatgttctccaatgtcgacggcgggtgcgacaggccgggcttcatggacacgggagaggcggaggagggggcggccagcgcgggcgcaatgaccgccgcggacggcttcggtgaccctaagcgggttaaaaggatattggcgaacaggcagtcagcgcagaggtcaagagttcggaagttgcagtacatctcagagcttgaacgcagcgtcaccggtctccagatggaggtgtcagcactctctccccgcgtggcctttctagatcatcagcggtcattactgaccgtcggcaacagccatctcaggcaaagaattgccgcccttgcacaagacaagatcttcaaagatgctcatcaagaggcactcaaagaggagattgagcgactacggcagctgttccaccaccagaagatcaaggccacaggcggcacagacatggccacggccgcctcaatgcaggccaagcaagagctccttatgtgtgagggagccgcgatgcgatagcacaacatggcgcaaccagcctttttgtggtgactttttcctttcactcttgtcgattcatcgtgtggaaacacaccaatgttactagattatttgtgcagtttgacatgttctttatttttgttttttgtgatgtttactcatccctaccgataattgtgttgggatggaaaattgtcgtagatatattgtttggaccatccttacatttgtgttggtaaagatatttttattacgaaaaaaaaaaaaaaaa

SEQ ID NO: 4070 - protein, 239 aa, Triticum aestivum
MAQLPPRAPSAGEQDWPVAGEFLGFAAARRGVHRRSASDPAAFLEAVPMDHILSGGGGDDEFDRLDDEQLMSMFSNVDGGCDRPGFMDTGEAEEGAASAGAMTAADGFGDPKRVKRILANRQSAQRSRVRKLQYISELERSVTGLQMEVSALSPRVAFLDHQRSLLTVGNSHLRQRIAALAQDKIFKDAHQEALKEEIERLRQLFHHQKIKATGGTDMATAASMQAKQELLMCEGAAMR

SEQ ID NO: 4071 - DNA, 1079 bp, Triticum aestivum
  misc_feature (1)..(1079): Ceres cDNA ID no. 21666070
  misc_feature (1)..(1079): Ceres CLONE  ID no. 1330988
  misc_feature (1)..(1079): Also known as  Ceres CDNA ID no. 24409968
attccattccgccaccgcaccaccaccaccaccaaaccctagcgagcgagggagagagagaccgccccgccgcgacgatggagagatcccgcgggctgctgctggtggcggggctgctggtggcgctgctgccggcggcggcggcgcagccgggggcgccgtgcgagcccgcgctgctggcgacgcaggtggcgctcttctgcgcgcccgacatgccgacggcccagtgctgcgagcccgtcgtcgccgccgtcgacctcggcggcggggtgccctgcctctgccgcgtcgccgccgagccgcagctcgtcatggcgggcctcaacgccacccacctcctcacgctctacagctcctgcggcggcctccgccccggcggcgcccacctcgccgccgcctgcgaaggacccgctcccccggccgccgtcgtcagcagccccccgcccccgcctccaccgtccgccgcacctcgccgcaagcagccagcgcacgacgcaccaccgccgccaccgccgtcgagcgagaagccgtcgtccccgccgccgtcccaggaccacgacggcgccgccccccgcgccaaggccgcgcccgcccaggcggccacctccacgctcgcgcccgccgccgccgccaccgccccgccgccccaggcgccgcactccgccgcgcccacggcgccgtccaaggcggccttcttcttcgtcgccacggccatgctcggcctctacatcatcctctgagtcgcgcgccgaccccgcgagagaccgtggtccgtccagtcgcagtagagtagagcgctcgtcgtctcgttccgtttcgtgcctgtcgccgttcgaggttcgtttctgcgtgcagtccggtcgaagaagccggtgggttttgagtactagtggtagtagtagcagcagctatcgtttctgtccgctcgtacgtgtttgcgtggtcgcggagaacaattaattgggtgtttgcgattcctctggttaagatgaaccactgatgctatgtgatcgatcgatcggtatgatctgaatggaaatggatcaagttttgcgttctgccgaaaaaaaaaaaaaaaa

SEQ ID NO: 4072 - protein, 220 aa, Triticum aestivum
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: GI Number: 25989119; NR Description: unknown [Streptomyces
  misc_feature: GI Number: 6523547; NR Description: hydroxyproline-rich
  misc_feature: GI Number: 100753; NR Description: hydroxyproline-rich glycoprotein - sorghum >gi|228939|prf||1814452D Hyp-rich
  misc_feature: GI Number: 7949115; NR Description: Ser/Arg-related nuclear matrix protein; plenty-of-prolines-101; serine/arginine repetitive matrix protein 1 [Mus musculus] >gi|3153821|gb|AAC17422.1|
  misc_feature: GI Number: 62948087; NR Description: Unknown (protein for
MERSRGLLLVAGLLVALLPAAAAQPGAPCEPALLATQVALFCAPDMPTAQCCEPVVAAVDLGGGVPCLCRVAAEPQLVMAGLNATHLLTLYSSCGGLRPGGAHLAAACEGPAPPAAVVSSPPPPPPPSAAPRRKQPAHDAPPPPPPSSEKPSSPPPSQDHDGAAPRAKAAPAQAATSTLAPAAAATAPPPQAPHSAAPTAPSKAAFFFVATAMLGLYIIL

SEQ ID NO: 4073 - DNA, 1516 bp, Triticum aestivum
  misc_feature (1)..(1516): Ceres cDNA ID no. 21666071
  misc_feature (1)..(1516): Ceres CLONE  ID no. 1329028
  misc_feature (1)..(1516): Also known as  Ceres CDNA ID no. 24360455
accctgctttctgcctagctccgtcttgcatgccacacacctaggcacctactaaccacctagccaagcttggaactccacgtcggtccaatggcggcctcctccacgcccacggcgacggtgctcctcctggtgctcctcgcgtgcggcggcgccacggcgcaggtgttcccgcggccgctgttcccgcgcgcgccgtggaacttcacgttcccgaacgggcccggcgacgcggcaggggccagcggcgccggcaccggcgcgacgggcggcggcggcggcgggccgtcggtgccggccatgttcgtgttcggcgactcgctgacggacaacggcaacaacaacgacctcacgtcgctggccaaggccaactacctgccctacggcatcgacttcgccggcgggcccaccggccgcttctccaacggctacaccatggtcgacgccatagctgagcttctggggctgcccctgctgccgtcgaacaacgaggcctccaacgccgacagtgacgccggcgcgctgcatggcgtgaactacgcctccgccgccgccgggatcctggacaacacgggccagaacttcgtggggcgcatcccgttcaaccagcagatcaagaacttccagacgacgctgaaccagatcaaggggaagatcggcgcgagcaagctggcctcctcgctgggccgcagcatcttctacgtgggcatgggcagcaacgactacctcaacaactacctcatgcccaactacaacacccgcaacgagtacaacggcgaccagtactccaccctcctcgtgcagcactacaccaagcagctcaccagcctgtacaacctgggggcccggaggttcgtgatcgcgggggtggggtcgatggcgtgcatccccaacatgcgggcgcggaacccgaccaacatgtgctcgccggacgtggacgagctcatcgcgcccttcaacagcaaggtgaagggcatggtggacaccctgaacgccaacctcccgcgggcgaagctcatctacatcgacaacttcgagatgatctccgaggtgctgcggagcccctggaactacggcttcagcgtggtggaccgcgggtgctgcgggatcgggcgcaaccgcggggtcatcacctgcctgcccttcctccgcccctgccccaaccgcaacacctacatcttctgggacgccttccaccccaccgagagggtcaacgtgctcctcggcaaggccgcctactccggcggcaccgacctcgcctaccccatgaacatccagcagctcgccgcgtggcagccgtagtagctaggagtactagctagctagctacgtgacagtgttcttctgtgagttaattcccagattaggtctggagtaccgtgtgctcagttcagtgtgtctgtttttgatcgatcagtcatatgagtgtgtagtgtaaggatcgttcaatggtgctgtggctgtcgtcgttctaatgataaattaagtaattatattagcaaaaaaaaaaaaaaaa

SEQ ID NO: 4074 - protein, 1516 aa, Triticum aestivum
  misc_feature: PFam Name: Lipase_GDSL; PFam Description: GDSL-like
  misc_feature: GI Number: 51964624; NR Description: PREDICTED P0498H04.26 gene product [Oryza sativa (japonica cultivar-group)] >gi|50940453|ref|XP_479754.1| putative GDSL-motif lipase/hydrolase protein [Oryza sativa (japonica cultivar-group)]
  misc_feature: GI Number: 7239493; NR Description: Strong similarity to the putative GDSL-motif containing lipase/hydrolase F26A9.7 from A. thaliana on BAC gb|AC016163. [Arabidopsis thaliana] >gi|12323716|gb|AAG51812.1| putative GDSL-motif lipase/hydrolase;
  misc_feature: GI Number: 34909504; NR Description: putative GDSL-motif lipase/hydrolase-like protein [Oryza sativa (japonica cultivar-group)] >gi|14209541|dbj|BAB56037.1| putative GDSL-motif lipase/hydrolase-like protein [Oryza sativa (japonica
  misc_feature: GI Number: 21592417; NR Description: lipase/hydrolase,
  misc_feature: GI Number: 18086455; NR Description: At1g29670/F15D2_22 [Arabidopsis thaliana] >gi|12323546|gb|AAG51758.1| lipase/hydrolase, putative; 118270-120144 [Arabidopsis thaliana] >gi|15220514|ref|NP_174260.1| GDSL-motif lipase/hydrolase family
ACCCTGCTTTCTGCCTAGCTCCGTCTTGCATGCCACACACCTAGGCACCTACTAACCACCTAGCCAAGCTTGGAACTCCACGTCGGTCCAATGGCGGCCTCCTCCACGCCCACGGCGACGGTGCTCCTCCTGGTGCTCCTCGCGTGCGGCGGCGCCACGGCGCAGGTGTTCCCGCGGCCGCTGTTCCCGCGCGCGCCGTGGAACTTCACGTTCCCGAACGGGCCCGGCGACGCGGCAGGGGCCAGCGGCGCCGGCACCGGCGCGACGGGCGGCGGCGGCGGCGGGCCGTCGGTGCCGGCCATGTTCGTGTTCGGCGACTCGCTGACGGACAACGGCAACAACAACGACCTCACGTCGCTGGCCAAGGCCAACTACCTGCCCTACGGCATCGACTTCGCCGGCGGGCCCACCGGCCGCTTCTCCAACGGCTACACCATGGTCGACGCCATAGCTGAGCTTCTGGGGCTGCCCCTGCTGCCGTCGAACAACGAGGCCTCCAACGCCGACAGTGACGCCGGCGCGCTGCATGGCGTGAACTACGCCTCCGCCGCCGCCGGGATCCTGGACAACACGGGCCAGAACTTCGTGGGGCGCATCCCGTTCAACCAGCAGATCAAGAACTTCCAGACGACGCTGAACCAGATCAAGGGGAAGATCGGCGCGAGCAAGCTGGCCTCCTCGCTGGGCCGCAGCATCTTCTACGTGGGCATGGGCAGCAACGACTACCTCAACAACTACCTCATGCCCAACTACAACACCCGCAACGAGTACAACGGCGACCAGTACTCCACCCTCCTCGTGCAGCACTACACCAAGCAGCTCACCAGCCTGTACAACCTGGGGGCCCGGAGGTTCGTGATCGCGGGGGTGGGGTCGATGGCGTGCATCCCCAACATGCGGGCGCGGAACCCGACCAACATGTGCTCGCCGGACGTGGACGAGCTCATCGCGCCCTTCAACAGCAAGGTGAAGGGCATGGTGGACACCCTGAACGCCAACCTCCCGCGGGCGAAGCTCATCTACATCGACAACTTCGAGATGATCTCCGAGGTGCTGCGGAGCCCCTGGAACTACGGCTTCAGCGTGGTGGACCGCGGGTGCTGCGGGATCGGGCGCAACCGCGGGGTCATCACCTGCCTGCCCTTCCTCCGCCCCTGCCCCAACCGCAACACCTACATCTTCTGGGACGCCTTCCACCCCACCGAGAGGGTCAACGTGCTCCTCGGCAAGGCCGCCTACTCCGGCGGCACCGACCTCGCCTACCCCATGAACATCCAGCAGCTCGCCGCGTGGCAGCCGTAGTAGCTAGGAGTACTAGCTAGCTAGCTACGTGACAGTGTTCTTCTGTGAGTTAATTCCCAGATTAGGTCTGGAGTACCGTGTGCTCAGTTCAGTGTGTCTGTTTTTGATCGATCAGTCATATGAGTGTGTAGTGTAAGGATCGTTCAATGGTGCTGTGGCTGTCGTCGTTCTAATGATAAATTAAGTAATTATATTAGCAAAAAAAAAAAAAAAA

SEQ ID NO: 4075 - DNA, 1854 bp, Zea mays
  misc_feature (1)..(1854): Ceres cDNA ID no. 21666072
  misc_feature (1)..(1854): Ceres CLONE  ID no. 1359138
  misc_feature (1)..(1854): Also known as  Ceres CDNA ID no. 0
ataacaaccttaggttacagtaacgttatctctcttccatcctttctctctctacctatctgttcccaagtatagaatataggaggagtatattttttttagagatcgttaacctctcacagtaatccctccttttgcccaaaacctaaaggaagccaaagtgggagcaccaaaatattcgcggcgggtgcatagttgtttgtttaggagaagacgaggttaagaggagatgaccgagccggcacctgcggcagcagcgggggagaagaaggccgtcgcggacacggctgcggctgtggtggcgaagggaaaagagaaggaggaggcggcgccaactctggcggccggcgccagggggaggttcgtggcctacccggcgcgggtgacggagcacacggacgtggtggcggacgccgcgcgcttcagggcggcgctcgaggggctgcacgcgcacatgaacacgaggctcaaggtgccaattattggagggaaagatttggatcttcatcagctatataaggaggtcacatcacggggtggtattgacaagttgaaggcagagaatagatggagggaagtgaccgcatcatttattttccctgccactgcaacaaatgcttcttttatgttgaagaaatactatatgtcactcttatatcattttgagcagctatacttctttagagtgcaaggctggtaccaacaagaaatagattccagaacgaattcctccattgaagttaaaaccgaagcccaagcttaccacaaaagaaaaaggggtatcaatgcatctctttcagatccagcttcgtcttcagataatgttgacgtagatgtgatagttgatggcaagtttgaacatggctacataataactgttattatgggatcaaaatccactaaagcaatcctctataactgcactgaagaacctgctctaccaacttcggagctagctgttgcaagtaacaacaatgatttgaagggtggacgccgccgaagacgacgtaagaagaagctaagtacaacagaccccaggcaccccaaaccaaacaggagtggctataatttcttcttccaggatcaacatagaatgcttaagccacaatgtcctggacaagacagattgatcagtaaaatgattggtgaacgatggaacaatctaagtcctgaagataaagctgtatatcaagaaagaggtgtacaggacaaggagcgataccggacccagctggctgcttatagaaagctgacaggccaacctatcagcaatgctgtgcctatcgagcagagactccctctgacagatgtgacgattgatgaagtagactccaaggtgagtgaaggtgatatgctgctgtcgaaccaagcgtacagcagtagtgatgaaagtgaccactcaggagaaaaaactgtagaagacgagctcaacactgaaacatctcctgaggtgagcatggaaacgactggttctcttcgacaccctgatccttgtgccgatgaggaccactttgagttgcggcggagagaaaaccccaaggcagatgagaaatataatgcaccacctgattcatgactttccgatttgaatgctatatctgtgaacgtatgaaagaagaatttccaaggggtgccgagctagacatacctgattgacttgcatagctctattagcagttagaatacctttcgttttgacagttctgaatttgtgttgctaaatttctttcgaacttaacaggtggctactggataaaattcccattatccagggatatgactggatggacacttgatcgacttgcataggaagttggaagtatattctttcattcgaaaaaaaaaaaaaaaaaa

SEQ ID NO: 4076 - protein, 448 aa, Zea mays
MTEPAPAAAAGEKKAVADTAAAVVAKGKEKEEAAPTLAAGARGRFVAYPARVTEHTDVVADAARFRAALEGLHAHMNTRLKVPIIGGKDLDLHQLYKEVTSRGGIDKLKAENRWREVTASFIFPATATNASFMLKKYYMSLLYHFEQLYFFRVQGWYQQEIDSRTNSSIEVKTEAQAYHKRKRGINASLSDPASSSDNVDVDVIVDGKFEHGYIITVIMGSKSTKAILYNCTEEPALPTSELAVASNNNDLKGGRRRRRRKKKLSTTDPRHPKPNRSGYNFFFQDQHRMLKPQCPGQDRLISKMIGERWNNLSPEDKAVYQERGVQDKERYRTQLAAYRKLTGQPISNAVPIEQRLPLTDVTIDEVDSKVSEGDMLLSNQAYSSSDESDHSGEKTVEDELNTETSPEVSMETTGSLRHPDPCADEDHFELRRRENPKADEKYNAPPDS

SEQ ID NO: 4077 - DNA, 2276 bp, Zea mays
  misc_feature (1)..(2276): Ceres cDNA ID no. 21666073
  misc_feature (1)..(2276): Ceres CLONE  ID no. 1370671
  misc_feature (1)..(2276): Also known as  Ceres CDNA ID no. 24359648
aataatagctagagtttggtttcttttacaagtatctccttaaggcgtatctgaatccgaagaggtgaatgattctgattagttaggactcaactctttgctgtttctctctttctgttggtttgatttttttggtctctgattggtttttttagatggaatcaccggagaacagtgttggtttcgattccgacggctcgttagagacggcggagaggataatactccgatgggactcaacagcttccgaagaagcgagagggaagatgatattccagagcgatcgtgacgaagtagatcggttcttgagagccgtagatgaaatccaacggtccgtgtcatctctctccttctcctctcctccttccttctcctcctcctccgccgccaccgatgaccaagaagtcaaagccaactcagctctccaaatcgcgatggctaggctcgaggaagagttccgcaacatcctcctctcccaaacatccgtcttcgagcccgactctctcttcctagaggagtcatcagtctccggagaagacagcactgacgctccccccgaagaagaagaagaaggttccgattccggttccggttcaagccggttaacgcgtaggagaagcagttacagatccacaagcagcatacgcgagatggatctcatctcccccgaagcagtttccgacttgagatcgatcgttcagagaatggtcgccgccggctactcccgcgagtgcatccaagtctacggaaacgtccgcaaatccgccgtggatacgatcctcaagcagctcgggatcgtcaagatcagcatcggagacgtgcagaagctcgagtgggaagtggtggaaggaaaaatcaggaagtggatccgcgcggctaaggtctgcgtgaggatcgtcttctcaagcgagaagagactctgttccgacctcttcgacgaagaagcgatgggtgacacgtgtttcatggagacggtgaagacgtctgctctacgcctcttcactttccccgaagcgataagcatcagcagaagatcgcccgagaagctcttcaagattctcgatctgcacgatgctatgggtgacatgttgcccgacatcgaagcgatcttcgactcggatgattcatcatcgcgagccgtctacctccaagcttccgagattcagacgaggctcgcggaggcggcgagagggatactctccgagttcgaaaacgccgttctccgcgagccttctgtggtccccgtccctggagggactatccatcctttgacgaggtatgtgatgaactatatcagcttgatctctgattacaagcagactctcaacaacctcatcgtgtcggatccctcgaccggatccgatcccaaccccaacgcgccggtgattgacttcaccgagctggacggtaagtcaccgttggctttgcatctgatatggctgatcatggtgctgcatttcaacttggaagagaagtcgcaccactacagagacgcgtccctagctcacatattcatcatgaacaacattcactacatagtccagaaggtgaaaggatcgccggagctgagggagatgatcggagaccattatttgaggaaactcactgggatattcagacacgcggccacgaactaccagagatccacgtgggtcagagtgctgaatagcttgagagacgaagggttgcacgtgagtgggagtttctcctctggtgtgtcgagaagtgcgttgagggagaggtttaaagcgtttaacgcgatgttggaagatgtccataggagtcagtctacgtggtcggttccggatgcgcagcttagagaggagctgaggatatctttgtctgagcatttgatcccggcttatagatcgtttcttgggaggtttagggggaatatagagagtgggagacatccggagaactacttgaagtattcggttgaagatattgacaggatcgttcttgatttctttgaagggtatgcacacccgccaaacttgaggagacgatgatgaaagaagaagatttggagaggttacttttgtctctttttgttttgtttcttggttctcagccatgttagggtgttgttgtaggatagatccattctttgaatttttattcacgggtccgttccctattgtgccccgatggaataatctcccaggtaaaacatacatttgtgttgttgttttgtgtcatacgtatactctcttcttttaatcaaatcgtgcaatgtcctctattcttttgatcaatcaaaaaaaaaaaaaaaa

SEQ ID NO: 4078 - protein, 618 aa, Zea mays
  misc_feature: PFam Name: Exo70; PFam Description: Exo70 exocyst complex subunit
  misc_feature: GI Number: 50946449; NR Description: putative leucine zipper-containing protein [Oryza sativa (japonica cultivar-group)] >gi|42409138|dbj|BAD10406.1| putative leucine zipper-containing
  misc_feature: GI Number: 51091401; NR Description: putative leucine zipper-containing protein [Oryza sativa (japonica cultivar-group)] >gi|51091351|dbj|BAD36086.1| putative leucine zipper-containing
  misc_feature: GI Number: 30695880; NR Description: exocyst subunit EXO70
  misc_feature: GI Number: 50908781; NR Description: putative leucine zipper-containing protein [Oryza sativa (japonica cultivar-group)] >gi|48716193|dbj|BAD23233.1| putative leucine zipper-containing
  misc_feature: GI Number: 19386798; NR Description: putative leucine zipper
MESPENSVGFDSDGSLETAERIILRWDSTASEEARGKMIFQSDRDEVDRFLRAVDEIQRSVSSLSFSSPPSFSSSSAATDDQEVKANSALQIAMARLEEEFRNILLSQTSVFEPDSLFLEESSVSGEDSTDAPPEEEEEGSDSGSGSSRLTRRRSSYRSTSSIREMDLISPEAVSDLRSIVQRMVAAGYSRECIQVYGNVRKSAVDTILKQLGIVKISIGDVQKLEWEVVEGKIRKWIRAAKVCVRIVFSSEKRLCSDLFDEEAMGDTCFMETVKTSALRLFTFPEAISISRRSPEKLFKILDLHDAMGDMLPDIEAIFDSDDSSSRAVYLQASEIQTRLAEAARGILSEFENAVLREPSVVPVPGGTIHPLTRYVMNYISLISDYKQTLNNLIVSDPSTGSDPNPNAPVIDFTELDGKSPLALHLIWLIMVLHFNLEEKSHHYRDASLAHIFIMNNIHYIVQKVKGSPELREMIGDHYLRKLTGIFRHAATNYQRSTWVRVLNSLRDEGLHVSGSFSSGVSRSALRERFKAFNAMLEDVHRSQSTWSVPDAQLREELRISLSEHLIPAYRSFLGRFRGNIESGRHPENYLKYSVEDIDRIVLDFFEGYAHPPNLRRR

SEQ ID NO: 4079 - DNA, 2130 bp, Glycine max
  misc_feature (1)..(2130): Ceres cDNA ID no. 21666075
  misc_feature (1)..(2130): Ceres CLONE  ID no. 1370936
  misc_feature (1)..(2130): Also known as  Ceres CDNA ID no. 25401935
ctctctctgtccactcatatggcatcggatctcactctctcaagtctcaacacgccaccctcttcttcttattcagattgtcataacgaggaagcttgtttgcatatataatagagaaaatggtattgttgttagtttattacaggtttgagtggttggttagtacttcgtagaagttagctggtaacaacaaataagtaaatcttgactctatggaagactacaatttttctgttggtcaagagttccctgatgtgaaagcattccggaatgctattaaagaagctgccattgcacagcattttgagcttcgtactattaaaagtgacctgattcgctactttgctaagtgtgcctcagatgggtgtccatggcggattcgtgcagtcaagctccctaatgccccaacatttactattagaagtattgatgggactcatacttgtgggagaaatgcaaacaatgggcaccatcaggcttctgttgattggattgtgagtttcatagaagaaaggttgcgagataacatcaattataaaccaaaagatattttacatgacatccataaacaatatggtataaccataccatacaagcaagcttggcgtgcaaaggagaggggtcttgcagctatatatggctcttctgaagaaggatattacctacttccttcatactgtgaacaaattaagaaaacaaatcctggaagtgttgctgaggtatttaccactggtgcagataaccgttttcagagactttttgtttccttttatgcatcaattactggttttgttaatggttgtttgccaattgttggacttggtggaatccagctgaaaagcaaataccttagcacattgctttcagcaacttcttttgatgctgatggagggttgtttccacttgcttttggtgttgttgatgtagaaaatgatgacagctggacatggttcctgtctgagttgcataaggtacttgaggtgaatactgaatgcatgccagagtttatatttttgtcagatgggctaaacagtattacagatgcagtaagaaggaagttccctagttcttctcatgcattctgcatgcgtcacttgaccgaaagcattggcaaagagttcaagaactctaggcttgtccatcttctgtggaaggcttcatattccaccacaaccattgcatttaaagaaaaaatgggtgaaatagaggaggtttctcctgaagctgctaaatggttacaacaattccatccttctcaatgggcccttgtacattttaaagggacacgatttggccatctatcctctaacatcgaggagtttaataaatggattcttgatgccagggaattaccaattattcaggtgattgaacggattcatagcaagcttaaaactgagtttgatgacaggcgtttaaaaagcagctcatggtgctctgtacttgccccatctgctgagaagcttatgactgaagccattaaccgtgcatctacacatcaagtccttagatcaaatgaagtagagtttgaggttctttcagccgatcgatcagatattgtaaatattggcagccatagctgttcctgccgtgattggcagcttaatggtattccatgttcccatgctgctgctgctcttatctcttgtcgaaaggatgtctatgcattttcccagaagtgttttactgctgcaagtttcagggatacctatgcagagactatacaccccatccccggaaaacttgaatggagtaaaacaggcaactcttctatggatgataatatccttgttgtaaggccaccaaaattacggcgaccaccaggacgccctgagaaacggatgtgtgtggatgaccttaatcgcgagaaacatacagtgcattgtagtcggtgtaatcaaactggacattacaagagaacttgtaaagcagagatgattaatagtatagagcagttttagttgtctgattttgtacttagttcaccaaagaactagtttagttttaacatctacagaccctatgtttagggcatacctatgatgcagatcatgtaaaagttagatatatatcactattaaatccgcgggtgtaatagaaatgaagtttacaacaaaaaaaaaaaaaaaa

SEQ ID NO: 4080 - protein, 582 aa, Glycine max
  misc_feature: PFam Name: MuDR; PFam Description: MuDR family transposase
  misc_feature: PFam Name: SWIM; PFam Description: SWIM zinc finger
  misc_feature: GI Number: 6175165; NR Description: Mutator-like transposase [Arabidopsis thaliana] gi|20465953|gb|AAM20162.1| putative mutator transposase [Arabidopsis thaliana] gi|18389286|gb|AAL67086.1|
  misc_feature: GI Number: 20259876; NR Description: mutator-like transposase-like protein [Arabidopsis thaliana] gi|9759134|dbj|BAB09619.1| mutator-like transposase-like protein [Arabidopsis thaliana] gi|16648945|gb|AAL24324.1| mutator-like
  misc_feature: GI Number: 20198324; NR Description: putative Mutator-like transposase [Arabidopsis thaliana] gi|2880040|gb|AAC02734.1| putative Mutator-like transposase [Arabidopsis thaliana] gi|25408094|pir||H84710 Mutator-like transposase [imported] -
  misc_feature: GI Number: 34912318; NR Description: putative Mutator-like
  misc_feature: GI Number: 6729001; NR Description: putative mudrA protein
MEDYNFSVGQEFPDVKAFRNAIKEAAIAQHFELRTIKSDLIRYFAKCASDGCPWRIRAVKLPNAPTFTIRSIDGTHTCGRNANNGHHQASVDWIVSFIEERLRDNINYKPKDILHDIHKQYGITIPYKQAWRAKERGLAAIYGSSEEGYYLLPSYCEQIKKTNPGSVAEVFTTGADNRFQRLFVSFYASITGFVNGCLPIVGLGGIQLKSKYLSTLLSATSFDADGGLFPLAFGVVDVENDDSWTWFLSELHKVLEVNTECMPEFIFLSDGLNSITDAVRRKFPSSSHAFCMRHLTESIGKEFKNSRLVHLLWKASYSTTTIAFKEKMGEIEEVSPEAAKWLQQFHPSQWALVHFKGTRFGHLSSNIEEFNKWILDARELPIIQVIERIHSKLKTEFDDRRLKSSSWCSVLAPSAEKLMTEAINRASTHQVLRSNEVEFEVLSADRSDIVNIGSHSCSCRDWQLNGIPCSHAAAALISCRKDVYAFSQKCFTAASFRDTYAETIHPIPGKLEWSKTGNSSMDDNILVVRPPKLRRPPGRPEKRMCVDDLNREKHTVHCSRCNQTGHYKRTCKAEMINSIEQF

SEQ ID NO: 4081 - DNA, 1870 bp, Zea mays
  misc_feature (1)..(1870): Ceres cDNA ID no. 21666076
  misc_feature (1)..(1870): Ceres CLONE  ID no. 1376575
  misc_feature (1)..(1870): Also known as  Ceres CDNA ID no. 24359595
ttgtagagcagtgcgacagagttccccgatcgaagcagattgaggtccactgtgctgtactgctgtgcgtcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcggacatgctccgcgccgcgccgtccggtgccatcgaggcgtgggggcccttgggcgcgggccacgccgtcaccaccgccagcccggccgacgtcgaccacctcctgcgctccagcttcgacaagtacgccaagggcgcgctcttccgcgacgccaccgcggatctcatcggcgacgggctcttcgccgccgacggccgcctctggagcctccagcggaagctggcgtcgcacgccttctcgtcccgctcgctccgccggttcaccgacggcgtcctcgacgtgcacctgcgccgccgcttcctgccgctcctggacgccgcagccagggacggcggggccgtggacctgcaggacgcgctgcgccggttcgggttccgcaccatctgccacgtcgcgttcggcgtggagggcctggacgacgacgccaggaggcaggatgcgctcttcgcggcgttcgacgcggccgtcgagatctccttccggcgcgcgctcacgccggccacgttcgtgcggcggctcaccaagctgctcgacgttggcaagtcgcgccggctccgagaggccgtccatgccatcgacgactacgccatgtccgtcgtcgaatccaaggtggcgcgtcggaggaacagcctcgacgacggggccgcggacctgctgtcgcggttcatggcggccatggacgacggcggcggcagcgacagcgagctcggcgccatgttccccacgccagcggccaagctccggttcctgcgggacgtggtcgtcaccttcgtactcgccgggaaggacacgacgtcgtcggcgctgacctggttcttctggctcctcgccgccaacccgcggtgcgagcggcgcgcccacgaggaggccgcgtcgtgctgcggtgacggcggcgacgtgaaggggatgcactacctgcacgccgcgatcaccgaggcgatgcggctgtacccgccggtgccgttcaacgggcgggtcgcggtgcgcgacgacgtgctgccgagcggcgcggctctgcgagccggttggtacgccaactactcggcgtacgcgatgggccggatggagaagctgtggggcaaggactgcttggagttcgtgccggagcggtggctaggcgagggcggcgagttcgtgccggtcgacgccgcgcggttcccggtgttccacgctgggccgcgggtgtgcctcgggaaggagatggcgtacgtgcagatgaagacggtcgccgcggccgtgctccggaggtttaggttggacgtggtggcgccggtggctaacatggaggcgccgccggcgtacgagatgacggcaacgatgaagatgaaaggagggctgttggtgcggctctgcagtcgggaagactagtcgttacagactatgggctatggcggctgttcttccttgacacgtaaattgcttggaaagacctcctaaaagtcatcacaccacataaaagtcttcgcaccgctacagctctgtgaaaagactttggacgtactaggagtagtggagtattttaggaatggttgggctaggttgtacacttgtactcatctgtccgcaatcatctacactcactactacaaaaaaaaaaaaaaaa

SEQ ID NO: 4082 - protein, 519 aa, Zea mays
  misc_feature: PFam Name: p450; PFam Description: Cytochrome P450
  misc_feature: PFam Name: Pkinase; PFam Description: Protein kinase domain
  misc_feature: PFam Name: FH2; PFam Description: Formin Homology 2 Domain
  misc_feature: PFam Name: APC_basic; PFam Description: APC basic domain
  misc_feature: PFam Name: Pyr_redox_2; PFam Description: Pyridine
  misc_feature: GI Number: 50931295; NR Description: putative cytochrome P450 [Oryza sativa (japonica cultivar-group)] >gi|47777427|gb|AAT38061.1| putative cytochrome P450 [Oryza sativa
  misc_feature: GI Number: 57900477; NR Description: putative cytochrome P450-dependent fatty acid hydroxylase [Oryza sativa (japonica
  misc_feature: GI Number: 50904519; NR Description: putative cytochrome P450-like protein [Oryza sativa (japonica cultivar-group)] >gi|19386831|dbj|BAB86209.1| putative cytochrome P450-like protein
  misc_feature: GI Number: 50904521; NR Description: putative cytochrome P450-like protein [Oryza sativa (japonica cultivar-group)] >gi|19386832|dbj|BAB86210.1| putative cytochrome P450-like protein
  misc_feature: GI Number: 34909022; NR Description: cytochrome P450-like protein [Oryza sativa (japonica cultivar-group)] >gi|20804566|dbj|BAB92258.1| cytochrome P450-like protein [Oryza
MEAIHLAYVLVFLLPILLLRLRRRGPPPVKRPRTTTAHCPHPSPVLGNTLHFIRNRRRFFDWYADMLRAAPSGAIEAWGPLGAGHAVTTASPADVDHLLRSSFDKYAKGALFRDATADLIGDGLFAADGRLWSLQRKLASHAFSSRSLRRFTDGVLDVHLRRRFLPLLDAAARDGGAVDLQDALRRFGFRTICHVAFGVEGLDDDARRQDALFAAFDAAVEISFRRALTPATFVRRLTKLLDVGKSRRLREAVHAIDDYAMSVVESKVARRRNSLDDGAADLLSRFMAAMDDGGGSDSELGAMFPTPAAKLRFLRDVVVTFVLAGKDTTSSALTWFFWLLAANPRCERRAHEEAASCCGDGGDVKGMHYLHAAITEAMRLYPPVPFNGRVAVRDDVLPSGAALRAGWYANYSAYAMGRMEKLWGKDCLEFVPERWLGEGGEFVPVDAARFPVFHAGPRVCLGKEMAYVQMKTVAAAVLRRFRLDVVAPVANMEAPPAYEMTATMKMKGGLLVRLCSRED

SEQ ID NO: 4083 - DNA, 1385 bp, Zea mays
  misc_feature (1)..(1385): Ceres cDNA ID no. 21666077
  misc_feature (1)..(1385): Ceres CLONE  ID no. 1376592
  misc_feature (1)..(1385): Also known as  Ceres CDNA ID no. 24359701
gtttactctttcctcaccatcacatcgccgctgccgcgacccgcgggccgacgagatgagagccgccgctgcggcctccttccatctggcacccgccacgaaaccggcccatcgccgcggctgcaccacagagtcctgttccctgaagcctgcgccgactgctcggccacctcgcctccgctcgctcgccggccgggcgcctcttgtctgcgcctctctcgggatatctcatgataaagggttcgacatttctgaccccaatgttgttggacagaatgatttactgattgtgggccctggtgttcttgggcgaatcatagctgagaagtggaaaaaggagcatccaagttgcaaagtttatggccagaccgcaagcaaaaatcatcacaacgagttaacagatcttggcatcatcccctcattgaaaggcaccactattcatcagaaggttccacatgttattttctgcgctcccccgtctggttcagatgattaccctagggatgtcagggctagggcttgggacctgctatgtttagacaagctcaaccatcacagtatcatgcatagtgacagagaaaggggctgtaaaacatgggtgatttctcaattcttgagattggcagcatcaaattggactggtgaaggatctttcctgtttacatcaagtacagctctgtatgattgcagtgacaacagcatgtgcaacgaggattgtctgtcagtgccaattggcaggagccctcgtactgatattcttctaaaagtggaaaatgttgttcttgaggcaggaggctgtgttctcaggctggctggactttataagatagacagaggtgcacatgttttctggttgaggaaaggaactttagacacacgaccagatcatatcatcaaccagattcattatgaggatgctgcctcccttgctgtagcaatcatgaaaaagggactgcggagtcgaatatttctgggttgtgacaacaagcccctttccaggcaagaaataatggatgctgttaacaatagtggaaaatttgacacgaagtttggaggctttactggtactgacggtccattggggaagagaatggagaattcaaaaactcgggctgagatcggttgggaaccaaagtatccaagcttcaccgaattccttggtatcagcagttaacatccttgcatactgttcagttagtctgactcagctgagtagcaaccgtgattagattgtaccatcgtttgaatttttatggcctgaaccggtgatggtgtacatctcagcctactttgggcctgtccccagtatttttgattttcacactatttgagctatgaaccagacagatgccaccccatcccatcggataaaaaaaaaaaaaaaa

SEQ ID NO: 4084 - protein, 372 aa, Zea mays
  misc_feature: GI Number: 34914690; NR Description: P0560B06.4 [Oryza sativa (japonica cultivar-group)] >gi|15528677|dbj|BAB64743.1| P0560B06.4
MRAAAAASFHLAPATKPAHRRGCTTESCSLKPAPTARPPRLRSLAGRAPLVCASLGISHDKGFDISDPNVVGQNDLLIVGPGVLGRIIAEKWKKEHPSCKVYGQTASKNHHNELTDLGIIPSLKGTTIHQKVPHVIFCAPPSGSDDYPRDVRARAWDLLCLDKLNHHSIMHSDRERGCKTWVISQFLRLAASNWTGEGSFLFTSSTALYDCSDNSMCNEDCLSVPIGRSPRTDILLKVENVVLEAGGCVLRLAGLYKIDRGAHVFWLRKGTLDTRPDHIINQIHYEDAASLAVAIMKKGLRSRIFLGCDNKPLSRQEIMDAVNNSGKFDTKFGGFTGTDGPLGKRMENSKTRAEIGWEPKYPSFTEFLGISS

SEQ ID NO: 4085 - DNA, 1189 bp, Zea mays
  misc_feature (1)..(1189): Ceres cDNA ID no. 21666078
  misc_feature (1)..(1189): Ceres CLONE  ID no. 1380504
  misc_feature (1)..(1189): Also known as  Ceres CDNA ID no. 0
aaacactatcaaagtctctcaatcttatcaaccagccaaccaaccaaccaaccaaccaacgatggattccgagatcgccttcgactactctccattgctcaaaatctacaagagtggccgcatcgagcgcctcatgggagaaacggccgtcccaccgtctttaaccccacaaaacggcgtcatttcaaaggacgtcgtttattcacccgacgacaacctctccgtccgcgtttacctcccagagaaagctgccgacaccgatgagaaactccctctcctcgtctacttccacggaggaggcttcatcatcgaaacagctttctcaccgacttaccacaatttcctcacggcggccgtctctgcgtccgactgcatagcggtgtcggtggattaccggcgtgcaccggagcatccgcttccgatctctttcgatgactcgtggacgtctctcaaatgggtattcacccatatcgccggatctggaccggagagctggttaaacaaacacgccgacttcagcaaagtgttcctcgccggagacagcgccggcgcgaacatcgctcatcacatggcgatgagagctgcgaaagagaagctcagtcccgagttaagcgactcaggaatcttcgggatcatcttggttcatccttacttctggtcgaaagcacctgtcgacgacaaggagacaacggatgctgcggtgcggtccaagatcgaagcgatatggatgatggctagtcctgacaacaaagacggagtggatgatccgtggctcaacgtggttcagtcagactcggtggatatctccgggttgggctgcgggaaggttttggtgttggtggctgagaaagatgcgcttgtgagacaaggttggggttacaaggcgaagcttgagaagaacggttggaaagggaaagtggagttggttgagagtgaaggtgaagatcatgtgtttcatttgacgagacctgattgtgagaatgctcttgaagccatgaagaagttcgcagggtttattaagggagagatgtaataggcgctctttcgtctggatgaaagattacgatatgtaatggaataattatctgtctatcagtctctgtaatgtttttaagtgatttatcatattagcacgaaaggcatcaataaaattctatgggttcagttctctaaaaaaaaaaaaaaaaaa

SEQ ID NO: 4086 - protein, 323 aa, Zea mays
MDSEIAFDYSPLLKIYKSGRIERLMGETAVPPSLTPQNGVISKDVVYSPDDNLSVRVYLPEKAADTDEKLPLLVYFHGGGFIIETAFSPTYHNFLTAAVSASDCIAVSVDYRRAPEHPLPISFDDSWTSLKWVFTHIAGSGPESWLNKHADFSKVFLAGDSAGANIAHHMAMRAAKEKLSPELSDSGIFGIILVHPYFWSKAPVDDKETTDAAVRSKIEAIWMMASPDNKDGVDDPWLNVVQSDSVDISGLGCGKVLVLVAEKDALVRQGWGYKAKLEKNGWKGKVELVESEGEDHVFHLTRPDCENALEAMKKFAGFIKGEM

SEQ ID NO: 4087 - DNA, 875 bp, Zea mays
  misc_feature (1)..(875): Ceres cDNA ID no. 21666079
  misc_feature (1)..(875): Ceres CLONE  ID no. 1383140
  misc_feature (1)..(875): Also known as  Ceres CDNA ID no. 24359671
ctctcctgaagcacgacagccagtccagccaccatttgggtgctcatctccctctgctcggcacctagccccagctcgcccgagctccctgcgccgacctcatcttccccatggcgcgtcaccttctagtcctctccttcccacggcacagcagcgcccctgcagctccccttctccagatccatggcacccaacaccttgagcgcccctgccgctgctcctccaccgggatctcctcctccactaggcgtccaggcttgtcccaccgtggctgcccctcctccatctcctccctccccaccaggttacccagattccatggccgccgccgccccagccatctccctggtggccgacctcgcccctgccccagccacagctcccccttcggccctgctgctgcaagcactcagcctctcccatggcacacggtactcgtccagcccctttctactggtggctgagccatctctctggtgctcgatgaaatgaccatgaggagttttgtgttgtgtgcagccccatctgcaacaccgtcgacccccgacgaggtcctttctcgccttgtcgttttagtactcggcgtcgattaagtagatgctaaccgtgtgtatattcgtgtgttcttgtgaggagaaatcccatgatttgggggaagacgaagtccaagcacaacccccgccaatcgctcgatgaaaaatctaaaccaaaaccctcagcgttttcaagggttccggagggattttatgttggtaaggtaatttgtgtcctaattagttcactcagttattgagttgaagagattgttagttgtatgtgtcgatgatgctattttgattagcaggtgttgtgcggtgtgaaaaaaaaaaaaaaaa

SEQ ID NO: 4088 - protein, 117 aa, Zea mays
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: FAP; PFam Description: Fibronectin-attachment
  misc_feature: PFam Name: TT_ORF2; PFam Description: TT viral ORF2
  misc_feature: GI Number: 7441829; NR Description: proline-rich cell wall protein - upland cotton >gi|435039|gb|AAA79360.1| proline-rich cell
  misc_feature: GI Number: 7441828; NR Description: extensin-like cell wall protein - sea-island cotton >gi|451544|gb|AAA79364.1| proline-rich
  misc_feature: GI Number: 13265426; NR Description: At2g14890 [Arabidopsis
  misc_feature: GI Number: 42570779; NR Description: arabinogalactan-protein
  misc_feature: GI Number: 12642860; NR Description: putative proline-rich protein [Arabidopsis thaliana] >gi|11908042|gb|AAG41450.1| putative proline-rich protein [Arabidopsis thaliana] >gi|21928071|gb|AAM78064.1| At2g14890/T26I20.5 [Arabidopsis
MARHLLVLSFPRHSSAPAAPLLQIHGTQHLERPCRCSSTGISSSTRRPGLSHRGCPSSISSLPTRLPRFHGRRRPSHLPGGRPRPCPSHSSPFGPAAASTQPLPWHTVLVQPLSTGG

SEQ ID NO: 4089 - DNA, 1728 bp, Zea mays
  misc_feature (1)..(1728): Ceres cDNA ID no. 21666081
  misc_feature (1)..(1728): Ceres CLONE  ID no. 1386757
  misc_feature (1)..(1728): Also known as  Ceres CDNA ID no. 25088176
atcattcatcaacagccgcttcgttgctctccacagtctccacgccgccgactcctgcgacgcacagacactggtcacccatggccggccgccgccgccgctgtgtgcatccccgtcaagcacggttgttgccgctgccttccccaggagtgccctcgcctctggaatccaacactctcagggaagttgctgttgcagaaagcccctccaaaaagatttgccacgccttaagctctaccccctcttcggcacctggccctgatgtttgggtggatctcttggacagcctgcttctccaaataattgttcttgttagctcattccatgatctccttgctttcattggcacctgccgttcttggcgcgctgtgctctcttccctcccacctgtatatacctttaacatcccacctctccaccttcgatcagatggttgtgattctcacccccatcgctggtacatgagggcaaaacttttatccgatatcaattggcagctcactgatcctgcgaagcaaacctcctcccttagttgttcggccctccaagactttcaggtctacatgcggtatttgggctgctcatatggttatcttatcttctccaatttggagcaatgcctccttgtcaatgtgtacagcggtgctaccgtgcggcctcccaagctcaaattcactgacaaccgcaatgtctaccatggagcccttgttgctccaatcaacttatctaattcatgtctcctattttgctcaagatcatccatttttcagtggaaggttggatcagacttttggtctgagcaccctttgggtgtcgagtgtattagtcaaatcgtgtcgttcaaaggtgagatatttgctattgacttacttaggaggcttcacagaatacagttggaacctcagctgagcttgcaggaagtagcagttgtctgggacgcggacatgtttctaggcctggatagtacacaatggttggtggtctgtggtgacatgcttctcatggttcacttgtcagtaacaatcgattctccctgttctggattttctgagacctttaatgtatgccgcctcgactttcaagttgagccagctaagtgggtaaaagtggataatatgggagacaatgctctatttgttggtactgatgggaggagtccaacgttttcttgcctgggtcccgagaaatggggcgggaaaaggaactgtatttacattgccagcccgcttgcagattctaatgagccttggggtgtgttcgaagttggtcaggcggtgcgttgttacaatgcaaaaaagtatctgacccgtgtacattcgagccgactgccaagcctttgggtgcttcccagtcttgtttatggtgttggccagtgaccaatccacgcttgccttggagttttggcaatttgtgaggatccatttcctttgatgctccaatatgatgtattagttagtcctgttgctttgttatttcttattttggcattcagtgtcctgtacagattgcagctaaggtgttgttgatgttgatctcaagatatatctaggtttctaaaccgagttttctcactgtgctgctggacagtaactgaaactatttggtatgagactttgctatgacagagcctaaagttcattgtagatgatggtcatttgaagtactttagcattgttgtggaagatgaatagattattgtattatggttggccaaaaaaaaaaaaaaaa

SEQ ID NO: 4090 - protein, 431 aa, Zea mays
  misc_feature: PFam Name: F-box; PFam Description: F-box domain
  misc_feature: GI Number: 24413941; NR Description: putative
MAGRRRRCVHPRQARLLPLPSPGVPSPLESNTLREVAVAESPSKKICHALSSTPSSAPGPDVWVDLLDSLLLQIIVLVSSFHDLLAFIGTCRSWRAVLSSLPPVYTFNIPPLHLRSDGCDSHPHRWYMRAKLLSDINWQLTDPAKQTSSLSCSALQDFQVYMRYLGCSYGYLIFSNLEQCLLVNVYSGATVRPPKLKFTDNRNVYHGALVAPINLSNSCLLFCSRSSIFQWKVGSDFWSEHPLGVECISQIVSFKGEIFAIDLLRRLHRIQLEPQLSLQEVAVVWDADMFLGLDSTQWLVVCGDMLLMVHLSVTIDSPCSGFSETFNVCRLDFQVEPAKWVKVDNMGDNALFVGTDGRSPTFSCLGPEKWGGKRNCIYIASPLADSNEPWGVFEVGQAVRCYNAKKYLTRVHSSRLPSLWVLPSLVYGVGQ

SEQ ID NO: 4091 - DNA, 883 bp, Zea mays
  misc_feature (1)..(883): Ceres cDNA ID no. 21666082
  misc_feature (1)..(883): Ceres CLONE  ID no. 1386939
  misc_feature (1)..(883): Also known as  Ceres CDNA ID no. 24360838
ctgattattatctttcgaaaatgtttattctccggtcgcagaagctatggacggtggttatgattctagtgatgtcgtcgcgtgtaacgcactcgctgcacttcgatctgcactcgggacggacgaagtgtatagcggaagacatcaagagcaattcaatgaccgtgggaaagtacagcgtcgataaccctcacgaaggccacgatttgcctcaatctcacaagatctccgtcaaggtgacgtcaagctcagggaatgcgtaccatcacgcggatcaagtggcgtctgggcaattcgcgttctcggcagtggaagctggggactacatggcttgtttctcagccgttgatcataagcctgaggtgactctgagcattgattttgagtggaggacgggtgttcaatccaagagctgggctactgttgccaagaagagccaagtcgaaaccatggagtttgatgtaaagagccttcttgatactgtcaactctattcatgaagagatgttttatcttagagaaagggaagaagaaatgcaagatctgaaccggtcaacaaacactaaaatggcgtggttgagtttgctctctttattcgtatgcataggagtggcagctatgcagtatgtacacttgaagacctttttcgagaagaagaaagtcatctaatttgttacttacaggcaatcacacgcacgaaacaatctacttatcttttgggtgttgtatattaagtcaatgactactgcaagcatgttctcttgagacttagaactttgattttatgtgccagtattgtccttcttgggtttagttctttgtttagatttgttggtccttaatacttggataatttgatggtttaaactaaaaaaaaaaaaaaa

SEQ ID NO: 4092 - protein, 883 aa, Zea mays
CTGATTATTATCTTTCGAAAATGTTTATTCTCCGGTCGCAGAAGCTATGGACGGTGGTTATGATTCTAGTGATGTCGTCGCGTGTAACGCACTCGCTGCACTTCGATCTGCACTCGGGACGGACGAAGTGTATAGCGGAAGACATCAAGAGCAATTCAATGACCGTGGGAAAGTACAGCGTCGATAACCCTCACGAAGGCCACGATTTGCCTCAATCTCACAAGATCTCCGTCAAGGTGACGTCAAGCTCAGGGAATGCGTACCATCACGCGGATCAAGTGGCGTCTGGGCAATTCGCGTTCTCGGCAGTGGAAGCTGGGGACTACATGGCTTGTTTCTCAGCCGTTGATCATAAGCCTGAGGTGACTCTGAGCATTGATTTTGAGTGGAGGACGGGTGTTCAATCCAAGAGCTGGGCTACTGTTGCCAAGAAGAGCCAAGTCGAAACCATGGAGTTTGATGTAAAGAGCCTTCTTGATACTGTCAACTCTATTCATGAAGAGATGTTTTATCTTAGAGAAAGGGAAGAAGAAATGCAAGATCTGAACCGGTCAACAAACACTAAAATGGCGTGGTTGAGTTTGCTCTCTTTATTCGTATGCATAGGAGTGGCAGCTATGCAGTATGTACACTTGAAGACCTTTTTCGAGAAGAAGAAAGTCATCTAATTTGTTACTTACAGGCAATCACACGCACGAAACAATCTACTTATCTTTTGGGTGTTGTATATTAAGTCAATGACTACTGCAAGCATGTTCTCTTGAGACTTAGAACTTTGATTTTATGTGCCAGTATTGTCCTTCTTGGGTTTAGTTCTTTGTTTAGATTTGTTGGTCCTTAATACTTGGATAATTTGATGGTTTAAACTAAAAAAAAAAAAAAA

SEQ ID NO: 4093 - DNA, 1375 bp, Zea mays
  misc_feature (1)..(1375): Ceres cDNA ID no. 21666083
  misc_feature (1)..(1375): Ceres CLONE  ID no. 1387952
  misc_feature (1)..(1375): Also known as  Ceres CDNA ID no. 25891918
aagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggccgccgaggaccagctgcggcagctgcgcgcgcgccgccgcgaggacgcccgcgccaacgcccgcgccgccgagatcttcgcgggccaccgcgccgcctggatggaggccgagcgccgcctgcaggcccgcgccgccgccgccgcggacgaggccgcctccctccgcgcgcacctcgccgacgccgaggccgacgccgctgcgctgcgcgcccgcgccgagcgactcgagcgcgaggccgccgagcgggatgagctgctcaccgcgctcctcgcggccacctcgcgcgccgggtactccggcggcgggcccctgccccgcgtccacgacggggaggagcaggaggaggaggagcgggcgcgccacgacgcgcgtggggagcgggagccggagcacgagcaggacccgctgcccgcgccgccgttggaccacgccgctgacaccaccgacgccgaggccctcgctgccgccgccgcgctctacgctcagcagcgccagaagcacgacgacgacttctacacggcggccatggccgcgtcgggaatgccgccgtggatggagatggaccgatcaaaagcctggcaggtctgtgacacgacaaaaagttgcctccccttttcgaccctttttacctgctgccagcttcggaatcgaaaggacacaaatctaagggtggattgctttatcgttgcttttctaatgatagtatgagtgtagattttagtacaagtaggatctactctattctttccatctgtgttaatgaaatctatcagatgagctttggttcatggcttcatgcaagttccagtatccttcaatagctctgctctgcatacacatatttccatgagtgatagtgataccatgtatccccacgcacagcacaatgctatgctatgcctgcggcagagtagaacggacagacaaccactttgatagcctctccatcaaacagaatccgatactgtatccgtggggcaacgcctcctccaagaaagctacctgttttttgttatctactccaccgaagtcacctgaatattatctggtccatatggtgtctagaatcaaaaaaaaaaaaaaaa

SEQ ID NO: 4094 - protein, 305 aa, Zea mays
MAAESARPPSPPRDSGCPAGAGDSTSSQLTATYLGVSFALFLATLPSGTAARHVASLQSRGRLLASRLLAAEDQLRQLRARRREDARANARAAEIFAGHRAAWMEAERRLQARAAAAADEAASLRAHLADAEADAAALRARAERLEREAAERDELLTALLAATSRAGYSGGGPLPRVHDGEEQEEEERARHDARGEREPEHEQDPLPAPPLDHAADTTDAEALAAAAALYAQQRQKHDDDFYTAAMAASGMPPWMEMDRSKAWQVCDTTKSCLPFSTLFTCCQLRNRKDTNLRVDCFIVAFLMIV

SEQ ID NO: 4095 - DNA, 1809 bp, Zea mays
  misc_feature (1)..(1809): Ceres cDNA ID no. 21666084
  misc_feature (1)..(1809): Ceres CLONE  ID no. 1390107
  misc_feature (1)..(1809): Also known as  Ceres CDNA ID no. 0
ctctctctctctcgtgcgctccctctcccactcgacggaggagaaaggggggaaagcaatcggaagcgcgagccggcgagcgagatgggcgccgggagcagccgcgcggacgcgccgtcgcggcgccgggcgcgcctcgggctcggagggtgcttcgggacccgatcctcctgctcctcttcctccccagccgccgccgccgcagcgcacgacggcgggagcttcaccttggccgggtcctcctcctccagcgctatcgaggtacaatcagggcgaccagtacgtgccctgaattttcaggcttctctagctgctaaggatctccagatttccaccgcgtcaagtccaaggctgcattcctcttcaagtaccataagccatcacctcagattcaatcacctcaattgccatgaaaacaaggaagatggcctggggactgaaaatgctgaaacaagtggccttgaaagctcatctaggaaggctgtcatggttaggggaagtttcagtaatgaagctgttaatagtgatatgtcaggagaagggataagttttataggatcagagctggaaaatattcctagcacagtctccactaatgaaactggtggctcagccgctgaatctggtttgggcccctcattgatggcatctgaaaggatcatgtctgacttagaaggagaggtatctccgcaagggacctcatccacaactgccatgacaagtgaaagatcagatgtatctcaagctagcttaacatctatgtttcctaactcttcaactgcatcatctgtgattgtggaaccaatgccagatccaatctctaccagggcagatgtccccatattcagtgggccacatggtgagcctggagggagtatattacatgatgacatgatgagcattttctcaaatgacggtctaggacgctctagggattctagcagcagtgaaacaaggaggagtcacagaaggattctatgggacacgttttccaggcgtggctcaagaggttatccagaatttgatgctgatgacctcggattttacagcacatggctagaccttggtgatgacatttttgaagagttgggggaatcaagatattttcatcgcaggcgacatggttcgatcagagtaagccagtattcaagatcccggattagggagcatcgccgtgctgtttttgatagtggtaatgaacaaagcactgctgcatgtcctttggggattcatcaaactggccgatgcacctgtgattctttcttggttgctgaagaatctagtgcccgagcaagtatatcaagaattgtcatgttaactgaggcgttatttgaggtgttggatgaaattcaccgtcaacctgcatcactttcactttccatggtctctgttcaggctcctgaatctgtagtcaattcgttgccatgcaagagctacaaaaagcttgaggcaccccaacgcagtgatgatatggaacagtgccatatctgcctaaatgaatatgaggatggagaccagataagaactcttccttgcaagcacgagttccacctgcaatgtgttgacaaatggctgaaagaaatacacagggtgtgccctctgtgccgcggagacgtctgctaagggggcgtttggttacttgtatgggtgagcctggctcgtatctagtgagcctggctcagactggactggctgagtgcatgcagtatagcgtgtttggttgtgtgtatgtggccagtctggttcacaagagatgttgtttggttgcttgcatgagtacatggtgcatgagtaaaaaaaaaaaaaaaa

SEQ ID NO: 4096 - protein, 512 aa, Zea mays
MGAGSSRADAPSRRRARLGLGGCFGTRSSCSSSSPAAAAAAHDGGSFTLAGSSSSSAIEVQSGRPVRALNFQASLAAKDLQISTASSPRLHSSSSTISHHLRFNHLNCHENKEDGLGTENAETSGLESSSRKAVMVRGSFSNEAVNSDMSGEGISFIGSELENIPSTVSTNETGGSAAESGLGPSLMASERIMSDLEGEVSPQGTSSTTAMTSERSDVSQASLTSMFPNSSTASSVIVEPMPDPISTRADVPIFSGPHGEPGGSILHDDMMSIFSNDGLGRSRDSSSSETRRSHRRILWDTFSRRGSRGYPEFDADDLGFYSTWLDLGDDIFEELGESRYFHRRRHGSIRVSQYSRSRIREHRRAVFDSGNEQSTAACPLGIHQTGRCTCDSFLVAEESSARASISRIVMLTEALFEVLDEIHRQPASLSLSMVSVQAPESVVNSLPCKSYKKLEAPQRSDDMEQCHICLNEYEDGDQIRTLPCKHEFHLQCVDKWLKEIHRVCPLCRGDVC

SEQ ID NO: 4097 - DNA, 1961 bp, Zea mays
  misc_feature (1)..(1961): Ceres cDNA ID no. 21666085
  misc_feature (1)..(1961): Ceres CLONE  ID no. 1391724
  misc_feature (1)..(1961): Also known as  Ceres CDNA ID no. 25088178
catccagagaagctagagtccaggtctcactcgcgaccgagagccacagagaaatggggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctaggggcggacggctaccacaaatacaagggagacgtgcagctgatgagtgacactggcctggaggcctaccgcttctccatttcttggtccaggcttattccaagaggaagaggagccatcaaccccaagggcctcgagtattacaacaacctcatcaatgagctagtaaaacgaggaattgagatacacgtgaccctgtcccacctggattaccctcagatcctggaggacgagtaccacggctggctgagccccaggatggtggacgacttcgaggcgtacgcggacgtgtgcttccgcgagttcggcgaccgggtgaggcactggaccaccatggacgagccgaacgtcaactccatcgccgcctacgacaacggcgccttcccccccggccgctgctccccgccgttcgggttcggcactaactgcaccgccggcggcaactccagcgtcgagccctacgtcgtcacccacaactgcatcctggcgcacgccgccgtcgccgccctctacacccgcagctaccgtgccgaacagcagggcgtcgtcggcatcaacatctacaccttctggaactaccccttctcccccgcccccgccgacgtccaggccacgcagcgctcgctcgacttcatgatcggctggatggtcaacccgttggtgtatggagactaccctcaagtgatgaagaggatagtcgggtcccgccttcccaggttcaccaagcggcagtcggagatggtccgcgggacggcggatttcattggcataaaccactacacctccgtgtacgtcagtgatcgccccaacgacgcagcagccgacaccacggggccccgggactacaatgctgatctgtcggctaccttcagattttctcgcgatgatccagccactggccagttcgtcccaatcaacatgccaagcgacccgcagggactgcaatgcatgctcgagtatctcagccaaacctacaacaacatccccgtctacgtgcaggaaaacggctacggggcgctcttcaacgactccatccatgaccacgagagagccgagtacttgagtgcctacatgggcagcgcactcgctgcactcaggaacggagccaacgtgaaagggtacttcgtctggtcgttcttggacgtgtttgagttgttggctggctactactcgcgatacggcctctaccatgtcgatttccaggacccggagctgccgaggacgccaaaactctctgcgctgtggtacggcaagttcttgaagagtgaaatcgacgacataatagagaacgttgtcgtcagcgctactgacgacgcgcgctcgcatgctgctgaacaatgagttagattgctagcgagcagcagcacacgacatgcatgtcgtagtagcggaggaaaagaatgttgtttcttatccattctttcttttttcacaagtccacagaagctcagaattttcagcagttcgtcaggctcggaattcagtgttcgtgaatcgtagccatagccaccctctttaatttggctgtagtagccctgtagtatgcgctacgtacggcaacagttgtcatgagtcactctctgtcgctactgacacaataaataatacagaaaggaactgcttttgccaaaaaaaaaaaaaaaa

SEQ ID NO: 4098 - protein, 534 aa, Zea mays
  misc_feature: PFam Name: Glyco_hydro_1; PFam Description: Glycosyl
  misc_feature: PFam Name: Mucin; PFam Description: Mucin-like glycoprotein
  misc_feature: PFam Name: MAGE; PFam Description: MAGE family
  misc_feature: GI Number: 27363302; NR Description: At4g27830/T27E11_70 [Arabidopsis thaliana] >gi|15982822|gb|AAL09758.1| AT4g27830/T27E11_70 [Arabidopsis thaliana] >gi|18417073|ref|NP_567787.1| glycosyl hydrolase family 1 protein
  misc_feature: GI Number: 6056418; NR Description: Similar to beta-glucosidases [Arabidopsis thaliana] >gi|25289480|pir||G86158
  misc_feature: GI Number: 17065374; NR Description: Similar to beta-glucosidases [Arabidopsis thaliana] >gi|15146266|gb|AAK83616.1| At1g02850/F22D16_15 [Arabidopsis thaliana] >gi|18379020|ref|NP_563666.1| glycosyl hydrolase family 1
  misc_feature: GI Number: 12746303; NR Description: beta-glucosidase [Musa
  misc_feature: GI Number: 42570185; NR Description: glycosyl hydrolase
  misc_feature: Phenotype: Useful for delaying flowering time
  misc_feature: Phenotype: Useful for making ornamental plants with modified leaves
  misc_feature: Phenotype: Useful for making plants with altered leaf shape
  misc_feature: Phenotype: Useful for making plants with increased biomass
MGGPGRPWRRHVFLVVSLQLLLVAPWQDETAARALNFTRQDFPRAFVFGAGTSAYQYEGATDEDGRSPSIWDNFTHAGRMPDKSTGDLGADGYHKYKGDVQLMSDTGLEAYRFSISWSRLIPRGRGAINPKGLEYYNNLINELVKRGIEIHVTLSHLDYPQILEDEYHGWLSPRMVDDFEAYADVCFREFGDRVRHWTTMDEPNVNSIAAYDNGAFPPGRCSPPFGFGTNCTAGGNSSVEPYVVTHNCILAHAAVAALYTRSYRAEQQGVVGINIYTFWNYPFSPAPADVQATQRSLDFMIGWMVNPLVYGDYPQVMKRIVGSRLPRFTKRQSEMVRGTADFIGINHYTSVYVSDRPNDAAADTTGPRDYNADLSATFRFSRDDPATGQFVPINMPSDPQGLQCMLEYLSQTYNNIPVYVQENGYGALFNDSIHDHERAEYLSAYMGSALAALRNGANVKGYFVWSFLDVFELLAGYYSRYGLYHVDFQDPELPRTPKLSALWYGKFLKSEIDDIIENVVVSATDDARSHAAEQ

SEQ ID NO: 4099 - DNA, 1865 bp, Zea mays
  misc_feature (1)..(1865): Ceres cDNA ID no. 21666086
  misc_feature (1)..(1865): Ceres CLONE  ID no. 1392496
  misc_feature (1)..(1865): Also known as  Ceres CDNA ID no. 25088179
ctttttatatcaatatataaaatgttgaggttccagggcaaccagcgggtttgaagtttgaactcagtccctccccccgcaagctttctctctctctctctctctctgatcaaatgtggcgagatctgtgtgagtaagcgtgaataccactacggtttttcgtcctccccttcccttcttgagctacttgagctactctggtcacttcttggagccggcaactgccagttgggggttttttaggacaaagggagcaaaaaaaaacgaacaccttcctgagcttaagacagcatggatcagtacgaggtgctggagcagatcggcaaaggagcatttggctctgccctgctggtcaggcacaagctggagaggaagaagtatgtgttgaaaaagatccgtcttgcgcgtcagacagaccgcactcgccggtccgcccaccaagagggttgctacgtctgcattgttatagggtactgcgagggaggagacatggctgaagctattaaaagggctaatgatacccacttttctgaggagaagctttgccagtggctagtgcagcttctcatggcccttgactatttgcatgcacatcacattcttcaccgtgatgtgaagtgctctaatatatttctcactagggaccaaaacataagactcggtgactttggtctcgcaaaaatattgaccgccgatgatctggcatcctcgattgtaggaacaccaagttacatgtgcccagaactcctcgccgatataccttatggtaccaaatctgatatttggtcactaggatgctgcatgtatgaaatggctgcgctcaaacctgcttttagagcttttgatatgcaaaaccttatcaacaagattaccaagtcgatagtatcacctttgccaacaagatattctggtgcatttcgaagacttgttaggagcatgctacggagaagtccagagcataggcctagtgcagccgaactacttaagcatccacatctggaaccgtacgtcctgcaactccatctgaagtcacacctttctcgcagcatagttcctgttcaccagtctccaagtgagaagaggatgacattcgccgcagagcccgtttgcaggagcaagggcaggaggaactctttaggcagcgaaaggatgatagcagcctttagcaaaccttctcctgatagaagttctgtcagctctattcggagtgtcaaggacgagtacaccgccacacagagtgtcagagagctatccgttgatgacagcatggtcgaggttgccagtaaacccgtggcatcaaggacctcagatgtcatgaggactccgaaggcgactccgtggaagatgatgacgactctgaggaatcggctagaagctccacaagcatcatatgaccatacagagcagttttcaagaacaccggttgacaagaggaacagccgcgtggcccgcagagcatcgcttcctctgcccgtatttgagaccccaatcctcccgggatccccttgtcaccaaatcaacccagtgttggtcgtggccccccggtttattttgttactatgctaccagttcttagttagttaatggcgctctggctagctagctagtgatgtaccaatgccccacacacacacacacacaccccagcagaattagcagcagcagggagtagcagtagaggtagagctggaggagtcttgagctaggaaggagaaggggattagtgagatgaaattcctatactgtgatgtagcccaaggatgtaccagtagcttcatatgcatcagtgctgcctgctgaagaacattcagacatctatggattcagccattcaggccggccgattgccaaaaaaaaaaaaaaaa

SEQ ID NO: 4100 - protein, 430 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 37718868; NR Description: putative LSTK-1-like kinase [Oryza sativa (japonica cultivar-group)] >gi|50917187|ref|XP_468990.1| putative LSTK-1-like kinase [Oryza
  misc_feature: GI Number: 18766642; NR Description: NIMA-related protein
  misc_feature: GI Number: 51963296; NR Description: PREDICTED P0534H07.24 gene product [Oryza sativa (japonica cultivar-group)] >gi|50934591|ref|XP_476823.1| putative NIMA-related protein kinase [Oryza sativa (japonica cultivar-group)]
  misc_feature: GI Number: 15637110; NR Description: LSTK-1-like kinase
  misc_feature: GI Number: 15221843; NR Description: protein kinase family
MDQYEVLEQIGKGAFGSALLVRHKLERKKYVLKKIRLARQTDRTRRSAHQEGCYVCIVIGYCEGGDMAEAIKRANDTHFSEEKLCQWLVQLLMALDYLHAHHILHRDVKCSNIFLTRDQNIRLGDFGLAKILTADDLASSIVGTPSYMCPELLADIPYGTKSDIWSLGCCMYEMAALKPAFRAFDMQNLINKITKSIVSPLPTRYSGAFRRLVRSMLRRSPEHRPSAAELLKHPHLEPYVLQLHLKSHLSRSIVPVHQSPSEKRMTFAAEPVCRSKGRRNSLGSERMIAAFSKPSPDRSSVSSIRSVKDEYTATQSVRELSVDDSMVEVASKPVASRTSDVMRTPKATPWKMMTTLRNRLEAPQASYDHTEQFSRTPVDKRNSRVARRASLPLPVFETPILPGSPCHQINPVLVVAPRFILLLCYQFLVS

SEQ ID NO: 4101 - DNA, 1918 bp, Zea mays
  misc_feature (1)..(1918): Ceres cDNA ID no. 21666087
  misc_feature (1)..(1918): Ceres CLONE  ID no. 1395854
  misc_feature (1)..(1918): Also known as  Ceres CDNA ID no. 0
gccccccgctcacccgcgccctccgcatcccgacacccccatggtcagcggcttcgctccgggcgacatggtctggggaaagaagctgaaccacgccgcctggccgggcctcatctactccgccggagggaacggcaccggccacgagggccagcttctcgtatcctactttggcgacaaggccttcgcctggtgcgacacagccgagctcaggccctatgaaccctacttccctgtcgccgagctctatgacgacggcggcgaggatttcgacgccgccgtcgaggcctccctcgacgagttctccagccgcgtcgagtccgccctcgcctccgccgcccgccctttcgcccccgccgatttccttgcctcgctccatgatctcgccgcggatcgcatgggcttcaccaatagggtgcaggccgccgtcgtcaaggcgcatctcagagccttcgacgccttcagggctctgccggacccacctcagtacaccttggagctcggtctactcccagacgtcccgctcccgctgcccaatcctaaagctgccacggatgccgccttcagctcctacaccacccccgcttccagtttcaggaggggcaggaagaggaaggaggaactcatcaaggacgatgactccgatgaggactgggaccctagcaagaggggtgccaccgacttggattctgatgtggactttgactgcaggagaggatccagaggcaggggcaggggcggcggcggcactggtgcgtcgcgtggcaggcctcgagggaggcccaggaaagcagatgcctgcatggacgaagatgagattcaagacaaactggagtatccgtcggctgctgagatgttgctgcagcttctgtccatcgccacggatcctgtaaatggcaattatgactctgctcctgtgattgttagcttcttctcaaagcacaaggactccgatgtgcctagtttatatgaagacaaagaactgattgagaattttggtggcaagaagggtaagaaaaagtccatcggaagcttgggcccagctacaaagccagaagccagcgatgatactgtggatggtcagaggggccgtaggaagtctgctgggagcttgtactcagctagaaaggccgaagattcatattggtgtgatattatcatcagcgatttcgatgacggagacagtgactatgacagtcacaagaggaagcggccctgtaacaggagcaccaataagaagatgaagcaggaggagccacctcaaggagccccatcatcgaatgcaaaacctgcagatggtccagccgcccttattctacatttcagcagtccagaagctattccttctgttgatgacatcaatagcatattccgtattcatggacctattgtggagcgtgagactgtgatcactaagaagtcaaagattgcaaaagtagttttctctaagagtgttgatgcagagcaggcacatcacagttccggaaagcgtaatgcatttggtccatcgcttctcacatctgaaattaagtacttgccatcggcacctcaggtttcttaaatgccgcagtctggactggtggatacgccgtggaaatgcgccatgaagcttggagcaacggagcataagttggtgtcactgactttactgaccaggtcacagtagtcactgagttgagtgagcaaattttaggctttctgtggttacatgcatccatttgactgattgtcgacccggagtttgttgtttatgttgatagtagattagattatgtagcatgatgtgcttcctcttatgctagcaacttttttttggtattgcctagtaattgcacagctgtggatctctctattatgtttttttatttgattgtcacgaggctagtgaagccgctttagtgcaaaaaaaaaaaaaaaa

SEQ ID NO: 4102 - protein, 506 aa, Zea mays
MVSGFAPGDMVWGKKLNHAAWPGLIYSAGGNGTGHEGQLLVSYFGDKAFAWCDTAELRPYEPYFPVAELYDDGGEDFDAAVEASLDEFSSRVESALASAARPFAPADFLASLHDLAADRMGFTNRVQAAVVKAHLRAFDAFRALPDPPQYTLELGLLPDVPLPLPNPKAATDAAFSSYTTPASSFRRGRKRKEELIKDDDSDEDWDPSKRGATDLDSDVDFDCRRGSRGRGRGGGGTGASRGRPRGRPRKADACMDEDEIQDKLEYPSAAEMLLQLLSIATDPVNGNYDSAPVIVSFFSKHKDSDVPSLYEDKELIENFGGKKGKKKSIGSLGPATKPEASDDTVDGQRGRRKSAGSLYSARKAEDSYWCDIIISDFDDGDSDYDSHKRKRPCNRSTNKKMKQEEPPQGAPSSNAKPADGPAALILHFSSPEAIPSVDDINSIFRIHGPIVERETVITKKSKIAKVVFSKSVDAEQAHHSSGKRNAFGPSLLTSEIKYLPSAPQVS

SEQ ID NO: 4103 - DNA, 2162 bp, Zea mays
  misc_feature (1)..(2162): Ceres cDNA ID no. 21666088
  misc_feature (1)..(2162): Ceres CLONE  ID no. 1397740
  misc_feature (1)..(2162): Also known as  Ceres CDNA ID no. 0
aagaagcagacgaacaccattctgggtggagccacttggaggcagcagcgaacaccattcttcgtgcaattattatctctctagataatagcacacttaactacagtacacatatatagcgaagagccttgacgtcgagggcagcaccgatcaagagctgcagtgcggagcagctcaatccagagctgtaatggcgacggtcctccttccgctgctgctcttgctcggctcggcggtgacgctcctaacgtgcgcgggcgcgggcgcgtcgttccccgtcaatgtctggccaaagccgacgtccatgtcatgggcggagccgcacgcggccgtaccggtgtcgccgtccttccacatcgtggcgtcatcgggtaacccgtacctcgcctcggccgcggagcgctacgccaagctgctgttcagggagacgtaccgacccatcgttcggccggcggtcaacgtcaccgcggggaacgcgctggagaagctgaccgtggcggtgtccgacctcgccgccccgctgcagcacggcgtggacgagtcctacacgctggagatcctccccacgggcgccgccacggtgaccgcggccaccgcgtggggcgccatgcgcgggctggagacgttctcgcagctgtcgtggcgggccggccgcggggacctcctgctggtggccgccggcgtgcgcgtcgaggaccggcccctgtacccgcaccgcgggctgatgctcgacaccggcaggacctacttccccgtggccgacatcctgcggaccatcgacgccatggcggccaacaagatgaacgtgttccactggcacatcacggactcgcagtcgttccccatcgtgctgccctccgagccgtcgctcgccgagaagggcgcctacggagaggacatgcggtacaccgtcgaggatgtcgagcacatcgtcgagttcgccatgagccgcgccgtccgcgtcgtgccggagatcgactcgcctggccacacagcttcgtgggccggcgcgtacccggaggccgttacctgcgcgggcaagttctggctgcccgacggcgactggaaccaccgcctcgccgccgagccgggctccggccagctgaacccgctggcggccaagacgtacgaggtcatcaccaacgtggtcaacgacctgacctccctcttcccggacggcttctaccacgccggcgccgacgaggtcaccccgggttgctgggaggcggaccccacgatccaggccgacctggagcgcggcgccacgctgagccagctcctggagcggtacgtgagcgcggtgcacccgctggtggtgtccaggaaccgcacggccgtgtactgggaggacgtgctgctggacgcggccgtgaacgtgagcgcgtcggcgatcccgccggccaccaccgtcctgcagtcgtggaacaacgggcccaacaacaccaagctgatcgtgcaggccgggtaccgcgccatcgtctcctccgcctccttctactacctggactgcgggcacggcgacttcgtcggcaacaacagcatctacgacgaccccaacagcgacttcgacgcgaacggcgggtcctggtgcgggccctacaagacgtggcagcgggtgtacgactacgacatcgcgtacgggctcacccccgaggaggcccagctggtcctcggcggcgaggtggcgatgtggacggagcaggtcgacacgaccgtcctggacggccgggtgtggccgagagcctcggccatggcggaggcgctctggtctggcaaccgcgacgcgtcgggcaggaagcggtacgccgaggcgaccgaccggctcatcgactggcggcagcgcatggtcgggaggggggtccgggccgagcccatccagccgctttggtgccgaacacgacccggaatgtgcaacgcggtccagtgacggcctggcgagaatggtggcctgcccttgttcggtcgccactgtttttgcggctcgaatgtgccatttgacaactgctgccaactatagcgtatccgatgtgtcgagcttttttttaaaaaaaaaacgaaccatttgtttgttcttttgtttatatttaaagtgaagtggacggcatgttatcctgttaagtggagtttgtgtaccttaaaagcctaaaaaaaaaaaaaaaaaa

SEQ ID NO: 4104 - protein, 578 aa, Zea mays
MATVLLPLLLLLGSAVTLLTCAGAGASFPVNVWPKPTSMSWAEPHAAVPVSPSFHIVASSGNPYLASAAERYAKLLFRETYRPIVRPAVNVTAGNALEKLTVAVSDLAAPLQHGVDESYTLEILPTGAATVTAATAWGAMRGLETFSQLSWRAGRGDLLLVAAGVRVEDRPLYPHRGLMLDTGRTYFPVADILRTIDAMAANKMNVFHWHITDSQSFPIVLPSEPSLAEKGAYGEDMRYTVEDVEHIVEFAMSRAVRVVPEIDSPGHTASWAGAYPEAVTCAGKFWLPDGDWNHRLAAEPGSGQLNPLAAKTYEVITNVVNDLTSLFPDGFYHAGADEVTPGCWEADPTIQADLERGATLSQLLERYVSAVHPLVVSRNRTAVYWEDVLLDAAVNVSASAIPPATTVLQSWNNGPNNTKLIVQAGYRAIVSSASFYYLDCGHGDFVGNNSIYDDPNSDFDANGGSWCGPYKTWQRVYDYDIAYGLTPEEAQLVLGGEVAMWTEQVDTTVLDGRVWPRASAMAEALWSGNRDASGRKRYAEATDRLIDWRQRMVGRGVRAEPIQPLWCRTRPGMCNAVQ

SEQ ID NO: 4105 - DNA, 1615 bp, Zea mays
  misc_feature (1)..(1615): Ceres cDNA ID no. 21666089
  misc_feature (1)..(1615): Ceres CLONE  ID no. 1400893
  misc_feature (1)..(1615): Also known as  Ceres CDNA ID no. 0
gatcagtttttggtcagctcatgcacaagcacaccgccaatacagtttttggcgatgcagtcctgcgagggggaagcagccacagcggcggtgcccgagcagattgatctagtgggcgaagtggcagccgcaagggcggcgtcggaacccgacgccacgaacgaagcgcgtgtggcggagacgccacaggaaggagaagaagaccccgagccggcgcaccgcggtagcaagagccggaccccggccccagcaccagcgtcgccatccacggtcaaggagcggcagatcccggtggacccggcgtcgctgcgccgtctgggcatggtggccgatgaggactggccactttccgcgccttccgtgctcacggaggtggtggtgcagttcccgatcctgcctcctctccgtcgtcccacgttcgttggcgccagcctgccgtgctcagcggcctcctcccccgtgcacggcgctcgtccaggtgctggcgccaagttggaggagcagcctgctgcccacagcccgacgtctgcgctacgctccctcgcccgccagcactccgccgcgctcgcccgtctcgtcgccgcgccgtccacgctatcaaggtccgcgtcccgcgccgagggcaggaccatggcgccgcacgacgacgaggagccggtccagctccagcccaagactatcgccgcggaggacggcttcacgtgcggcgcgctgtgcatgctcttccccggcttctccaagaggaggcccgccttctccggcacaaccgctggcacggccgtgtcgtccagcatgcagaggcagcagtcgggcttgaggcctcgtcgtcgctgcagcgcgtcgcgggtggcgtcgctggagaggttcgagtgcgggtcgtggagccctcctcttccgccgcctgtggccgcgcagcacgacgccgtcgactgccacgcgacggaggtggccaagaccagctgcgcggatgacgacgcggaggcgctggtcaagatggcgttcgtgttcgacggcgaaccacccgcggcgaagagggggatactgaagaactcggcatcgtcgcggctcgactcggccagggcgtcgacgtcttcgcagaggcacgtgaggttctcgacggtggcggcggcggatgcgtcgtcgtcgtcgtcgtgcccatcatcgccgtgcatcacgccgcgtctggcgagggccagggcggagttccacgcgttcttggaggcgcagagcgcttagagccagttgctgtgcgcactgatattctcctgcgtggcaacgttggctcttggatgcgggcctgctgccatagaccgggaacatttttcacctttcatccattgccattgttttccctgcttggggttgggtctgagtcgaatttattttccctatcacggagaccgagggattcctatatgtagagctagatgcatatagctcagccaggcttcgtagatgcaacatgcaaattattggttgcctgaatcgatcgttaggcctggcccatacagatccgtagaaacgataggtggcgtttggttgagcgattgtaatggtaatgttaatgtaaataaatacattggtatctgttaccatgtcaaaaaaaaaaaaaaaa

SEQ ID NO: 4106 - protein, 393 aa, Zea mays
MQSCEGEAATAAVPEQIDLVGEVAAARAASEPDATNEARVAETPQEGEEDPEPAHRGSKSRTPAPAPASPSTVKERQIPVDPASLRRLGMVADEDWPLSAPSVLTEVVVQFPILPPLRRPTFVGASLPCSAASSPVHGARPGAGAKLEEQPAAHSPTSALRSLARQHSAALARLVAAPSTLSRSASRAEGRTMAPHDDEEPVQLQPKTIAAEDGFTCGALCMLFPGFSKRRPAFSGTTAGTAVSSSMQRQQSGLRPRRRCSASRVASLERFECGSWSPPLPPPVAAQHDAVDCHATEVAKTSCADDDAEALVKMAFVFDGEPPAAKRGILKNSASSRLDSARASTSSQRHVRFSTVAAADASSSSSCPSSPCITPRLARARAEFHAFLEAQSA

SEQ ID NO: 4107 - DNA, 1676 bp, Zea mays
  misc_feature (1)..(1676): Ceres cDNA ID no. 21666091
  misc_feature (1)..(1676): Ceres CLONE  ID no. 1404240
  misc_feature (1)..(1676): Also known as  Ceres CDNA ID no. 0
gttttcgcctcccctcggcatctcagtttctttgccaccgctcgcactagcgcgcgcgccttcctcgtcctgcgttctcgtctcagcaccgcaccaccgtagacgactgcgcgcgagggcctacgaagctacgagtccatcgtgctggtgctgctagctcatcatcaccatcatgctagagaaccaaaagcaagcggaggttctctggccgcggctggtggccaacaagctcttccggaagacctcgggcagccacgctttcgtcgccgacttcccggccgccgatgacgatgacgacatcgtctttggaacggaggccgacggcgggggcgggtgcagccccgacgcggacgccagccgctgcgtgaagcgggcgcggccccacgagcgcaacaagaccctaaagtacaagctgttcgcgagcacgtggaacgtgggcggcgtggcgccaccggacgggctggacctgtcggactggctggacggcggcgacgacgacgggccctacgacatgtacgtgctggggttccaggaggtggtgccgctgcgcgcgcgcaacgtgctgggcgccgacaagaagcgcgtcgggatgcggtggatcgagctcacccgcgccgcgctgaaccggtcgcactcgcagcgcagcaggggcggcggcggcggcaagcagaaggtgcacccggtgcgggacggcggtggcggcgagctgggcagggagtaccggtgcgtggtgagcaagcagatggtgggcatcctgctcacggtgtgggtgcgctccgacctccgccgcttcgtccgccgccccagcgtctcctgcgtcggatgcggcgtcatgggctgcctcggcaacaagggtggcgtgtccgtccggttctggctgcacgacacgagcttctgcttcgtctgctgccacctcgcgtcgggcgggcgcgagggcgacgaggcgcaccgcaacgccaacgccacggagatcctttcccggacgacattcccgcgggggcacgcgctcaacttgccgttgccgcagaacattctagaccacgaccgggtgatcctgctcggggacctcaactacaggatctccctgccggaggccaagacgaggctgctggtggagcgccaggactggaagacgctgctggagaacgaccagctgcgcgccgaggtgtgccgcggaggcgcgttccagggctggagcgaggggcccatcggcttctccccgacgtacaagtaccaccccaactccgacgcctactacggctgcgccaccgccgcccgcggccggaacaagcggcgcgcgccggcgtggtgcgaccgcgtcctgtggcgcggcgcggggctcgcgcagacccgctacgaccgctgcgagtcccggctgtcggaccaccgccccgtccgcgccgtcttcgcggtggaggtggatgcgcccggggacctcaactcgctcaggagcttcttcatgtccgagaggttcgacagggaccagatgctgctccgcaaggatgacgtcaacagcgccagattcggcgacactctttgagacacgcgtgttgagagggtgaagttgtcagtccagttctccgactgcaattgtactacgcaggcaaaagtgtgatgcagagcagagtacatatatggatgtttttcatttctgagccaaaaaaaaaaaaaaaaaa

SEQ ID NO: 4108 - protein, 455 aa, Zea mays
MLENQKQAEVLWPRLVANKLFRKTSGSHAFVADFPAADDDDDIVFGTEADGGGGCSPDADASRCVKRARPHERNKTLKYKLFASTWNVGGVAPPDGLDLSDWLDGGDDDGPYDMYVLGFQEVVPLRARNVLGADKKRVGMRWIELTRAALNRSHSQRSRGGGGGKQKVHPVRDGGGGELGREYRCVVSKQMVGILLTVWVRSDLRRFVRRPSVSCVGCGVMGCLGNKGGVSVRFWLHDTSFCFVCCHLASGGREGDEAHRNANATEILSRTTFPRGHALNLPLPQNILDHDRVILLGDLNYRISLPEAKTRLLVERQDWKTLLENDQLRAEVCRGGAFQGWSEGPIGFSPTYKYHPNSDAYYGCATAARGRNKRRAPAWCDRVLWRGAGLAQTRYDRCESRLSDHRPVRAVFAVEVDAPGDLNSLRSFFMSERFDRDQMLLRKDDVNSARFGDTL

SEQ ID NO: 4109 - DNA, 1380 bp, Zea mays
  misc_feature (1)..(1380): Ceres cDNA ID no. 21666092
  misc_feature (1)..(1380): Ceres CLONE  ID no. 1411760
  misc_feature (1)..(1380): Also known as  Ceres CDNA ID no. 24359626
gaggcgcccgtccaagcatcccatccattctctctcgctgctctgctccccacggaccacggggcaccaccacaaaccagacgcgacgcacgcgcgcaaaatcatccggcggagccagggcggaggcaagccagagacgcggcacgcgacgcgtgagggcgaggagcagcggcagcgcgggcgcggcgacaccgcgaggacagagcgagacgcagcggcggaggaggggcagaggcgagcgccgcctagagtccctgctaccatggacactttcttcctgtcgcacggctcgcccacgctctccatcgacgacaacatcccggcgcggcacttcttcaagtcgtgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccaagcccatgtacaagctcaagtaccccgctccgggcgccccggacctggccctgcggaccaaagggctcctggagcaagccgggttcggccccgtgaaggaggaccacagccgcgggctggaccacggcgcctgggtgccgctgatgctcatgtacccggacgccgacatccccgtgtgccagctgtcggtgcagagcgaccgggacggcgcgtaccactacagcctcggcagggcgctggcgccgctgcgggaggagggcgtcctcgtcctcggctccggcagcgccacgcacaacctgcgcaagatggggccgttcgacgcgcccgtgccgcagtgggccgccgagttcgacgcctggctcaaggactcgctcctcgacggaaggtacgaggacgtgaaccggttcgaggagaaagcgccgcatgggagggtggcgcacccgtggccggaccacttctacccgctgcacgtggcgctcggcgccgccggggacggcgcaaaggcggagcagatccaccagtgctggaccaacgccacgctctcctacgcgtcctacaggttcaccaccaagagctgacgcgcccgtgcagctgtcgggtggaggaccgccacccccctcccccccggggccagctgctgaattcgtgggaagcacatccgtcgacgtgcgcgacagcattcatatacacgcaccgcatgtagaaatgtgtttttctcaataaactcccgagtgccgatcgcggtagatatgtcttgcattgttcaacgcagcagcttgtttcgagaagcattctgttgttaaatctcattccatcatcattgtcttcaagtggtgcatattacggagtacgtgtctttttgcccttctcaaaaaaaaaaataaaaaaaaaaaaaaaa

SEQ ID NO: 4110 - protein, 265 aa, Zea mays
  misc_feature: PFam Name: LigB; PFam Description: Catalytic LigB subunit of
  misc_feature: GI Number: 34907366; NR Description: P0471B04.17 [Oryza sativa (japonica cultivar-group)] >gi|21952792|dbj|BAC06208.1| P0018C10.9 [Oryza sativa (japonica cultivar-group)] >gi|22202675|dbj|BAC07333.1| P0471B04.17 [Oryza sativa (japonica
  misc_feature: GI Number: 34907368; NR Description: P0471B04.18 [Oryza sativa (japonica cultivar-group)] >gi|21952793|dbj|BAC06209.1| P0018C10.10 [Oryza sativa (japonica cultivar-group)] >gi|22202676|dbj|BAC07334.1| P0471B04.18 [Oryza sativa (japonica
  misc_feature: GI Number: 47900738; NR Description: putative dioxygenase
  misc_feature: GI Number: 34850080; NR Description: 4,5-DOPA dioxygenase
  misc_feature: GI Number: 33636344; NR Description: 4,5-DOPA dioxygenase extradiol [Portulaca grandiflora] >gi|42558922|sp|Q7XA48|DODA_PORGR
MDTFFLSHGSPTLSIDDNIPARHFFKSWVPAKVAGDQPPRAILVVSGHWDTATPEVNVIRGSNDTIYDFYGFPKPMYKLKYPAPGAPDLALRTKGLLEQAGFGPVKEDHSRGLDHGAWVPLMLMYPDADIPVCQLSVQSDRDGAYHYSLGRALAPLREEGVLVLGSGSATHNLRKMGPFDAPVPQWAAEFDAWLKDSLLDGRYEDVNRFEEKAPHGRVAHPWPDHFYPLHVALGAAGDGAKAEQIHQCWTNATLSYASYRFTTKS

SEQ ID NO: 4111 - DNA, 710 bp, Glycine max
  misc_feature (1)..(710): Ceres cDNA ID no. 21666093
  misc_feature (1)..(710): Ceres CLONE  ID no. 1433537
  misc_feature (1)..(710): Also known as  Ceres CDNA ID no. 24360169
aaattccgcagccaccaccaccccaacccaccggagcagacgaaggcggcgccgcggcgacctcatctccggccaagggaaatgactaccgttccggggtctctggtgtgggagctcgtgaagaaaaacaactgcttcttgatcaagcagttcggcaacagcaacgccaaggtgcagttcagcaaggagccaaacaacctctacaatgtccactcctacaagttctctggcttggcgaacagcaagaccgtgtcggtccagccatcagcgggagaggacaaggctgtcgtcctgtccacgaccaagaccaagaagcagaacacccctgccaacctccagcacaagactctgatgcgcaaggagttccgcaagatggccaagtccgtcaagaaccaggtctgcgacaactactacaggcctgatctgaccaagccggcccttgcaaggctgagtgccgtgtaccgcagcctccaggtttccaagtctggaatcaagaagaagaacaggcagccaactaagctgtaaactcattgagattgcctttcagcgctcatgttaccatgtctgttccgacagttttgagtcataagtgagacccttggaggaaccatgttacaaacccgccctagtttgtaccctgacagtgttagaagaattgtttgtgtcgatctataattattgtttgatttgcaccaaaaaaaaaaaaaaaa

SEQ ID NO: 4112 - protein, 710 aa, Glycine max
AAATTCCGCAGCCACCACCACCCCAACCCACCGGAGCAGACGAAGGCGGCGCCGCGGCGACCTCATCTCCGGCCAAGGGAAATGACTACCGTTCCGGGGTCTCTGGTGTGGGAGCTCGTGAAGAAAAACAACTGCTTCTTGATCAAGCAGTTCGGCAACAGCAACGCCAAGGTGCAGTTCAGCAAGGAGCCAAACAACCTCTACAATGTCCACTCCTACAAGTTCTCTGGCTTGGCGAACAGCAAGACCGTGTCGGTCCAGCCATCAGCGGGAGAGGACAAGGCTGTCGTCCTGTCCACGACCAAGACCAAGAAGCAGAACACCCCTGCCAACCTCCAGCACAAGACTCTGATGCGCAAGGAGTTCCGCAAGATGGCCAAGTCCGTCAAGAACCAGGTCTGCGACAACTACTACAGGCCTGATCTGACCAAGCCGGCCCTTGCAAGGCTGAGTGCCGTGTACCGCAGCCTCCAGGTTTCCAAGTCTGGAATCAAGAAGAAGAACAGGCAGCCAACTAAGCTGTAAACTCATTGAGATTGCCTTTCAGCGCTCATGTTACCATGTCTGTTCCGACAGTTTTGAGTCATAAGTGAGACCCTTGGAGGAACCATGTTACAAACCCGCCCTAGTTTGTACCCTGACAGTGTTAGAAGAATTGTTTGTGTCGATCTATAATTATTGTTTGATTTGCACCAAAAAAAAAAAAAAAA

SEQ ID NO: 4113 - DNA, 689 bp, Zea mays
  misc_feature (1)..(689): Ceres cDNA ID no. 21666094
  misc_feature (1)..(689): Ceres CLONE  ID no. 1446283
  misc_feature (1)..(689): Also known as  Ceres CDNA ID no. 24360877
aaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcggagctggagcgggaggtggcggcgctgcggctggagctgggcgcggcgcggcgccgcgccgagacggcggaagaggccgaggagcggctgtgcgtgcagctcggcgacgccgaggtggaggcgctcgagctcgcgcgcgcctaccaggcccacgtccacgagctcgccagggagctcgccgccgcgcgcgcggccccggcacgcccggccagataggttctcgtgggctggtagtaggctactagtagctatagcgtgcggttcagcgggatggctgtggttcccgcgtttggttggcgtcggacggcaccccgcgccgcggtgccatttatttgctcgccgccggcatcgtcgtctttgctttttgctgtgtcgatgatgattctttaacaaaaaaaaaaaaaaaa

SEQ ID NO: 4114 - protein, 106 aa, Zea mays
  misc_feature: GI Number: 50910221; NR Description: putative fasciated ear2 [Oryza sativa (japonica cultivar-group)] >gi|47497306|dbj|BAD19348.1| putative fasciated ear2 [Oryza sativa
  misc_feature: GI Number: 16418023; NR Description: fasciated ear2 [Zea mays]
MAPSISVGAAAPSRAAGASTKKSADEVELLRRRNAELEREVAALRLELGAARRRAETAEEAEERLCVQLGDAEVEALELARAYQAHVHELARELAAARAAPARPAR

SEQ ID NO: 4115 - DNA, 728 bp, Zea mays
  misc_feature (1)..(728): Ceres cDNA ID no. 21666095
  misc_feature (1)..(728): Ceres CLONE  ID no. 1446923
  misc_feature (1)..(728): Also known as  Ceres CDNA ID no. 24361015
aatgtatttccatggaaccgaacgcgtgctgcgcctcctgtacggcgcggaggtaggtcaagccgcggttgggacgcggtgtggcgtgggcgagccgaaccaagcggcgatcgatcgaaacgaggcgtcgcgtggcagccggagatgtcgcagaagaggcagccggaggagggcgacgtcccgcggcgcgccgccgatgccggcggcggcggcggaggagacgagcccggtgggagctcgtcgcgctcctctctgccccagcgccacggcgagccgaagcggcagaggatcgcccttcgcgagtgagtttgtcctcccccgcgcgccctggattgggtcgcgccgattcgtgcgccgcgctctctgattcgatgcgccgtggtgacttggattgttccccccttgcagtgtgatcacggaggtgatgcggaacaccagcatcgagaagtttctaatcgcgctcgagcccctcatcaggagagtggtgagaccgccttttttatcttttactatctgccccatttctcacttcagtccttcttgaatggaaattcataggattggatagtgatctgatgtgagccctctaggttgtttgcctttcctcttgttggatacataacgatacatagtgctgttgtaatcccatctgcatgtgtggctgattggcactctgatattggttttggcaagagcaagttctttccctcccaaaaaaaaaaaaaaaa

SEQ ID NO: 4116 - protein, 728 aa, Zea mays
AATGTATTTCCATGGAACCGAACGCGTGCTGCGCCTCCTGTACGGCGCGGAGGTAGGTCAAGCCGCGGTTGGGACGCGGTGTGGCGTGGGCGAGCCGAACCAAGCGGCGATCGATCGAAACGAGGCGTCGCGTGGCAGCCGGAGATGTCGCAGAAGAGGCAGCCGGAGGAGGGCGACGTCCCGCGGCGCGCCGCCGATGCCGGCGGCGGCGGCGGAGGAGACGAGCCCGGTGGGAGCTCGTCGCGCTCCTCTCTGCCCCAGCGCCACGGCGAGCCGAAGCGGCAGAGGATCGCCCTTCGCGAGTGAGTTTGTCCTCCCCCGCGCGCCCTGGATTGGGTCGCGCCGATTCGTGCGCCGCGCTCTCTGATTCGATGCGCCGTGGTGACTTGGATTGTTCCCCCCTTGCAGTGTGATCACGGAGGTGATGCGGAACACCAGCATCGAGAAGTTTCTAATCGCGCTCGAGCCCCTCATCAGGAGAGTGGTGAGACCGCCTTTTTTATCTTTTACTATCTGCCCCATTTCTCACTTCAGTCCTTCTTGAATGGAAATTCATAGGATTGGATAGTGATCTGATGTGAGCCCTCTAGGTTGTTTGCCTTTCCTCTTGTTGGATACATAACGATACATAGTGCTGTTGTAATCCCATCTGCATGTGTGGCTGATTGGCACTCTGATATTGGTTTTGGCAAGAGCAAGTTCTTTCCCTCCCAAAAAAAAAAAAAAAA

SEQ ID NO: 4117 - DNA, 629 bp, Zea mays
  misc_feature (1)..(629): Ceres cDNA ID no. 21666097
  misc_feature (1)..(629): Ceres CLONE  ID no. 1447232
  misc_feature (1)..(629): Also known as  Ceres CDNA ID no. 24361047
cccgcaatccccatcttcccctccaagctttccaatcttccttctcgcctgccgctgccgagatgacggtggagaaggtcgacgcgacggtggccgacttcgacggccacttcgaaaagctcttcgccggcgacgatggcggcaagctgaagctgctgctcttcctcgccgaccgggagccgtcctcctccctcacctggtgccccgactgcaacgtggcggagccggtgatctacgagaagctggagtcggtgggcaaggacgtggtgctcctgcgcgcgttcgtcggcgacaagcccacgtggagggacccggcccacccgtggagggtggacccgcggttcgcgctcaagggcgtgccgacgctgctgcggtgggacaagggcgccgccgcggggcgcctcgaggacgacgaggccaacgtcggggacaagatcgacgccctgctcaattgagttagttatcatgtgctgacggctatctcgtctgcttaatccgagtgccaagagaatgcttttggcggcagatgttatctactatctgaagtgtgctcttcttgtaaccagtcagtctcagtcatgaaccaaataaaacaggggaacgcgtaaacacgaaaaaaaaaaaaaaaa

SEQ ID NO: 4118 - protein, 130 aa, Zea mays
  misc_feature: GI Number: 21592399; NR Description: unknown [Arabidopsis thaliana]
MTVEKVDATVADFDGHFEKLFAGDDGGKLKLLLFLADREPSSSLTWCPDCNVAEPVIYEKLESVGKDVVLLRAFVGDKPTWRDPAHPWRVDPRFALKGVPTLLRWDKGAAAGRLEDDEANVGDKIDALLN

SEQ ID NO: 4119 - DNA, 723 bp, Zea mays
  misc_feature (1)..(723): Ceres cDNA ID no. 21666098
  misc_feature (1)..(723): Ceres CLONE  ID no. 1447611
  misc_feature (1)..(723): Also known as  Ceres CDNA ID no. 25088181
gtacagaactacggtctcagatgaagcgtcaaaaacggcatctgtgttcaccttggccagacgagctcctgctcctgtgggttgttgttggatgggataagaaacaaagcatttttcactacagtggttgacgactttgactagaaagaaaagcattttcactaaccatcagagttctcaagtgcattatcgttgctacccgccggcagacttttagcccaatcataggacttgaggtgcatggaaccaaacagtatcttgctaaacactgtcatcccaggatggttgtggaggggaataattgccgatttcggtaaacagaagataccaaactgcaaagaaacagttcaatggttgtggttgagcaagcaagatccttaccgaaaaggcgcaggcttgcgggatgtgagaaactaaattaccgaaaactcggaggaaccatagaagtgcaaataggtaactggaggggggcttgttggatcggcatgcttgaagacggacatgcttggggcaaccctgacgtcacgaggcttcagctcatctgcgtccaaaattcatcccatgatgattattagttagtaggtttacaagaaaagcagtggatgcaatgcgatagtcagctgcatagcattagcagttatgcttgcattccatgccagggcaagagtatgtatgtaacagtatttctaattaaacaggtgtacttgaaaaaaaaaaaaaaaa

SEQ ID NO: 4120 - protein, 74 aa, Zea mays
MVVVEQARSLPKRRRLAGCEKLNYRKLGGTIEVQIGNWRGACWIGMLEDGHAWGNPDVTRLQLICVQNSSHDDY

SEQ ID NO: 4121 - DNA, 846 bp, Zea mays
  misc_feature (1)..(846): Ceres cDNA ID no. 21666100
  misc_feature (1)..(846): Ceres CLONE  ID no. 1448847
  misc_feature (1)..(846): Also known as  Ceres CDNA ID no. 24361022
gaacgcattcaaaatccagctcccctccgaagtccgaacgcttcttggacgttaaacacggaggaaacaatcctcaaggtggcgtgggtggtggtgctccaaaggaatcgtcggtcgatagcgtttccagctcgctcagtgggataagctttgaagatgttagctctgcctgtgcctatgcagcagcatcctctcagcagcagaacgggtcgagcattgccaggaggaggagaacatctgaacagggtgtcaagcgaatgcgtcctttcaaacccaggcttccgaatttccttccgtcagagaaggtcgatctcaagcatcagtcggtgggcgatcccagagccgctgaggagtggatgctcgactacgctcttcggaaggaagtgaagaagctggcccgtgctcagaagaggaaagttgagatgcttgtccaggccttcgaatctgttatgcccacgcttgcaaacgagaagaagcccgagcaacacgacaatggtgacaatgacaagagaacattcactcttgcatggccttcccaacttgtggtttagctggaaccaaccatggtctgaagtctgaacttctgaaggttctaactcagcagtcactgccagaaaaaattcttaccgctattgttttcttatctgatagttgagctactaggataggagctcgctgagttcggttagtggagggcctagtgcatgtacatatgtctcgtgtgctcagtttagtgatgaggaacgagtgtaggagactagcacaccggcaagaatgttgagatgtgttcctttaggcagatatcaataaagctctcattaacagcatttaaaaaaaaaaaaaaaa

SEQ ID NO: 4122 - protein, 97 aa, Zea mays
  misc_feature: PFam Name: CaM_binding; PFam Description: Plant
  misc_feature: GI Number: 57900471; NR Description: putative PNCBP [Oryza
  misc_feature: GI Number: 24637279; NR Description: pathogen-induced
  misc_feature: GI Number: 17933110; NR Description: PNCBP [Solanum tuberosum]
  misc_feature: GI Number: 24637243; NR Description: pathogen-induced
MRPFKPRLPNFLPSEKVDLKHQSVGDPRAAEEWMLDYALRKEVKKLARAQKRKVEMLVQAFESVMPTLANEKKPEQHDNGDNDKRTFTLAWPSQLVV

SEQ ID NO: 4123 - DNA, 713 bp, Zea mays
  misc_feature (1)..(713): Ceres cDNA ID no. 21666105
  misc_feature (1)..(713): Ceres CLONE  ID no. 1457945
  misc_feature (1)..(713): Also known as  Ceres CDNA ID no. 24371406
acaacggagaagaagataatggagagcaacggagagaacaagaaagtggagagacaatcgtcatccttcaggcttcgaagcccaagcctaaacgctcttcgtctccaacgcattttcgacttgttcgacaaaaacggcgacggtttcatcaccctcgaggagctaaaccaagctctctcccgtctcggcctcgacgcggatctctccgacctcaaatccaccgtcgagtcctacatccagcctggaaacaccggtctcgacttcgacgactttacctcactccacaagaccctcgacgagtccttcttcggcggagcaggagattgcgatgagtcttcgccggagtccgcagaggaggcggatcttgtggaggcgtttaaggtgttcgacgagaatggcgacgggtttatctccgctaaggagttgcaggcggttttgaagaagcttgggttgcctgaaggaagtgagatggagagagtggagaagatgatcgtctccgttgaccggaaccaagatggtcgcgttgacttttctgagttcaagaacatgatgcgcattgtcgtcatcccttcttgattttcattaaacaagtttatttttccgacaggattatttccttatttcttttggttttcattttctcaactgaattcatctcatgtaatttcaaatttcagatagatttattttatccaaacaaaaaaaaaaaaaaa

SEQ ID NO: 4124 - protein, 185 aa, Zea mays
  misc_feature: PFam Name: zf-B_box; PFam Description: B-box zinc finger
  misc_feature: PFam Name: Peptidase_S8; PFam Description: Subtilase family
  misc_feature: PFam Name: HlyD; PFam Description: HlyD family secretion protein
  misc_feature: PFam Name: Cupin_1; PFam Description: Cupin
  misc_feature: PFam Name: Extensin_2; PFam Description: Extensin-like region
  misc_feature: GI Number: 51964156; NR Description: PREDICTED OJ1476_F05.18 gene product [Oryza sativa (japonica cultivar-group)] >gi|50910361|ref|XP_466669.1| putative COL1 protein [Oryza sativa (japonica cultivar-group)] >gi|47497178|dbj|BAD19225.1| putative
  misc_feature: GI Number: 21667487; NR Description: CONSTANS-like protein [Hordeum vulgare subsp. vulgare] >gi|21667485|gb|AAM74069.1|
  misc_feature: GI Number: 21655154; NR Description: CONSTANS-like protein
  misc_feature: GI Number: 41323978; NR Description: CONSTANS-like protein
  misc_feature: GI Number: 51535607; NR Description: putative constans [Oryza
MESNGENKKVERQSSSFRLRSPSLNALRLQRIFDLFDKNGDGFITLEELNQALSRLGLDADLSDLKSTVESYIQPGNTGLDFDDFTSLHKTLDESFFGGAGDCDESSPESAEEADLVEAFKVFDENGDGFISAKELQAVLKKLGLPEGSEMERVEKMIVSVDRNQDGRVDFSEFKNMMRIVVIPS

SEQ ID NO: 4125 - DNA, 1108 bp, Zea mays
  misc_feature (1)..(1108): Ceres cDNA ID no. 21666107
  misc_feature (1)..(1108): Ceres CLONE  ID no. 1459447
  misc_feature (1)..(1108): Also known as  Ceres CDNA ID no. 0
atgaccactgtgccgacaccctacgtccagcaccactctccacgccagcgccgctactctccgcctgcgcccccgtgcctcccaccgggccacttcgctagcgccgcccgctgcagcactagccgtcgagcgcggcgctcgccgccgacttctcacgcggccgcgtcgtcgacccacgtccccaccggctggggttcaacgggagaaggaaccgatggacgcgctcatggcgagctacgcgtccgacaccgactctgacggcggcgagtctgcttccgtctctggaggcgccccggaggtcccggaaccttcggccttgctcccacctcctcccctcgacctcctccagccccccaacttcgtagattactcggcgatggcgcaggggggtcgcgtccggagcttcccccatgtggaaggcaactatgctgtacatgtttatatccctgtcgtcataccttctgatgcaaggaaacaactggctctttctatgaaaagagctgcatctcttgtgccggatctctatgccgttgatgcagactatgcgctttctgaattgtgcaaagatgaacagaagcttgagaaagtgcttctgagcagggagtttcatgtaagcttgggaagacctgttgcagttcaggtgcatcagattgactcatttattgcaatgcttcgccagaagttccagccacaacaacagtactggatggagttcaataaatgggagcactttgtcaatgatgattgtacacggtcatttgtttcactagaagttacaagaactggtttgccagagataacgaggcagatacttatggtagatgaagtgtatcgattgcatggtcttcctgaattttacacgaatccacggccacatatatcgttggtgtgggcattgggtgatgtcagcggcaaactaaagcaggcactaaaggacattgaaaaatatcagagcagtatgagctcattgcaaaaatgtaatgttcgatgcaagttcagtcgtgtagtttgtaaagtaggcaagaaggtgcatgatatctgtaaagttgcagattgaaacacacatgaattacgctcgataagcttcgaggtaaaaaaaaaaaaaaaa

SEQ ID NO: 4126 - protein, 280 aa, Zea mays
MDALMASYASDTDSDGGESASVSGGAPEVPEPSALLPPPPLDLLQPPNFVDYSAMAQGGRVRSFPHVEGNYAVHVYIPVVIPSDARKQLALSMKRAASLVPDLYAVDADYALSELCKDEQKLEKVLLSREFHVSLGRPVAVQVHQIDSFIAMLRQKFQPQQQYWMEFNKWEHFVNDDCTRSFVSLEVTRTGLPEITRQILMVDEVYRLHGLPEFYTNPRPHISLVWALGDVSGKLKQALKDIEKYQSSMSSLQKCNVRCKFSRVVCKVGKKVHDICKVAD

SEQ ID NO: 4127 - DNA, 746 bp, Zea mays
  misc_feature (1)..(746): Ceres cDNA ID no. 21666109
  misc_feature (1)..(746): Ceres CLONE  ID no. 1460028
  misc_feature (1)..(746): Also known as  Ceres CDNA ID no. 24360609
atcacatctctcccagccaaaggcaattaagcaaccattacgcagccacaacagcaacgcagcaagctaagctagagggagtagtgagtgggagagagagagagagagacaaatgaggccggaaagagttggaggtgtggcgccgacgacgacggtgctattggctggcggcgggcggccgagcctgtggaggacgccgacgccatatctcttcctggggttcgcgacgatgatggtcctcatcgcggtggcgctggtcgcgctcatgtgcgcgcgccgcaaggcctcttcgtcgtcgtcgtcgtcggccaacggcggcgacgagaagccggcgtcggtgcgggtcctggtgccgctcgaccgggagccccccaaggtcgtggtcgtcatggccggcgacgccctgccgtccttcatcgccgtcgccagcgcgaggaagccgctcgccttcgccgccacaccggccgcgccggccgagggcttgtaggcgcatatgcatgggcgggcgagaagagaacccgcgcatcgcgagttcgcgacgcgcgcgggggccaattttgtcgagaggtttttgtttgttcttttgctttggagctcggtggcgtagcgtaggtgaacggtgaactgtgagctagggcgcccacgcgccgccaccggccggcagctggttttggtctgtttcgggaaaagcttgcagcttgaataaaacgcgcacggctttcttttcgctaaaaaaaaaaaaaaaa

SEQ ID NO: 4128 - protein, 124 aa, Zea mays
MRPERVGGVAPTTTVLLAGGGRPSLWRTPTPYLFLGFATMMVLIAVALVALMCARRKASSSSSSSANGGDEKPASVRVLVPLDREPPKVVVVMAGDALPSFIAVASARKPLAFAATPAAPAEGL

SEQ ID NO: 4129 - DNA, 747 bp, Zea mays
  misc_feature (1)..(747): Ceres cDNA ID no. 21666110
  misc_feature (1)..(747): Ceres CLONE  ID no. 1460149
  misc_feature (1)..(747): Also known as  Ceres CDNA ID no. 0
ctatccctctctagtctctacccccatctgtagtgcggtctgcggccaagcagagcccggggaaacgatcgagacgatatgtgcgggggagcgatccttgccgaactcatcccagcacgggtgcaccggccgctgaccgccgccacgctctgggcggcggccctgagtgggaccactaccgtcggcaagtggaaggccgatgcagccgccgctaccgacgacgacgacgacgaagagttcgaggccgagttccagcttttcgacgacgatgacgagtgcgaggccgagttccagcttctcgacgaccaccaaccatctcccgcagcttcgcctgaggccagcggctgcaagcggaagcctgcccttgctcctcctgctgatatggccagtactaagactcagagcacgctagcgcgggtcaaggaactgatcgcgcagggacctcacgacgagcggctggcggcgaggatcgtgcctgagctgatgatgcacgggagcagggacgaggctgcggcgttgatcgccgagttcagccgtcagatggaggagatcgctgcgttgcggagggaccttgagacacgcgagaggcagcttgttcagctggtttctctagtacttcgttgaccactcactccgatgatgcatgatctgatgactgtcaagtgtgaacaatgtgtttgtgacactagaacagtcatcatctactgctatagttataggtcctgtttggtaaaaaaaaaaaaaaaa

SEQ ID NO: 4130 - protein, 181 aa, Zea mays
MCGGAILAELIPARVHRPLTAATLWAAALSGTTTVGKWKADAAAATDDDDDEEFEAEFQLFDDDDECEAEFQLLDDHQPSPAASPEASGCKRKPALAPPADMASTKTQSTLARVKELIAQGPHDERLAARIVPELMMHGSRDEAAALIAEFSRQMEEIAALRRDLETRERQLVQLVSLVLR

SEQ ID NO: 4131 - DNA, 1860 bp, Zea mays
  misc_feature (1)..(1860): Ceres cDNA ID no. 21666114
  misc_feature (1)..(1860): Ceres CLONE  ID no. 1469649
  misc_feature (1)..(1860): Also known as  Ceres CDNA ID no. 24390713
gaaaaaatgcttcctcttagtaggtgctctctccctacctcctccaatccgggcccgggcccctctctaggattcttgttgcacgtacacaccatgatctgctacgtgctgtggttagctgcgtgctgcctcctcctcctcttgtacagcgtccgattcaggtcccgcatcagccatggcaacggccccaggacctacccgttgattggctgcctggtcagcttctaccagaaccggtggcggctgctggactggtacaccgagatgctggcggcgtcgccgacgcagacgatcgtcgtggaccgtctgggcgcgcggcggaccgtggtgaccgcgaacccggtgaacgtggagcacatcctcaagggcaacttcggcaactaccccaaggggaagcccttcaccgacatcctcggcgacctgctcggcaccggcatcttcaacgtcgacggcgagctgtggtacgcgcagaggaagctggtgagccacgagttctcggcgcgcgcgctcagggacctggagttcgccgtgctcgaggacgaggcgcgggagcgcctcgtgccggccctgggcctggccgcggcgcgcggcgacgccgtggacatgcaggacctgctccgccgcttctccttcgacgtcatctgccgcgtgtcgctgggcgttgaccccggctgcctggacccggcattgccggcgccgaggctggccgcggcgttcgacgcggccgcggggatcatcgccaggcgcggcgccgcgcccgtggccgccgtgtggaaggccaaacgcgcgctgggcgtgggctcggagcgcctgctgcgcgaggagatccgggtcatccacgaggccgtcatggacctcatccgcatccgcaagaaggagcgcggcctgcaggtcaacgacgccgacgggcggaggagcgacctgctgtcgcggatgatcgaatgcgggtacccggacgagatgatccgcgacatggtgatcagcttcatcatggccgggcgcgacaccacgtcgtccgcgctgacatggttcttctggctgctcacccgccaccgcgacgtggaacgggaggtcctgcgggaggtcacgggcggcggcggcgcgagccacgccgcaggcgggcagggcaagatgagcgtgctccacgcggcgctgtgcgagacgatgcggctgtacccgccggtggcgtgggactccaagcacgctgcggcgggcgacgtgctgcccgacggcacccgcgtggagcgcggcgaccgcgtcacctacttccagtacgggatggggcggatggagtccatctggggcgccaacgccgccgacttcagcgtgcagcgctggctgtccataggggaggacaacgcgccccccgccgcggtggccggcgtgtcgccgttcaagtacccggtgttccaggcggggccgcggacgtgcctcggcaaggagatggccttcgtgcagatgaagttcgtggccagcaccgtgctccggcggttcgagatcgtgcccgttgacgagggccgcgtgccggtgttcctgccgctgatgacggcgcacatggccggcgggctcaacgtgacggtgaggagaagaggggatccggaacccattgccgctgctgctactccactcgatccttctgctgatccagtattataaatatatttaaccctcctcatgtaagtacgacaaattaaaatcatgattatttagttcctattatacataaattatatataattgaaattcatgaggacacgcaatgtttttgctgcttatcacagacgatagcagtacacttttgtaccttatcgatcatgatcatatgaaagagatacacagcacgcataaaaaaaaaaaaaa

SEQ ID NO: 4132 - protein, 1860 aa, Zea mays
  misc_feature: PFam Name: p450; PFam Description: Cytochrome P450
  misc_feature: PFam Name: Peptidase_S8; PFam Description: Subtilase family
  misc_feature: GI Number: 53828589; NR Description: At3g48520 [Arabidopsis thaliana] >gi|51536434|gb|AAU05455.1| At3g48520 [Arabidopsis thaliana] >gi|6523083|emb|CAB62341.1| cytochrome P450-like protein [Arabidopsis thaliana] >gi|15228396|ref|NP_190421.1|
  misc_feature: GI Number: 21536522; NR Description: cytochrome P450-like
  misc_feature: GI Number: 9758286; NR Description: cytochrome P450-like protein [Arabidopsis thaliana] >gi|15242759|ref|NP_201150.1|
  misc_feature: GI Number: 6513941; NR Description: putative cytochrome P450 [Arabidopsis thaliana] >gi|6091730|gb|AAF03442.1| putative cytochrome P450 [Arabidopsis thaliana] >gi|18395978|ref|NP_566155.1| cytochrome P450 family protein
  misc_feature: GI Number: 18000072; NR Description: cytochrome
GAAAAAATGCTTCCTCTTAGTAGGTGCTCTCTCCCTACCTCCTCCAATCCGGGCCCGGGCCCCTCTCTAGGATTCTTGTTGCACGTACACACCATGATCTGCTACGTGCTGTGGTTAGCTGCGTGCTGCCTCCTCCTCCTCTTGTACAGCGTCCGATTCAGGTCCCGCATCAGCCATGGCAACGGCCCCAGGACCTACCCGTTGATTGGCTGCCTGGTCAGCTTCTACCAGAACCGGTGGCGGCTGCTGGACTGGTACACCGAGATGCTGGCGGCGTCGCCGACGCAGACGATCGTCGTGGACCGTCTGGGCGCGCGGCGGACCGTGGTGACCGCGAACCCGGTGAACGTGGAGCACATCCTCAAGGGCAACTTCGGCAACTACCCCAAGGGGAAGCCCTTCACCGACATCCTCGGCGACCTGCTCGGCACCGGCATCTTCAACGTCGACGGCGAGCTGTGGTACGCGCAGAGGAAGCTGGTGAGCCACGAGTTCTCGGCGCGCGCGCTCAGGGACCTGGAGTTCGCCGTGCTCGAGGACGAGGCGCGGGAGCGCCTCGTGCCGGCCCTGGGCCTGGCCGCGGCGCGCGGCGACGCCGTGGACATGCAGGACCTGCTCCGCCGCTTCTCCTTCGACGTCATCTGCCGCGTGTCGCTGGGCGTTGACCCCGGCTGCCTGGACCCGGCATTGCCGGCGCCGAGGCTGGCCGCGGCGTTCGACGCGGCCGCGGGGATCATCGCCAGGCGCGGCGCCGCGCCCGTGGCCGCCGTGTGGAAGGCCAAACGCGCGCTGGGCGTGGGCTCGGAGCGCCTGCTGCGCGAGGAGATCCGGGTCATCCACGAGGCCGTCATGGACCTCATCCGCATCCGCAAGAAGGAGCGCGGCCTGCAGGTCAACGACGCCGACGGGCGGAGGAGCGACCTGCTGTCGCGGATGATCGAATGCGGGTACCCGGACGAGATGATCCGCGACATGGTGATCAGCTTCATCATGGCCGGGCGCGACACCACGTCGTCCGCGCTGACATGGTTCTTCTGGCTGCTCACCCGCCACCGCGACGTGGAACGGGAGGTCCTGCGGGAGGTCACGGGCGGCGGCGGCGCGAGCCACGCCGCAGGCGGGCAGGGCAAGATGAGCGTGCTCCACGCGGCGCTGTGCGAGACGATGCGGCTGTACCCGCCGGTGGCGTGGGACTCCAAGCACGCTGCGGCGGGCGACGTGCTGCCCGACGGCACCCGCGTGGAGCGCGGCGACCGCGTCACCTACTTCCAGTACGGGATGGGGCGGATGGAGTCCATCTGGGGCGCCAACGCCGCCGACTTCAGCGTGCAGCGCTGGCTGTCCATAGGGGAGGACAACGCGCCCCCCGCCGCGGTGGCCGGCGTGTCGCCGTTCAAGTACCCGGTGTTCCAGGCGGGGCCGCGGACGTGCCTCGGCAAGGAGATGGCCTTCGTGCAGATGAAGTTCGTGGCCAGCACCGTGCTCCGGCGGTTCGAGATCGTGCCCGTTGACGAGGGCCGCGTGCCGGTGTTCCTGCCGCTGATGACGGCGCACATGGCCGGCGGGCTCAACGTGACGGTGAGGAGAAGAGGGGATCCGGAACCCATTGCCGCTGCTGCTACTCCACTCGATCCTTCTGCTGATCCAGTATTATAAATATATTTAACCCTCCTCATGTAAGTACGACAAATTAAAATCATGATTATTTAGTTCCTATTATACATAAATTATATATAATTGAAATTCATGAGGACACGCAATGTTTTTGCTGCTTATCACAGACGATAGCAGTACACTTTTGTACCTTATCGATCATGATCATATGAAAGAGATACACAGCACGCATAAAAAAAAAAAAAA

SEQ ID NO: 4133 - DNA, 1375 bp, Zea mays
  misc_feature (1)..(1375): Ceres cDNA ID no. 21666115
  misc_feature (1)..(1375): Ceres CLONE  ID no. 1471473
  misc_feature (1)..(1375): Also known as  Ceres CDNA ID no. 24360726
actcacatccatccatgcacaagcgcgactcctcagcttcctcctctccttccttccttagctgcccttcccgccacctctgacccgtttgctgctcctgacgtacgtacgtctgattctcgcggcggcgcacatggacccgtggatcgggcagccttccctgagcctggacctcaacgtcggccttccgacggcggcgaggccgcctgcgaccaccaccgccaaggtcctggtcgaggaggacttcctggccgtcgagaaagaccgggaggtgcaggtgcaggtgcaagcgctcgaggcggagctccggcgagccggcgaggagaacagacgcctcagcgacatgctccgcgcggtggtggccaagtacgcggagctgcagggccaggtcaacggcatggcggcgccggtgtccacggcgggcaacagcgccgccgccgccgccgccaaccgccagtcctccgcgtcgtccgacgacggcggctccgcggccggctcgccgtccaggaagcggccggtccggagcgacagcctcgacaccgcgccccagcatcacaaccgcaagccgccgtcgccgtacgcggccgcccccgcccccggccccgaccagatggagtgcacgtcggccgccgtcaccgtcgtcgccgccgccgccttccaccacgagccggccaggcgcatccgggaggcggagcgcaagcccaaggtgtcccgacgattcgtccacgccgacccctctgacctcagcctcgtggtgaaggacgggtaccagtggcgcaagtacgggcagaaggtgaccaaggacaacccgtgcccgcgcgcctacttccggtgctcgctcgcgccgtcgtgcccggtgaagaagaaggtgcagcgcagcgcggacgacagcgccgtcctggtggccacgtacgagggcgaccacaaccacgcccgcccgccgcagcacgacggcgccgccaagaggtcgtccgcgccgccggcgggcgaggccgcgcgaccgccggcgcaggcgccggcgccactgccgctgcagatgatgcagcagcagaagcaagaggcggggccgtcgtcggaggtcgcgaggaagaaccttgcggagcacatggcggtcacgctcacgcgggatcccgggttcaaggcggcgctagtcagcgcgctctccggccggatccttgaccagggattataggctaataatagacgaacatgatcgattaattgacgaatacacaggcatttttattttatcatgctctctgttggcccgtgccattgaagttatcaattcaaactagctctagcatgtacgccataatccaagtttcaagctacaccatgatgctggagatggagataaaaaaaaaaaaaaaaa

SEQ ID NO: 4134 - protein, 352 aa, Zea mays
  misc_feature: PFam Name: WRKY; PFam Description: WRKY DNA -binding domain
  misc_feature: PFam Name: FH2; PFam Description: Formin Homology 2 Domain
  misc_feature: PFam Name: Protamine_P1; PFam Description: Protamine P1
  misc_feature: PFam Name: TT_ORF1; PFam Description: TT viral orf 1
  misc_feature: PFam Name: Transformer; PFam Description: Fruit fly
  misc_feature: GI Number: 46394310; NR Description: TPA: WRKY transcription
  misc_feature: GI Number: 51535436; NR Description: putative WRKY
  misc_feature: GI Number: 50843960; NR Description: transcription factor WRKY09 [Oryza sativa (indica cultivar-group)] >gi|46394396|tpg|DAA05136.1| TPA: WRKY transcription factor 71
  misc_feature: GI Number: 50905687; NR Description: WRKY transcription factor [Oryza sativa (japonica cultivar-group)] >gi|44893906|gb|AAS48546.1| WRKY transcription factor [Oryza sativa (japonica cultivar-group)] >gi|49388020|dbj|BAD25136.1|
  misc_feature: GI Number: 44893902; NR Description: WRKY transcription
MDPWIGQPSLSLDLNVGLPTAARPPATTTAKVLVEEDFLAVEKDREVQVQVQALEAELRRAGEENRRLSDMLRAVVAKYAELQGQVNGMAAPVSTAGNSAAAAAANRQSSASSDDGGSAAGSPSRKRPVRSDSLDTAPQHHNRKPPSPYAAAPAPGPDQMECTSAAVTVVAAAAFHHEPARRIREAERKPKVSRRFVHADPSDLSLVVKDGYQWRKYGQKVTKDNPCPRAYFRCSLAPSCPVKKKVQRSADDSAVLVATYEGDHNHARPPQHDGAAKRSSAPPAGEAARPPAQAPAPLPLQMMQQQKQEAGPSSEVARKNLAEHMAVTLTRDPGFKAALVSALSGRILDQGL

SEQ ID NO: 4135 - DNA, 1388 bp, Zea mays
  misc_feature (1)..(1388): Ceres cDNA ID no. 21666117
  misc_feature (1)..(1388): Ceres CLONE  ID no. 1476818
  misc_feature (1)..(1388): Also known as  Ceres CDNA ID no. 24385111
aacgtgtttaatgtttagaagataaatgcatcttttttcaaaggattcgatgctctgtcgtgtttagtagttcttcacagctcaggatttggccgtgcggcgctctgtatgaccctctcatagccaatgcaaagacaaaccccgcccatcagtctacgcgaatcgctgtggcctcgctcgttgcaaaccttccagcctgtcttgcctccacgcgaggctacatgacacttcctttccttcttcatcctcccgctatatatagccgccctcttcgggtcctcctcctccatcggccatcgccatctccatttccagcatagaagacgcgatacagctcaaggacagcgctccgcacccgcacgcaagccagaccggaccgaatcgaagcagcagcagcgtacagaagatcacaccctactgccgcgctgcactgcacaatgggcatctgcgtgtcgtgcgacgcggcggacgagggcgccgcgacggcggcgcgggtggtgctccccagcggagagctccgggagtacgcgccaccggccaccgccgcggaggcgctgcaagcggcgggcgagggctcgtcgtggctcctctgcgacgccgacgggatggcgttcgagggccccgtcgcagtcgcggcggtcgcgccggggtccgagctccaggcggggcagatctacttcgtgctccccgccgagatgcagcgccgccgcctcgcccgcgccgaggtcgccgcgctcgcggtccgggccagctcggcgctcgccagggccgcggcgctcgcccagccatcgtcgccctgccgccgccgccggcgcggcgcggcggcgcagctcgtgttcccggtccccgaggaggagttcgcggcggcggacccggtcgcgtcgaagcccgcggctgcggtggtggcgcatcggaaacggagggtggcgtaccggggcgggagcgggagggcgtccaggttctcccccgacctgaccgctatcccggagagcgagtagtagatggagcctgccatgtgtctccggtggtgacgggtcgctcgctggcgctcggtcggacggtgtggtcgaggccgagctcgcgcgcgccggagatcgatggagcaggaagcgttgtagacgcagagctcgggagtgagaaatgtgagtagtgtttttggcgccgttggtttaggaggcaataggatgagtgttgttgcggtattacgaacgtttaggttttagatgcaagtgtaaatactatacacgggatctccgtacggtgtgcccagtgagtcacagtttggaactcagcttctaatcagtgctcgtgttcaggctaaaaaaaatgaaatctctcgctgtttcggaaaaaaaaaacttatttctgatgaaaaaaaaaaaaaaaaa

SEQ ID NO: 4136 - protein, 186 aa, Zea mays
  misc_feature: PFam Name: Peptidase_S8; PFam Description: Subtilase family
  misc_feature: PFam Name: TP2; PFam Description: Nuclear transition protein 2
  misc_feature: GI Number: 21553860; NR Description: unknown [Arabidopsis thaliana]
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 5821145; NR Description: RNA binding protein [Homo
  misc_feature: GI Number: 47124032; NR Description: SRRM2 protein [Homo sapiens]
  misc_feature: GI Number: 5821143; NR Description: RNA binding protein [Homo
MGICVSCDAADEGAATAARVVLPSGELREYAPPATAAEALQAAGEGSSWLLCDADGMAFEGPVAVAAVAPGSELQAGQIYFVLPAEMQRRRLARAEVAALAVRASSALARAAALAQPSSPCRRRRRGAAAQLVFPVPEEEFAAADPVASKPAAAVVAHRKRRVAYRGGSGRASRFSPDLTAIPESE

SEQ ID NO: 4137 - DNA, 648 bp, Zea mays
  misc_feature (1)..(648): Ceres cDNA ID no. 21666119
  misc_feature (1)..(648): Ceres CLONE  ID no. 1502305
  misc_feature (1)..(648): Also known as  Ceres CDNA ID no. 0
aggatcccgttctcagtcgccagccactggtcacagccaccgtctccctccttccccaacctcgccgctatcaggtggtggatgcagcagcgcggccgctccttcaacagccgctctcggagcttctcccgcgcccgcgtcgccatcgagggatcttaatctcacagccatccctcgatcatttcgtttgaactcggttctgaaattctgactgacgaacgcacgcaacgacctaccgtgatggacgccgccgccgccgccaccgttgtttctcttaacgggaagatgggggccgaggagaggaaggcgcagaagagctactgggaggagcattccaagaacctcaccgtcgaggccatgatgctggactcccgcgccgctgatctcgacaaggaggagcgccctgaggtgattgattccgcgaggatgtttcttcccgttatccattccattttttatttctaggtatttaggtgcatatactgctactgtcttgttttagtgcctttcgggatccagctgcttggatctgggcagcatctgtcagacactcagcctttgctacgtggtatcacatggcaatctctgaagggcgcgtgtgtggaaataaaggcggttgcacttttttttaaaaaaaaaaaaaaaaaa

SEQ ID NO: 4138 - protein, 74 aa, Zea mays
MDAAAAATVVSLNGKMGAEERKAQKSYWEEHSKNLTVEAMMLDSRAADLDKEERPEVIDSARMFLPVIHSIFYF

SEQ ID NO: 4139 - DNA, 650 bp, Zea mays
  misc_feature (1)..(650): Ceres cDNA ID no. 21666121
  misc_feature (1)..(650): Ceres CLONE  ID no. 1509689
  misc_feature (1)..(650): Also known as  Ceres CDNA ID no. 24360695
aaccatccaatcagaaacacatgagggaagaagaacatcaaaacgaattagttcagactccatcacagagagcggaaaattgcttccgttgcaatgtgttcgcgtttctcgtcccacttttggaggttatcaaggtggttgctgctcccgttgcctccgtgatctttataggcttcgccgggataatactcgcctgtttagccgtggcattagctgtatccgcaccgcttttcatcatattcagtccggttctcgtacctgctgccactatagccactactctcggcacaggtgtcgccttcgcagtgacggccgtggctctcattatatggctcaccaagtaaatttaatcagaatattgaattgacatatggactcgagaattatgcttatatattattcacatacgtgcttataaaagaaaatatagcttttttccttctgtatttctcttttttttttctcaaagtttctgtttacctgctacttcaacacttttcttcttcttaaagttacaaatcagttacacctcattctcattgttctcattgctgttttacttcttaagaaattttaacttattatgtgtctttcgtcagaactttctttctgcctttggaaatatttgtcacgtaaaaaaaaaaaaaaaa

SEQ ID NO: 4140 - protein, 107 aa, Zea mays
  misc_feature: PFam Name: Oleosin; PFam Description: Oleosin
  misc_feature: GI Number: 38260613; NR Description: pollen coat
  misc_feature: GI Number: 1183870; NR Description: oleosin-like protein [Brassica napus] >gi|7488473|pir||T08109 oleosin-like protein OLN6
  misc_feature: GI Number: 1183880; NR Description: oleosin-like protein [Brassica napus] >gi|7488471|pir||T08132 oleosin-like protein OLN11
  misc_feature: GI Number: 34013886; NR Description: pollen specific
  misc_feature: GI Number: 1769972; NR Description: oleosin-like protein [Brassica napus] >gi|7488469|pir||T08134 oleosin-like protein -
MREEEHQNELVQTPSQRAENCFRCNVFAFLVPLLEVIKVVAAPVASVIFIGFAGIILACLAVALAVSAPLFIIFSPVLVPAATIATTLGTGVAFAVTAVALIIWLTK

SEQ ID NO: 4141 - DNA, 647 bp, Zea mays
  misc_feature (1)..(647): Ceres cDNA ID no. 21666122
  misc_feature (1)..(647): Ceres CLONE  ID no. 1511614
  misc_feature (1)..(647): Also known as  Ceres CDNA ID no. 24371291
aacagcctccatttcccaatctggcaggcgacgccgacgcgctccaccggcggcaccgatgcgggcgatctcgacggccgtggggggcatgctgcgcgcgcggctccgctccgcctcccgcgtgcgcggcggcggcggcggcggcggcgagggcgcggggcggtggacgacgccggggcacgaggagcggcccaagggtacctcttcaaccgcccgccgccgccggccgggggagacgcggaagtgggaggactgggagcttccctgttacatcacttccttcctcaccgtcgtcatcctcggcgtcggcctcaacgccaagcccgacctcacgatcgagacctgggcgcacgagaaggcgctggaacgcctcaagcagcaggagctagccgccgtctccggaggcggtgacgccgatgccgatgccgagtgatccgctggtcagatcacccgcaactctagatatattgttttttcttttcttttcttttctttctggttccctgcttgtgtcgcgcggttcaataaggctgtctgtactgagatgcatgtcatgagattccagaaatggatggacatcagactgaacactgtatcattgttgctgtttcgctggataacttacacctcaaaaaaaaaaaaaaaaa

SEQ ID NO: 4142 - protein, 124 aa, Zea mays
  misc_feature: GI Number: 9858777; NR Description: BAC19.9 [Lycopersicon
MRAISTAVGGMLRARLRSASRVRGGGGGGGEGAGRWTTPGHEERPKGTSSTARRRRPGETRKWEDWELPCYITSFLTVVILGVGLNAKPDLTIETWAHEKALERLKQQELAAVSGGGDADADAE

SEQ ID NO: 4143 - DNA, 2097 bp, Zea mays
  misc_feature (1)..(2097): Ceres cDNA ID no. 21666125
  misc_feature (1)..(2097): Ceres CLONE  ID no. 1530993
  misc_feature (1)..(2097): Also known as  Ceres CDNA ID no. 24360613
aaggcagccgagccatggatcagaagaaggcgatgaggtctcaccactctcacatgtcaccatggcagcgtgggttagcggcgcgacgggggtggtgccagcaggcggctgcgcggcccacgacggttcttgtgatcgtggtgaccgtgtttgccgcgctgctcttggccgtcgtcctcttcggcgtccggctcacgcccttgggcgccaacaatacctgggtctcggccggggtacgcgtcgtcctcaaagccgtgtccgactccgaccacggcactggtccactggcgacggtgccggaccccagcgaccggctgctgggcggcctcctctcgccggacttcgacgaaagctcctgcctcagccgctacagcgccgcgctctaccgccgcccgtcgctgcacgccgtttcaacctacctcgtctccgcgctccgccgctacgagtcgctgcaccggcgctgcggcccgggcactccaggctacgcgcgcgccgtcgagctcctgcgcgcgaacgcctccgctgctgcttcttcgtcctccggatcatgcagctacgccgtgtgggccccgatcgaggggctcggcaaccgcatgctctccatcacctccgccttcctctacgcgctgctcacggaccgggtgctcctcctccacagcagcggcggcggcggcgacctcgacggcctcttctgcgagccgttcccgggctccacgtggatcctgccgggcgacacgggcttccccatccgcggcatcgagcggctcacggaccggtaccaccaccagagcctgggctccgtgctgaggcgcggcgaggaccccggcgcggcgccgtggctgtacgtgcacctgcggcacgactacaccaaggacagccgcgaccagcagttcttctgcgacgacgtgcaggccaggctgggggccgtgccgtggctcgtgttccggtcggacaactacttcgtgccggggctgttcctggtcccgcggcacgaggcggagctggcgcgcatgttcccgcgccgcgacgtcgtgttccaccacctcggccgctacctcttccacccgagtgacacggtgtggggcatggtgacccagtaccacgactcgtacttcgccagcgcggacgagcgcgtggggatccaggtgcgcaggttctactgggcgccgatctccaccgacgacctcttcgcccagatcctcaactgctcgcagcgcgaggacatcctgcccagcgttggcgttcccgcggcaaaaggcggctccgacggccagcagcctgcgaaacagaaggccgtggtcgtcgtgtccctgcacggcgagtactccgagaagctcagggacctgtaccaggggcacggcggagcggcgggcggccaggaggcggtgagcgtgcaccagccgacgcacctgggctcgcagcgctccggcgagcagcagcacaaccagaaggcgctcgcggagatggtgctgctcagcttctcggacgcgctggtcacctccgcggtctcgacgttcgggtacgtagggcaggggctagcggggctgagaccttgggtgctcacgagccccgtcgacaggaagggccccgggatgccgctgccgtgccggcgcgccgctaccgtcgagccttgcttccatgcgccgctcgactacgattgtcgggccaaagcaaaaggtgacgccggtaggagggtgcggcacatccgacactgtgaggacttcccgcgaggtgtgcagttggtggaatgatgaactacgcactagtattacatcacatgggcgctcaggagctaccaagcaccagtttttcattatattacaattaaacatggggaataaatacggcattcagtctaagaggttactgtaaaaaaagttatgtaagatgaccatcgcaaatagcgtgcgttgctaggttttcttttaccacaacatttgattttttattaaaaacatttttgttaacaaatttgtttctttgtatttgtatcggtttttgctccatatgtctccgttgtatttataggcataaactctatatctgtcttccaaatgaaaggtggtattcaatttcgtttaaaaaaaaaaaaaaaaa

SEQ ID NO: 4144 - protein, 2097 aa, Zea mays
  misc_feature: PFam Name: XG_FTase; PFam Description: Xyloglucan
  misc_feature: PFam Name: SerH; PFam Description: Cell surface
  misc_feature: PFam Name: Peptidase_S8; PFam Description: Subtilase family
  misc_feature: GI Number: 50913075; NR Description: putative galactoside 2-alpha-L-fucosyltransferase [Oryza sativa (japonica cultivar-group)] >gi|46805726|dbj|BAD17113.1| putative galactoside 2-alpha-L-fucosyltransferase [Oryza sativa (japonica
  misc_feature: GI Number: 51536203; NR Description: putative xyloglucan
  misc_feature: GI Number: 5231145; NR Description: xyloglucan
  misc_feature: GI Number: 51091911; NR Description: putative galactoside 2-alpha-L-fucosyltransferase [Oryza sativa (japonica cultivar-group)] >gi|51090519|dbj|BAD35721.1| putative galactoside 2-alpha-L-fucosyltransferase [Oryza sativa (japonica
  misc_feature: GI Number: 7453579; NR Description: xyloglucan fucosyltransferase [Pisum sativum] >gi|20138107|sp|Q9M5Q1|FUT1_PEA Galactoside 2-alpha-L-fucosyltransferase (Xyloglucan
AAGGCAGCCGAGCCATGGATCAGAAGAAGGCGATGAGGTCTCACCACTCTCACATGTCACCATGGCAGCGTGGGTTAGCGGCGCGACGGGGGTGGTGCCAGCAGGCGGCTGCGCGGCCCACGACGGTTCTTGTGATCGTGGTGACCGTGTTTGCCGCGCTGCTCTTGGCCGTCGTCCTCTTCGGCGTCCGGCTCACGCCCTTGGGCGCCAACAATACCTGGGTCTCGGCCGGGGTACGCGTCGTCCTCAAAGCCGTGTCCGACTCCGACCACGGCACTGGTCCACTGGCGACGGTGCCGGACCCCAGCGACCGGCTGCTGGGCGGCCTCCTCTCGCCGGACTTCGACGAAAGCTCCTGCCTCAGCCGCTACAGCGCCGCGCTCTACCGCCGCCCGTCGCTGCACGCCGTTTCAACCTACCTCGTCTCCGCGCTCCGCCGCTACGAGTCGCTGCACCGGCGCTGCGGCCCGGGCACTCCAGGCTACGCGCGCGCCGTCGAGCTCCTGCGCGCGAACGCCTCCGCTGCTGCTTCTTCGTCCTCCGGATCATGCAGCTACGCCGTGTGGGCCCCGATCGAGGGGCTCGGCAACCGCATGCTCTCCATCACCTCCGCCTTCCTCTACGCGCTGCTCACGGACCGGGTGCTCCTCCTCCACAGCAGCGGCGGCGGCGGCGACCTCGACGGCCTCTTCTGCGAGCCGTTCCCGGGCTCCACGTGGATCCTGCCGGGCGACACGGGCTTCCCCATCCGCGGCATCGAGCGGCTCACGGACCGGTACCACCACCAGAGCCTGGGCTCCGTGCTGAGGCGCGGCGAGGACCCCGGCGCGGCGCCGTGGCTGTACGTGCACCTGCGGCACGACTACACCAAGGACAGCCGCGACCAGCAGTTCTTCTGCGACGACGTGCAGGCCAGGCTGGGGGCCGTGCCGTGGCTCGTGTTCCGGTCGGACAACTACTTCGTGCCGGGGCTGTTCCTGGTCCCGCGGCACGAGGCGGAGCTGGCGCGCATGTTCCCGCGCCGCGACGTCGTGTTCCACCACCTCGGCCGCTACCTCTTCCACCCGAGTGACACGGTGTGGGGCATGGTGACCCAGTACCACGACTCGTACTTCGCCAGCGCGGACGAGCGCGTGGGGATCCAGGTGCGCAGGTTCTACTGGGCGCCGATCTCCACCGACGACCTCTTCGCCCAGATCCTCAACTGCTCGCAGCGCGAGGACATCCTGCCCAGCGTTGGCGTTCCCGCGGCAAAAGGCGGCTCCGACGGCCAGCAGCCTGCGAAACAGAAGGCCGTGGTCGTCGTGTCCCTGCACGGCGAGTACTCCGAGAAGCTCAGGGACCTGTACCAGGGGCACGGCGGAGCGGCGGGCGGCCAGGAGGCGGTGAGCGTGCACCAGCCGACGCACCTGGGCTCGCAGCGCTCCGGCGAGCAGCAGCACAACCAGAAGGCGCTCGCGGAGATGGTGCTGCTCAGCTTCTCGGACGCGCTGGTCACCTCCGCGGTCTCGACGTTCGGGTACGTAGGGCAGGGGCTAGCGGGGCTGAGACCTTGGGTGCTCACGAGCCCCGTCGACAGGAAGGGCCCCGGGATGCCGCTGCCGTGCCGGCGCGCCGCTACCGTCGAGCCTTGCTTCCATGCGCCGCTCGACTACGATTGTCGGGCCAAAGCAAAAGGTGACGCCGGTAGGAGGGTGCGGCACATCCGACACTGTGAGGACTTCCCGCGAGGTGTGCAGTTGGTGGAATGATGAACTACGCACTAGTATTACATCACATGGGCGCTCAGGAGCTACCAAGCACCAGTTTTTCATTATATTACAATTAAACATGGGGAATAAATACGGCATTCAGTCTAAGAGGTTACTGTAAAAAAAGTTATGTAAGATGACCATCGCAAATAGCGTGCGTTGCTAGGTTTTCTTTTACCACAACATTTGATTTTTTATTAAAAACATTTTTGTTAACAAATTTGTTTCTTTGTATTTGTATCGGTTTTTGCTCCATATGTCTCCGTTGTATTTATAGGCATAAACTCTATATCTGTCTTCCAAATGAAAGGTGGTATTCAATTTCGTTTAAAAAAAAAAAAAAAAA

SEQ ID NO: 4145 - DNA, 1381 bp, Zea mays
  misc_feature (1)..(1381): Ceres cDNA ID no. 21666126
  misc_feature (1)..(1381): Ceres CLONE  ID no. 1531433
  misc_feature (1)..(1381): Also known as  Ceres CDNA ID no. 25088193
aatggccagtccgacacatacgtacgcgtcatccggtcaggtgcatggtccacggtgcccctgctcaacgattagccgccgccgccgtgtcgtcgtcatcgagtccgcctttttctttttgtttagctcgtgggatctttcgcaagattttgttcctctgctaattaatcggcctgtaatcttagtagcagctaagaattgacgggcggaatgcatgggtggtggtggtggtggtggttgcttgcaggttcggtggatccgggcgctctactccaacttcagcgagttcacggcggaccaggagcgcctcatctccctcggcagcggcggcggacgccggttcgactacgtggagggcttcgtcgtcgccgccgagggcctcatcaacaactggaggtcctccttcttctcgccgcagaaccccgtgaagctcacctcgctcaagcaccattccagcgtcctctactgcctcgaggtcaccaagaactacgacgacgaaaccgcagggtcggtcgaccaggacgtggatacgctgctgggcgagctgaacttcctccctggcacggtgttcactacggacctgccgtacgtggacttcctggaccgcgtgcacaaggcggagctgaagctgcgcgccaaggggatgtgggaggtgccgcacccgtggctcaacctcttcgtgccggcgtcccgcatcgccgacttcgaccgcggcgtcttccgtggcgtgctggggggccgcaccgccggcgccggcggccccgtcctcatctaccccatgaacaagcacaagtgggacccgaggagctcggcggtgaccccggacgaggaggtgttctacctggtggcgttcctgcggtcggcgctgccgggcgcgccggagagcctggaggcgctggcgcggcagaaccagcggatcctcgacttctgcgcgggcgcgggcatcggcgccaagcagtacctgccgggccacaaggcgcggcacgagtgggcggagcacttcggcgccgcgaggtgggaccggttcgcgaggctcaaggccgagttcgacccgcgggccatcctggcggcggggcagggcatcttcaggccgcccggctcgccggcgctcgcggccgactcgtaacgtaatccagctgcttatactaattattaggcgcgtttagtgtaaggtagaggtactagctacagcagtaaccatacaggattgtttagttagctccggttggttcatgtacaaatgtggggttgttaatcgcgtgctctgccatggctgctgtgatcggttctgtacaggggatgaggggagccaaatatgaacgtggcaaaatcgatacttcttataaagaaaaaatatctatggtaaaaaaaaaaaaaaaaa

SEQ ID NO: 4146 - protein, 303 aa, Zea mays
  misc_feature: PFam Name: Peptidase_S8; PFam Description: Subtilase family
  misc_feature: PFam Name: Collagen; PFam Description: Collagen triple helix
  misc_feature: PFam Name: SSDP; PFam Description: Single-stranded DNA
  misc_feature: GI Number: 53793376; NR Description: putative cytokinin oxidase [Oryza sativa (japonica cultivar-group)] >gi|53791662|dbj|BAD53232.1| putative cytokinin oxidase [Oryza
  misc_feature: GI Number: 34910002; NR Description: putative cytokinin
  misc_feature: GI Number: 51970898; NR Description: cytokinin oxidase (CKX6) [Arabidopsis thaliana] >gi|22330649|ref|NP_177678.2| FAD-binding domain-containing protein / cytokinin oxidase family protein
  misc_feature: GI Number: 11120516; NR Description: cytokinin oxidase
  misc_feature: GI Number: 2618686; NR Description: putative cytokinin oxidase [Arabidopsis thaliana] >gi|7487602|pir||T00807 probable cytokinin oxidase [imported] - Arabidopsis thaliana >gi|15227374|ref|NP_181682.1| FAD-binding domain-containing
MGGGGGGGCLQVRWIRALYSNFSEFTADQERLISLGSGGGRRFDYVEGFVVAAEGLINNWRSSFFSPQNPVKLTSLKHHSSVLYCLEVTKNYDDETAGSVDQDVDTLLGELNFLPGTVFTTDLPYVDFLDRVHKAELKLRAKGMWEVPHPWLNLFVPASRIADFDRGVFRGVLGGRTAGAGGPVLIYPMNKHKWDPRSSAVTPDEEVFYLVAFLRSALPGAPESLEALARQNQRILDFCAGAGIGAKQYLPGHKARHEWAEHFGAARWDRFARLKAEFDPRAILAAGQGIFRPPGSPALAADS

SEQ ID NO: 4147 - DNA, 1908 bp, Zea mays
  misc_feature (1)..(1908): Ceres cDNA ID no. 21666127
  misc_feature (1)..(1908): Ceres CLONE  ID no. 1541139
  misc_feature (1)..(1908): Also known as  Ceres CDNA ID no. 21666127
actctctcatcttgagaaagaactcctcgtcctcgctccctccccaaccatcaagagcgcacacgcacacgcacacgccgcgcgcaagccggccgacgtacggcatggagaagagcgctacaactggcggcggcggttcaagcggcggcggagaggcggcggaggaggcgaaggtgcctctgctgcagccgagggctgcggcggcggcggcggccgaggaggaccatggaggaggaggaggatacgacggcaaggcggcgtcggcggcggcggatgaggagggcagggacgcgtcgtggtcgtcgctgccgctgcggcggcgcgcgtgggaggagaacaagaagctgtgggttgtggccggtccgtccatcttcacgcgcttcgcgtccttcggcgtcaccgtcatcagccaggccttcatcggccacatcggcgccaccgagctcgccgcctacgcgctcgtctccaccgtcctcatgaggttcagcaacggcatcctgctgggcatggcgagcgcgctggagacgctgtgcgggcagtcgtacggggcgaagcagtaccacatgctgggcatctacctgcagcggtcgtggatcatcctgtcggcgtgcgccgtggtgcagctccccgtgtacctgttcacggagccgctgctggtggcgctggggcaggacccggacatctcggcggtggcggggaccgtggcgctctggtacatccccgtgctcttctccttcgtctgggccttcccgctgcagatgtacctgcaggcgcagatcaagaacatgatcatcacgtacctcgccatgctcaacctcggcctccaccttgccctgtcctggctcgcggtcgtccacctccgcctcggcctcgccggcgtcatgggctccatggtcgtcgccatgtggatccccgtgttcggccagctcgccttcgtcttcttcggcggatgccctctcacctggaccggattctcgtccgccgccttcgccgacctcggcgccatcgtcaggctctcgctctcttctggtgtcatgctctgcttggaattgtggtacaacaccatactggtgctcctcacaggatacatgaagaatgcagagatcgcacttgacgccctttcaatatgccttaacatcaatggttgggagatgatgatctccatcggcttcctggctgcaacaggagtgcgagtggcgaacgagctgggagctgggagcgcgaggagggccaagttcgcgatctacaacgtggtcatcacctccttcgccatcgggctcgtgctgttcgtgctcttcctcttcttccgcgggagcctcgcctacatattcaccgacagccaggcggtggccggagccgtcgccgacctctcgcccctgctggccttctccatactgctcaacagcgtccagcccgtgctgtcaggtgtcgctgttggtgccggttggcaaggcgtagtcgcgtacgtcaacgtcacgtcgtactacctgatcggcattcctcttggcgcagtcctaggctacgtggtggggcttcatgtgaagggcatttggatcggaatgctgctcggaacgctggtccagactatcgtgcttctcttcataacagtaaagaccgactgggacaaacaggtggtggccgctcaagagaggctgaagaaatggtacatggaagagaacagaaggatgcaggcctcgagggggagtccttgagccggtccttcaaccaacttcaagcctggcctttgtgggttgctgattgacacaattttatgctaatatttctactattcatcacctcaacatcaaagtgagcccggcattccagatcgtgtgctcctcgagccaagcaatggaaaggcactgtcactgtcagcagcagtaggataaccaaaaaaaaaaaaaaaaa

SEQ ID NO: 4148 - protein, 535 aa, Zea mays
MEKSATTGGGGSSGGGEAAEEAKVPLLQPRAAAAAAAEEDHGGGGGYDGKAASAAADEEGRDASWSSLPLRRRAWEENKKLWVVAGPSIFTRFASFGVTVISQAFIGHIGATELAAYALVSTVLMRFSNGILLGMASALETLCGQSYGAKQYHMLGIYLQRSWIILSACAVVQLPVYLFTEPLLVALGQDPDISAVAGTVALWYIPVLFSFVWAFPLQMYLQAQIKNMIITYLAMLNLGLHLALSWLAVVHLRLGLAGVMGSMVVAMWIPVFGQLAFVFFGGCPLTWTGFSSAAFADLGAIVRLSLSSGVMLCLELWYNTILVLLTGYMKNAEIALDALSICLNINGWEMMISIGFLAATGVRVANELGAGSARRAKFAIYNVVITSFAIGLVLFVLFLFFRGSLAYIFTDSQAVAGAVADLSPLLAFSILLNSVQPVLSGVAVGAGWQGVVAYVNVTSYYLIGIPLGAVLGYVVGLHVKGIWIGMLLGTLVQTIVLLFITVKTDWDKQVVAAQERLKKWYMEENRRMQASRGSP

SEQ ID NO: 4149 - DNA, 2047 bp, Glycine max
  misc_feature (1)..(2047): Ceres cDNA ID no. 21666128
  misc_feature (1)..(2047): Ceres CLONE  ID no. 1238522
  misc_feature (1)..(2047): Also known as  Ceres CDNA ID no. 24361155
gtcgctcgttctagggtttaacaaacggctgaatagtaaatactttcagaggcagtagcgtaattgttcggctctcgcaaatacgagaaggaacaaaacaccgcggaagcaaccatggccgaagcagaacacaacgatcccacctcgccggagcgcgaggtccaaaccaaaagcaacaagaagaaactccgcaagaggaaaaggcctcacaagaccgagcagaaacgagatgaggacaagaacgatgctaacattgatagtgcccaaacacaaaccgaagatgaagaagaagaacaaaaagaagaagacacaaacaacttctcatccggaatcatgagcaccgagtctttctcctctctgggcttgtccgaacccacttccaaagccattgcggacatgggcttccaccgtatgactcagattcaagcgaaggcaattccgccgcttctgaccaggaaggacgttctgggcgcggcgagaacgggtgcgggaaaaaccctagcgtttttagttccggcggtggagttgctgtacagcattcagttcacgcctcggaacgggacgggtgttgttgtgatatgcccgacgagggagctggcgattcagacgcacgccgtggcgaaggagctgctgaagtatcactcgcagacgcttgggttggtgattgggggttccgggaggaagggagaggcggagcgcattgtgaaaggggtgaacctgttggtggcgacgccaggaaggcttctcgatcacctccagaatacgaaggggttcatatataaaaacttgaagtgcctaatgattgatgaagctgacaggatattggaagcaaattttgaggaggagatgaagcagattattaacatacttccaaagaaaaggcaaacagctttgttctcagctacccaaacaaagaaggtcgaggatcttgcccgcttatcatttcaggcaactcctatctatattgatgtagatgatgggagaaaaaaggtcacaaatgaaggattgcagcagggctatgttgttgttccctgtgctaaacgttttgttgttctctattcattcttgaggagataccaatcaaaaaaagtgatggtctttttctcttcatgcaactctgtcaaattccatgcagatcttctcaagtgcactgggttggactgtttaaatattcatggaaaacaaaagcaacatgccaggactactacgttcttcaacttctgcaaagcagaaaaggggatcttgctctgtactgatgttgctgctcgtggacttgacatacctgatgtggactggattgtgcagtatgatcctcctgatgaaccaaaggaatatatccacagggttggtagaacagctcgtggggaaggtggaaaaggaaatgctttacttttcctgattcctgaagaattgcaatttcttcactatttgaaggcagcaaaggttcccgtgaaagaatatgcgtttgatcataagaagcttgcaaatgtacaatctcaactggagaagttggtggctggcatttatcatttgaatgttatggctaaagatgcatataggtcatatatattagcatataattcacactccatgaaagatatattcaatgttcaccgccttgatttacaggctgttgctgcttcattctgtttttctaacccaccgaaggtgaatctgaacatagatagcagtgcttcaaagcataggaagaaaatacgcaaagtagaaggaaagagaagatgataaaaggcattttctcacggccgtgcagtggtgtgatccccacattctcccacccacaccacaccaccccataaagttttggtaggcaccccaattttatataaagagatggatttgtaactttatcaaacaaccttggttattagaagcatcagaaaatttaaattagaatgtgttatgcgcatttttgaaccgtaatattccacatgacgaccggtgtcccatcccatgttcgaatttgtaagcttattcttttgttgttgaaaattatatcatgaattttcaagcaaaaaaaaaaaaaaaa

SEQ ID NO: 4150 - protein, 542 aa, Glycine max
  misc_feature: PFam Name: DEAD; PFam Description: DEAD/DEAH box helicase
  misc_feature: PFam Name: Helicase_C; PFam Description: Helicase conserved
  misc_feature: GI Number: 66849132; NR Description: ATP-dependent RNA
  misc_feature: GI Number: 9759574; NR Description: ATP-dependent RNA helicase-like [Arabidopsis thaliana] >gi|2827700|emb|CAA16673.1| DEAD box ATP dependent helicase protein [Arabidopsis thaliana] >gi|16649121|gb|AAL24412.1| ATP-dependent RNA helicase-like
  misc_feature: GI Number: 12654791; NR Description: DEAD (Asp-Glu-Ala-Asp) box polypeptide 18 [Homo sapiens] >gi|13097183|gb|AAH03360.1| DEAD (Asp-Glu-Ala-Asp) box polypeptide 18 [Homo sapiens] >gi|19353239|gb|AAH24739.1| DEAD (Asp-Glu-Ala-Asp) box
  misc_feature: GI Number: 31981163; NR Description: DEAD (Asp-Glu-Ala-Asp) box polypeptide 18 [Mus musculus] >gi|20380248|gb|AAH28246.1| DEAD
  misc_feature: GI Number: 38327634; NR Description: DEAD (Asp-Glu-Ala-Asp) box polypeptide 18; Myc-regulated DEAD box protein; putative ATP-dependent RNA helicase; DEAD/H (Asp-Glu-Ala-Asp/His) box polypeptide 18 (Myc-regulated) [Homo sapiens]
MAEAEHNDPTSPEREVQTKSNKKKLRKRKRPHKTEQKRDEDKNDANIDSAQTQTEDEEEEQKEEDTNNFSSGIMSTESFSSLGLSEPTSKAIADMGFHRMTQIQAKAIPPLLTRKDVLGAARTGAGKTLAFLVPAVELLYSIQFTPRNGTGVVVICPTRELAIQTHAVAKELLKYHSQTLGLVIGGSGRKGEAERIVKGVNLLVATPGRLLDHLQNTKGFIYKNLKCLMIDEADRILEANFEEEMKQIINILPKKRQTALFSATQTKKVEDLARLSFQATPIYIDVDDGRKKVTNEGLQQGYVVVPCAKRFVVLYSFLRRYQSKKVMVFFSSCNSVKFHADLLKCTGLDCLNIHGKQKQHARTTTFFNFCKAEKGILLCTDVAARGLDIPDVDWIVQYDPPDEPKEYIHRVGRTARGEGGKGNALLFLIPEELQFLHYLKAAKVPVKEYAFDHKKLANVQSQLEKLVAGIYHLNVMAKDAYRSYILAYNSHSMKDIFNVHRLDLQAVAASFCFSNPPKVNLNIDSSASKHRKKIRKVEGKRR

SEQ ID NO: 4151 - DNA, 1354 bp, Zea mays
  misc_feature (1)..(1354): Ceres cDNA ID no. 21666129
  misc_feature (1)..(1354): Ceres CLONE  ID no. 1375420
  misc_feature (1)..(1354): Also known as  Ceres CDNA ID no. 24359709
agttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagccggttggcggcagcgatggagctgcatcatcaggcgcagaaggaggctatggcgccgcagcaggctcaggctccgcccctcttcttggacttctcgcatggagattacggcggcgggaggaagcggcagcgcgaggcggagcccatgtcgtcgcagttcttctctctgcagcagcaaccgcaggcgcaggggcccaaggtgatcaacctggcgcaacttcagaagcggacggcgatgggcctccggctcgacttcgacgagggctcggagcacgtgtcgtgcacgtccccggcctcggcctcggcctcatgtctcctctctaaagagctcgccgcgcagcgcgatcagcacaggaacgagatggaccggctgatccaggaacatgcggacaggctccggcgcgcgctggccgacactcggcggcggcactaccgttcgctggtcggcgcggcggaggcggcggctgctcaacgggtaagggagaaggaggcggaggcgtcggaggccgcgcggcgccgcgcggacctggaggaccgggtggcgcggctgagggcggaggcggcggcgtggcaggccaaggacgcagcggatcagtccacagccgcggcgctccacgcgcagctgcagaaggcggcggcggcgcaggcgaggggcaaggccgaggaggaggacaacgtgggcgccgcggcggacgacgccgggtcctgcttcgtcgacccggacagggtcgtggaggtcgccccgccgcgcccgctggccaggccgtgccggacgtgcgggcagcgttcggcctccgtcgtgctgctcccgtgccgccacctctgcgtctgcgccgagtgcgagcccgccgtccccgctgccggcgccgtcgcggctgcctgccccatgtgccgtggcgcggtgaccggcaccgtgcaagtgttcttctcctagcaagctttaggaaaggggaaaatgctaaaagaaaaagcaagacaaaatcgttgctcctgccaaaaggaatgatccgtgaaaatggggaattgttcatgatagtccgttctctgcttcttttttttttctctccctctctcagttgtttattataatccttctattagtatataagtcgatctcttctagtaaaaaaaaaaaaaaaa

SEQ ID NO: 4152 - protein, 336 aa, Zea mays
  misc_feature: PFam Name: GRP; PFam Description: Glycine rich protein family
  misc_feature: PFam Name: S-antigen; PFam Description: S-antigen protein
  misc_feature: PFam Name: Secretin_N; PFam Description: Bacterial type
  misc_feature: PFam Name: Dehydrin; PFam Description: Dehydrin
  misc_feature: PFam Name: Pkinase; PFam Description: Protein kinase domain
  misc_feature: GI Number: 50911595; NR Description: S-ribonuclease binding protein SBP1-like [Oryza sativa (japonica cultivar-group)] >gi|41052730|dbj|BAD07587.1| S-ribonuclease binding protein
  misc_feature: GI Number: 6714275; NR Description: F6N18.12 [Arabidopsis thaliana]
  misc_feature: GI Number: 50909081; NR Description: SBP1-like [Oryza sativa (japonica cultivar-group)] >gi|49388268|dbj|BAD25386.1| SBP1-like
  misc_feature: GI Number: 21536706; NR Description: S-ribonuclease binding
  misc_feature: GI Number: 62321633; NR Description: At1g10650 [Arabidopsis
MAVQAHYHHHYHRESPFLVSGAPEGSRLAAAMELHHQAQKEAMAPQQAQAPPLFLDFSHGDYGGGRKRQREAEPMSSQFFSLQQQPQAQGPKVINLAQLQKRTAMGLRLDFDEGSEHVSCTSPASASASCLLSKELAAQRDQHRNEMDRLIQEHADRLRRALADTRRRHYRSLVGAAEAAAAQRVREKEAEASEAARRRADLEDRVARLRAEAAAWQAKDAADQSTAAALHAQLQKAAAAQARGKAEEEDNVGAAADDAGSCFVDPDRVVEVAPPRPLARPCRTCGQRSASVVLLPCRHLCVCAECEPAVPAAGAVAAACPMCRGAVTGTVQVFFS

SEQ ID NO: 4153 - DNA, 1452 bp, Glycine max
  misc_feature (1)..(1452): Ceres cDNA ID no. 21666130
  misc_feature (1)..(1452): Ceres CLONE  ID no. 1239981
  misc_feature (1)..(1452): Also known as  Ceres CDNA ID no. 25087608
aattttcctattttccatgaatgttctggctctagggcgcttcctcacttcccccttatataagacttcccctctcactccctccccaatccaattcacacccatttttcttcatcccccaaagtttcaatctttgtattcaattcaccctttctctctctccatggccacttgtgttgatgccccaacccctctttctcggaagcctaacgggtcccaatccgatgatcattccttcaattacatgaaattctgccgacccactttctctgatcgcgttccctgcatacccatttgcaagaatcgtgacactgccttcacacgcgtggaggagtttgacacatgtgtggaggataatgatgatattgaggttgaggttgtggagggtgttgatctttggttgaagattcaagaggaggcaaggttagatgttgatcaagaaccaattttatccagctactatttcagttccattttgtctcacaaatctttggagagtgccttggccaaccacctctccacaaatttgagcagcttgagccttccaagcagcaccctttttgaccttttcatgggtgttttggttgatgatggagatgatgacatcgtaggtgctgtgaaggatgatttgatagctgttaaggagagggaccctgcttgcataagttatgtgcattgcttgctgaatttcaagggttttttggcatgtcaggctcataggattgctcacaaattgtggcttcaagggaggaaggtcttggcgctgttgattcagaatagggtgtctgaggtttttgctgtggatattcaccctggtgccaaaattggacgtgggattttgctggatcatgcaacaggacttgttgtgggggagactgcagttattgggaataatgtgtcaattttgcataatgtgacattgggagggactggtaaggcaagtggggatagacaccctaagattggtgatggggtgttgataggtgcagggacttgtattttggggaacattaagattggtgatggagctaagattggtgcttgttctgttgtgttgaaggaagtgccaccaaggactactgctgttgggaaccctgctaggttggttggagggaaggataaccctattaaattggataagatgcctagttttaccatggaccatacttcatggtctgattatgttatatagaagctaattaattgtctaacatgttttagagtttgtgtttaggtgggaattgttttggttgagggggcttggttgttgtgcaagagagaatctaagttctcctgctgacaacagggcgtcctttgaatcatcgtgttagatttttaaagaatagttagatgtagtactttgttgttgtaaggggccatgatgacaaccctttgtgtaaaatttatgaatatggatatttcagcttgttatggttaaaaaaaaaaaaaaaa

SEQ ID NO: 4154 - protein, 1452 aa, Glycine max
  misc_feature: PFam Name: SATase_N; PFam Description: Serine
  misc_feature: GI Number: 23343583; NR Description: serine acetyltransferase
  misc_feature: GI Number: 38350581; NR Description: serine acetyltransferase
  misc_feature: GI Number: 23343581; NR Description: serine acetyltransferase
  misc_feature: GI Number: 47779324; NR Description: mitochondrial serine
  misc_feature: GI Number: 47779326; NR Description: chloroplast serine
AATTTTCCTATTTTCCATGAATGTTCTGGCTCTAGGGCGCTTCCTCACTTCCCCCTTATATAAGACTTCCCCTCTCACTCCCTCCCCAATCCAATTCACACCCATTTTTCTTCATCCCCCAAAGTTTCAATCTTTGTATTCAATTCACCCTTTCTCTCTCTCCATGGCCACTTGTGTTGATGCCCCAACCCCTCTTTCTCGGAAGCCTAACGGGTCCCAATCCGATGATCATTCCTTCAATTACATGAAATTCTGCCGACCCACTTTCTCTGATCGCGTTCCCTGCATACCCATTTGCAAGAATCGTGACACTGCCTTCACACGCGTGGAGGAGTTTGACACATGTGTGGAGGATAATGATGATATTGAGGTTGAGGTTGTGGAGGGTGTTGATCTTTGGTTGAAGATTCAAGAGGAGGCAAGGTTAGATGTTGATCAAGAACCAATTTTATCCAGCTACTATTTCAGTTCCATTTTGTCTCACAAATCTTTGGAGAGTGCCTTGGCCAACCACCTCTCCACAAATTTGAGCAGCTTGAGCCTTCCAAGCAGCACCCTTTTTGACCTTTTCATGGGTGTTTTGGTTGATGATGGAGATGATGACATCGTAGGTGCTGTGAAGGATGATTTGATAGCTGTTAAGGAGAGGGACCCTGCTTGCATAAGTTATGTGCATTGCTTGCTGAATTTCAAGGGTTTTTTGGCATGTCAGGCTCATAGGATTGCTCACAAATTGTGGCTTCAAGGGAGGAAGGTCTTGGCGCTGTTGATTCAGAATAGGGTGTCTGAGGTTTTTGCTGTGGATATTCACCCTGGTGCCAAAATTGGACGTGGGATTTTGCTGGATCATGCAACAGGACTTGTTGTGGGGGAGACTGCAGTTATTGGGAATAATGTGTCAATTTTGCATAATGTGACATTGGGAGGGACTGGTAAGGCAAGTGGGGATAGACACCCTAAGATTGGTGATGGGGTGTTGATAGGTGCAGGGACTTGTATTTTGGGGAACATTAAGATTGGTGATGGAGCTAAGATTGGTGCTTGTTCTGTTGTGTTGAAGGAAGTGCCACCAAGGACTACTGCTGTTGGGAACCCTGCTAGGTTGGTTGGAGGGAAGGATAACCCTATTAAATTGGATAAGATGCCTAGTTTTACCATGGACCATACTTCATGGTCTGATTATGTTATATAGAAGCTAATTAATTGTCTAACATGTTTTAGAGTTTGTGTTTAGGTGGGAATTGTTTTGGTTGAGGGGGCTTGGTTGTTGTGCAAGAGAGAATCTAAGTTCTCCTGCTGACAACAGGGCGTCCTTTGAATCATCGTGTTAGATTTTTAAAGAATAGTTAGATGTAGTACTTTGTTGTTGTAAGGGGCCATGATGACAACCCTTTGTGTAAAATTTATGAATATGGATATTTCAGCTTGTTATGGTTAAAAAAAAAAAAAAAA

SEQ ID NO: 4155 - DNA, 1283 bp, Zea mays
  misc_feature (1)..(1283): Ceres cDNA ID no. 21705146
  misc_feature (1)..(1283): Ceres CLONE  ID no. 219078
  misc_feature (1)..(1283): Also known as  Ceres CDNA ID no. 24358261
atattcatatacatacgcatacactacagcaccagccaccaggctgaccagaagaagcagagctcgtggcgcacgctcatggagggagtcatctctacttccccaggcgcaaggatcgccgtggtcaccggcgggaacaaaggtattgggctagaggtgtgccggcagctggccgggaacggcatcaccgtcgtcttaacagccagggacgagacgaggggcgcagctgccttggaggagctcagagcgctgggtctttccgacgtcgttttccatctgctggacatcacggacgcgtcgagcatcgctaggctagccggtttcttgaaggcccgtttcgggaggctagacattctgataaataatgccgcgtttggcggcgtcgaatacgcccggggtcctgctgctgctgctgctgggtcagtgacaagtgaagaagaattgagcggcatggatagggatcagaggcttgaatgtctgtggaggaatacccgggagacttacgacgctgcaaagaaaggcctgctgacgaactactacggcaccaagcatgtgatcgaagcgttgctacctctgctccgagcctcctctgacggaagaatcgttaacgtctcctccgactttgggctgcttaggttcttcagaaacgaggagctgaagcaagagctgcacaacgtcgagaagctgaccgaggggaggctggacgagctgctggacgcgttcctggaggacttcgaggccgacgaggccgacgcgcgcgggtggccggcggcgttcgcggcgtacaaggtgggcaaggcggccatgaacgcgtactcgaggatcctggcggcggagcagccgacgctgcgcgtcaactgcgtgcatcctggctacatcaagaccgacataaccttgcgctcggggctcctgacgcccgaggaaggcgcgggcaacgtggtcaaggtggcgctgctgccgggaggcggggtcaccggcgccttctttgaagacggccaggagacgtcgttcgtgtgacgtcatctgttggacacttggaccggcattcagaaaggagagctggagttggcgatggtgtggcgtatagatataacaccatgggttagccaaggcacgacacgaaaaagtacggtgcaggcacgacccggtccggctagtatagtgtcagtgtctgagccactatctcgactcgtagtgctggcacgggcacgacacggttacattttttattttaaaaataatagttttattgtgttataaaaaaaaaaaaaaaaaaaaaaaaa

SEQ ID NO: 4156 - protein, 312 aa, Zea mays
  misc_feature: PFam Name: adh_short; PFam Description: short chain dehydrogenase
  misc_feature: GI Number: 50911108; NR Description: short-chain dehydrogenase/reductase protein-like [Oryza sativa (japonica cultivar-group)] >gi|49388250|dbj|BAD25370.1| short-chain dehydrogenase/reductase protein-like [Oryza sativa (japonica
  misc_feature: GI Number: 50940121; NR Description: carbonyl reductase -like protein [Oryza sativa (japonica cultivar-group)] >gi|33146492|dbj|BAC79601.1| carbonyl reductase -like protein [Oryza sativa (japonica cultivar-group)]
  misc_feature: GI Number: 50911104; NR Description: short-chain dehydrogenase/reductase protein-like [Oryza sativa (japonica cultivar-group)] >gi|49388248|dbj|BAD25368.1| short-chain dehydrogenase/reductase protein-like [Oryza sativa (japonica
  misc_feature: GI Number: 4115379; NR Description: putative carbonyl reductase [Arabidopsis thaliana] >gi|25412197|pir||F84633 probable carbonyl reductase [imported] - Arabidopsis thaliana
  misc_feature: GI Number: 33950297; NR Description: menthol dehydrogenase
MEGVISTSPGARIAVVTGGNKGIGLEVCRQLAGNGITVVLTARDETRGAAALEELRALGLSDVVFHLLDITDASSIARLAGFLKARFGRLDILINNAAFGGVEYARGPAAAAAGSVTSEEELSGMDRDQRLECLWRNTRETYDAAKKGLLTNYYGTKHVIEALLPLLRASSDGRIVNVSSDFGLLRFFRNEELKQELHNVEKLTEGRLDELLDAFLEDFEADEADARGWPAAFAAYKVGKAAMNAYSRILAAEQPTLRVNCVHPGYIKTDITLRSGLLTPEEGAGNVVKVALLPGGGVTGAFFEDGQETSFV

SEQ ID NO: 4157 - DNA, 1420 bp, Zea mays
  misc_feature (1)..(1420): Ceres cDNA ID no. 21705147
  misc_feature (1)..(1420): Ceres CLONE  ID no. 239138
  misc_feature (1)..(1420): Also known as  Ceres CDNA ID no. 24362629
cttggacccgaggtaagaccgcccatagaattttcatttcgccgcattattttttttcccttctcactccctccttcggtccttcgccttcctcatgtccccgactctccgatactagtcgagtagtccggtacatcacaccgcctcgcaccgcggccatgttgacaccgcgcgtcctcaaggcttcgctgctccgctgcttgcgcgctaccgccgagctgcctccgttgcggcgaccccggatcctacctgtgcgggtttaccattccagaggctattctagtgggggaagctccaagtatgataggccaatgagacagttttctgaacagaatgagtcaacctctcagccattaatatattacattgctccatctgctctgcttgcttttgctgggatagccacatttgttcattacaatgatgagaggcgtgcagttcccttcgctaaagtaccaggacagaccaatgttcccaaaagatgtactaccaatagacctgcaataggagggccatttaagctgtatgatacagaaaacaatgaggtgactgaatcaaagcttcggggaaagtggaatctgatgtactttggctatacatcatgcccagatgtgggtccagctgaagttcagaagatagctgatgttgttaaactgttagagtcaaagtacgatatcaatattacaccactctttgtcacaattgatccacaacgtgattcacctgctcagcttaaggcataccttactgagtttgacccaagaatagtaggactaacaggccccatcagtgcagtaagacagatagctcaggagtaccgtgttttctttaaaagagtagaggaagttggtcaggactatcttatagaaagctctcacaatatgtacttgctagatccatgcttggagacagtaaggtgctttggaagtgagtacgaggcatcagaccttgctgaggctataacaacagaggttcagaaagcatctgcctcatcaacaaattagtctagcggtatggcagcatcagcagttttccaatcttgccgtgaagcacctcgcctgttgcatagccctcacagaagggcgtgactcacagtgggctggccattcagctctgcctgcaaccaaccgatccaagttttcctattctcgctcttgttgtgtcagatctgagtttaactgtacagaatggtcttcttgcgacgaaatctcctggcagttccagatcacttacaattctgcgacatgagaatgatcttacaatttccagcaaacattaacctgctgcattggatgtgccatatgacctacagacttaccaggttgttagaacagattcatgaacctgctttgctcttccctctggatgctgaacaggtaaacgattgtgaggcgtaaaaaaaaaaaaaaaaaaaaaaaaa

SEQ ID NO: 4158 - protein, 281 aa, Zea mays
  misc_feature: PFam Name: SCO1-SenC; PFam Description: SCO1/SenC
  misc_feature: GI Number: 50899796; NR Description: putative SenC [Oryza sativa (japonica cultivar-group)] >gi|49389106|dbj|BAD26385.1|
  misc_feature: GI Number: 21593335; NR Description: unknown [Arabidopsis thaliana] >gi|18420515|ref|NP_568068.1| electron transport
  misc_feature: GI Number: 6403490; NR Description: putative SCO1 protein
  misc_feature: GI Number: 6319511; NR Description: inner mitochondrial membrane protein; Sco1p [Saccharomyces cerevisiae] >gi|134307|sp|P23833|SCO1_YEAST SCO1 protein, mitochondrial precursor >gi|83521|pir||JE0051 SCO1 protein precursor - yeast
  misc_feature: GI Number: 6319498; NR Description: Protein with similarity to Sco1p, originally identified as a multicopy suppressor of a respiratory defective mutant; Sco2p [Saccharomyces cerevisiae] >gi|536232|emb|CAA84966.1| SCO2 [Saccharomyces cerevisiae]
MLTPRVLKASLLRCLRATAELPPLRRPRILPVRVYHSRGYSSGGSSKYDRPMRQFSEQNESTSQPLIYYIAPSALLAFAGIATFVHYNDERRAVPFAKVPGQTNVPKRCTTNRPAIGGPFKLYDTENNEVTESKLRGKWNLMYFGYTSCPDVGPAEVQKIADVVKLLESKYDINITPLFVTIDPQRDSPAQLKAYLTEFDPRIVGLTGPISAVRQIAQEYRVFFKRVEEVGQDYLIESSHNMYLLDPCLETVRCFGSEYEASDLAEAITTEVQKASASSTN

SEQ ID NO: 4159 - DNA, 1382 bp, Zea mays
  misc_feature (1)..(1382): Ceres cDNA ID no. 21705148
  misc_feature (1)..(1382): Ceres CLONE  ID no. 324229
  misc_feature (1)..(1382): Also known as  Ceres CDNA ID no. 23760438
atagatgtttaatgtatataggaaaaaaatgagatattgaaaaaaatattttacgcgaggacggataggacattcggcgttcctagtcgtaccccgcagcttccgtgctcacctcgcctgcagggcagcagccgctggaagaacacgaagacgacgggagtgcggggtggcgtcgccgccggagcaccagttgtagccggcggctaggcctccgcgccgctctccgtggccaacgtgccgtcatgcttgcggcgtcggcgcggcggctgtccgccgccgcctcgttttcctcttcttccatgcgctccagccagctcgccgccgtactgaaccaacagaggtggatgcacgacaggaacaagaaggcgatggagctggtggccaagggatggagtgcgctccaggaggtcgaccgcgtcatcgactacgccgatcgcaacgacaagcgcctcatcccgcttctaaggggcgctaaggaaaactttgagctggctttggagattgacaatggtaatacacatgcgaggtattggctgggaaaaatgcatttcaagtatcatgttcctggtgcttgcaaggcagttggtgctgctttgttggttgaagctgcaaatatgggtgatccagatgcacagtatgaacttggatgtcgactaagaattgagaatgactatgttcagtcggatcaacaggctttccattacattgagcaagctgttgatcagctgcaccctggtgctttatatcttctcggtgctgtatatctaactggggactgtgttaagagagatatggcttccgcgttgtggtgttttcatagagcttcagaaaagggacatgctggtgcagctatcgcatatggatccctgcttcttaaaggtgctgaaatacctgaagttattacaaggttcaactcaggcaagagtccatcaactgggaaaatgcggaaaaggaccctacagcaggatccagtaaagctagcgaaagaacagtttcaaattgcagctgaggcaggctgtgatcttggtctgcggtggttgaagaggcttgaagcttatgaaaaccaagaagaaaagctaaagcaggttcagcaatgatatccactgaaagaatcccattgcatttgtcgcatacaagtatggtatatggcagcatggttgctgcacataggtataccaataagttcctttcctgccttcattatgttggaggctattcgatcctcggatgttcgggtcaaatttgcaggaagatatactgaaatttggatatttagactaacttcttggattctaggcgcttggatgttcactttgtacgatgtattagcgttgacattactggaagccctaattgtgagaagtacaaaaaaaaaaaaaaaa

SEQ ID NO: 4160 - protein, 284 aa, Zea mays
  misc_feature: GI Number: 21554301; NR Description: unknown [Arabidopsis thaliana]
MLAASARRLSAAASFSSSSMRSSQLAAVLNQQRWMHDRNKKAMELVAKGWSALQEVDRVIDYADRNDKRLIPLLRGAKENFELALEIDNGNTHARYWLGKMHFKYHVPGACKAVGAALLVEAANMGDPDAQYELGCRLRIENDYVQSDQQAFHYIEQAVDQLHPGALYLLGAVYLTGDCVKRDMASALWCFHRASEKGHAGAAIAYGSLLLKGAEIPEVITRFNSGKSPSTGKMRKRTLQQDPVKLAKEQFQIAAEAGCDLGLRWLKRLEAYENQEEKLKQVQQ

SEQ ID NO: 4161 - DNA, 1877 bp, Zea mays
  misc_feature (1)..(1877): Ceres cDNA ID no. 21705149
  misc_feature (1)..(1877): Ceres CLONE  ID no. 324980
  misc_feature (1)..(1877): Also known as  Ceres CDNA ID no. 24358217
atcagtttcacatttcacactcgctccccacttcgcatcgccgaagcgccaccacctcacgcactccactgtccactccagtactccactccaccgaagcgcacgctccccgccaggagcagaggaggaggggatgccgggcggcgtggtggacgcggccgccaagggcgtgaggctggagcggcacgcggcgctgctgcggcgcgcggcgggcgccaagcagctggtgtcggcgtcgtcgcagctgctcttccgcgccaccgtgctcgccacgctggcgctagtcgtcctcttcgccgtgcactacccgtccatgctctcccgctcattcagcctctccgcagcgcccgcgtccggcgcctcgtcctcgcggtcgcggcactcgcaccggagcctgttgggctcgaggccggcgtcgcgctggagcgccgcgtgggagcgggaggtgcggcgcagcgccgcgccgcggcgggacggggcgctgtcggtgctggtcacgggcgcggcgggcttcgtgggcgcgcactgctcgctggcgctccgcgcgcgcggcgacggcgtcgtcggcctggacaacttcaacgcctactacgacccgtccctgaagcgcgcgcggcagcggctgctggcgtcccgcggcgtggcggtggtggacggcgacgtcaacgacgcggcgctgctggagcggctgctcgcgtcggtgcgcttcacgcacgtgctgcacctggccgcgcaggccggcgtgcggcacgcgatgcgggcgccgcaggcgtacgtggcctccaacgtggccggcctcgtcgccctcttcgaggccgcggcaaggcacgccgacccgcagccggcggtcgtgtgggcgtcgtcgtcgtcggtgtacgggctcaacacccaggcgcccttctccgaggagcaccgcacggaccgccccgcgtcgctgtacgcggccaccaagaaggccggcgaggccatcgcgcacgcgtacaaccacatctacgggctctccatcaccggcctccgcttcttcaccgtgtacgggccctggggccgccccgacatggcctacttctccttcgcccgcagcatcgtcgccggcgagcccgtcacgctgttccgcgccgccgacggctccgacgcgcgccgcgacttcacctacatcgacgacgtcgtcaggggctgcctcggcgcgctcgacacggccggcaggagcacgggctccaggtccggccgcaagcgcgggcccgcgccgctccgcgtgtacaacctcggcaacacctcgccggtgcccgtcacccgcatggtcgccatcctcgagaagctcctcggcaagaaggctatcaagcgcgtcgtcacgatgccggccaacggggacgtgccgttcacgcacgccaatgtcagccacgccgcgcgcgacttcgggtaccgccccgccacctcgctcgaggcctgcctccgccatttcgtcgactggttcgtcaggtactacaaggtcgacatcaggggcgggaatgtcctcgccggcaagaccgccaagaggaaatccatggccatgtcctcagcatcgtgaggagccgccgccgctgcgtgtgcccaagccccgccgtccaccaccaagtgtgcattcgattgtccttggaggagtgtcctgtaacttcgcgagacgcgaggtgcttattgtttaagccttgctgcttttgcttcttcatgatgctaccatactactaccatagcagtgcttagtgccatggaaaaggatccatagataaactaagcttaactgcttgagaaaaagaaaaaggtagagaaaaaaaaagatgtgggtatagatacacagcagagcaaagcaaaggagccatgtctgaacaaaaaaaaaaaaaaaa

SEQ ID NO: 4162 - protein, 476 aa, Zea mays
  misc_feature: PFam Name: Epimerase; PFam Description: NAD dependent
  misc_feature: PFam Name: Pyr_redox_2; PFam Description: Pyridine
  misc_feature: PFam Name: Podocalyxin; PFam Description: Podocalyxin
  misc_feature: PFam Name: Pkinase; PFam Description: Protein kinase domain
  misc_feature: PFam Name: Cation_efflux; PFam Description: Cation efflux family
  misc_feature: GI Number: 50947799; NR Description: putative type 1 capsule synthesis gene(CapI) [Oryza sativa (japonica cultivar-group)] >gi|29647497|dbj|BAC75426.1| putative type 1 capsule synthesis
  misc_feature: GI Number: 22136952; NR Description: putative NAD dependent epimerase [Arabidopsis thaliana] >gi|13877895|gb|AAK44025.1| putative NAD dependent epimerase [Arabidopsis thaliana] >gi|9294651|dbj|BAB03000.1| nucleotide sugar epimerase-like
  misc_feature: GI Number: 24417280; NR Description: unknown [Arabidopsis thaliana]
  misc_feature: GI Number: 51091715; NR Description: putative uridine
  misc_feature: GI Number: 50915498; NR Description: putative nucleotide sugar epimerase [Oryza sativa (japonica cultivar-group)] >gi|47497071|dbj|BAD19123.1| putative nucleotide sugar epimerase [Oryza sativa (japonica cultivar-group)] [Oryza sativa (japonica
MPGGVVDAAAKGVRLERHAALLRRAAGAKQLVSASSQLLFRATVLATLALVVLFAVHYPSMLSRSFSLSAAPASGASSSRSRHSHRSLLGSRPASRWSAAWEREVRRSAAPRRDGALSVLVTGAAGFVGAHCSLALRARGDGVVGLDNFNAYYDPSLKRARQRLLASRGVAVVDGDVNDAALLERLLASVRFTHVLHLAAQAGVRHAMRAPQAYVASNVAGLVALFEAAARHADPQPAVVWASSSSVYGLNTQAPFSEEHRTDRPASLYAATKKAGEAIAHAYNHIYGLSITGLRFFTVYGPWGRPDMAYFSFARSIVAGEPVTLFRAADGSDARRDFTYIDDVVRGCLGALDTAGRSTGSRSGRKRGPAPLRVYNLGNTSPVPVTRMVAILEKLLGKKAIKRVVTMPANGDVPFTHANVSHAARDFGYRPATSLEACLRHFVDWFVRYYKVDIRGGNVLAGKTAKRKSMAMSSAS

SEQ ID NO: 4163 - DNA, 1307 bp, Zea mays
  misc_feature (1)..(1307): Ceres cDNA ID no. 21705150
  misc_feature (1)..(1307): Ceres CLONE  ID no. 346928
  misc_feature (1)..(1307): Also known as  Ceres CDNA ID no. 24371660
acacgagctctgtctgtgtgaagatgaggacgcgctgcaaccagctggggctgcttctcgcgctgttgtttgccgctcttcttggcagcgcgcaatgccagagctctcacggtggtggcgccgccgccgctaacctcacggtggtgggcaccgtgttctgtgacgcctgctccaccagctccttctccaagaatagctacttcttgccaggtgtccgagtccggctggactgcatgatcaaagtgaactcgaactccaaggaggagatcaagatcacggcggagaaggtgaccaacagcgacggcgcgtaccagctggacatcccggcgatcgacggcttcgagtgcgcggcgcccggcgcgaccgccggcgagtccttctgccgggcggccgtgctggacaacccgtccgcgctgtgcggcgtgccggccgtgaccaccacggtcggccacatctctctgccgagccaggaccccagcgcctgcttctacagcctcaactcgctctactaccgccccagcaagccgggcccagctcagtgcggcggcgccgccgccggcctgtcaccgcctgcggcggcgctgaacacgtccctgttctactgcccgccgtggccgtggccgcccatcccgttctgcacgccgcggccgtggttcccgcccataccgttcttcaccccgccgccgccggcgttcccgttcccgctgccaccgctaccgttcttcaccccgccgtcgcctccgccaccggcgttccctttcccgctgccaccactgccatggacgacgccaccgtcgcctccgccgtcgccatcgttcccgtttcctcatctgccgccgatctttacaacaccatcgcctccgccaccgccaccgccgccgccacaattcccgttccctatgccaccgcttccacacctgcctcctctcccgcacttcccaccgctaccgtcactttactcaccgccacctcctccacctccaccaccgcctccgccgccgtcgttcccgtggacgtttccgccgttaccgtttttccctcctggtcctggttcttctgggccatctcctccaccgttgatcagtggttatcgtaaagatccaaccacttggtctccttccaataaacaaccatgaagtaaataatacttggctccttctgggaaggataatgtgcattgcaaaagactatgttatattttttttctgttttatatccctgagctgtatggatacgaatttaagtttctgcttgcccccgatacgtatatacataaaattcctaggttttgaacaaaaaaaaaaaaa

SEQ ID NO: 4164 - protein, 1307 aa, Zea mays
  misc_feature: PFam Name: GATase_2; PFam Description: Glutamine
  misc_feature: PFam Name: LMBR1; PFam Description: LMBR1-like membrane protein
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: GI Number: 21322711; NR Description: pherophorin-dz1 protein
  misc_feature: GI Number: 4584539; NR Description: extensin-like protein [Arabidopsis thaliana] >gi|7268037|emb|CAB78376.1| extensin-like protein [Arabidopsis thaliana] >gi|7484961|pir||T06291 extensin homolog T9E8.80 - Arabidopsis thaliana
  misc_feature: GI Number: 6523547; NR Description: hydroxyproline-rich
  misc_feature: GI Number: 791146; NR Description: extensin-like protein [Vigna unguiculata] >gi|7488885|pir||T11671 extensin-like protein
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
ACACGAGCTCTGTCTGTGTGAAGATGAGGACGCGCTGCAACCAGCTGGGGCTGCTTCTCGCGCTGTTGTTTGCCGCTCTTCTTGGCAGCGCGCAATGCCAGAGCTCTCACGGTGGTGGCGCCGCCGCCGCTAACCTCACGGTGGTGGGCACCGTGTTCTGTGACGCCTGCTCCACCAGCTCCTTCTCCAAGAATAGCTACTTCTTGCCAGGTGTCCGAGTCCGGCTGGACTGCATGATCAAAGTGAACTCGAACTCCAAGGAGGAGATCAAGATCACGGCGGAGAAGGTGACCAACAGCGACGGCGCGTACCAGCTGGACATCCCGGCGATCGACGGCTTCGAGTGCGCGGCGCCCGGCGCGACCGCCGGCGAGTCCTTCTGCCGGGCGGCCGTGCTGGACAACCCGTCCGCGCTGTGCGGCGTGCCGGCCGTGACCACCACGGTCGGCCACATCTCTCTGCCGAGCCAGGACCCCAGCGCCTGCTTCTACAGCCTCAACTCGCTCTACTACCGCCCCAGCAAGCCGGGCCCAGCTCAGTGCGGCGGCGCCGCCGCCGGCCTGTCACCGCCTGCGGCGGCGCTGAACACGTCCCTGTTCTACTGCCCGCCGTGGCCGTGGCCGCCCATCCCGTTCTGCACGCCGCGGCCGTGGTTCCCGCCCATACCGTTCTTCACCCCGCCGCCGCCGGCGTTCCCGTTCCCGCTGCCACCGCTACCGTTCTTCACCCCGCCGTCGCCTCCGCCACCGGCGTTCCCTTTCCCGCTGCCACCACTGCCATGGACGACGCCACCGTCGCCTCCGCCGTCGCCATCGTTCCCGTTTCCTCATCTGCCGCCGATCTTTACAACACCATCGCCTCCGCCACCGCCACCGCCGCCGCCACAATTCCCGTTCCCTATGCCACCGCTTCCACACCTGCCTCCTCTCCCGCACTTCCCACCGCTACCGTCACTTTACTCACCGCCACCTCCTCCACCTCCACCACCGCCTCCGCCGCCGTCGTTCCCGTGGACGTTTCCGCCGTTACCGTTTTTCCCTCCTGGTCCTGGTTCTTCTGGGCCATCTCCTCCACCGTTGATCAGTGGTTATCGTAAAGATCCAACCACTTGGTCTCCTTCCAATAAACAACCATGAAGTAAATAATACTTGGCTCCTTCTGGGAAGGATAATGTGCATTGCAAAAGACTATGTTATATTTTTTTTCTGTTTTATATCCCTGAGCTGTATGGATACGAATTTAAGTTTCTGCTTGCCCCCGATACGTATATACATAAAATTCCTAGGTTTTGAACAAAAAAAAAAAAA

SEQ ID NO: 4165 - DNA, 1283 bp, Glycine max
  misc_feature (1)..(1283): Ceres cDNA ID no. 21705154
  misc_feature (1)..(1283): Ceres CLONE  ID no. 479703
  misc_feature (1)..(1283): Also known as  Ceres CDNA ID no. 24366894
aagcaaacacacctggagaaagaagtgtggtagtcaagaatgagatgagtgaaaaccagttggcagctaaggttatgcaacttcgtttgaagggaaagcatgaagaagctgacaaactgatgcaagaagcaaaagttatgaacacaaagcaaggaaatcaagatcattcaattagatcaggaactgagggaagttctagcaggtatgctatgcagaagatatcttctgagcagaagaaaggagaggatgatggtgatatgcatcttgctcacaagatcatgcagaacaagcagtttagggcttctactcaggctgatgatgaatatgactttgaggatggtccaagcagaaagagtagaaagaagcaaggaggtgatgatcacaagagtatccaaaagaagacaaatcgattcttgactcagcaagagcgctgcctattttgtttagaaaatccaaatcggcctatgcatcttgttgtttcaatcgcaaatttcacatatcttatgttgccaaagtggcagcctgtggtgcctggtcattgctgcattttacctattcagcatgaatcagctacaagaactgtagacgataatgtctggacagaaattcgaaacttcaagaagtgcctaattatgatgtttgctaagcaagagaaggaggtggtgtttcttgagactgtgatgggattggcacagcaacgaaggcattgtatggttgagtgcattcccttacccgaagatattgccaaagaggctcctttgtactttaaaaaggcgattgatgaagctgaagatgagtggagccagcacaatgcaaagaaacttattgatacaagtcaaaagggactgcgcaattcaatacctaagcactttccatattttcacgttgaatttggtctaaacaagggttttgtccatgttattgatgatgaaaagcagtttaacatcagccttggcttgaatgtcataagaggcatgctacatttggcagaggaggacatgtacaggcgacggcgctacgaggctgtggaggtacaaaagcaagcagttgaaagcttttccaaagagtggaaacattttgactggacaaaacagcttcatgaaacttaataacaaacattttacagattaggtcattttttatttaagaattaagttaatatacattaatatttgctcatgtgccgtgaaatgctgtaactttactgatagaaacgaattttgtactgaacacccccttttataataaaagtgaaataatgtttcaaaaaaaaaaaaaaaaaa

SEQ ID NO: 4166 - protein, 1283 aa, Glycine max
  misc_feature: PFam Name: CwfJ_C_1; PFam Description: Protein similar to
  misc_feature: PFam Name: CwfJ_C_2; PFam Description: Protein similar to
  misc_feature: GI Number: 33990033; NR Description: CWF19L2 protein [Homo sapiens]
  misc_feature: GI Number: 28175585; NR Description: Cwf19l2 protein [Mus musculus]
  misc_feature: GI Number: 28829365; NR Description: similar to Arabidopsis thaliana (Mouse-ear cress). Hypothetical 79.2 kDa protein
  misc_feature: GI Number: 17551838; NR Description: protein similar to CwfJ, N-terminal 1 and Protein similar to CwfJ, N-terminal 2 (3I397)
  misc_feature: GI Number: 66849281; NR Description: cell cycle control
AAGCAAACACACCTGGAGAAAGAAGTGTGGTAGTCAAGAATGAGATGAGTGAAAACCAGTTGGCAGCTAAGGTTATGCAACTTCGTTTGAAGGGAAAGCATGAAGAAGCTGACAAACTGATGCAAGAAGCAAAAGTTATGAACACAAAGCAAGGAAATCAAGATCATTCAATTAGATCAGGAACTGAGGGAAGTTCTAGCAGGTATGCTATGCAGAAGATATCTTCTGAGCAGAAGAAAGGAGAGGATGATGGTGATATGCATCTTGCTCACAAGATCATGCAGAACAAGCAGTTTAGGGCTTCTACTCAGGCTGATGATGAATATGACTTTGAGGATGGTCCAAGCAGAAAGAGTAGAAAGAAGCAAGGAGGTGATGATCACAAGAGTATCCAAAAGAAGACAAATCGATTCTTGACTCAGCAAGAGCGCTGCCTATTTTGTTTAGAAAATCCAAATCGGCCTATGCATCTTGTTGTTTCAATCGCAAATTTCACATATCTTATGTTGCCAAAGTGGCAGCCTGTGGTGCCTGGTCATTGCTGCATTTTACCTATTCAGCATGAATCAGCTACAAGAACTGTAGACGATAATGTCTGGACAGAAATTCGAAACTTCAAGAAGTGCCTAATTATGATGTTTGCTAAGCAAGAGAAGGAGGTGGTGTTTCTTGAGACTGTGATGGGATTGGCACAGCAACGAAGGCATTGTATGGTTGAGTGCATTCCCTTACCCGAAGATATTGCCAAAGAGGCTCCTTTGTACTTTAAAAAGGCGATTGATGAAGCTGAAGATGAGTGGAGCCAGCACAATGCAAAGAAACTTATTGATACAAGTCAAAAGGGACTGCGCAATTCAATACCTAAGCACTTTCCATATTTTCACGTTGAATTTGGTCTAAACAAGGGTTTTGTCCATGTTATTGATGATGAAAAGCAGTTTAACATCAGCCTTGGCTTGAATGTCATAAGAGGCATGCTACATTTGGCAGAGGAGGACATGTACAGGCGACGGCGCTACGAGGCTGTGGAGGTACAAAAGCAAGCAGTTGAAAGCTTTTCCAAAGAGTGGAAACATTTTGACTGGACAAAACAGCTTCATGAAACTTAATAACAAACATTTTACAGATTAGGTCATTTTTTATTTAAGAATTAAGTTAATATACATTAATATTTGCTCATGTGCCGTGAAATGCTGTAACTTTACTGATAGAAACGAATTTTGTACTGAACACCCCCTTTTATAATAAAAGTGAAATAATGTTTCAAAAAAAAAAAAAAAAAA

SEQ ID NO: 4167 - DNA, 1608 bp, Zea mays
  misc_feature (1)..(1608): Ceres cDNA ID no. 21705155
  misc_feature (1)..(1608): Ceres CLONE  ID no. 505788
  misc_feature (1)..(1608): Also known as  Ceres CDNA ID no. 24371792
gacatgctctctctctctctctctgtccccattcattagaaacgtacaccacgcagtccactagtccaccggcatgtcgtcgcagccgccgcacgtcctcctggtgtcgttcccgctccagggccacgtgaacccgctgctccgcctgggcgcccgcctcgccgccaagggcctcctcgtcaccttcacgacgttccgccacgccggcatccgagccttgcgcgaggacggcgcgtgcgtcgccgccgccgggcgcggccgccttcggttcgactacctccgcgacgacggctgcgggccacgctctccggtcccgggcgacccgagcgacatgctgcgccacgtcgcggacgcgggcccctcggcgctggccggcctcctccggcgccaggccgacgccgggcgccccgtggcgtgcgtcgtcaacaaccccttcgtgccgtgggcgctcgacgtggccggggccgcgggcatcccgtgcgccacgctgtggatccagtcctgcgccgtgctctcgctctactaccacttctaccgctgccccgagggcttcccgaccgaggccgacaccgccgcgccggtcgcggtagtgccgggcctgccgacgctggccgcggacgagctgccgctcatggtccgccccgagcacgcggggaacctgtggggccagacgctacgggcgcagctcgcggggttcaggaaaaataacacggtggcctgggtgctggtcaacaccttcgaggggctcgagcgccccgtcgtcgaggcgctccgctcccacgcgccggtgacgcccgttggcccgctcctggaccacgaccacgaccacgacggcggcggcgacgacggctgcatggcgtggctcgacgcgcagcctcccgggtccgtggtgtacgtggcgttcggcagcctcgtgaccgtcggctgcggcgagatgctggcgctggcggagggcctggccgccaccggcaggcctttcctgtgggtggtgcgcgacgacagccgccggctcctccccgacggcgcgctcgcggcgtgcggcggcaggggcagggtggtggcgtggtgcccgcaggggcgcgtgctccggcacggcgccgtcggctgcttcgtcacgcactgcggctggaactccgtcgccgaggctctcgccgccggcgtgcccatggtcgggtacccgtggtggtccgaccagttcaccaacgccaagctgctggcggaggagtacggggtcggcgtccggctgcccgcgccggcgacgcgggacgccgtccgcgcgtgcgtccacgaggtgatgggcgggccacgggcggcggtgttccggatggcggctaaggcgtggaaagacgaggcggcagcagctgttgccgatggcgggtcctccgaccggaacctccatgcctttgtccaagagatacgacggtttcatgaaacaagagctggaggtagcatgatcaactccaacatttgaattcgatcgatattcgttgagatgttcgaaagctttatttactggtcaatgttaaacagacttgtgaaaaggattgttcaataagaatctttccgaactaagaataagaatgatcttatacaaaaaaaaaaaaaaaa

SEQ ID NO: 4168 - protein, 465 aa, Zea mays
  misc_feature: PFam Name: UDPGT; PFam Description: UDP-glucoronosyl and
  misc_feature: PFam Name: Peptidase_S8; PFam Description: Subtilase family
  misc_feature: GI Number: 50905805; NR Description: putative Limonoid UDP-glucosyltransferase [Oryza sativa (japonica cultivar-group)] >gi|46389901|dbj|BAD15522.1| putative Limonoid
  misc_feature: GI Number: 34911272; NR Description: limonoid UDP-glucosyltransferase-like protein [Oryza sativa (japonica cultivar-group)] >gi|18844877|dbj|BAB85346.1| LGT_CITUN LIMONOID UDP-GLUCOSYLTRANSFERASE [Oryza sativa (japonica cultivar-group)]
  misc_feature: GI Number: 34911270; NR Description: limonoid UDP-glucosyltransferase-like protein [Oryza sativa (japonica cultivar-group)] >gi|18844876|dbj|BAB85345.1| LGT_CITUN LIMONOID
  misc_feature: GI Number: 56784995; NR Description: glucosyltransferase NTGT2-like [Oryza sativa (japonica cultivar-group)] gi|56784439|dbj|BAD82532.1| glucosyltransferase NTGT2-like [Oryza
  misc_feature: GI Number: 25082972; NR Description: indole-3-acetate
MSSQPPHVLLVSFPLQGHVNPLLRLGARLAAKGLLVTFTTFRHAGIRALREDGACVAAAGRGRLRFDYLRDDGCGPRSPVPGDPSDMLRHVADAGPSALAGLLRRQADAGRPVACVVNNPFVPWALDVAGAAGIPCATLWIQSCAVLSLYYHFYRCPEGFPTEADTAAPVAVVPGLPTLAADELPLMVRPEHAGNLWGQTLRAQLAGFRKNNTVAWVLVNTFEGLERPVVEALRSHAPVTPVGPLLDHDHDHDGGGDDGCMAWLDAQPPGSVVYVAFGSLVTVGCGEMLALAEGLAATGRPFLWVVRDDSRRLLPDGALAACGGRGRVVAWCPQGRVLRHGAVGCFVTHCGWNSVAEALAAGVPMVGYPWWSDQFTNAKLLAEEYGVGVRLPAPATRDAVRACVHEVMGGPRAAVFRMAAKAWKDEAAAAVADGGSSDRNLHAFVQEIRRFHETRAGGSMINSNI

SEQ ID NO: 4169 - DNA, 1750 bp, Glycine max
  misc_feature (1)..(1750): Ceres cDNA ID no. 21705156
  misc_feature (1)..(1750): Ceres CLONE  ID no. 510987
  misc_feature (1)..(1750): Also known as  Ceres CDNA ID no. 24366559
gactcctgtctcttcaatcgtttgagtttgagtttgaatttgatttggacgaggttggaggtttgcaatttccttcggttgtgacctgtgaatccgattgtattctgaattagggtttaagctttacacacagagatgggtagcccctcgaagaagaacgaaagtaaggggtttttcgccgccgtgtcttccatgttcaccagcgctgtcaaccgatcggtcaacgggcttagtgtagaagtcataaatccagagggaggtaaagaagattcggaggaggaagctcagagaggaagatggaaacaggaggaaagagatggttactggaagatgatgcagaagtatattggctcggatgtaacatcaatggtgacactaccagttattatatttgaaccaatgactatgattcagaaaattgctgagttgatggagtactcctacttgttagatcaagcagatgaatcagaggatccatacatgcagttagtttatgcaacatcatgggccatatcggtgtactttgcgtaccaacgaacctggaagccttttaatcctatccttggagagacttatgaaatggttaaccatggtggaattacatttcttgctgaacaggtgagtcatcatcccccaatgagtgctgcgcatgccgagaatgagcattttacatatgatgtgacttcaaagttgaaaactaagtttttgggaaattctgttgatgtttaccctgttggaagaactcgtgtgacccttaagagagatggtgttgtcttagatttggtgccacctcctacaaaggttaacaacctcatatttggccgaacttggattgattcacctggggaaatgataatgacaaatttgacaactggagacaaagctgtactatattttcaaccatgtggatggtttggtgctggtcgatatgaagtggatggatatatttataattcttccgaggagcctaaaatattaatgacagggaagtggaatgagtcaatgagttatcagccctgtgattcagaaggagagcctcttccaaacacagaattgaaagaggtttggcatgttgctgatgttccccagaatgacaaatttcagtatacacattttgctcataaaataaacagctttgacactgcccctaaaaagttgttggcgtcagattctcgtctacgcccagatagatatgcactcgagatgggcgatctgtcaaaatctggggcagaaaagagcagtttggaggagaggcagcgtgctgaaaagagaagccgagaggagaaagggcatagcttcacaccaagatggtttgatttaactgaagaagtgacaccaactccttggggtgatttggaaatctatcaatataatggtaaatacactgaacatcgggctgctgcagataactcgggaagcattgatgatgttgatgttaaatcaattgaatttaatccatggcagtatggtaatttggtcacggaatgaactagtttcaatttgcttttggtttttggatgctacagctagttcatgtaacttttttattgatacatagaataaatcttttttttgtgtgtggttttgtttgcttgtgtacgttgtaatatctgcagttctctttctgcctaggttagtattttgattccatcacgcagaatgttcttttgttttgaatggatggaaaacgtaagagttaccttgaacttgtatatatccgttgctgtcttgcaaaaaaaaaaaaaaaaaa

SEQ ID NO: 4170 - protein, 450 aa, Glycine max
  misc_feature: PFam Name: Oxysterol_BP; PFam Description: Oxysterol-binding
  misc_feature: GI Number: 8885548; NR Description: oxysterol-binding protein
  misc_feature: GI Number: 23197814; NR Description: oxysterol-binding protein [Arabidopsis thaliana] >gi|15450786|gb|AAK96664.1| oxysterol-binding protein [Arabidopsis thaliana] >gi|15238398|ref|NP_200750.1| oxysterol-binding family protein
  misc_feature: GI Number: 38639323; NR Description: oxysterol-binding
  misc_feature: GI Number: 6478922; NR Description: putative oxysterol-binding protein [Arabidopsis thaliana] >gi|20260050|gb|AAM13372.1| putative oxysterol-binding protein [Arabidopsis thaliana] >gi|17065254|gb|AAL32781.1| putative
  misc_feature: GI Number: 38639321; NR Description: putative
MGSPSKKNESKGFFAAVSSMFTSAVNRSVNGLSVEVINPEGGKEDSEEEAQRGRWKQEERDGYWKMMQKYIGSDVTSMVTLPVIIFEPMTMIQKIAELMEYSYLLDQADESEDPYMQLVYATSWAISVYFAYQRTWKPFNPILGETYEMVNHGGITFLAEQVSHHPPMSAAHAENEHFTYDVTSKLKTKFLGNSVDVYPVGRTRVTLKRDGVVLDLVPPPTKVNNLIFGRTWIDSPGEMIMTNLTTGDKAVLYFQPCGWFGAGRYEVDGYIYNSSEEPKILMTGKWNESMSYQPCDSEGEPLPNTELKEVWHVADVPQNDKFQYTHFAHKINSFDTAPKKLLASDSRLRPDRYALEMGDLSKSGAEKSSLEERQRAEKRSREEKGHSFTPRWFDLTEEVTPTPWGDLEIYQYNGKYTEHRAAADNSGSIDDVDVKSIEFNPWQYGNLVTE

SEQ ID NO: 4171 - DNA, 1876 bp, Glycine max
  misc_feature (1)..(1876): Ceres cDNA ID no. 21705157
  misc_feature (1)..(1876): Ceres CLONE  ID no. 517408
  misc_feature (1)..(1876): Also known as  Ceres CDNA ID no. 25088216
tttttttttgcgcttgataacaatgaaccaatgattcctgcatgtgccacatttgatgaaatccttgcaaccatgggacagttaaagaaacatttgtcccaattcccatattcccaatatcttggcttctgggactaccagtcccagaatttcagaatctgtgtgtccctgactattttttcaatcttatatagattgatttactgagttgtagttcggaatattgaatgtttcaatttctcatgagacaaaaatttctctacatatcttgtttgatctcttttccactgctttgtttgatcattgattatccttctatctaaattctttgtatatgtttcccatgattttctgccacttattctgtaactggcgtattcatgagaataattgaatgttgtgctgttttcagggactgtaccgtgaacatcaatgaatttagggatgggcaaagacatgatatgtggctgtcacttaagaacatgaaaatggggaggttgcgtttggcaataactattcttgaagataatggaaagggagttgatactactacacgtgaccaggaaacaatggactttgaagaacgaaaaatctcctttgaagcaaatgagactactgataatagttccttctcacctgttccacctgaaaaatctgagaagttggcagataactatgagcctatagacatcgacgggcaaaaagagacaggagtttgggttcatcacccaggaagtgaagtttcccaaaggtgggagcctaggaaagggaagagtcggcgccttgatacagaaattcatggggagcctaatgattcagttggcagtggtaattcaactgtatcaggatccttgaacaatgacagcagcagtcctgataataatcctgaagaaaagcatcgaatgagaacggttaggaagggccttcacaagattggttcagtattccaccggagtaaaagaagggagggtttttcaggttctgttgatgaggagattctgtctccacatgataacattaggtcagagaatgctaaggggatgattgctgtgaagtttgtcatggacgagaacatttccggctttcaaactggtaaggttcaggcagaagggggatcaacagaagggagtggtcctgagagccctgccagtgccaagggaaatgtgaaggatatggcgaagaatatttttaaacatgcagaaaaatcggctcgtggcttgaggcacgttctttcttgtaaatcaaggaaattgaaatttaaaggtgagtctccaacagttccagaaagagaacatgaatctgactcttctgacgaggaatctattgcagctcaatctcccatagatgtaataagaactccagttggttctcatgctgtggtctcaggtagcaatggttcccctggttctggggtgaacgtggttcaaatagttccatcaaacactaatttggacaatgaagccacagctaaaatcacgaatgaaaaagatgaccctgaaaatgcatgctcccctgacaggtctagccaagaagttgttaaatctgctgaagtggagcatgataaagaggaaatgggggcacagataaaagagattctatcggtttgtcctactgaagaaagtttcaagtagcatatagcatattttctccagcatttcatacccgtgttcttatatacagtcttccaagtgagtgtttctacagtacttggcagattttgattgtagtaatagtcctgtgatcgtcatagaccgttttacataaacatgttcatgtttcaggtgctgtagtttgtaagcatgtaaataactttatacaaggaataaaaaagaaaaggttttcaaaaaaaaaaaaaaagaaaaaaaaaaaaaaaaaa

SEQ ID NO: 4172 - protein, 416 aa, Glycine max
  misc_feature: GI Number: 42564167; NR Description: C2 domain-containing
  misc_feature: GI Number: 18404532; NR Description: C2 domain-containing
  misc_feature: GI Number: 8671868; NR Description: Contains similarity to protein kinase C from Aplysia californica gb|M94883 and contains a C2 PF|00168 domain. ESTs gb|AI992807, gb|T20499 come from this
  misc_feature: GI Number: 50907471; NR Description: C2 domain-containing protein-like [Oryza sativa (japonica cultivar-group)] >gi|46391036|dbj|BAD15979.1| C2 domain-containing protein-like
  misc_feature: GI Number: 34904532; NR Description: B1066G12.11 [Oryza sativa (japonica cultivar-group)] >gi|20160485|dbj|BAB89437.1|
MRIIECCAVFRDCTVNINEFRDGQRHDMWLSLKNMKMGRLRLAITILEDNGKGVDTTTRDQETMDFEERKISFEANETTDNSSFSPVPPEKSEKLADNYEPIDIDGQKETGVWVHHPGSEVSQRWEPRKGKSRRLDTEIHGEPNDSVGSGNSTVSGSLNNDSSSPDNNPEEKHRMRTVRKGLHKIGSVFHRSKRREGFSGSVDEEILSPHDNIRSENAKGMIAVKFVMDENISGFQTGKVQAEGGSTEGSGPESPASAKGNVKDMAKNIFKHAEKSARGLRHVLSCKSRKLKFKGESPTVPEREHESDSSDEESIAAQSPIDVIRTPVGSHAVVSGSNGSPGSGVNVVQIVPSNTNLDNEATAKITNEKDDPENACSPDRSSQEVVKSAEVEHDKEEMGAQIKEILSVCPTEESFK

SEQ ID NO: 4173 - DNA, 1240 bp, Glycine max
  misc_feature (1)..(1240): Ceres cDNA ID no. 21705160
  misc_feature (1)..(1240): Ceres CLONE  ID no. 524302
  misc_feature (1)..(1240): Also known as  Ceres CDNA ID no. 0
aaggttgtgtttgcttacgttgcgaagcctgttgtgtcactattgaaacttgaatcccctcttcaacgccgtggtgagagtctcagtcgccgctatgttccgcagaatcttgtcccatcatcgcacactctcagcctgcgcccacaatgcaacaacacgctctcaggccactcgccgccacgcccccaatgtccctccacccccttccttcctaatcccacgatcaaggcccctttcttccaaaacatcccaatccaacgaagccgctgaaagctccaataaggccaaaaaggacgtggcaaacgttgaagatccctttagtgcccctacctataacattccggagaagcctgtgacgtttgtggagggagcgtcctacagtgttgtcattcttgcgggactcggaatcgctgctgctgccggatatgctgttttcaaagagcttatttttcaacctaaggagtacaagatctataacaaggctctcaaaagaattcaggatgatggtcaggtacgggtgaggattggatttccaattactggttatggtcaggagagtagaaaccgagctgctcgccaaagaattcctcacagggtatggactgatgaggaaggtgttgagcatgtggaggttaatttttatatccggggcccccatgggcatggaaaagtatttgcggaaatgttcaaaggcactgacaacgaatggaagtttacttacttgattgttgagattagagcaccatctactgcacaaataattctggagtcatacattccatcttacagtccaaccaagtagcctagatgatataagctatcagcattgaccaccttagccagtccatgtttcatgagggatgaaagttgaaagaaggaaagacaattaaagaaagtcaaataatgtgaaaaacaggatcgcaagtctcaggttcagtatttttgtttttttgtttttccatttagaacctgcggatttggggaaaatttttgggcgaggatcttagtaacgatgaccggagcaatttactttgtccttgacagctattgagaaatccgtataccaatttgttgttattgctgacaattcaacttggcttggtttgtgaaagtacattgagtagctggttgtagaatgcaaatttttaaggatgaatataaggggattgtagccaaaaaccaaaattgatatggatcatataagatcgatattcgattgttagaaaaaaaaaaaaaaaaa

SEQ ID NO: 4174 - protein, 235 aa, Glycine max
MFRRILSHHRTLSACAHNATTRSQATRRHAPNVPPPPSFLIPRSRPLSSKTSQSNEAAESSNKAKKDVANVEDPFSAPTYNIPEKPVTFVEGASYSVVILAGLGIAAAAGYAVFKELIFQPKEYKIYNKALKRIQDDGQVRVRIGFPITGYGQESRNRAARQRIPHRVWTDEEGVEHVEVNFYIRGPHGHGKVFAEMFKGTDNEWKFTYLIVEIRAPSTAQIILESYIPSYSPTK

SEQ ID NO: 4175 - DNA, 1949 bp, Glycine max
  misc_feature (1)..(1949): Ceres cDNA ID no. 21705161
  misc_feature (1)..(1949): Ceres CLONE  ID no. 525034
  misc_feature (1)..(1949): Also known as  Ceres CDNA ID no. 25088224
gagaaacacattcttcgaaggaatttgtcaaagagtagccatgccccaacgatcccgtttcccttcacttctctacgcaaagccccttgttttgcatagagctacttaaaatgtcggagggaaatgcggagagaggaaagagaattgccattattggtgtctcaaccttattgttggtggcgatggttgtggctgtcacagttggtgtcaatgttagtgagaatggttccaacaatgaggacacaaaaattgcttcttctgtaaaagccgtccaaaccctttgccatcccacaaattataagaaagaatgtgaggaaagcctcatagccagggctggaaataccactgatccaaaagaacttatcaaaattgtcttcaacatcaccattacaaaaattggcgataaactcaaaaaaactaatcttttgcatgaggttgaggaggatcccagagccaagatggcacttgacacatgcaagcaactcatggatctttctattgaggagttaacaaggtcacttgatggaataggtgagtttgacctgaaaaatatcgacaaaatcctcatgaatttaaaagtttggcttagtggtgcagttacataccaagatacttgcttggatgggtttgagaacaccactagtgacgctggtaaaaagatgaaggatttgttgacggcaggcatgcatatgagcagcaatgcccttgccattgtaacgaatttggctgacactgttgatgattggaatgtcacagaattatctaggcgtcgcctccttcaagattctaagcttcccgtgtgggttgatcaacatagactccttaatgaaaatgaaagtctattaagacacaagcctaatgttactgtagccattgatggtagtggggatttcgaaagcatcaatgaggcattgaagcaagtgcctaaggaaaaccgaaagccatttgtgatctacatcaaggaaggcgtttaccaagagtatgttgaggttacaaagaaaatgacccatgtggtgtttattggtgaaggtggaaaaaagacacgaataactggtaacaaaaacttcatagatggaacaaacacttacagaactgccactgttgctattcaaggagattactttgtggccatcaatatggggtttgagaattctgctggaccacaaaagcatcaagcagtagcattaagagtccaagcagataagtccattttctacaattgctcaatggatgggtatcaggacactctttatgtacacaccatgcgtcaattctatagagattgcacgatttcaggtaccattgactttgtgtttggtaatgcacttgctattttccaaaattgcactttcgtggtccgaaagccattggagaaccaacaatgcattgtgactgcacaaggtagaaaagagatacaacaaccatctggaatagtaatccaagggggatccattgtgtctgatcctgagttctactctgtgagatttgagaacaaggcttacctagctcgtccatggaagaattactctaggaccatcatcatggacacttacattgatgatttgattaatgttgatgggtatttgccatggcaaggactagagggtccttctggtatgaatacttgcttctatgccgagtaccacgacagtggcccgggttcagacaaatctaaacgtgtgaaatgggctgggatttggaatctcaattcaaaagctgcacgttggttctcagcatctaagttttttcacggaactgactggattgaagttactgggattccttgctttcgtgacattcccgcacaccataggcacaaaaagacaaggcttaattggtaataaaagtgatgagttgtgaaagcaagaaatataaattaattaataaggaatgattgagcttctttattctttaattattttgatttcattaaaaaaaaaaaaaaaaaa

SEQ ID NO: 4176 - protein, 576 aa, Glycine max
  misc_feature: PFam Name: Pectinesterase; PFam Description: Pectinesterase
  misc_feature: PFam Name: PMEI; PFam Description: Plant invertase/pectin
  misc_feature: GI Number: 29029008; NR Description: At3g05610 [Arabidopsis thaliana] >gi|26451784|dbj|BAC42986.1| putative pectinesterase
  misc_feature: GI Number: 21594190; NR Description: pectin methylesterase [Arabidopsis thaliana] >gi|10177147|dbj|BAB10336.1| pectin methylesterase [Arabidopsis thaliana] >gi|18700151|gb|AAL77687.1| AT5g49180/K21P3_5 [Arabidopsis thaliana]
  misc_feature: GI Number: 15241079; NR Description: pectinesterase family
  misc_feature: GI Number: 6714449; NR Description: putative pectinesterase [Arabidopsis thaliana] >gi|15230019|ref|NP_187212.1| pectinesterase
  misc_feature: GI Number: 7549630; NR Description: pectin methylesterase,
MSEGNAERGKRIAIIGVSTLLLVAMVVAVTVGVNVSENGSNNEDTKIASSVKAVQTLCHPTNYKKECEESLIARAGNTTDPKELIKIVFNITITKIGDKLKKTNLLHEVEEDPRAKMALDTCKQLMDLSIEELTRSLDGIGEFDLKNIDKILMNLKVWLSGAVTYQDTCLDGFENTTSDAGKKMKDLLTAGMHMSSNALAIVTNLADTVDDWNVTELSRRRLLQDSKLPVWVDQHRLLNENESLLRHKPNVTVAIDGSGDFESINEALKQVPKENRKPFVIYIKEGVYQEYVEVTKKMTHVVFIGEGGKKTRITGNKNFIDGTNTYRTATVAIQGDYFVAINMGFENSAGPQKHQAVALRVQADKSIFYNCSMDGYQDTLYVHTMRQFYRDCTISGTIDFVFGNALAIFQNCTFVVRKPLENQQCIVTAQGRKEIQQPSGIVIQGGSIVSDPEFYSVRFENKAYLARPWKNYSRTIIMDTYIDDLINVDGYLPWQGLEGPSGMNTCFYAEYHDSGPGSDKSKRVKWAGIWNLNSKAARWFSASKFFHGTDWIEVTGIPCFRDIPAHHRHKKTRLNW

SEQ ID NO: 4177 - DNA, 999 bp, Glycine max
  misc_feature (1)..(999): Ceres cDNA ID no. 21705162
  misc_feature (1)..(999): Ceres CLONE  ID no. 527665
  misc_feature (1)..(999): Also known as  Ceres CDNA ID no. 24367220
gattcgtcagttcattgacttgcccacagtgagaatgaagatgttgcgaacgacaatactgcaattcgctgcgttgcaggttttgtttattctgttgggtgttggtgccgattacataccgccttcgagatttgatggcttcgtctacgggaaggggaacttgaatttgttggatacggttttgatagaagcgttttatgacccagtgtgcccagatagcagggattcctggcctccactcaaacaagctcttcatcactacgcttctcgggtttcgctccttcttcacctcctccctctaccttaccatgacaatgcttttgttacgtctcgtgctctgcacattgtgaacaatttgaacgcatctgcaacgttccccttgctggagtggttcttcaggtatcaggagaatttctatggggctcaaacacggaacttatctagggcttctattatagaggaagtagtgaagtctgcaacacaagtagttgggagctcttattataaaaccataaagaatggcttcaatgacacaacaactgatattcagaccagagtttcttttaagtatgctgcttcgagaggggtgtatggaacgccatttttctatgtcaatggattcttgttgcctgatactggagctgctgttgactacaagacttggagaaaggtcattgacccattggttggtgctaagaataagaagagtatccaaaatgaagagtcccttcatttcttcttgtgaaaattgtcggtatataaataaagtccagttgcattagcactgtatcagtgaaggaatctgaagaatgtatccgctgactaataatggaatcaaatgttataaaacattccttagtccatacatatacatatgtggcatgtattggaatatatgatacactgggcaatgatgatgtgatattccttggcctatgtttgaattttatgaaaggtgatagaatgaatattaaaaataaaaaaaaaaaaaaaaaaaaa

SEQ ID NO: 4178 - protein, 999 aa, Glycine max
  misc_feature: PFam Name: DSBA; PFam Description: DSBA-like thioredoxin domain
  misc_feature: GI Number: 8778978; NR Description: Contains similarity to pigpen protein from Mus musculus gb|AF224264 and contains protein of unknown function DUF78 PF|01918 domain. ESTs gb|N38077, gb|BE037702, gb|AV442191, gb|AV441368, T20H2.2 protein -
  misc_feature: GI Number: 8778813; NR Description: T4O12.23 [Arabidopsis thaliana]
GATTCGTCAGTTCATTGACTTGCCCACAGTGAGAATGAAGATGTTGCGAACGACAATACTGCAATTCGCTGCGTTGCAGGTTTTGTTTATTCTGTTGGGTGTTGGTGCCGATTACATACCGCCTTCGAGATTTGATGGCTTCGTCTACGGGAAGGGGAACTTGAATTTGTTGGATACGGTTTTGATAGAAGCGTTTTATGACCCAGTGTGCCCAGATAGCAGGGATTCCTGGCCTCCACTCAAACAAGCTCTTCATCACTACGCTTCTCGGGTTTCGCTCCTTCTTCACCTCCTCCCTCTACCTTACCATGACAATGCTTTTGTTACGTCTCGTGCTCTGCACATTGTGAACAATTTGAACGCATCTGCAACGTTCCCCTTGCTGGAGTGGTTCTTCAGGTATCAGGAGAATTTCTATGGGGCTCAAACACGGAACTTATCTAGGGCTTCTATTATAGAGGAAGTAGTGAAGTCTGCAACACAAGTAGTTGGGAGCTCTTATTATAAAACCATAAAGAATGGCTTCAATGACACAACAACTGATATTCAGACCAGAGTTTCTTTTAAGTATGCTGCTTCGAGAGGGGTGTATGGAACGCCATTTTTCTATGTCAATGGATTCTTGTTGCCTGATACTGGAGCTGCTGTTGACTACAAGACTTGGAGAAAGGTCATTGACCCATTGGTTGGTGCTAAGAATAAGAAGAGTATCCAAAATGAAGAGTCCCTTCATTTCTTCTTGTGAAAATTGTCGGTATATAAATAAAGTCCAGTTGCATTAGCACTGTATCAGTGAAGGAATCTGAAGAATGTATCCGCTGACTAATAATGGAATCAAATGTTATAAAACATTCCTTAGTCCATACATATACATATGTGGCATGTATTGGAATATATGATACACTGGGCAATGATGATGTGATATTCCTTGGCCTATGTTTGAATTTTATGAAAGGTGATAGAATGAATATTAAAAATAAAAAAAAAAAAAAAAAAAAA

SEQ ID NO: 4179 - DNA, 1604 bp, Glycine max
  misc_feature (1)..(1604): Ceres cDNA ID no. 21705163
  misc_feature (1)..(1604): Ceres CLONE  ID no. 530863
  misc_feature (1)..(1604): Also known as  Ceres CDNA ID no. 24727124
ggaagccaattgccaaacaaaaactcagaaaacacagggaaagaaagagttgagtgatggcggcttgtctgcaactgtggcaatgcaaactagcgagaccctttgactcattaccggtgcgaaggtcaattcctttgagtctgaggtgttcggccgcgccctcttcttccaagccgacgcgctcctacagcatcactctcatccccggcgacggcatcggccccgaaatcatctcggtggccaaagacgttcttgtcctcgccggttatctcgaagggattaaatacgacttccgcgagatgcttatgggtggagctgcattggatgccacgggactccctttaccccatgaaaccctttctgccgctaagcaatctcatgccgttctccttggtgccgtcggaggttataaatgggataggaacgacaaacatctcaagcctgagactggcttgcttcagatacgtaaagagcttggagtatttgcaaatcttagaccggctaccgtatactctccgttagttgatgcttctactttgaagagagaggttgctgaaggggttgatatcatgcttataagagaactcactggaggtatctattttggagaacccaggggctttggcaccaatgataatggtgaagagattggctttaatactgagatttatgctacacatgagatagatcgcatagctcattttgcatttaaggttgctcaaaagcgtcgtcggaaactttgctctgttgacaaagccaatgtactagaggcatcaatgttatggaggaagagatttttggcaatagcacaagaatatcctgatgttgagctctcacacatgtatgttgataatgcctcaatgcaactaatccgcgatccaaaacagtttgacaccatggtgacaaacaacatttttggcgatatattatcagatgaggcttcaatggtcactggaagtattgggatgcttccttctgctagcctgggggcttcgggacctggactttttgaacccatacatggttctgcacctgatattgctggacaggacaaggcaaatccatttgccactgttcttagtgctgctatgcttttgagatatggcctaggagaagaaaaggcagctgaaagaatagagaatgcagtgatggacactttgaacaggggatttcgaactggtgacatatattctgctggaacgaagctggtaggatgcaaacagctaggtgaggagatactgaagtcagttgaatctaacgttcctgctggtgctgctgcagtgtgattttgaaaccaactcgccatagcattttgggttctggtttaggttggaggccactatgactgccaaagccgagaaagtctccctagtctattaagttctggcttccttctgtatcatgtatttcggttaacacacccagcctatgtatgattgaattttagaaagtagcaaggttgtttatcttgtattcttgtacccgggattctagtttcccttgcatgcgaggtcgcttgtaatggtggaataatgattaatggagtttgtcttgttaaaaataaaaaaaaaagatttatcaggttcaaaaaaaaaaaaaaaaaa

SEQ ID NO: 4180 - protein, 409 aa, Glycine max
  misc_feature: PFam Name: Iso_dh; PFam Description:
  misc_feature: GI Number: 17827; NR Description: 3-isopropylmalate dehydrogenase [Brassica napus] >gi|81676|pir||S20510 3-isopropylmalate dehydrogenase (EC 1.1.1.85) precursor - rape
  misc_feature: GI Number: 15221631; NR Description: 3-isopropylmalate
  misc_feature: GI Number: 21592944; NR Description: 3-methyladenine DNA
  misc_feature: GI Number: 18377879; NR Description: AT5g14200/MUA22_20
  misc_feature: GI Number: 53749178; NR Description: At5g14200 [Arabidopsis thaliana] >gi|9757801|dbj|BAB08299.1| 3-isopropylmalate dehydrogenase [Arabidopsis thaliana] >gi|21759264|sp|Q9FMT1|LE33_ARATH 3-isopropylmalate dehydrogenase
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 4181 - DNA, 2255 bp, Glycine max
  misc_feature (1)..(2255): Ceres cDNA ID no. 21705167
  misc_feature (1)..(2255): Ceres CLONE  ID no. 533302
  misc_feature (1)..(2255): Also known as  Ceres CDNA ID no. 24367386
aggttttgcgggcaccatagttgtctcttcaccccaagctgctgaactgttcctcaagacccatgaccttgtctttgctagtaggccacctcttgaggctgaaaaacacatctcttgggggcagaggggaacttaggctttgctgaatatggttcttattggagcaacatgcggaagatcgatccaaaattagtttgcatgtttattgtaagtggccagactcagggctttttagtaatcgatttgggctgaggccgtatgcgtaaattcaatctgtgctatctctctcactgttggttcccatgtctagtctatcttcttgctcttcttctccttcatttgcagcaagttacggcactattacccatccacgcgcggccccactgagtcgaatttcatgcggtggtccgagaccccctaagagcaagaaaagcaacctcaattcagaagcgcaagagcttgttcgcttactcacgagcaagataagaagcaacgacaaagaggttctgctgaagaccttgaacaagtatgtgaagcaggtccgaacccaacattgcttcttgctcttcgaagaactcggcaagcacgacaactggctccaatgccttgaggttttcagatggatgcaaaaacaacgatggtatattgctgataatgggatttactcaaaactgatatccgttatgggaaagaaagggcaaaccagaatggctatgtggcttttctcggagatgcgtaatactggttgtcgtcctgatacttctgtctacaatgcgctaattacagctcaccttcgttcacgggacaaaataaaggctttggctaaagccattggctactttcaaaagatgaaaggaatggagcgctgtaagcccaacattgttacttacaacattcttttgagagcttttgctcaagctcggaacgtggagcaggtcaattctttgtttaaggatcttgatgagagcattgtttcgcccgatatttacacttttaatggtgtgatggatgcatatggtaaaaatgggatgatccgtgaaatggaagcagtgcttgctcggatgaaaagcaaccagtgtaagcctgacctgattacctttaacttgctgattgattcctatgggaagaagcaggcgtttggtaagatggaacaggtgttcaagagtttgttgcactccaaggagagaccatcactgcccacgtttaattcaatgattttaaactatgggaaggcacggcttaaggataaagcagaagatgttttcaagaagatgactgacatgggttacacgctgagctttgttacacacgagagtatgatctatatgtatggcttctgtgattgtgtctccagggctgcacaattgtttgatgagctggttgagtctaaagttcatataaaagtttcaaccctaaatgccatgcttgatgtttactgcttaaatggtttaccgcaggaagcagattcactgtttgaaagagcaattagtataaaaatacatcctgattcatcaacatttaaacttctttataaggcttacactaaagccaaccagaaggagcttcttgataaattgctgaagcatatggataaagatggtattatcccaaataagaggttcttcttggatgctttgggtgctgttgcgtctttaccagcaaattcagaatctgctaatgctgcaactgattcaaacacagcaaattcagaatctgctaatgctgcaactgattcaaacgcatcaaattcagaatctgctaatgctgcaactgattcaaacgcatcaaattcagaatctgcttatgccgctactgactcaaacaacccccaagattttgcaaagttggcaactggtgtgaagaatattttggctcatcgatgacttgcatacaaacagctcagttctcgtgagatggtatggatgtatttccattttccagctcattgccccttgtcttggcactatggtctatgaaatgaagaacgcttcagacctgacagctgccaaagctaattagttgatgacaaccaatccaaaaagagcagacttgctgctggaaagcaatgtgtaaatctgtaactaacaaaattgagttattatcaatgatgttattgataattcatgtacaattatttttctgatgtaatttgaaatcattactaaaaagattgacttgtcatgttttctgcacagtactgaaaataaccgagtaatgaaagaatttgttgaaaaaaaaaaaaaaaaaaaaaaaaa

SEQ ID NO: 4182 - protein, 526 aa, Glycine max
  misc_feature: PFam Name: PPR; PFam Description: PPR repeat
  misc_feature: GI Number: 50912811; NR Description: pentatricopeptide (PPR) repeat-containing protein-like [Oryza sativa (japonica cultivar-group)] >gi|46390206|dbj|BAD15637.1| pentatricopeptide (PPR) repeat-containing protein-like [Oryza sativa (japonica
  misc_feature: GI Number: 55773690; NR Description: putative PPR2 [Oryza
  misc_feature: GI Number: 30961817; NR Description: PPR2 [Zea mays]
  misc_feature: GI Number: 6630737; NR Description: nodulin / glutamate-ammonia ligase-like protein [Arabidopsis thaliana] >gi|11358580|pir||T46163 nodulin / glutamate-ammonia ligase-like protein - Arabidopsis thaliana >gi|15231760|ref|NP_190885.1|
  misc_feature: GI Number: 15229587; NR Description: pentatricopeptide (PPR)
MSSLSSCSSSPSFAASYGTITHPRAAPLSRISCGGPRPPKSKKSNLNSEAQELVRLLTSKIRSNDKEVLLKTLNKYVKQVRTQHCFLLFEELGKHDNWLQCLEVFRWMQKQRWYIADNGIYSKLISVMGKKGQTRMAMWLFSEMRNTGCRPDTSVYNALITAHLRSRDKIKALAKAIGYFQKMKGMERCKPNIVTYNILLRAFAQARNVEQVNSLFKDLDESIVSPDIYTFNGVMDAYGKNGMIREMEAVLARMKSNQCKPDLITFNLLIDSYGKKQAFGKMEQVFKSLLHSKERPSLPTFNSMILNYGKARLKDKAEDVFKKMTDMGYTLSFVTHESMIYMYGFCDCVSRAAQLFDELVESKVHIKVSTLNAMLDVYCLNGLPQEADSLFERAISIKIHPDSSTFKLLYKAYTKANQKELLDKLLKHMDKDGIIPNKRFFLDALGAVASLPANSESANAATDSNTANSESANAATDSNASNSESANAATDSNASNSESAYAATDSNNPQDFAKLATGVKNILAHR

SEQ ID NO: 4183 - DNA, 1002 bp, Glycine max
  misc_feature (1)..(1002): Ceres cDNA ID no. 21705168
  misc_feature (1)..(1002): Ceres CLONE  ID no. 533616
  misc_feature (1)..(1002): Also known as  Ceres CDNA ID no. 23688898
aaactcaacaaaaccatgatcccaaacgttgaaatccctcactgggacgccgacggaggaggaccactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgccgccgtgacccccgcaagtaccactactccggcaccgcctgccccgattaccagaaggggaactgcaagaggggcgacacttgtcagttctcgcacggcgtcttcgaatgctggctccatccttctcgctaccggacccacctctgcaaagacggaaccacttgccgccgcagagtctgcttcttcgctcacaccaccgaacaactccgcctcgtagtaacggattcatcatcgtcctcctttgtttcctctcccacttcggtcctcaactcttcgtccttctccgattctttgccgtacagcttcgtgcgcgaaatagttaactcaacgcggaatgttaaaatcgaggattcgggtttgacccgttgcgtgtttgggtcgccacgtggcgggtttttaagtgtgaatgggtgcgaggaggagcctgctatggagagggtggaatctgggaaagacattagagcgagaatctatgccaagcttagtagggagaacacgattggagcctctgaccctgacattggatgggtttcggaactcgtcaaatgaccgcatgtttgtttctcccttgttagattattatgttcgagacaaagtcattttatcttttctaactctaaaccaaatatgcactgaatggattcagttgcttttcatttgggtctgtatgtatagttaagttgtataatgcaatttgaataaaataaaataaaactctatgtacatagttgagaccgtttgggtctctgtttttgtaaaaaaaaaaaaaaaaaa

SEQ ID NO: 4184 - protein, 258 aa, Glycine max
  misc_feature: PFam Name: zf-CCCH; PFam Description: Zinc finger
  misc_feature: GI Number: 22531114; NR Description: putative CCCH-type zinc finger protein [Arabidopsis thaliana] >gi|21536515|gb|AAM60847.1| putative CCCH-type zinc finger protein [Arabidopsis thaliana] >gi|3687237|gb|AAC62135.1| putative CCCH-type zinc finger protein
  misc_feature: GI Number: 21593538; NR Description: putative CCCH-type zinc
  misc_feature: GI Number: 50933107; NR Description: putative zinc finger transcription factor [Oryza sativa (japonica cultivar-group)] >gi|47777438|gb|AAT38071.1| putative zinc finger transcription
  misc_feature: GI Number: 56605376; NR Description: putative CCCH
  misc_feature: GI Number: 34906436; NR Description: putative zinc finger transcription factor [Oryza sativa (japonica cultivar-group)] >gi|9988428|dbj|BAB12694.1| putative zinc finger transcription
KLNKTMIPNVEIPHWDADGGGPLSPFISSSSNADKCSLLFSSDHFRMFQFKVRICPRGRSHDWTECPYAHPAEKARRRDPRKYHYSGTACPDYQKGNCKRGDTCQFSHGVFECWLHPSRYRTHLCKDGTTCRRRVCFFAHTTEQLRLVVTDSSSSSFVSSPTSVLNSSSFSDSLPYSFVREIVNSTRNVKIEDSGLTRCVFGSPRGGFLSVNGCEEEPAMERVESGKDIRARIYAKLSRENTIGASDPDIGWVSELVK

SEQ ID NO: 4185 - DNA, 1633 bp, Glycine max
  misc_feature (1)..(1633): Ceres cDNA ID no. 21705169
  misc_feature (1)..(1633): Ceres CLONE  ID no. 533917
  misc_feature (1)..(1633): Also known as  Ceres CDNA ID no. 24367659
gatacacataggtacacatacattgatcccagaaatccaaagtcccatattatctgaccgctactttttttccaaatatcacgaaaacgtgcgaaagaagagcaaaggaaagcaaaaagcagaagataaagtaagaaaaggctcaaatgaaaaatagtttgtactaaaatgatgcacgagacgtacatagaaaattgagcacaaagtggtgttgttcatggatagcagagattcatcatcggggtctcagcacccacaccttcctccagggtttcggttccaccccaccgatgaagagctcgtggttcactacctcaagagaaaagctgcttctgcaccccttcccgtcgccatcatcgccgatgttgatctctacaagttcgacccttgggagctcccaagtaaagcaacttttggtgagcaagagtggtactttttcagcccaagggatagaaaatacccaaatggggctaggcccaatagagctgctacttctgggtattggaaggccactggaactgacaagcctatattaacaacatatgggcaccacaaagttggagttaagaaagcacttgttttttatggtggaaagcctccaaaaggggttaaaaccaattggatcatgcatgagtataggcttgttgatgattcctttaattcaagctcaaaaccgcctcctctggttcctcataacaagaaaaattccctgaggctggacgattgggttttgtgccgaatatacaagaaaagcaacaacaccaccctaccaaggccacccatgatggagcatgaagaggagctttcaatggacaacatgctaccaacgatgtcaacgttgtcaatggctaacaacaaaatgcaaaaccctaaacctccctcgaggagcacgagttatggtccactaggacttgaaaatgatgacaacttcttcgagggagtcttggccgtggatcaaagcatgcaaaatggttctgattctcacattttctctccaaactcaaagggtgataataataataacaacaacaataatgctagcaactttcctatcaaacgtgcactgatcacatcacaactttggaacgagacagggtctccggggtcttcttcttcgtgcaagcgatttcatggtgatcttaattgtggatgcagcaatgctgaggacaataatgattcctttatttccctgctaagccagtttcctcagaacgcaacttttcagccaaacgcgattcatgggtccgttgaggatgatggtgcgccgaggcaacaatttcatcttcatggcataaattggaactgattaatcaatagtgtgctttagcttagtttactttacacacacatgaaaattaaatgtaactaccattaattatagacttcttcatgcaggtcttagtatttttcactttccttctactgtattcataacacaaaataggaagagatcgagactataggcatggagtactatatatatgttgaacttgaagcttacaacattaattatactagattaaattggatacaaccgcgaaattaaaatcttatatggaaagaaaatttataaggaaggactggtgcagcaacaaataataattgacttaaatacaaaaaaaaaaaaaaaaaa

SEQ ID NO: 4186 - protein, 362 aa, Glycine max
  misc_feature: PFam Name: NAM; PFam Description: No apical meristem (NAM) protein
  misc_feature: GI Number: 21593425; NR Description: NAM protein, putative
  misc_feature: GI Number: 63252923; NR Description: NAM-like protein [Prunus
  misc_feature: GI Number: 7021736; NR Description: putative jasmonic acid regulatory protein [Arabidopsis thaliana] >gi|15795116|dbj|BAB02380.1| jasmonic acid regulatory protein-like
  misc_feature: GI Number: 52353038; NR Description: NAC domain protein [Lycopersicon esculentum] >>gi|52353036|gb|AAU43922.1| NAC domain
  misc_feature: GI Number: 4325286; NR Description: NAC domain protein NAM [Arabidopsis thaliana] >gi|50401213|sp|Q9ZNU2|NA18_ARATH NAC-domain containing protein 18 (ANAC018) (NO APICAL MERISTEM protein) (AtNAM) >gi|4325282|gb|AAD17313.1| NAC domain protein
MDSRDSSSGSQHPHLPPGFRFHPTDEELVVHYLKRKAASAPLPVAIIADVDLYKFDPWELPSKATFGEQEWYFFSPRDRKYPNGARPNRAATSGYWKATGTDKPILTTYGHHKVGVKKALVFYGGKPPKGVKTNWIMHEYRLVDDSFNSSSKPPPLVPHNKKNSLRLDDWVLCRIYKKSNNTTLPRPPMMEHEEELSMDNMLPTMSTLSMANNKMQNPKPPSRSTSYGPLGLENDDNFFEGVLAVDQSMQNGSDSHIFSPNSKGDNNNNNNNNASNFPIKRALITSQLWNETGSPGSSSSCKRFHGDLNCGCSNAEDNNDSFISLLSQFPQNATFQPNAIHGSVEDDGAPRQQFHLHGINWN

SEQ ID NO: 4187 - DNA, 1488 bp, Glycine max
  misc_feature (1)..(1488): Ceres cDNA ID no. 21705170
  misc_feature (1)..(1488): Ceres CLONE  ID no. 535369
  misc_feature (1)..(1488): Also known as  Ceres CDNA ID no. 0
acactactccttctttctctctctacatttgaattcaatcgacccgccgctctttctctctctaaattcgcaatgagcaaaagagctaataagaggaaagcgaagcaagacgaacagcccaaacaacgcaagaagcgatccacaacaattaaacctgccgagcacgaagagtacttcgaggatcagcgcaacttggaagacttatggagggaaacattccctgtcggaacagagtgggatcaattggattctgtgtatcaatacaagtggaatttctctaacctggaaaatgcgtttgaagagggtggtgtacttcatgggaaaagggtttatctctttggttgcaccgagcctcaactggtctggttcaaagatgaaagcaaagttgtctgcatacctgttgttgtagctgttgtatcacctttcccaccgtctgataaaattgggattaactcagttcagagagagttcgaagagataattcccatgaaacaaatgaaaatggactggattccatatatcccccttgaggaccgagaaagccgagttgatagattaaagtctcaaatatttatcttaagttgcacccaaagaagggctgcattgaaacatctgaagttggatcgtgtaaagaaatacgagtattgcttgccttacttctaccatccgtttaaggaagatgaacttgaacagagcactgaagttcaaataatatttccagcagagccaaagccggttttctgtgaatttgattgggaattagatgagcttgaggagttcactgataagctcatagaggaggaggagttattggaagatcaaaaagatacctttaaggaatttgtcaaagaaaaagtacgggaagcaaagaaagctaatagagaggcaagggaagctcgaagaaaagccattcaagaaatgagtgaggaagctagagctgcatttgagaatatgagattttataagttctaccctgtgcaaagtccagatgcacctgatgtatctaatgttaagtctccattcataaacaggtattatggaaaggctcatgaggttctgtaattggattcaagacgatgccaacttcgtctgcaggcttgttttacctgacactaaggatttagtcatctatgacgttcagaaggcaacctcctggtgcctggttagaagtgtaggtgtctgaaggaacataccatgtaaaattaagctcagaaatcccagagaagtgcattagataggaggaatatatgggacgggtttctgatttccaatctgtggagaatagccgaagttcaggagctttaattggtgtggctcttgcttgtcttggtttcaaatttcagattctttgtccattctaagttgtacggcaaggtttgactataagctaaatgaaaatagatagttgtccttttaacatccaagaacgaaaatatatttgttgaaaggacaattttgttgaaaaaaaaaaaaaaaaaaaaaaaaaaa

SEQ ID NO: 4188 - protein, 329 aa, Glycine max
MSKRANKRKAKQDEQPKQRKKRSTTIKPAEHEEYFEDQRNLEDLWRETFPVGTEWDQLDSVYQYKWNFSNLENAFEEGGVLHGKRVYLFGCTEPQLVWFKDESKVVCIPVVVAVVSPFPPSDKIGINSVQREFEEIIPMKQMKMDWIPYIPLEDRESRVDRLKSQIFILSCTQRRAALKHLKLDRVKKYEYCLPYFYHPFKEDELEQSTEVQIIFPAEPKPVFCEFDWELDELEEFTDKLIEEEELLEDQKDTFKEFVKEKVREAKKANREAREARRKAIQEMSEEARAAFENMRFYKFYPVQSPDAPDVSNVKSPFINRYYGKAHEVL

SEQ ID NO: 4189 - DNA, 1693 bp, Glycine max
  misc_feature (1)..(1693): Ceres cDNA ID no. 21705172
  misc_feature (1)..(1693): Ceres CLONE  ID no. 541284
  misc_feature (1)..(1693): Also known as  Ceres CDNA ID no. 24367390
gggcaaaccttggaccttcaggctggaagcgtggtggtcttggttggcggttatgcccaagaacatcagatcagcaatggcaacctcttctttcttcttcaccttgctattactgcttctcactgtttcagatttgtttgtgcaaagccgtggccttaattttggaatcaactacgggcaaatagccaacaaccttccatctccatctcgtgtggctgttctaataaaatctctgaatgtatccagaatcaaactctatgatgctgatccaaatgttctatctgcattctccaattcagatgtggaattcatcataggactagggaacgagtatctgcagagcatgagagacccttctaaggctcagagctgggttcaacagcatgttcagccttacatttcacaaaccagaatcacttgcatcactgtaggaaatgaggtattcaactacaatgatacacagctcacagcaaatcttctcccagcaatgcaaagtgtgtataatgcccttgttaatctaggactagcacaacaagttactgttacgactgctcattctttcaacattttagccaattcttttcctccttcatctggggcattcaggcaagatctgatacaatacattcaacccctccttagctttcatgctcaaatcaaatcacccttcctcattaatgcatatcccttttttgcatacaaggacaatccaaaccaaatctccttgaactatgtgctatttcagccaaatcaaggggccactgatccaaacaccaatttgcattatgataacatgttgtatgctcagattgatgctgtctacgccgccatcaaagcgctgggacataccgatgttgaagtcaggatttcagaaactggttggccttctaagggtgaccctgatgaggttggagccacaccccagaatgcagaaatatataatagtaatttattgaagaggatagagcagaagcaaggcactcctgctaatccatctgttccaattgatatttttgtctttgcacttttcaatgagaatttgaagcctggtcctgtttctgagagaaactatggcctttattatcctgatggtaccccagtttataacattggattagaaggttatctcccagaaatggttatagagcccaaatctaacgctttgtccaccaattttctcatctacatatttacatgtttgttgttcatttgggagctttcaagaccgtgacaaaacaaataactttctacaaatcattcttttgcaagagttggtgaagggagacaaaggcaaggcaaattctacactttttgtacacagccatgggagcagttgttcaaggactagttcgtattcttaaatctagtttttagctaaatccattcatataattttttatttcacagtttagaaataatcgtaatatggagtacagtgatttttttttgacagaaagttgatatagaaaaaaaaaacgttttcttttttagacagaaagaaaggagaattatatattatgctgtacatgtagaagaaagtgttcagttatgactctcgtttgtgcgtagtctcagttggcaatttttttgtgaaaaacttcattgagttaaactaatgatgctgatttaatttgtttttatatgtacttacaaatattagtaaaaaaaaaaaaagaaaaaaaaaaaaaaaaaa

SEQ ID NO: 4190 - protein, 1693 aa, Glycine max
  misc_feature: PFam Name: Glyco_hydro_17; PFam Description: Glycosyl
  misc_feature: GI Number: 42570949; NR Description: glycosyl hydrolase family 17 protein [Arabidopsis thaliana] gi|25316425|pir||F84673
  misc_feature: GI Number: 20465431; NR Description: putative beta-1,3-glucanase [Arabidopsis thaliana] >gi|17529078|gb|AAL38749.1| putative beta-1,3-glucanase [Arabidopsis thaliana] >gi|21536820|gb|AAM61152.1| putative
  misc_feature: GI Number: 34908492; NR Description: putative beta-1,3-glucanase [Oryza sativa (japonica cultivar-group)] >gi|20161652|dbj|BAB90571.1| putative beta-1,3-glucanase [Oryza sativa (japonica cultivar-group)] >gi|20521248|dbj|BAB91764.1|
  misc_feature: GI Number: 56785404; NR Description: putative elicitor inducible beta-1,3-glucanase NtEIG-E76 [Oryza sativa (japonica cultivar-group)] gi|56784812|dbj|BAD82033.1| putative elicitor inducible beta-1,3-glucanase NtEIG-E76 [Oryza sativa (japonica
  misc_feature: GI Number: 50251398; NR Description: putative beta-1,3-glucanase precursor [Oryza sativa (japonica
GGGCAAACCTTGGACCTTCAGGCTGGAAGCGTGGTGGTCTTGGTTGGCGGTTATGCCCAAGAACATCAGATCAGCAATGGCAACCTCTTCTTTCTTCTTCACCTTGCTATTACTGCTTCTCACTGTTTCAGATTTGTTTGTGCAAAGCCGTGGCCTTAATTTTGGAATCAACTACGGGCAAATAGCCAACAACCTTCCATCTCCATCTCGTGTGGCTGTTCTAATAAAATCTCTGAATGTATCCAGAATCAAACTCTATGATGCTGATCCAAATGTTCTATCTGCATTCTCCAATTCAGATGTGGAATTCATCATAGGACTAGGGAACGAGTATCTGCAGAGCATGAGAGACCCTTCTAAGGCTCAGAGCTGGGTTCAACAGCATGTTCAGCCTTACATTTCACAAACCAGAATCACTTGCATCACTGTAGGAAATGAGGTATTCAACTACAATGATACACAGCTCACAGCAAATCTTCTCCCAGCAATGCAAAGTGTGTATAATGCCCTTGTTAATCTAGGACTAGCACAACAAGTTACTGTTACGACTGCTCATTCTTTCAACATTTTAGCCAATTCTTTTCCTCCTTCATCTGGGGCATTCAGGCAAGATCTGATACAATACATTCAACCCCTCCTTAGCTTTCATGCTCAAATCAAATCACCCTTCCTCATTAATGCATATCCCTTTTTTGCATACAAGGACAATCCAAACCAAATCTCCTTGAACTATGTGCTATTTCAGCCAAATCAAGGGGCCACTGATCCAAACACCAATTTGCATTATGATAACATGTTGTATGCTCAGATTGATGCTGTCTACGCCGCCATCAAAGCGCTGGGACATACCGATGTTGAAGTCAGGATTTCAGAAACTGGTTGGCCTTCTAAGGGTGACCCTGATGAGGTTGGAGCCACACCCCAGAATGCAGAAATATATAATAGTAATTTATTGAAGAGGATAGAGCAGAAGCAAGGCACTCCTGCTAATCCATCTGTTCCAATTGATATTTTTGTCTTTGCACTTTTCAATGAGAATTTGAAGCCTGGTCCTGTTTCTGAGAGAAACTATGGCCTTTATTATCCTGATGGTACCCCAGTTTATAACATTGGATTAGAAGGTTATCTCCCAGAAATGGTTATAGAGCCCAAATCTAACGCTTTGTCCACCAATTTTCTCATCTACATATTTACATGTTTGTTGTTCATTTGGGAGCTTTCAAGACCGTGACAAAACAAATAACTTTCTACAAATCATTCTTTTGCAAGAGTTGGTGAAGGGAGACAAAGGCAAGGCAAATTCTACACTTTTTGTACACAGCCATGGGAGCAGTTGTTCAAGGACTAGTTCGTATTCTTAAATCTAGTTTTTAGCTAAATCCATTCATATAATTTTTTATTTCACAGTTTAGAAATAATCGTAATATGGAGTACAGTGATTTTTTTTTGACAGAAAGTTGATATAGAAAAAAAAAACGTTTTCTTTTTTAGACAGAAAGAAAGGAGAATTATATATTATGCTGTACATGTAGAAGAAAGTGTTCAGTTATGACTCTCGTTTGTGCGTAGTCTCAGTTGGCAATTTTTTTGTGAAAAACTTCATTGAGTTAAACTAATGATGCTGATTTAATTTGTTTTTATATGTACTTACAAATATTAGTAAAAAAAAAAAAAGAAAAAAAAAAAAAAAAAA

SEQ ID NO: 4191 - DNA, 1856 bp, Glycine max
  misc_feature (1)..(1856): Ceres cDNA ID no. 21705173
  misc_feature (1)..(1856): Ceres CLONE  ID no. 541305
  misc_feature (1)..(1856): Also known as  Ceres CDNA ID no. 23699041
acatgatctatttcttatctcttgtataaaatttgcattgatatgtaaatatgcaatggactagcaacattactaaatacattcgtgtacgatatccatatgttaaagccgtaacctatggactaccacacaacagttctgctactgattacctttgtgagtgcaaccattattctcatattcattcggagattattcaaccaaacctcagaatcagaatatgcaaagcttccaccagggcctcgtccatttcctatcataggaaacatcttggaacttggcacaaatccacacatagcactcaccaaactctcaaagatttatggatctcttatgacttttaaacttggcagaataaccaccttagttatctcctctcctcaagtagccaaagaagtactacttgaaaatggccaagtcctttctagcagaacaattccacattcagtccatgcacttgaccatcacatatactctactgtgtggctgccaccatcagctcaatggaggaaccttaggcgagtttgtgcaacaaaaatattctctccacaattgcttgactccactcaaatccttcgccaacaaaaggttaaagatttattggattttgtgaaagaacgatgcaagaaaggtggggttgtggatattggagaggttgtctttacaacaatccttaattccatttcaaccactttcttctctatggatttgtctgattctacatctgaaaagtctcatgagttcatgaacattattcgaggcataatggaagaaattggaaggcctaatgttgcagacttgtttcccattcttcgtccacttgaccctcaacgtgtccttgctaggacgaccaattattttaagaggttgcttaagattatcgatgaaattattgaagaaagaatgccttcaagagtttcaaaatccaaccactccaaggtgtgcaaggatgtactggattcacttcttaacgatattgaagaaacgggttctcttttgagtcgcaatgagatgttacatttatttctggatttacttgttgctggggttgacacaacatcaagcacggttgaatggattatggcagagttgctacgcaacccagataaattggtaaaagcaaggaaagagttatctaaagcaattggaaaagatgtaacacttgaagaatcacaaatcttaaagttgccattcttacaagcagtggtaaaggaaactcttcgcttgcatccaccaggtccacttttagtaccccataagtgtgatgaaatggtaaacatatctggcttcaatgtgcctaaaaatgcacaaatcttggtcaatgtgtgggccatgggacgagatccaaccatttgggagaatccaacaatttttatgcccgaaagatttttgaaatgtgagattgattttaaaggtcacgattttaagctcataccctttggagctggtaaaaggatatgcccaggattgccattagctcacaggacaatgcatttaatagtagcatcccttgtacacaactttgaatggaagctagctgatgggttaattccagaacacatgaacatggaggagcaatatgcgataacattaaagaaggttcagcctcttcgagttcaagctactccaatcaaacgcgattaattttatataatattgtgtttcaaatcactgcaagtcctcttatagttactgtcattttgttttcctcagataagcataacagaattcaaatatttgtcacattactacactttgttagcccttatatggaccttacaacaaaacattattgtgcttataaatatgggaaaacatatattagttgttttcaaaataaaaaaaaaaaaaaaaaa

SEQ ID NO: 4192 - protein, 508 aa, Glycine max
  misc_feature: PFam Name: p450; PFam Description: Cytochrome P450
  misc_feature: GI Number: 7406712; NR Description: putative ripening-related
  misc_feature: GI Number: 17065916; NR Description: geraniol 10-hydroxylase
  misc_feature: GI Number: 46403209; NR Description: cytochrome P450
  misc_feature: GI Number: 27529728; NR Description: cytochrome P450 [Petunia
  misc_feature: GI Number: 46370700; NR Description: cytochrome P450 [Ammi majus]
MDYHTTVLLLITFVSATIILIFIRRLFNQTSESEYAKLPPGPRPFPIIGNILELGTNPHIALTKLSKIYGSLMTFKLGRITTLVISSPQVAKEVLLENGQVLSSRTIPHSVHALDHHIYSTVWLPPSAQWRNLRRVCATKIFSPQLLDSTQILRQQKVKDLLDFVKERCKKGGVVDIGEVVFTTILNSISTTFFSMDLSDSTSEKSHEFMNIIRGIMEEIGRPNVADLFPILRPLDPQRVLARTTNYFKRLLKIIDEIIEERMPSRVSKSNHSKVCKDVLDSLLNDIEETGSLLSRNEMLHLFLDLLVAGVDTTSSTVEWIMAELLRNPDKLVKARKELSKAIGKDVTLEESQILKLPFLQAVVKETLRLHPPGPLLVPHKCDEMVNISGFNVPKNAQILVNVWAMGRDPTIWENPTIFMPERFLKCEIDFKGHDFKLIPFGAGKRICPGLPLAHRTMHLIVASLVHNFEWKLADGLIPEHMNMEEQYAITLKKVQPLRVQATPIKRD

SEQ ID NO: 4193 - DNA, 1590 bp, Glycine max
  misc_feature (1)..(1590): Ceres cDNA ID no. 21705174
  misc_feature (1)..(1590): Ceres CLONE  ID no. 554099
  misc_feature (1)..(1590): Also known as  Ceres CDNA ID no. 24363321
aattaattgtcgagtgtgaaacaaattgtaatcacacgactatgatgctgtatacagacacatatgactgacatactattttaaggtttcgtcatttctaaaaataatcctagcttttatatggagcttctgcatatacaagaaccttatagatgaattagtctttctagttaactgaaaattcaggtgagctcaattaaaatttcatcattcatttgggagatagacagtttctttctgttccattattttccaaagcaatggtttgcagtgtgcatctggtggagctacgtggaactggtcaatattttgcgatgaaagctatggataagggtgttatgctcaatcgtaataaggtgcatagagcttgcgcagagagagaaattcttgacaagttggaccattcttttctacctgcattatatgcttccttccagaccaaaacacacgtttgtttgattactgattattgtcctgggggagaactattcctgcttcttgatcggcagccgactaaggttctcaaggaagatgccgtgagattttatgcagcagaggtagtgatcgtattggagtaccttcattgccaaggaataatatatcgagatttgaagccagaaaatgtgttactccagagcaatgggcatgtgtccctaacagattttgatttgtcatgtttaacatctagcaagccacagcttataattccagctaccaattcaaagaagaagaaaaagaagaaacagaaaagtcaagaggttccaatgtttatggcagaaccaatgagagcatcaaattcttttgttggcacggaagagtacattgctccggaaattataactggttcaggtcacacaagtgctgtggattggtgggctctaggtattctaatatatgaaatgctttatgggtatacgccattccgggggaaaacaagacaaaaaacatttgcaaatattcttcacaaggaccttaaatttcccaaaagtaaaccggtaagtctccagggaaagcagctaatttactggttgttgcagagagatcctaaagacagattgggttcacgtgaaggagcaaatgaaattaaacgtcatcctttcttccggggtgtcaattgggcactagttcgttgcatgaaacctcctgagcttgatgctcctctcttaccggaaactgaagaagaaaaagaagccaaagatatacatcctgggctagaggatctgcagacaaatattttctaaaatatcgagaaacacatgatgaattctttgcgattttgaacaattaatggaattttaatcccttgcttcagcggtgcaaagtttgatcatgttcattgtaatttatgaatggaagacctactatatttttctagatttgatgctacttaagctgcctggccttccaatggggtattagggattgggaccatcaaggcaattagtctagtgtggaaatttgtgtatatttttagaataatgttgagtcatttaagacatgccttgtaacatcaaaattaaatctgtattgttaaaccattttttggaaaataaaatacttttagtgtgactcaaaaaaaaaaaaaaaaaa

SEQ ID NO: 4194 - protein, 326 aa, Glycine max
  misc_feature: PFam Name: Pkinase; PFam Description: Protein kinase domain
  misc_feature: GI Number: 20338415; NR Description: phototropin 1 [Pisum sativum]
  misc_feature: GI Number: 60099454; NR Description: phototropin [Phaseolus
  misc_feature: GI Number: 24899168; NR Description: phototropin [Vicia faba]
  misc_feature: GI Number: 24899170; NR Description: phototropin [Vicia faba]
  misc_feature: GI Number: 12040650; NR Description: phototropin-like protein
MVCSVHLVELRGTGQYFAMKAMDKGVMLNRNKVHRACAEREILDKLDHSFLPALYASFQTKTHVCLITDYCPGGELFLLLDRQPTKVLKEDAVRFYAAEVVIVLEYLHCQGIIYRDLKPENVLLQSNGHVSLTDFDLSCLTSSKPQLIIPATNSKKKKKKKQKSQEVPMFMAEPMRASNSFVGTEEYIAPEIITGSGHTSAVDWWALGILIYEMLYGYTPFRGKTRQKTFANILHKDLKFPKSKPVSLQGKQLIYWLLQRDPKDRLGSREGANEIKRHPFFRGVNWALVRCMKPPELDAPLLPETEEEKEAKDIHPGLEDLQTNIF

SEQ ID NO: 4195 - DNA, 1493 bp, Triticum aestivum
  misc_feature (1)..(1493): Ceres cDNA ID no. 21705175
  misc_feature (1)..(1493): Ceres CLONE  ID no. 555391
  misc_feature (1)..(1493): Also known as  Ceres CDNA ID no. 24369678
gttagaaaatttccagccctgcccctccccggcgccggcgaccaccgccgcagccgccacctcctccaggagcgccggcgtcgcccgtccgcacccggcggcggcggcggaggcagcgatggcgaggcaagaggccgtgggggccgccacgggggtggacttccacctgccggacgagatcctggccgtgatccccactgacccgtacgagcagctggacgtcgcccgcaagatcacctccatggccatcgcgtcccgcgtctcccgcctcgaggccgacgtcgcgcgcctccgcagggacctcgccgaccgcgaccgcggcgaggccgacctccgcgcccgcctcgccgactccgacgcccgcctcctcgccgcgctcgacgagaacgcgaagctggtgaaggagagggacacgctcgccctgacggccaagaagctgtcgaggaacttggcaaagttagaggcatttaagaagcagttgatgaaatcgctgagtgaagataatttattgcaattgtcagaaacaggtgaagatcgtgatgtagatgcagaaaataatgggaccgctcgaattccttcctggaaagatgaagtttcaagcagtcacacctcttcaaatacttccagcagatccacaatcaccgaatcagcccaaggataccagttctcaatcacaccatatgtagccccccaaataactcctggttcaacaccaattatttcatcctctagtggttccccactagcatattcaactggtccatccactccgaagttctattctggtccaacatcgcctacaagatcacgttctgaagaccaatcggcattttcatcatggaatggatcaagtcatcagtattcagcccctgtctctcctcaacgccgctcatttgcagggcgacctcgtatagatggaaaggaattcttccgacaagcacggacacgactatcttatgagcaatttggagcattcttggcaaatattaaggaatttaatgcacagaaacaatcgcgagaggacaccttgtcgaaagcagaggagatttttggaacagagcacaaagacttgtacatttctttccagaatatgcttaaccgcaaccaatcgtgaacctgtcataggctgccgtatttcttcttttgaacaagctggtttagttcatcggtatgtctcttcggtttaaacgacggtaccattctgctggggtaataattcctatgccaggccatctgtttccaagagagcgtgtatcgttggagttctcgttgatcacaagatcatctccttagaaatctgtgcataggccattgtagttttggtgtggccatcctcaataacatgatgtaaatgggtatggtcatgcatgcattcaacaaggaaaagtttcttttctttttgcgaacaagtggaagttgagactgtcagatatattggtctgtgtaattgacttgtgaattgaagctcgttttcaacaaaaaaaaaaaaaaaa

SEQ ID NO: 4196 - protein, 1493 aa, Triticum aestivum
  misc_feature: PFam Name: Peptidase_S8; PFam Description: Subtilase family
  misc_feature: GI Number: 34909876; NR Description: B1143G03.2 [Oryza sativa
  misc_feature: GI Number: 34872074; NR Description: similar to Ser/Arg-related nuclear matrix protein; plenty-of-prolines-101;
  misc_feature: GI Number: 49522807; NR Description: Srrm1-prov protein
  misc_feature: GI Number: 33150824; NR Description: Ser/Arg-related nuclear matrix protein [Homo sapiens] >gi|3005587|gb|AAC09321.1|
  misc_feature: GI Number: 23274133; NR Description: Serine/arginine
GTTAGAAAATTTCCAGCCCTGCCCCTCCCCGGCGCCGGCGACCACCGCCGCAGCCGCCACCTCCTCCAGGAGCGCCGGCGTCGCCCGTCCGCACCCGGCGGCGGCGGCGGAGGCAGCGATGGCGAGGCAAGAGGCCGTGGGGGCCGCCACGGGGGTGGACTTCCACCTGCCGGACGAGATCCTGGCCGTGATCCCCACTGACCCGTACGAGCAGCTGGACGTCGCCCGCAAGATCACCTCCATGGCCATCGCGTCCCGCGTCTCCCGCCTCGAGGCCGACGTCGCGCGCCTCCGCAGGGACCTCGCCGACCGCGACCGCGGCGAGGCCGACCTCCGCGCCCGCCTCGCCGACTCCGACGCCCGCCTCCTCGCCGCGCTCGACGAGAACGCGAAGCTGGTGAAGGAGAGGGACACGCTCGCCCTGACGGCCAAGAAGCTGTCGAGGAACTTGGCAAAGTTAGAGGCATTTAAGAAGCAGTTGATGAAATCGCTGAGTGAAGATAATTTATTGCAATTGTCAGAAACAGGTGAAGATCGTGATGTAGATGCAGAAAATAATGGGACCGCTCGAATTCCTTCCTGGAAAGATGAAGTTTCAAGCAGTCACACCTCTTCAAATACTTCCAGCAGATCCACAATCACCGAATCAGCCCAAGGATACCAGTTCTCAATCACACCATATGTAGCCCCCCAAATAACTCCTGGTTCAACACCAATTATTTCATCCTCTAGTGGTTCCCCACTAGCATATTCAACTGGTCCATCCACTCCGAAGTTCTATTCTGGTCCAACATCGCCTACAAGATCACGTTCTGAAGACCAATCGGCATTTTCATCATGGAATGGATCAAGTCATCAGTATTCAGCCCCTGTCTCTCCTCAACGCCGCTCATTTGCAGGGCGACCTCGTATAGATGGAAAGGAATTCTTCCGACAAGCACGGACACGACTATCTTATGAGCAATTTGGAGCATTCTTGGCAAATATTAAGGAATTTAATGCACAGAAACAATCGCGAGAGGACACCTTGTCGAAAGCAGAGGAGATTTTTGGAACAGAGCACAAAGACTTGTACATTTCTTTCCAGAATATGCTTAACCGCAACCAATCGTGAACCTGTCATAGGCTGCCGTATTTCTTCTTTTGAACAAGCTGGTTTAGTTCATCGGTATGTCTCTTCGGTTTAAACGACGGTACCATTCTGCTGGGGTAATAATTCCTATGCCAGGCCATCTGTTTCCAAGAGAGCGTGTATCGTTGGAGTTCTCGTTGATCACAAGATCATCTCCTTAGAAATCTGTGCATAGGCCATTGTAGTTTTGGTGTGGCCATCCTCAATAACATGATGTAAATGGGTATGGTCATGCATGCATTCAACAAGGAAAAGTTTCTTTTCTTTTTGCGAACAAGTGGAAGTTGAGACTGTCAGATATATTGGTCTGTGTAATTGACTTGTGAATTGAAGCTCGTTTTCAACAAAAAAAAAAAAAAAA

SEQ ID NO: 4197 - DNA, 1512 bp, Glycine max
  misc_feature (1)..(1512): Ceres cDNA ID no. 21705176
  misc_feature (1)..(1512): Ceres CLONE  ID no. 557003
  misc_feature (1)..(1512): Also known as  Ceres CDNA ID no. 24367408
gatatacaatttattctttttatattttgaaataattctgacttccctctaaacaagcacaatggcatctaaaaccgctgatactactcaaaaaactcccggcagcgctcctcctcaacctgacaatcaagagatcatgaatcaagttgtcgaaaaaaccgatgacgaagttgctaatttgatcaagcttttcgataacaatatcagagctatgaagaacgaagaaaagagacttggtcatgaaataaaaaacgcccaggctagaattaaagaaaatcaagaaaagatcaaattaaacaaacaacttccttacttagtcagtaacatcgttgaagtattagatgttgaacctgatgaggaagatggcgatgatgttcctgctgctccagttcaacgcacagaaaaagctgttgttgtcaagacttccactagacagactatcttcttacctattcccggtcttgttgatgtctctgaacttagaccttctgacttagtcggtgtgaataaggacagtttcctcattcttgagaaacttccagctgaatacgacgccagagtcaaggcaatggaggtcgaagagagacccaccgaagaattcactgatatcggtggtcttgaaaagcaaattgaagagcttagagaagctatcgttttacctattgcccataaagataagttcaagaaccttggtattagaccaccaaagggagtcttgatgcatggacctccaggtgtcggtaagactatgatggccagagcttgtgctgctcaaactagtgctactttcttaaaattggctggacctcaacttgtgcaaatgtttatcggtgatggtgccaagatcgtcagagatgcttttgctttggctaaagagagagctccagcagttatcttcattgatgagttggatgctatcggcacaaagagattcgattctgatacatcaggtgatagagaagtacaaagaaccatgttggagcttttgaatcagttggatggtttttcatctgctgaagatataaaggttattgctgctaccaatagacctgatattctcgatcccgctctattgagatctggtcgtttggatagaaagattgagttccccttacccaatgaagaagctagaggccaaattatgaaaattcattctagaaagatgaacgttagcaagaaagatgtaaacttccaagaacttgctagatctactgatgagttcaatggtgctcaacttaaggctgtttgtgtcgaagctggtatgagtgctttgagaagaggagctactttccttgttcacgaagatttcctcgatggtattgctcaagtccaagccaagaagaagaacgagcttgattacttcgcatagagagtttatatacttatattcactgctttaaaaaaagtgtttttatctattatataatatacatagagaaaaaattcgcatatattcttataaactaggttacaatatatgtacttacaaataacaaaaaaaaaaaaaaaaaa

SEQ ID NO: 4198 - protein, 435 aa, Glycine max
  misc_feature: GI Number: 4574740; NR Description: Tat-binding protein-1
  misc_feature: GI Number: 23481369; NR Description: 26s protease regulatory subunit 6a (tat-binding protein homolog 1) (tbp-1). [baker's yeast
  misc_feature: GI Number: 46437126; NR Description: likely 26S proteasome regulatory particle ATPase Rpt5p [Candida albicans SC5314] >gi|46437054|gb|EAK96407.1| likely 26S proteasome regulatory
  misc_feature: GI Number: 65305438; NR Description: 226S proteasome
  misc_feature: GI Number: 23508505; NR Description: 26S protease subunit regulatory subunit 6a, putative [Plasmodium falciparum 3D7] >gi|23496239|gb|AAN35898.1| 26S protease subunit regulatory subunit
MASKTADTTQKTPGSAPPQPDNQEIMNQVVEKTDDEVANLIKLFDNNIRAMKNEEKRLGHEIKNAQARIKENQEKIKLNKQLPYLVSNIVEVLDVEPDEEDGDDVPAAPVQRTEKAVVVKTSTRQTIFLPIPGLVDVSELRPSDLVGVNKDSFLILEKLPAEYDARVKAMEVEERPTEEFTDIGGLEKQIEELREAIVLPIAHKDKFKNLGIRPPKGVLMHGPPGVGKTMMARACAAQTSATFLKLAGPQLVQMFIGDGAKIVRDAFALAKERAPAVIFIDELDAIGTKRFDSDTSGDREVQRTMLELLNQLDGFSSAEDIKVIAATNRPDILDPALLRSGRLDRKIEFPLPNEEARGQIMKIHSRKMNVSKKDVNFQELARSTDEFNGAQLKAVCVEAGMSALRRGATFLVHEDFLDGIAQVQAKKKNELDYFA

SEQ ID NO: 4199 - DNA, 1899 bp, Triticum aestivum
  misc_feature (1)..(1899): Ceres cDNA ID no. 21705178
  misc_feature (1)..(1899): Ceres CLONE  ID no. 575879
  misc_feature (1)..(1899): Also known as  Ceres CDNA ID no. 24368700
aaacgcacccaaaagactttgtggtggtggttgagcatgactgtgcagcgaggaccgagcaggacagcagggctgcattcgtgttcttctctctcgcccacattgagagcggaggctgcagccccggatgtcgtcggccgggagggcgagggccgcgagcctggcggcggtggcggtgcggatggtggtgggggcggcggcgcggcccgcgccgagcgcggcgctgctgatggcggcggtgcgtggggaggacacggagttcgggacggcgttgtggtgggcgtacgccgccttctccgccctcctggtgctgctggccgggatcatgtcggggctcaccctgggcctcatgtcgctcggccccgtggatctggagatcctcatgcgcagcggcaccgacgccgagaaggctcaggccgctgctatccttccggttgtaaaaaagcagcaccagcttcttgtcactctgctgctctgtaatgcttgtgccatggaggctctccctatattccttgacaggattttcaatcctgttcttgcaattatattgtcagtgacatttgttcttgcctttggggaggttatacctcaagcaatatgtaccaggtatgggctggcagtgggtgctagctttgtctggctcgtacgcatcgtcatgttcattgcctatcctattgcttacccgattgggaagctcctagactttgctcttgggcatgaatctgcgcttttcaggcgagctcagttgaaagctcttgtttctatccatagcaaagcggctggcaagggtggagagcttacccatgatgagactacaatcataagtggagcgttggacttaactgaaaagaccgccgaagaagctatgacgcctattgaatcaactttctctttagatgtggactccaagttggattgggaaacaattggtacaattcttgcccggggccacagccgtgtacctgtgtattcaggaagccctagaaatgttataggtctcctattggtcaaaagtcttctgacagttcgtgctgaaatagagacgccagttagtgctgtttccattaggaggattccaagggttccttcagacatgcctttgtatgatatactgaacgagtttcagaaaggaggtagtcatatggctgctgttgtgaaggcaaagcctaagaatgcaccacctcatgataaaactgaacctggtatggagtcggctggggcaacacaactgactgcacccttgctagccagtactgatgaaagggtggatactattattgttgatactgaaagacagcagaacatgcaggttaatagaaataaagcccactcgatgcagccgaatgatacaccgtcaaatgcattggctcagttatcagaggatatggataatggtagtgtcattggtatcatcacactggaagacgtatttgaagaactcttgcaggaggagatagttgatgagacggacgaatatgttgatgtccatcaaaggatccgagtggctgctgcagtcgctgcatcagcagttgcaagggttccatcttatcgaaaattattgagtcaaaagggttcacagggacagggtcagccagggcaacagcctaccggaattctgaagaaacctagtggtgattcaaacaagtcaaaaaataaagtgagccttgttgagcctcttctataaaacgggaggtaattttagatatatcacatcaatgtaaagatggaagaacacaggggtattgggaaacttttttccgttcatgcaatcttcggcaagcaataaatacaagcaaacttgctctgtaaatttcaagtacagcaacatttggtgaccacttttgaaaccactgatcactgaaccataaacataaaactgtttgaaaaaaaaaaaaaaaa

SEQ ID NO: 4200 - protein, 518 aa, Triticum aestivum
  misc_feature: PFam Name: CBS; PFam Description: CBS domain pair
  misc_feature: GI Number: 51536574; NR Description: At4g14240 [Arabidopsis
  misc_feature: GI Number: 42566780; NR Description: CBS domain-containing
  misc_feature: GI Number: 42568492; NR Description: CBS domain-containing
  misc_feature: GI Number: 6959526; NR Description: putative hemolysin
  misc_feature: GI Number: 9280370; NR Description: ancient conserved domain
MSSAGRARAASLAAVAVRMVVGAAARPAPSAALLMAAVRGEDTEFGTALWWAYAAFSALLVLLAGIMSGLTLGLMSLGPVDLEILMRSGTDAEKAQAAAILPVVKKQHQLLVTLLLCNACAMEALPIFLDRIFNPVLAIILSVTFVLAFGEVIPQAICTRYGLAVGASFVWLVRIVMFIAYPIAYPIGKLLDFALGHESALFRRAQLKALVSIHSKAAGKGGELTHDETTIISGALDLTEKTAEEAMTPIESTFSLDVDSKLDWETIGTILARGHSRVPVYSGSPRNVIGLLLVKSLLTVRAEIETPVSAVSIRRIPRVPSDMPLYDILNEFQKGGSHMAAVVKAKPKNAPPHDKTEPGMESAGATQLTAPLLASTDERVDTIIVDTERQQNMQVNRNKAHSMQPNDTPSNALAQLSEDMDNGSVIGIITLEDVFEELLQEEIVDETDEYVDVHQRIRVAAAVAASAVARVPSYRKLLSQKGSQGQGQPGQQPTGILKKPSGDSNKSKNKVSLVEPLL

SEQ ID NO: 4201 - DNA, 1755 bp, Triticum aestivum
  misc_feature (1)..(1755): Ceres cDNA ID no. 21705180
  misc_feature (1)..(1755): Ceres CLONE  ID no. 576015
  misc_feature (1)..(1755): Also known as  Ceres CDNA ID no. 24369006
gaagtttaagcccatttcggaataatgggccattagattaggcgcgcgcccacctccttctagaaccctccagaaccttcctccttccccagcacccccccactccggcgaggagcgcggacgccctcctctcctcatcctccgcgctccagagcgccccggccttcccctccagcggtgggggcagaggagccagccaagggacggccggcggcggcggcgccgggatgaagtacccgcccatcccgccgcgccgggccggcccctgcggctgcggctacctggccgccttcgtcgcgctcatcgtcatcacctcgctccagatccaccaccaccacctcaaggtggatctcggcaggtcggactatgccgcggccaccgccacgcagcagcgggaggggagcggcggcaaggggaaggcggcggcggcccgctggaactggaaccggaggaccggcgccgagggcctgccgcgcgggatcgtccagaccagctccgacatgttcctccgcccgctctgggaccccgccgccaaccgcgccatccccaagaataagaatgatagacacaaagctctcctggcgatggcggtcgggatctcgcagatgcagaatgtggacgtaatggctcgtaagtttctgaacgagagctacacggttatgctgttccattatgacgggaacgtggatgggtggcgtagcctcgagtggagcgataaggccatacacatagttgcgcccaaccaaactaaatggtggtttgccaagcgttttctgcatcctagtgtcgtggctatctacgatttcatctttttatgggatgaagaccttggagtggaaaattttgatccaaggaggtatattgatataatggtgtcggaaggcttagaaatcacgcaacctgcattggatcctgatctatcaacagatattcaccaccgcatcacaattcgcaacaagatgacaaaagtgcataggagagtatatgacaatcgttcaagcatgaactgctctgatgatagtaaaggacctccatgcacagggtgggttgagggcatggcaccagttttttctcgtgctgcctggaaatgtgtatggcatctaatacagaacgacttgattcatggatggggccttgacatgaagcttggttattgtgcccagggtgatcgagctgagaaggtcggcgtaattgacagtgagtatgtcgtccatcaagggataccatcattaggaggaccatcagataccagcaagttacctcgaagatctttggacttgcggacacacattagaagacagtcgtcagcggagctggaaaagttcaaagaacggtgggaaaaagccgtaagggaagatgacgagtggatggatccttttgatgcctgattactctggaagaaacatctgacatgaagatacaaggcccacgatacatgggtggatgcgtccacattcatcatggcggttggagtcgagatcatgtgggcctcatagcaaaacagttagttatatagcctttataggcattttgctgactaacacacaccaccctgccctcaagagctggaagaacaagtgggaaaggcggagaaaccgagcaagaacctgtatactaccagtggccgacagacacagtatcttgtaaccttaattcgattctccaatcaccgaggttgtatagtgacaatgcatatatgtatgtgcagttattttagcaataataagtatttatagtagaaaaaaaaaaaaaaaa

SEQ ID NO: 4202 - protein, 386 aa, Triticum aestivum
  misc_feature: PFam Name: FH2; PFam Description: Formin Homology 2 Domain
  misc_feature: GI Number: 24636978; NR Description: lysine ketoglutarate
  misc_feature: GI Number: 50938415; NR Description: putative lysine ketoglutarate reductase trans-splicing related 1 [Oryza sativa (japonica cultivar-group)] >gi|33146749|dbj|BAC79660.1| putative lysine ketoglutarate reductase trans-splicing related 1 [Oryza
  misc_feature: GI Number: 50902376; NR Description: P0678F11.16 [Oryza sativa (japonica cultivar-group)] >gi|19386727|dbj|BAB86109.1|
  misc_feature: GI Number: 57899847; NR Description: lysine ketoglutarate reductase trans-splicing related 1-like [Oryza sativa (japonica
  misc_feature: GI Number: 9743342; NR Description: F21J9.23 [Arabidopsis thaliana]
MKYPPIPPRRAGPCGCGYLAAFVALIVITSLQIHHHHLKVDLGRSDYAAATATQQREGSGGKGKAAAARWNWNRRTGAEGLPRGIVQTSSDMFLRPLWDPAANRAIPKNKNDRHKALLAMAVGISQMQNVDVMARKFLNESYTVMLFHYDGNVDGWRSLEWSDKAIHIVAPNQTKWWFAKRFLHPSVVAIYDFIFLWDEDLGVENFDPRRYIDIMVSEGLEITQPALDPDLSTDIHHRITIRNKMTKVHRRVYDNRSSMNCSDDSKGPPCTGWVEGMAPVFSRAAWKCVWHLIQNDLIHGWGLDMKLGYCAQGDRAEKVGVIDSEYVVHQGIPSLGGPSDTSKLPRRSLDLRTHIRRQSSAELEKFKERWEKAVREDDEWMDPFDA

SEQ ID NO: 4203 - DNA, 1586 bp, Glycine max
  misc_feature (1)..(1586): Ceres cDNA ID no. 21705181
  misc_feature (1)..(1586): Ceres CLONE  ID no. 576899
  misc_feature (1)..(1586): Also known as  Ceres CDNA ID no. 25891525
aggactagttagtgtcaaaactctctctttcgtctcatcaatcattcaattcaccgatcgttagagaccaagcgtattcgccgcttgatccgacgcaatggacgcgcgcgagccgctccgcccaccgccgcccactatcatggcgggccccacatcctacggttccgccaacatcggccctaattcctccgccaccgtctccgccatgctggcccccgccaccgcgcaattccccttcgccgccgtgccgcaacagcaccagcctcctccctcgtcggagccgttccccgcctccgcatacgacggctcctcctcgccgatgaaggcctgctccctcgccaagaagaagcgcggccggccccggaaatactcgccggacggtaacattgccctccgcctcgctccaacccatgcctcgccgcccgctgctgcctccggaggcggcggcggcggcgattctgccggcatggcgtctgccgatgctccggcgaagaagcaccgcggaaggccacccgggtctgggaagaaacagcttgatgccctcggtgctggtggggttgggtttacgccccacgtgatcttggtggagtctggcgaggacatcacagcaaaaattatggccttttctcagcaagggcctcggacagtttgtattctttctgctattggcgcaattggtaatgtcacccttcaacagtctgcaatgacgggtggtattgctacgtatgagggccgctttgagattatatctttatcaggttctttgcagcaatctgaaaataacagtgaacgcagtagaacatgcactttgaatgtaacccttgcagggtccgatggacgtgttttgggtggcggagttgctggaacgctaattgcagcatcaactgtacaggtcattgtgggcagctttattgcggatgcgaaaaagtcgagctccaatgccctgaaatctgggtcttcttctgcaccaccaccccaaatgctaacctttggttcatccatgaccccaaatagtcctacctctcaagggccttcaactgagtcctctgaggaacaggatcatagtcctttttgtagggggccagggcctgggtctggacatggactctacaataatgctagccagcccgttcataatatgcccatgtaccatcatccactatgggctggccaatctcatcagtaaagaagatgtgacttcggattaacagtgcagaaactgcgtcgtatttagcatgatgcctgttcaaagtagtggctagaggtcaattctaaaatgctaactgcatttttgagactgactttagaacagtctatcttaaggttaaagttcttcagttgattattaggattttttttttatcgtaacatttctagtgatgatagccaaggatatggtgccccttatccgaattctgtcattttgaagattgctgtctgcactatgcagtagcatatagcagaatcagaatgtgctttcctccatgcatcgtgctttattgtttgtggtaaatgctaatcagtgtcactggttaaagaagtaagagtaaaggtttttatttggatgcctaaaaaaaaaaaaaaaa

SEQ ID NO: 4204 - protein, 362 aa, Glycine max
MDAREPLRPPPPTIMAGPTSYGSANIGPNSSATVSAMLAPATAQFPFAAVPQQHQPPPSSEPFPASAYDGSSSPMKACSLAKKKRGRPRKYSPDGNIALRLAPTHASPPAAASGGGGGGDSAGMASADAPAKKHRGRPPGSGKKQLDALGAGGVGFTPHVILVESGEDITAKIMAFSQQGPRTVCILSAIGAIGNVTLQQSAMTGGIATYEGRFEIISLSGSLQQSENNSERSRTCTLNVTLAGSDGRVLGGGVAGTLIAASTVQVIVGSFIADAKKSSSNALKSGSSSAPPPQMLTFGSSMTPNSPTSQGPSTESSEEQDHSPFCRGPGPGSGHGLYNNASQPVHNMPMYHHPLWAGQSHQ

SEQ ID NO: 4205 - DNA, 979 bp, Glycine max
  misc_feature (1)..(979): Ceres cDNA ID no. 21705182
  misc_feature (1)..(979): Ceres CLONE  ID no. 580564
  misc_feature (1)..(979): Also known as  Ceres CDNA ID no. 24366488
aaaaacgacgaagtggtggaggatgttgcgaagggataacatcactcactcccacccaaaagaatcaagaagagaagaaaagcaaagaggaagaagacacagaaggagaggttcaacatcttcttcatctatggcgacgccggattctgacgctaccactcagcctcaagattccgacactgctcccaattccagtcctcccaacgccctcgtccccgccgctcccgccgtttgcctccttcgcttcgccaccgactccgccggcggcgctctcatgggctccgtctttggatacggtgctggattgtttaagaagaaaggttttaaaggatcctttgtagaagcagggtcttatgcaaagacatttgcagttttgtctggagttcatagtttggttgtttgcatcttgaaaaggcttagaggaaaagatgatgtcattaatgcgggtgttgctggatgttgcactggtcttgctctaagttttccaggtgcaccacaagctcttctgcagagctgtctcacttttggggcattttcttttatcatggaagggctaaacaagcagcaaccagcacttgcagttcccatgtcctggaaaaaaactgtgcaacacaatgcatgtcctcccttggtactcccccttcaactctctcttccagacgaactaaaagatgccttctcctttttctccgagtctttgaagaagcgcagcaagggaccttatcctacatcttgataagaaattaggatatcacgattttctagcatctgtagataagatgtgcaccctttgccattttaacttttaggctccttgtatcgtttgtcaacatttctttttgatgaacttaattaagggtgacatcaaattgtccaaggacatgggttgtttacttgcttctgagttccaatatggcatcttaattctaccatgttctttcttggtggtttgttgaaaaaaaaaaaaaaaaaaaaaaaa

SEQ ID NO: 4206 - protein, 201 aa, Glycine max
  misc_feature: PFam Name: Tim17; PFam Description: Tim17/Tim22/Tim23 family
  misc_feature: GI Number: 50897226; NR Description: At5g55510 [Arabidopsis thaliana] >gi|46931218|gb|AAT06413.1| At5g55510 [Arabidopsis
  misc_feature: GI Number: 21593873; NR Description: unknown [Arabidopsis thaliana] >gi|20857097|gb|AAM26699.1| AT4g26670/F10M23_10 [Arabidopsis thaliana] >gi|15294264|gb|AAK95309.1| AT4g26670/F10M23_10 [Arabidopsis thaliana]
  misc_feature: GI Number: 42568553; NR Description: mitochondrial import inner membrane translocase subunit Tim17/Tim22/Tim23 family protein
MATPDSDATTQPQDSDTAPNSSPPNALVPAAPAVCLLRFATDSAGGALMGSVFGYGAGLFKKKGFKGSFVEAGSYAKTFAVLSGVHSLVVCILKRLRGKDDVINAGVAGCCTGLALSFPGAPQALLQSCLTFGAFSFIMEGLNKQQPALAVPMSWKKTVQHNACPPLVLPLQLSLPDELKDAFSFFSESLKKRSKGPYPTS

SEQ ID NO: 4207 - DNA, 1715 bp, Glycine max
  misc_feature (1)..(1715): Ceres cDNA ID no. 21705183
  misc_feature (1)..(1715): Ceres CLONE  ID no. 580825
  misc_feature (1)..(1715): Also known as  Ceres CDNA ID no. 24366476
atttttgttgcacggtttgagtcctgaatcctagtggccgatctatgttgttccatcttgcaactccttcttctattcccactgccattttttttctttccaacacaacacaacaaacgcagtacataacaacttttgttaccttagcgccgccacaccaacatgccagccttcgccatttccaacaacgccgccgccgccacgtggaaaattccccaattcaacacttgtcactttcctcacaccccatccatcgttctccaccattctctcctcaacacccgcgctttcaggatccactgtgtcccccaagaacccctcccctcattgcaacaaaccaaacacgatcaaccctcttccagtggcggcggaggtcacggtgacgctgacggcgatggtggcggcggcggcggcggcggagacggagacggaggtcaaggaggaggagatgaagagttcggacccttgttgaagtttgaagccgttatgagagaatcgaaagctcgtggtgtcaagttgcctccggatatggaggaggctgcgaggatcactggcattcgggaaatgtttcttcttcgttacatggagttgcagggttcgtcttggccagtgtcttttctgatccagcattgtgctatgctgagaaatcgaatgctagctgacccttcttttcttttcaaagttggaaccgagattgttatagactcttgttgtgcaacccttgcggaggttcagaagagaggcaagaatttctgggctgaatttgagttgtacgctgctgatcttctggttggagtggttgttgacattgctttagtgggtctattagcaccatatgctcgaattggcaagccttctttttcaaaaggtttgcttggacaaattcagcatgcttgtgctgctcttcctagcagtgtttttgaagctgaaagaccaggatgtaaattctctgtgatgcagcgcgtatctacatacttctacaagggtgcattgtatggatcagttggctttggatgtggtattattggtcaaggaattgcaaatatgatcatgaatgccaaaaggagctttaagaaatctgaacatgacatacctgtgcctcctcttctgcaaagtgctgctctttggggattctttcttgctgtgtcatccaacacacgttatcaaataatcaacggactagaaagccttgttgaagcatctcccgtggcaaagagggtcccacttgttgcaatggcattcactgtgggtgtgagatttggcaacaacatctatggtggcatgcagttcgtagactgggccaaatggagtggcgtacaatgagtgaagctaggcaatttcgccttttttgaaagttttattacccaaagttggctaggctattcttgtccctttctttctcaaatcaaggagtgaagctccccaccaatttttcatatgtagggcatctttcttgtgattaaaattggaccatgcccccctttactcttgattcctcctgctttttcttttcttcaatctttttcacatttttattttcattgttatcctatgttatactataacttagttgtgtcagatatgttcaagggaagttaaggtttttataactaggcatggtagtattaaagttaagctgaccatgtttttgtttgggtaccgatctaagcatcggaaaatataattttgcatttacttcaaaaaaaaaaaaaaaa

SEQ ID NO: 4208 - protein, 386 aa, Glycine max
  misc_feature: PFam Name: GRP; PFam Description: Glycine rich protein family
  misc_feature: PFam Name: Acyl-CoA_dh_M; PFam Description: Acyl-CoA
  misc_feature: GI Number: 57834123; NR Description: OSJNBb0065J09.14 [Oryza
  misc_feature: GI Number: 6934300; NR Description: unknown [Euphorbia esula]
  misc_feature: GI Number: 32489853; NR Description: OSJNBb0065J09.13 [Oryza
  misc_feature: GI Number: 34909204; NR Description: P0425G02.25 [Oryza sativa (japonica cultivar-group)] >gi|18844779|dbj|BAB85250.1| P0425G02.25 [Oryza sativa (japonica cultivar-group)] >gi|20161467|dbj|BAB90391.1| P0432B10.9 [Oryza sativa (japonica
  misc_feature: GI Number: 20857082; NR Description: At2g40400/T3G21.17 [Arabidopsis thaliana] >gi|4586056|gb|AAD25674.1| chloroplast lumen common protein family [Arabidopsis thaliana] >gi|15294188|gb|AAK95271.1| At2g40400/T3G21.17 [Arabidopsis
MPAFAISNNAAAATWKIPQFNTCHFPHTPSIVLHHSLLNTRAFRIHCVPQEPLPSLQQTKHDQPSSSGGGGHGDADGDGGGGGGGGDGDGGQGGGDEEFGPLLKFEAVMRESKARGVKLPPDMEEAARITGIREMFLLRYMELQGSSWPVSFLIQHCAMLRNRMLADPSFLFKVGTEIVIDSCCATLAEVQKRGKNFWAEFELYAADLLVGVVVDIALVGLLAPYARIGKPSFSKGLLGQIQHACAALPSSVFEAERPGCKFSVMQRVSTYFYKGALYGSVGFGCGIIGQGIANMIMNAKRSFKKSEHDIPVPPLLQSAALWGFFLAVSSNTRYQIINGLESLVEASPVAKRVPLVAMAFTVGVRFGNNIYGGMQFVDWAKWSGVQ

SEQ ID NO: 4209 - DNA, 1278 bp, Glycine max
  misc_feature (1)..(1278): Ceres cDNA ID no. 21705184
  misc_feature (1)..(1278): Ceres CLONE  ID no. 581694
  misc_feature (1)..(1278): Also known as  Ceres CDNA ID no. 24367273
ggattcatcgtattgttatcatcccttgcaatccatgtttctgtttctaccaccaaagcatgaagttctgcaagacctaccagcagtacatgcaaggacatggccacaacaagctcccttctgttggcttcaagaacctaaaaaagatcattaaaagctgcaggagagcctccactcaacctacctgccctgatcattgcccagtgtgcgatgggacctttttcccttcccttctcaatgaaatgtcagatatagtagggtgctttaatcagcgcgcgcagcaattgctggaactacatcttgcttctggcttcagaaagtactttctcatgttgaaaggaaaattacacaagaatcatactgctctaatcgaagaaggaaaagatctagtcatatatgcactcataaattccatcgcaattcgaaaaatcttgaagaaatatgataagattcattattccaagcaaggccaattattcaagtcgaaagtccagaccatgcacaaggaaattcttcaaagtccctggctttgtgagcttattgccttacacattaacttaagggaaacaaaatccaagccaagggaggcatccgcactgtttgatggatgttatctcacattcacggatggaaaaccatcacttacttgtgagctctttgattccgtcaaaattgatattgacttgacctgctctatatgcttggatacagtgtttgattcagtttctctgacatgcggccacatattctgctacacctgtgcttgctcaactgcatcagttaccattgtcgatggacttaaggcagcaaatcctaaagaaaaatgtcctctatgccgagagggaagagtttacgaagatgctgtgcatttggaagaattaaatattctgctaggccgaagctgcagggagtactgggagcaaaggcttcagatggagagggtagagagggttaagcaagttaaggagcactgggaaacgcagtgtagggcgttcatgggcatctaaaaataaatataaacaaatgttcactttctctttcatttccctattcgtctcgttttcacactcatctcatgacactttggggtgtaagtttacccaacatctaaacacgatcaacttctcttgggtatggtagttttcggttgaaatgtctgtgtgttgtttgatcttgtatcttagcagtagcatttctaagttgtttattggtagtgttcgtacttgactctcttcaatgtaaataaaggcttctactttaggaaaaaaaaaaaaaaaa

SEQ ID NO: 4210 - protein, 315 aa, Glycine max
  misc_feature: PFam Name: SPX; PFam Description: SPX domain
  misc_feature: PFam Name: zf-C3HC4; PFam Description: Zinc finger, C3HC4
  misc_feature: GI Number: 21618082; NR Description: unknown [Arabidopsis thaliana]
MKFCKTYQQYMQGHGHNKLPSVGFKNLKKIIKSCRRASTQPTCPDHCPVCDGTFFPSLLNEMSDIVGCFNQRAQQLLELHLASGFRKYFLMLKGKLHKNHTALIEEGKDLVIYALINSIAIRKILKKYDKIHYSKQGQLFKSKVQTMHKEILQSPWLCELIALHINLRETKSKPREASALFDGCYLTFTDGKPSLTCELFDSVKIDIDLTCSICLDTVFDSVSLTCGHIFCYTCACSTASVTIVDGLKAANPKEKCPLCREGRVYEDAVHLEELNILLGRSCREYWEQRLQMERVERVKQVKEHWETQCRAFMGI

SEQ ID NO: 4211 - DNA, 1772 bp, Triticum aestivum
  misc_feature (1)..(1772): Ceres cDNA ID no. 21705185
  misc_feature (1)..(1772): Ceres CLONE  ID no. 584862
  misc_feature (1)..(1772): Also known as  Ceres CDNA ID no. 24368677
gagctgcctcccactcccccccgtgccctcttcccgggccgccgcccggttccaccgctctcccccgcccgccgtggtcgcccgggtctcagcgacgatgtctcccgcctccgcgcgcgccctcaccgtcgactctctgaacccaaaggtgctggcgctcgcggatcacctcgggggcgccgtcgcccgccgcgcggagcgcatgcaaaaagagctagaaacaaatccaggtttataccctttcaatgagataatctattgcaaccttagcaatccacattatctcggacaacagccaattaagttcttccgtgaggttcttgccttgtgtgattacccgcatcttctaaactgcagtgtaactagttccatattcagttctgatgcaataacaagggcaagggagattctagacctcattcctgggagagcaatgggaggatacagccactgtcagggtactgaagggttgcgaaatgcaattgctgctggaatagccactcgtgatgctttcccatgcaatgcagaggacattttcctgacagatggagcagccgcgccggttcatatggtaatgcacctgttgatacgagatgaaaaagatggcatcctttgcccgattccatcacacttcctttatacaagctcaatggctctgtgtggcgcaactcttgtaccatattaccttgacgaatcaggaggttgggccgtgagtatttcgaacctgaagaagcagctggatggtgcccgatctgaaggcatcactgttaggggacttgtggttgtaaatccaggcaatcctactgggcaggttcttgtgaaggaaaaccagtgtgaaatagtggaattctgcaggaatgaaaaccttgttcttctagcagatgaggtttaccaagaaaatgtttacacagatgaaaagaaatttatctctttcaagaagatagcacggtccatgggttttggtgaagaagatatttctttaatatcattccattcagtttctaatggatactatggagaatgtgggagaagagggggttacatggaggtcactggcttcaattctgaagttcggaaacaagtatacaaagtggcatccctaagctcatgctccaacttagccggccaggttctcgtgagcctagtcatgaacccaccaaaggttggagatgagtcatacacctcttaccgggaagaaagagatcgcattatgttatcgttatcccgatgtgcagaggccatggtgcaggcattcaacagcctggaaggcctgacttgcagcaaggctgaaggggcaatgtttgtatttccatctgttcggctgcctaaaagggcgattgcggctgctgaggcaatgaacgccaagccagatgtgttctacgctctccgccttcttgaaaacactggcatcgtcgtcttgcctggttctgtgtttggacaagtacctggcgcatggcatttcagatgcacaatcctgcaacaggaggagaaagtacaactgataatctatcgctttaaggcgttccacaaagctttcatggaagaatttcgcgattaaaagtcgccagcttattttatctgtagcacaactttagaagtccggacagaaaaaacatgagctttgtaaactgtcagttacatgatttatgtctggaacaattgagtttttcctttgtatcattctgaagttaatctaaaacttatcctttgcaaaaaataaaaaacttatcaattttaaatcaaaaaaaaaaaaaaaaaaaaaaaaaaaaaaa

SEQ ID NO: 4212 - protein, 1772 aa, Triticum aestivum
  misc_feature: PFam Name: Aminotran_1_2; PFam Description: Aminotransferase
  misc_feature: GI Number: 8778976; NR Description: Strong similarity to alanine aminotransferase from Zea mays gb|AF055898. It contains an aminotransferases class-I domain PF|00155. ESTs gb|AV546814, gb|AV519234, gb|AV536176, gb|AV537339, protein T13M22.3
  misc_feature: GI Number: 9082270; NR Description: alanine aminotransferase
  misc_feature: GI Number: 37953301; NR Description: alanine aminotransferase
  misc_feature: GI Number: 469148; NR Description: alanine aminotransferase [Hordeum vulgare subsp. vulgare] >gi|1703227|sp|P52894|ALA2_HORVU Alanine aminotransferase 2 (GPT) (Glutamic--pyruvic transaminase 2)
  misc_feature: GI Number: 296204; NR Description: alanine aminotransferase [Panicum miliaceum] >gi|461498|sp|P34106|ALA2_PANMI Alanine aminotransferase 2 (GPT) (Glutamic--pyruvic transaminase 2) (Glutamic--alanine transaminase 2) (ALAAT-2)
GAGCTGCCTCCCACTCCCCCCCGTGCCCTCTTCCCGGGCCGCCGCCCGGTTCCACCGCTCTCCCCCGCCCGCCGTGGTCGCCCGGGTCTCAGCGACGATGTCTCCCGCCTCCGCGCGCGCCCTCACCGTCGACTCTCTGAACCCAAAGGTGCTGGCGCTCGCGGATCACCTCGGGGGCGCCGTCGCCCGCCGCGCGGAGCGCATGCAAAAAGAGCTAGAAACAAATCCAGGTTTATACCCTTTCAATGAGATAATCTATTGCAACCTTAGCAATCCACATTATCTCGGACAACAGCCAATTAAGTTCTTCCGTGAGGTTCTTGCCTTGTGTGATTACCCGCATCTTCTAAACTGCAGTGTAACTAGTTCCATATTCAGTTCTGATGCAATAACAAGGGCAAGGGAGATTCTAGACCTCATTCCTGGGAGAGCAATGGGAGGATACAGCCACTGTCAGGGTACTGAAGGGTTGCGAAATGCAATTGCTGCTGGAATAGCCACTCGTGATGCTTTCCCATGCAATGCAGAGGACATTTTCCTGACAGATGGAGCAGCCGCGCCGGTTCATATGGTAATGCACCTGTTGATACGAGATGAAAAAGATGGCATCCTTTGCCCGATTCCATCACACTTCCTTTATACAAGCTCAATGGCTCTGTGTGGCGCAACTCTTGTACCATATTACCTTGACGAATCAGGAGGTTGGGCCGTGAGTATTTCGAACCTGAAGAAGCAGCTGGATGGTGCCCGATCTGAAGGCATCACTGTTAGGGGACTTGTGGTTGTAAATCCAGGCAATCCTACTGGGCAGGTTCTTGTGAAGGAAAACCAGTGTGAAATAGTGGAATTCTGCAGGAATGAAAACCTTGTTCTTCTAGCAGATGAGGTTTACCAAGAAAATGTTTACACAGATGAAAAGAAATTTATCTCTTTCAAGAAGATAGCACGGTCCATGGGTTTTGGTGAAGAAGATATTTCTTTAATATCATTCCATTCAGTTTCTAATGGATACTATGGAGAATGTGGGAGAAGAGGGGGTTACATGGAGGTCACTGGCTTCAATTCTGAAGTTCGGAAACAAGTATACAAAGTGGCATCCCTAAGCTCATGCTCCAACTTAGCCGGCCAGGTTCTCGTGAGCCTAGTCATGAACCCACCAAAGGTTGGAGATGAGTCATACACCTCTTACCGGGAAGAAAGAGATCGCATTATGTTATCGTTATCCCGATGTGCAGAGGCCATGGTGCAGGCATTCAACAGCCTGGAAGGCCTGACTTGCAGCAAGGCTGAAGGGGCAATGTTTGTATTTCCATCTGTTCGGCTGCCTAAAAGGGCGATTGCGGCTGCTGAGGCAATGAACGCCAAGCCAGATGTGTTCTACGCTCTCCGCCTTCTTGAAAACACTGGCATCGTCGTCTTGCCTGGTTCTGTGTTTGGACAAGTACCTGGCGCATGGCATTTCAGATGCACAATCCTGCAACAGGAGGAGAAAGTACAACTGATAATCTATCGCTTTAAGGCGTTCCACAAAGCTTTCATGGAAGAATTTCGCGATTAAAAGTCGCCAGCTTATTTTATCTGTAGCACAACTTTAGAAGTCCGGACAGAAAAAACATGAGCTTTGTAAACTGTCAGTTACATGATTTATGTCTGGAACAATTGAGTTTTTCCTTTGTATCATTCTGAAGTTAATCTAAAACTTATCCTTTGCAAAAAATAAAAAACTTATCAATTTTAAATCAAAAAAAAAAAAAAAAAAAAAAAAAAAAAAA

SEQ ID NO: 4213 - DNA, 1362 bp, Glycine max
  misc_feature (1)..(1362): Ceres cDNA ID no. 21705187
  misc_feature (1)..(1362): Ceres CLONE  ID no. 599361
  misc_feature (1)..(1362): Also known as  Ceres CDNA ID no. 24428735
ctctgttagaagatagaagaagaaatatcttgttgcgtgttgcgatatcataacatcgatggcctccatcatccaaatctcacaatgtcgtcaactcttctcccagtgacagcaactcccattttcactctcaccaaaaccctccctctccccaaaccctacctactctcctataaattcaaattcaacaccctcgtccgccgctgctccctctccgaccacgaggagcagcgctggctccgcgaagagcagcgctggctccgcgacgaacaccgctggctccgtgaggagcagcgctgggctcgcgagcgcgaccaactcctccgcgagatcgccgacctcaagctccaaatccaggcgctggagcgtcgcctcttgacgcgcgatttgtcctctccggcttccatctccgacgccgtcgccaatgtcacgttgctcttgcaggtgctcaaggacaagaatctggttctcgagagcggttcgagcctgcggaacacggaggaggtgaagcaattggaagaggtcgtcgaacatgtgaaggaggttgtggtggttgaggaatctgctagggttgaaaagaggatctcgttgcggataggttccgaaggtgaagaggttcgacagatgcaggaagcattgttgaaattggggttttactctggcgaggaagacatggagtattccagcttctcaagtggaaccgagcgtgctgtgaagacttggcaagctgcattaggtgctcctgaggatggtatcatgacagctgaacttcttgaaaggttgtatttggagataaggaataaggacaccggcagtgcgactcaagacaaacaatctactactgttttgccaaaggaagttgaaaatggagctgcagttgcttcagtggcagaaaattcagagggtcagcaaaaagatgtgaaaagtgataagggaacagaagtctcccaccggggagtttttctccttggagagaatcggtgggaagaaccatcaagacttttcacaaggaatggagttgataggagcaagaacaaggatgtaacgacaaaatgccttcaatgtcgtggggaaggtcgcttgctgtgtacagaatgtgatggatctggcgagccaaatattgaacctcaatttttggaatgggtggacgagggtacaaaatgcccatattgtgaaggcctagggtatactgtatgtgatctatgtggagggaaaacaatggtataggtatgacatacatttctagttcatcgtttcatactcaggcatgtaattatcagtatcattgcatcacaaaattttgtatagtatgctatttaatcatcaaaactgggaaataggaacttaaaaaaaaaaaaaaaa

SEQ ID NO: 4214 - protein, 380 aa, Glycine max
  misc_feature: PFam Name: PG_binding_1; PFam Description: Putative
  misc_feature: GI Number: 30682566; NR Description: peptidoglycan-binding
MSSTLLPVTATPIFTLTKTLPLPKPYLLSYKFKFNTLVRRCSLSDHEEQRWLREEQRWLRDEHRWLREEQRWARERDQLLREIADLKLQIQALERRLLTRDLSSPASISDAVANVTLLLQVLKDKNLVLESGSSLRNTEEVKQLEEVVEHVKEVVVVEESARVEKRISLRIGSEGEEVRQMQEALLKLGFYSGEEDMEYSSFSSGTERAVKTWQAALGAPEDGIMTAELLERLYLEIRNKDTGSATQDKQSTTVLPKEVENGAAVASVAENSEGQQKDVKSDKGTEVSHRGVFLLGENRWEEPSRLFTRNGVDRSKNKDVTTKCLQCRGEGRLLCTECDGSGEPNIEPQFLEWVDEGTKCPYCEGLGYTVCDLCGGKTMV

SEQ ID NO: 4215 - DNA, 1326 bp, Glycine max
  misc_feature (1)..(1326): Ceres cDNA ID no. 21705188
  misc_feature (1)..(1326): Ceres CLONE  ID no. 604897
  misc_feature (1)..(1326): Also known as  Ceres CDNA ID no. 24367394
ataaatatacttctaagttataacctattaagctcgtaatcaaacagcaccgaaacgtaacaatgccaacactctcatccaaacccccctttaccaattacccggtcggcgccgccgcggccaccacccttctcttccttttcttcgccgtcggaatttccacggtcctcgctagcaaccaccacgtcatcaatttccggtccccgaacctcttcccggagggcctggcgtgggacccgacagcgcagcacttcctggtcggatccctccgccaccgcacgatctccgccgtctccgacgccggcgtggtcgaaaccctaatctccgacccctccctcccggaaaacgtcaccttccttggcctcgccgtggactcccgcaacaaccgcgtcctcgtggcgatccacgccacggagcccctccctccgttcaacgcgctcgccgcctacgacctccgctcccgccgccgcctcttcctctcccccctcccctccgccgccggcgatgacaaacgcgccaccgcgaacgacgtcgctgcagacttcaacggcaacgcctacgtcaccaattctgtaggaaactacatctggaaggttaatctcaacggagaagcttcgattttatcaaattccccgaagttcaccgtacaccccgtggtacgcgacacagtgtatagcttctgcggcctaaacggcatcgtttacaacaacaagggctatctattggtggtgcaatccaatacgggaaagatgtttaaaatcgataaggacgatgggactgtgagacaagtgcttctcaacgaggatctaatgggcgctgacggagttgccttgaggggagacggcgtcgttttggtggtgtcctttagcaaattgtggtttgtgaagagtaatgatgggtgggcccagggtgcggtgtttgacaagattgaccttgacgaggaggggtttcccacttcggttgtagtgggggagagggacagggcgtacgtgctgcacgggcgtgtgatggagggcattttggggaattcggagagggagagttttatgatagaggaggtgaagtcgccgaaggagagtgagggggagaatgtttggttgtatgttatggttggaattgggttggcttatttcttgttttggaggtttcagatgaagcagctcgtgaagaacatggacaagaaaatcaactgatgatttgttgtttggaaacattgtactttacgctcagttttttttgtttgttagatttgtagaagtgaaatcatattatttatatatgtgcctttgaaattatcgtattaaaaaaaaaaaaaaaaaaaaaaaa

SEQ ID NO: 4216 - protein, 376 aa, Glycine max
  misc_feature: PFam Name: Pyr_redox_2; PFam Description: Pyridine
  misc_feature: PFam Name: Drf_FH1; PFam Description: Formin Homology Region 1
  misc_feature: PFam Name: Extensin_2; PFam Description: Extensin-like region
  misc_feature: PFam Name: FH2; PFam Description: Formin Homology 2 Domain
  misc_feature: PFam Name: Mucin; PFam Description: Mucin-like glycoprotein
  misc_feature: GI Number: 34912468; NR Description: P0704D04.8 [Oryza sativa
  misc_feature: GI Number: 188864; NR Description: mucin
  misc_feature: GI Number: 46226738; NR Description: uncharacterized secreted protein with thr rich regions, possible mucin [Cryptosporidium
  misc_feature: GI Number: 186396; NR Description: mucin
  misc_feature: GI Number: 2135765; NR Description: mucin 2 precursor,
MPTLSSKPPFTNYPVGAAAATTLLFLFFAVGISTVLASNHHVINFRSPNLFPEGLAWDPTAQHFLVGSLRHRTISAVSDAGVVETLISDPSLPENVTFLGLAVDSRNNRVLVAIHATEPLPPFNALAAYDLRSRRRLFLSPLPSAAGDDKRATANDVAADFNGNAYVTNSVGNYIWKVNLNGEASILSNSPKFTVHPVVRDTVYSFCGLNGIVYNNKGYLLVVQSNTGKMFKIDKDDGTVRQVLLNEDLMGADGVALRGDGVVLVVSFSKLWFVKSNDGWAQGAVFDKIDLDEEGFPTSVVVGERDRAYVLHGRVMEGILGNSERESFMIEEVKSPKESEGENVWLYVMVGIGLAYFLFWRFQMKQLVKNMDKKIN

SEQ ID NO: 4217 - DNA, 1638 bp, Triticum aestivum
  misc_feature (1)..(1638): Ceres cDNA ID no. 21705190
  misc_feature (1)..(1638): Ceres CLONE  ID no. 615712
  misc_feature (1)..(1638): Also known as  Ceres CDNA ID no. 23725293
atagatggatgccgcggtgcacgttctcgtgttcccttggccacggcagggacacatcaatcccatgctccagttcgccaccgccctcgtcgacgttggcgtccaagtcacgttcctccacaccgagcacaacctccgccgtctcgcccaggcgcatccgccgggcctacgcttgctatccatctccgacggcctccccgacgagcacccccgcggcttcttggcgttcatggagtccatgtgcacggcgggcagcgccgcataccgtgccctgctcttgtcgcttgtctgtgctgctgatgcgccagtgacatgcgttgtcgctgatggcaccatgccgttcgccatcgaaatccccgaggagctcggcatccccgcgctctccttcgtcacgcacagcgcgtgcagctacctagcgttcctgtgtatgcccaagctcgtcgagctcggcgagactcccttcactgcggacgacctggtttctagcgttccggggatggagcgcttcctccggcgacgagatcttcctcgtgggctctactgcaccgagcaaggcgacggtgatcccttggtgctcaagttcgccgaggccgtcggtcgtaccagcaaggcatgtgcgctcatattcaacaccgccgcgtccatggagcggccagcgctcgcccacgtcgcgtcgggcacaagcgacgtcttcgctataggcccactgcacgccaggtcgagttccgccgcaagcccaagcctgtggcgggaggacgacggatgcatggcgtggctggacggccacgaggaccggtccgtcgtatacgtgagcctggggagcctcgccgtgatcacgcacgcgcagttcaccgagttcctctccggcctggccgccacggggtacgccttcctctgggctctccggccgggcatggtccagacgaccagccccgctctcctccgagaagcagtcggggcagcgggaggcaaggggcgcgtcgtcgagtgggctcctcagcgggacgtgttgcggcaccgggcggtgggttgctttctgacacacgccggatggaactcgacgctggagtgcgccgtcgagggcatgccgatggtgtgctggcccttcttcgtcgaccagcagaccaacagccgcttcgtgggcgccgtctggaggacggggctggacatgaaggacgtctgccagagaggggtcgtggagaggacggtgagagaggccatggcatccgacgagatcagggcagcggcccaagccatggcgcagcagttgaggctggatgttgcggagacggggtcgtcgtcgtcggagttggagcgtctcgtccgcttcatcagggagctcagcgtcagatcctcctcaagcccagaattattggaaactagcacaagctgcagaggtctctcatttacatctcactactactactaatttacgagacacgtggtcctgtaaaacgaacacattgtttagtggtatctccaaatcttgagttgtgtagaccgatcatgtttttgttatttgccatccatgcttcctcatggcagtggtctggtggacatggtgttggacttggatcatcacaattattattatttctctccccatcaccacccactggctcaaaaaaaaaaaaaaaa

SEQ ID NO: 4218 - protein, 474 aa, Triticum aestivum
  misc_feature: PFam Name: UDPGT; PFam Description: UDP-glucoronosyl and
  misc_feature: GI Number: 50937263; NR Description: putative glucosyltransferase-2 [Oryza sativa (japonica cultivar-group)] >gi|33146987|dbj|BAC80059.1| putative glucosyltransferase-2 [Oryza
  misc_feature: GI Number: 50937251; NR Description: putative glucosyltransferase-12 [Oryza sativa (japonica cultivar-group)] >gi|33146981|dbj|BAC80053.1| putative glucosyltransferase-12 [Oryza sativa (japonica cultivar-group)]
  misc_feature: GI Number: 50937197; NR Description: putative glucosyltransferase-2 [Oryza sativa (japonica cultivar-group)] >gi|28564775|dbj|BAC57706.1| putative glucosyltransferase-2 [Oryza
  misc_feature: GI Number: 50937225; NR Description: putative UDP-glucose glucosyltransferase [Oryza sativa (japonica cultivar-group)] >gi|50937205|ref|XP_478130.1| putative glucosyltransferase-2 [Oryza
  misc_feature: GI Number: 50937249; NR Description: putative UDP-glucose glucosyltransferase [Oryza sativa (japonica cultivar-group)] >gi|34394122|dbj|BAC84378.1| putative UDP-glucose
MDAAVHVLVFPWPRQGHINPMLQFATALVDVGVQVTFLHTEHNLRRLAQAHPPGLRLLSISDGLPDEHPRGFLAFMESMCTAGSAAYRALLLSLVCAADAPVTCVVADGTMPFAIEIPEELGIPALSFVTHSACSYLAFLCMPKLVELGETPFTADDLVSSVPGMERFLRRRDLPRGLYCTEQGDGDPLVLKFAEAVGRTSKACALIFNTAASMERPALAHVASGTSDVFAIGPLHARSSSAASPSLWREDDGCMAWLDGHEDRSVVYVSLGSLAVITHAQFTEFLSGLAATGYAFLWALRPGMVQTTSPALLREAVGAAGGKGRVVEWAPQRDVLRHRAVGCFLTHAGWNSTLECAVEGMPMVCWPFFVDQQTNSRFVGAVWRTGLDMKDVCQRGVVERTVREAMASDEIRAAAQAMAQQLRLDVAETGSSSSELERLVRFIRELSVRSSSSPELLETSTSCRGLSFTSHYYY

SEQ ID NO: 4219 - DNA, 1371 bp, Triticum aestivum
  misc_feature (1)..(1371): Ceres cDNA ID no. 21705191
  misc_feature (1)..(1371): Ceres CLONE  ID no. 615928
  misc_feature (1)..(1371): Also known as  Ceres CDNA ID no. 24368730
aaaaaaacaacactagctgaggctgcggcggcgacccacctctttcttgtctggttgcggagcggccggcggcgaggatggtggttcgcctcctcttcctcctcctgcccctcctcttcctcctcctgcccctcgcttgctccctcctcttcctcgagctcccctcggtctcaggcaaaccaactgtccatgatgacttggatccagctcaagtgaccaacccgaccacgcccatcacagtcccatcgacgaacccaacaccaacaatcatcaccgtgccgtccacaaaccctaccatcacaatcccttcattaaaccctttgcccacacctatcacaaccccctcaaacgacccttctaccacattaccattgccaaccccttcgacatctgcacccaacacgccagtcaccattcctgttaccaccccttcgacattccccccatcggcaccactgacaaacccagcgacgaacccaatggtgcctactgtcggcactacaccgcctacttctccgaccactactccagtcacagctcctgttgtgtcagggcagcaagcctggtgcgtggccaaggccggctcatcacaaaccgcgctccaggacgcactggactatgcgtgcggtattggtggagcagattgctcaccaatacagccatcagggagctgctattatccaaataccttggaagcccatgcgtcatacgccttcaacagctattaccagaagaaccctgcaccctccagctgcgactttaggggtgccgcaatgcttgccaatgctaatccaagctcagcaacctgtgtattggcatcatcaatgtcttctccaacgagctctactgctggatccactgctcctactacatcatccactagccctgttactagttcatctgattctgatccaggatcatcagtactgaactcgagtggctcaggcatttctggatcatcagactttgggtcggacttcccaggagaggccaacactggcaatggttggcactcaatcttgccctctggctggtcctgggcaggtttgttctcaacgcttgcattgccatacgttggagggatattttgaagaacgaagctgctccagaattttggaaactgtgagagttgaagtggtggcaaagatttagagttttgcctttagctgtagtggttgtatcctgtatgagtagaccagagttgtgtgctagtaggaagtaggcttattgcctgtattaaccagtggatgtagtttctaggtgtatcaaatcaaatgttgattatgtgcacttctgctcttgcaagttgttgtattttgctcagtttgaatgtgtgatttaaacttgaagcagctaaaaaaaaaaaaaaaa

SEQ ID NO: 4220 - protein, 337 aa, Triticum aestivum
  misc_feature: PFam Name: X8; PFam Description: X8 domain
  misc_feature: PFam Name: Mucin; PFam Description: Mucin-like glycoprotein
  misc_feature: PFam Name: Drf_FH1; PFam Description: Formin Homology Region 1
  misc_feature: PFam Name: MSA_2; PFam Description: Merozoite Surface
  misc_feature: PFam Name: Pyr_redox_2; PFam Description: Pyridine
  misc_feature: GI Number: 50919911; NR Description: putative glucanase [Oryza sativa (japonica cultivar-group)] >gi|40714691|gb|AAR88597.1| putative glucanase [Oryza sativa
  misc_feature: GI Number: 22329437; NR Description: glucan
  misc_feature: GI Number: 34912962; NR Description: beta-1,3 glucanase-like protein [Oryza sativa (japonica cultivar-group)] >gi|20161490|dbj|BAB90413.1| beta-1,3 glucanase-like protein [Oryza
  misc_feature: GI Number: 57899559; NR Description: glycosyl hydrolase
  misc_feature: GI Number: 22328593; NR Description: glycosyl hydrolase
MVVRLLFLLLPLLFLLLPLACSLLFLELPSVSGKPTVHDDLDPAQVTNPTTPITVPSTNPTPTIITVPSTNPTITIPSLNPLPTPITTPSNDPSTTLPLPTPSTSAPNTPVTIPVTTPSTFPPSAPLTNPATNPMVPTVGTTPPTSPTTTPVTAPVVSGQQAWCVAKAGSSQTALQDALDYACGIGGADCSPIQPSGSCYYPNTLEAHASYAFNSYYQKNPAPSSCDFRGAAMLANANPSSATCVLASSMSSPTSSTAGSTAPTTSSTSPVTSSSDSDPGSSVLNSSGSGISGSSDFGSDFPGEANTGNGWHSILPSGWSWAGLFSTLALPYVGGIF

SEQ ID NO: 4221 - DNA, 1284 bp, Triticum aestivum
  misc_feature (1)..(1284): Ceres cDNA ID no. 21705192
  misc_feature (1)..(1284): Ceres CLONE  ID no. 616810
  misc_feature (1)..(1284): Also known as  Ceres CDNA ID no. 24368718
ctctaaaagcaccggacgccgacgccacgtaccggagcacccaccagactcctcctccgcaactcagctcagctccctcccccactctccccgcagcgagcgagcgagcgagcgatcggcgatgaagaagtgcgcgtcggagctggagctggaggccttcatccgcgggcgggggctcgccgccgagcagaagcccggcagcgccgccgcgggcgcgaatggtccctacggcctcttctccgccgccgacctctccagcgccttcggcttcgccgactcggccctcaatggaaccattcagaatcacctgtggcctcagtccccgaacctcggcgcacggcatcccgcagtctccacgacaatcgagtcgcagtcgtcattctatgcagcgagtcccacgtcggccaccaatctgagtatcaaagagagccaagcattcggaggcacgagcggctcggactccgacagcgagtcgatgttcgacgacggtggcttgtgcgacaacggcacgaacccaacggacgttaagaggatgagacggatggtgtcgaaccgggagtcggcgcggcggtcgaggaagaggaagcaagctcacttggttgagctggagacgcaggtggatcagctccggggtgacaacgcgtcgatcttcaagcagctgacggacgcgaaccagcagttcacgacggcggtgacggacaaccggatcctcaagtcggacgtggaggcgctgcgggtgaaggtgaagctggcggaggacatggtggcgcgcggcgcgatgtcgtgcgggctgggccacctggggctgtccccggcggcgctgaacccgtgccgcgtcccggacgtgctggccggtctggacttcctccccggcggcgccgacgacgcctgcttcggcagcctgtccccggctgagcaggtgcagagctcgccgatgcagagcatggccagcctcgagagcctcgagcacagcagccggatgcagcacggcggcggcgccgacgccgtcgacgtctggggctgggactccagctccaacggcgccatgtccaagtgaagccatgcacgttcctccctgtctgcgtacctacctatgtcgaagtgtttgagctgatgaaaactcttgatggacttgagtttttcagagtcctctcgtgtcgcgtcagtcggtaataactctgcgtcttcggggtgcctagtagctatgtaatggaactttctacccagagtacatgtaatggtacgtaagaccatgtcagttaactgtgaaaaaaaaaaaaaaaa

SEQ ID NO: 4222 - protein, 311 aa, Triticum aestivum
  misc_feature: PFam Name: bZIP_1; PFam Description: bZIP transcription factor
  misc_feature: PFam Name: bZIP_2; PFam Description: Basic region leucine zipper
  misc_feature: PFam Name: Collagen; PFam Description: Collagen triple helix
  misc_feature: GI Number: 50251965; NR Description: putative RISBZ4 [Oryza sativa (japonica cultivar-group)] >gi|556409|gb|AAC37418.1| transcriptional activator protein >gi|7489562|pir||T03990 probable
  misc_feature: GI Number: 13365772; NR Description: RISBZ4 [Oryza sativa]
  misc_feature: GI Number: 50905667; NR Description: RISBZ4 [Oryza sativa (japonica cultivar-group)] >gi|49388982|dbj|BAD26199.1| RISBZ4 [Oryza sativa (japonica cultivar-group)] >gi|50251200|dbj|BAD27607.1| RISBZ4 [Oryza sativa (japonica
  misc_feature: GI Number: 3287219; NR Description: RITA-2 protein [Oryza sativa (japonica cultivar-group)] >gi|7489563|pir||T03991 probable
  misc_feature: GI Number: 52075908; NR Description: RISBZ5 [Oryza sativa (japonica cultivar-group)] >gi|13365774|dbj|BAB39175.1| RISBZ5
MKKCASELELEAFIRGRGLAAEQKPGSAAAGANGPYGLFSAADLSSAFGFADSALNGTIQNHLWPQSPNLGARHPAVSTTIESQSSFYAASPTSATNLSIKESQAFGGTSGSDSDSESMFDDGGLCDNGTNPTDVKRMRRMVSNRESARRSRKRKQAHLVELETQVDQLRGDNASIFKQLTDANQQFTTAVTDNRILKSDVEALRVKVKLAEDMVARGAMSCGLGHLGLSPAALNPCRVPDVLAGLDFLPGGADDACFGSLSPAEQVQSSPMQSMASLESLEHSSRMQHGGGADAVDVWGWDSSSNGAMSK

SEQ ID NO: 4223 - DNA, 1187 bp, Glycine max
  misc_feature (1)..(1187): Ceres cDNA ID no. 21705193
  misc_feature (1)..(1187): Ceres CLONE  ID no. 624535
  misc_feature (1)..(1187): Also known as  Ceres CDNA ID no. 24366469
gctgtagtgctgtactagtgttacgcccgagtagattaggagagccaaaaaacttttgaaacagctcactcggaagcagagcagaatagatgaatttgttatcgcaatccactgccccttctacttctctatcaccttcctgttttcttccacgccaccctcatggttccacctggttctcttctggtaccttcaaattcttgaagaaagagagtagatgtctaaggaaagctggacgtactaaaatcactgcaaagtttgagctgaagccaccaccatatcctttgagtgctttggagccaattatgagtcaggagacactcgaataccattgggggaagcatcataggacttatgtagataatctgaacaggcaaattgatggaacagatctagatgggaattcactggagaacactatagttattacgtacaataagggtgacattcttccagctttcaacaatgcagcgcaggcatggaaccatgacttcttctgggagtccatgaaacctggtggtggtggaaggccatctggggatcttctaaatctgattgaaagagactttggttcattcgaaaaattccttgatgagttcaagactgctgcttcaacacagtttggttcaggatgggcatggcttgcatataaagaaagcagacttgacgtggaaaatgctgtgaaccctcttcaatctgatgaggacaagaagctagttgtggtgaagactcccaatgctgtaaacccccttgtttggaactactatcatccactccttaccattgatgtttgggagcatgcttacttcattgactttcagaaccagcgccgtgattatatatcagttttcatggataagcttgtgtcttgggatgcagtcagctcaagacttgagcaagccaaggctctaatcaaggagagagagagagaggctgagaggaaaagaagagaggaagaagagaaacggacaagcagtgaagccattcctgagatatattctgatggtgatgctgacttggatgcagaatgagtaattttatttgcaaatagatgtagtttaaaattatgtatcctttgcactagctaggtgtggtatagaggctcaatcacttcaagctgcaaattttgttttatgataaatgttgtaatttagtgtttcttagttcattcaaaaaaaaaaaaaaaa

SEQ ID NO: 4224 - protein, 313 aa, Glycine max
  misc_feature: PFam Name: Sod_Fe_C; PFam Description: Iron/manganese
  misc_feature: PFam Name: Sod_Fe_N; PFam Description: Iron/manganese
  misc_feature: GI Number: 46402892; NR Description: Fe-superoxide dismutase 1 precursor [Lotus corniculatus var. japonicus] >gi|46402890|gb|AAS92464.1| Fe-superoxide dismutase 1 precursor
  misc_feature: GI Number: 16974682; NR Description: Fe-superoxide dismutase
  misc_feature: GI Number: 32879324; NR Description: iron-superoxide
  misc_feature: GI Number: 6840824; NR Description: iron-superoxide dismutase
  misc_feature: GI Number: 56554197; NR Description: Chain X, The Crystal Structure Of The Eukaryotic Fesod From Vigna Unguiculata Suggests A
MNLLSQSTAPSTSLSPSCFLPRHPHGSTWFSSGTFKFLKKESRCLRKAGRTKITAKFELKPPPYPLSALEPIMSQETLEYHWGKHHRTYVDNLNRQIDGTDLDGNSLENTIVITYNKGDILPAFNNAAQAWNHDFFWESMKPGGGGRPSGDLLNLIERDFGSFEKFLDEFKTAASTQFGSGWAWLAYKESRLDVENAVNPLQSDEDKKLVVVKTPNAVNPLVWNYYHPLLTIDVWEHAYFIDFQNQRRDYISVFMDKLVSWDAVSSRLEQAKALIKEREREAERKRREEEEKRTSSEAIPEIYSDGDADLDAE

SEQ ID NO: 4225 - DNA, 1576 bp, Glycine max
  misc_feature (1)..(1576): Ceres cDNA ID no. 21705194
  misc_feature (1)..(1576): Ceres CLONE  ID no. 625470
  misc_feature (1)..(1576): Also known as  Ceres CDNA ID no. 24366356
acgcctccaccaaccttatatcctctccaacgcgcttttccttcttccgccaacccaatcaatccaaacacgcccttagcagaatggagactaatccccgcacgatccgcagcctagtctcgaagctgagctccgtttccgaagccgcccgcgtcgacgccctctcccaactccgcctcatgtccaaacagtcccccgaaacccgccccctcatcgccgacgccggcgcaatccccttcgtcgcagaaaccctctattgctcttcgcaccccccccaagaaaacgccgctgccacactcctgaacctcagcatcacccaaaaggagcccctcatgtcgacacgtggcgtcctcgacgccatcgcgcacgtgatctctcaccacaacaccacctcctcccccgcggcggtccagtccgccgccgccaccatccacagcctcctctcctccgtggactcctaccgccccgtcgtcgggtccaagcgcgagattgtctactccctcatcgacatcctccgctgccacgtctcgtctcctcctcgcaccatcaaggactcgttaaaggccttattcgccatcgcgcttcatcctcttaaccgatctactatgattaatcttggcgcggttcccgcgcttttttcgttggttgccaaggacggtagggttgggattgtggaggacgccaccgccgtcatcgcgcaggtcgccggttgcgaggacgccgccgaggccttttttaaggcctccggagtcggcgtcctcgctgacctcctcgaccttgccaccgccgccagcatgcggactaaagagaacgccgtctcggcgttgctcaatttggtgcggtgcggcggtgacaaggtcgccgccgacgtgcgcgacgccgtggcgttcggcgcgttggatggaattgcggatgttagggacggcgggagcggcaaggggaagaacaaagctgcggagttgttgaaggttttgctcggtgagaacaatggcgatgttgttgcgttgaacagtgatacttgttcttcgtttggttcctcgaggaatcatgattcggaatgagtttgattctttttgttcggaaatggattctttggattcgcggattcattcaggcattcatgaattggaatggttgaatgaagataagatggttcgcattttggatacatgtgttaagtttgttacatttaggataaaaacatagatgcagtttcttatgtgcttttggccatgttttccgatcagaattagagttttacctcggaaatctgtgttggtatttgatgtgaatctatattatgcaaattaccgaggtgaatctccaattatgattggagaataacactgataatactgaagatttgtatattcattcaatggttctgactagctgaatgtgtgaatgcagcaggagtttcctggctgtagggaattccagttgatttaggtttagagaggctgatttggtgtacaaattaggtgataattttgttgttttgatgatattctattgattattatgttatgatatgaacaatatcatgatgtgttttacatgaaaaaaaaaaaaaaaa

SEQ ID NO: 4226 - protein, 325 aa, Glycine max
  misc_feature: PFam Name: Arm; PFam Description:
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Pkinase; PFam Description: Protein kinase domain
  misc_feature: GI Number: 30680596; NR Description: armadillo/beta-catenin
  misc_feature: GI Number: 21593574; NR Description: unknown [Arabidopsis thaliana]
  misc_feature: GI Number: 6579203; NR Description: T23G18.19 [Arabidopsis
  misc_feature: GI Number: 6664324; NR Description: T27G7.2 [Arabidopsis thaliana]
  misc_feature: GI Number: 50904547; NR Description: B1139B11.16 [Oryza sativa (japonica cultivar-group)] >gi|20161875|dbj|BAB90788.1|
METNPRTIRSLVSKLSSVSEAARVDALSQLRLMSKQSPETRPLIADAGAIPFVAETLYCSSHPPQENAAATLLNLSITQKEPLMSTRGVLDAIAHVISHHNTTSSPAAVQSAAATIHSLLSSVDSYRPVVGSKREIVYSLIDILRCHVSSPPRTIKDSLKALFAIALHPLNRSTMINLGAVPALFSLVAKDGRVGIVEDATAVIAQVAGCEDAAEAFFKASGVGVLADLLDLATAASMRTKENAVSALLNLVRCGGDKVAADVRDAVAFGALDGIADVRDGGSGKGKNKAAELLKVLLGENNGDVVALNSDTCSSFGSSRNHDSE

SEQ ID NO: 4227 - DNA, 1527 bp, Glycine max
  misc_feature (1)..(1527): Ceres cDNA ID no. 21705195
  misc_feature (1)..(1527): Ceres CLONE  ID no. 626853
  misc_feature (1)..(1527): Also known as  Ceres CDNA ID no. 24365730
atcaagatccacattaagcaagttattcttagattcagaacaggaatattggtgagtgaagaagaattaagaagagaagcaagaatagtgtcataggatgtatgtgactaggcctttgtctctgtataagaaatctgcagatgctctctcattgcctccacctgagggccccaattctggtattttggtgatccaagatgaagatttggtgccaacctcttgttttgggttgggagagttccatgaagtgaaggagttgcctttccctcaaaatctaaaccttgagttgttctatagatcaggcatttcactgaatagaaccactcactaccaccatgttgccttcattccagttcttaaccagcccttgtcttccaacaaatactatgtgataaatctcagtgggaaaaaaagaggggaggcatacattaactcaaagggggaagatttggacacattctgtttctacaatgctgtatctgatgtaccactacatccaatagttatcaatgacacatatcaagagtttgagatatttcctagaagaagcaaagttactttcaggagtggtttttcagctaaatctgttgccccagatggataccctccaagatttttgagtacaaggtggaaagtgagtgcttcaacttcaagtgattctagcctaggagaagcatcaggtgtgaatgaaaccctccgtgccagcaagccagagttccaattctccttagcaaaaaagagttcagatagtgttgttgtgggaaaatggtattgccccttcatgtttatcaaggagggaactcacaaaacattgaaggaagaaatgagaaagtcaatgttttatgagatgacactggagcagaaatgggagcaaatcttttcatgtgagaatgagtatggaatgggaaacactgtgaatgtggatgttgtggttcaaaaggaagtggttgtaattgctggctgggaagcagtgattaatgagatggatattgctgaaggttttgtgtggtttaatagtgtcaacaatgttggagaaaagagtagtgtgggattgagcactgcagtagttgagagaatgaagtgggagcaggaaagggtagggtggaatggaggaatagagaagcaaattagagttaagaaagtggaagaatttgaaggcacaaatgggtggaagaaatttggatgttttgtgttggttgagacttttatactaaaaacattggacggaagcatagtactaacccatgctttcaaacaccatgatcaactcaggagtaaatgggaatgaagatttctggaattggttttagaccaagcaaaactcgtccaaatttgtttgcaagtgtatatcccgtaggtctttgtgaaagaaaagaatgacttatcttgtagtatgcttccaattttgtaagattttgttgactaagtttgttcattcattcagttttttcagtgtaatcattttgatattgcataaagattataaggataaactgtcgagatcattcttcaaaaaaaaaaaaaaaa

SEQ ID NO: 4228 - protein, 396 aa, Glycine max
MYVTRPLSLYKKSADALSLPPPEGPNSGILVIQDEDLVPTSCFGLGEFHEVKELPFPQNLNLELFYRSGISLNRTTHYHHVAFIPVLNQPLSSNKYYVINLSGKKRGEAYINSKGEDLDTFCFYNAVSDVPLHPIVINDTYQEFEIFPRRSKVTFRSGFSAKSVAPDGYPPRFLSTRWKVSASTSSDSSLGEASGVNETLRASKPEFQFSLAKKSSDSVVVGKWYCPFMFIKEGTHKTLKEEMRKSMFYEMTLEQKWEQIFSCENEYGMGNTVNVDVVVQKEVVVIAGWEAVINEMDIAEGFVWFNSVNNVGEKSSVGLSTAVVERMKWEQERVGWNGGIEKQIRVKKVEEFEGTNGWKKFGCFVLVETFILKTLDGSIVLTHAFKHHDQLRSKWE

SEQ ID NO: 4229 - DNA, 1295 bp, Glycine max
  misc_feature (1)..(1295): Ceres cDNA ID no. 21705196
  misc_feature (1)..(1295): Ceres CLONE  ID no. 627653
  misc_feature (1)..(1295): Also known as  Ceres CDNA ID no. 24366450
attgaccttaacaaaaaaccacagttgcttttgcttttgtgtttcctttacctccttaatggcactctctttgacatctaatggggtcaatgagtaccaaaaatgtgtggttgaagaggaagatggctcacaaagtactaatgggctcagcaatgattcagcttcagccataaccaattctcctcctctatgtggcaatgagtatgttcataagagcacacattaccaacttgaagaagcagaatccctgattaatttcaaagccaatgatcaatacaacaacctcatgcaaggtagtgaatcttttcttagctttcagcagagttggatgttctccaaagagagtaatttgcatgaaggttataaccagtggaaccatgttattagtcctaaaagccccacagatatgcgcctagtgcaaaatttcagttgctttgaaacagccactggctatagctccatattcaatggtgcaaaagacaagcaacatggtgaaagttcatcatctgggtggctatactctgaaccaaatgtccctagtgatagcttgcatgagtcagcagcacaagaattggtcttgaaaaagcgctcttttatgggagagaacatgcaagttaccaatgccaagaagccatgcacaagtgcaagtaaagcagcaaaaccaaagtcaaacccatcccaggatcctcaaagtgttgctgccaagaatagaagagagagaataagtgagcggcttaagatactacaagaactggtccccaacggttccaaggttgatttggtcacaatgttggagaaagcaattagttatgttaagtttcttcagttgcaagtgaaggtgttggcagctgatgaattttggccagtccaaggtggaaaagcccctgacatttctcaagtgagacaagccattgatgccattctttcatctcaaagatgaatcccaaaaagatcatgaatccaagaaatcatacttcacaattcaaacacaactttgctgaacgagaaaaactttgttctggaagttggtcgttctgaagggcgttttagtatttcagaatgcttgaccttttctaatttgttaatactaaatcaagatctagcagaaaatttgagcatcttgtgttagttgtttgtgtatatgctggggctggaaattaaaccgtgtcccaggatttcattcacaaaatatctacgtgtctacgttgtactttaattttctctgtactactagtggcgatggaagtgtttctaataaatatctgactactcagccaacaaaaaaaaaaaaaaaa

SEQ ID NO: 4230 - protein, 293 aa, Glycine max
  misc_feature: PFam Name: HLH; PFam Description: Helix-loop-helix
  misc_feature: GI Number: 15240346; NR Description: basic helix-loop-helix
  misc_feature: GI Number: 50912031; NR Description: bHLH protein-like [Oryza sativa (japonica cultivar-group)] >gi|41052641|dbj|BAD07489.1| bHLH protein-like [Oryza sativa (japonica cultivar-group)] >gi|41052857|dbj|BAD07771.1| bHLH protein-like [Oryza sativa
  misc_feature: GI Number: 52077404; NR Description: bHLH protein-like [Oryza
MALSLTSNGVNEYQKCVVEEEDGSQSTNGLSNDSASAITNSPPLCGNEYVHKSTHYQLEEAESLINFKANDQYNNLMQGSESFLSFQQSWMFSKESNLHEGYNQWNHVISPKSPTDMRLVQNFSCFETATGYSSIFNGAKDKQHGESSSSGWLYSEPNVPSDSLHESAAQELVLKKRSFMGENMQVTNAKKPCTSASKAAKPKSNPSQDPQSVAAKNRRERISERLKILQELVPNGSKVDLVTMLEKAISYVKFLQLQVKVLAADEFWPVQGGKAPDISQVRQAIDAILSSQR

SEQ ID NO: 4231 - DNA, 1777 bp, Triticum aestivum
  misc_feature (1)..(1777): Ceres cDNA ID no. 21705198
  misc_feature (1)..(1777): Ceres CLONE  ID no. 632950
  misc_feature (1)..(1777): Also known as  Ceres CDNA ID no. 24369594
gttagaggatccacttctgtcttcgtggccgtggccgtggccgcgcaaaaaccactgggcatcggcgcacgaacgcagcatcctcccccatcaccaccaccttcccaaagtccaaactccaatccccttgctcgccaaacccccgttccccaaatacaatccctactcccaccgcgattcccaaatggtaacgctgagcgcctccttttccgccgcgctcgtagtcgaggatttcccatcgttggagagcgatgacaagatggagatgccactggtcaagcaccgcgaggtgttcgacctcgcacagtgtggcgcccgcgccttccgggagcgccgcttcgacgaggctatttcattttattctaaagctcacaatttgagatcaggagatccgattatccttagcaatcgaagttctgctttctgtttgataagtcaagttctgagggagagatcagcagccgactcagagtaccagccattgaatggccttgatcctacaacacatgcagagttagcactgaaggatgcagagaaggtagtaactacccacggtaattctcctaggccatatcttctcaaggcatacgcacttattctgctggagcgatatcaggaagcacgtgagtcccttctggctggtcttcaagttgatcccctcagccatatcctgcaaacctgcctcagtgatctggatagaaatacaaatgctgcagccggagcaagatgcccaaggctagataggactgatgattttgagtgcacattgtgttttaaactattgtttgaaccagttaccacaccatgtgggcacacgttctgtcgctcttgtttacatcagtcaatggatcacggcaataagtgccccatgtgtcggacagttctttttattggtccaagaacttatcctataagcgtaacattgagcaacataattcagaaaaatttccctgaagaatatgctgagaggaggtcagaacatgaaaatatgacatatgcaggcattgatttgatgcctctctttgttatggatgtcgtattaccatgccaaaagatggcactgaacatatttgaacctcgctacaggctgatggtaaggagaataatggaagggagtcatcggatgggaatggttgctattgattctgcgacgggaactgtagctgactgtggttgtgaggtggaaattcttgagtgcgagccccttccagatggacgtttttatctagaggtggaaggttcacgacggtttcgtatcttgcgatcctgggatgaagatgggtaccgtgttgctgaaattgaatggttccaagatgtttctttaccagaaggatcacaagagagaagagatctaattgaaagggccaatgaagcttcagaactggctaggacgtacattaggcgtaccagagaaaccataaggcctgtgggccgggcaagacactttgatcttgagagcattcctggaccacgggaccctgagaagttcagtttttggcttgtcaacttgattaatttgaggccatcggataaattagaactattacgcctctgtgatactcgggagagaatatctcttagccttagattgctgggcaatgcagaacaaggttgccgtgtacagtaacggatttatatttgacgcacaaccattgactaacaatgttaatttgtaatattattttatcacatattctgatgcttgtgaaattcttatgattttatatatgttcttttattctcttacctgcaaaaaaagccaaaaaaaaaaaaaaaa

SEQ ID NO: 4232 - protein, 480 aa, Triticum aestivum
  misc_feature: PFam Name: LON; PFam Description: ATP-dependent protease La
  misc_feature: PFam Name: zf-C3HC4; PFam Description: Zinc finger, C3HC4
  misc_feature: GI Number: 21554128; NR Description: unknown [Arabidopsis thaliana]
  misc_feature: GI Number: 42571537; NR Description: zinc finger (C3HC4-type
  misc_feature: GI Number: 50730436; NR Description: PREDICTED: similar to
  misc_feature: GI Number: 50755011; NR Description: PREDICTED: similar to
  misc_feature: GI Number: 51704940; NR Description: similar to FLJ45273
MVTLSASFSAALVVEDFPSLESDDKMEMPLVKHREVFDLAQCGARAFRERRFDEAISFYSKAHNLRSGDPIILSNRSSAFCLISQVLRERSAADSEYQPLNGLDPTTHAELALKDAEKVVTTHGNSPRPYLLKAYALILLERYQEARESLLAGLQVDPLSHILQTCLSDLDRNTNAAAGARCPRLDRTDDFECTLCFKLLFEPVTTPCGHTFCRSCLHQSMDHGNKCPMCRTVLFIGPRTYPISVTLSNIIQKNFPEEYAERRSEHENMTYAGIDLMPLFVMDVVLPCQKMALNIFEPRYRLMVRRIMEGSHRMGMVAIDSATGTVADCGCEVEILECEPLPDGRFYLEVEGSRRFRILRSWDEDGYRVAEIEWFQDVSLPEGSQERRDLIERANEASELARTYIRRTRETIRPVGRARHFDLESIPGPRDPEKFSFWLVNLINLRPSDKLELLRLCDTRERISLSLRLLGNAEQGCRVQ

SEQ ID NO: 4233 - DNA, 1634 bp, Triticum aestivum
  misc_feature (1)..(1634): Ceres cDNA ID no. 21705199
  misc_feature (1)..(1634): Ceres CLONE  ID no. 639424
  misc_feature (1)..(1634): Also known as  Ceres CDNA ID no. 24368843
aacaggactacgtgagagacgggagagcactgctggctagcttctgtagcttcacgtggtaagtgtcgaacaccatggcagcggtgccgcacgtcgtggtgatcaccttcccttttgcctcccacgcggtgaagctgttccgcctggcgcgcgccctggccgcggcggcgccggccgccaccttctccttcctctccaccgccggctccatcgcgcagctgcaggagaagaaccaggatgccctcgaggcgaacctacgcttcgtggaggtgccggacgggttattgccaccgagctccggtggcgacgggccggcgccgccgcagaaccatatggcccgtctcgggctcttcttggcggccgctgaggctggcggggtgaaggttgcgctcgagacggctcgcgccgccgcgggcggcgccagggtcacctgcgtcgtcggggatgcgttcgtctggatggccgctgaggccgccgctgcggtgggcgcaccatgggtcccggtctggaccggcggtccgagcgcgctccttgcgcacctctgcggtgacgcgctgcgtgacgacatcggcgacaaagtggcgagccgggcggatgagctgctgacgtcgcacccgggcctagaaagctaccgcgtccgggacctccccgacggctgcgtgttcggcgagatgcacctgccaatcgtcgccctcttccgtcgcgtcgccgagcagctgcacgttccccgcgccgccaccgccgtggccttgaacaccttcccgggcctcctccccgacgacgtcaccgccgctctcgccgcggagctcccggaggtcctccccatcggccccttccatcttctcccagtgcccggcgacgacgacaacgccgccccggccgacccgcacggatgcctcgcctggctcgacggccaccccgcccgcgccgtcgcgtacgccagcttcggcacggtcgtcaccgccgtggtaggagggcaggaggagctgcgcgagctagcggccgggctggaagcgtccggcgcgccgttcctttggtcgctgcccaaggagtactggccgctgctcccgccggggttcttggacctcgagcgcggcaaggtggtgtcgtgggcgccgcaggcagccgtgttgcggcatgcatcggtgggcggcttcgtgacgcacgccgggtgggcgtcggtgctggagggcgtggccggcggtgtgcccatggcgtgccgtcccttcttcagcgaccagaggatgaacgcgcggatggtggagcacgtctggggtttcggcaccgtcttcgagcagcccatgacgcgcgcgaccgtcgcggaggccgtatcgtcgctgctcgccggcgaccaaggcacccagatgcaggagatgcggggcatggcggccaccgcgttcgcgcccgacggcggcagcaggaagaaccttgataagctcctcaagatagtctgtccaccacatgagcacagccgtggtgatcatgtcgacaagacagcagaggtgacggaatgcgcaccgacgacacatggtctgcttggtgctagcagcctagcgcacaccgtggctgactgaatgaatcagtgctcccttcatctcacaatataaaacatttttgtaaaaaaaaaaaaaaaa

SEQ ID NO: 4234 - protein, 499 aa, Triticum aestivum
  misc_feature: PFam Name: UDPGT; PFam Description: UDP-glucoronosyl and
  misc_feature: PFam Name: Extensin_2; PFam Description: Extensin-like region
  misc_feature: PFam Name: Peptidase_S8; PFam Description: Subtilase family
  misc_feature: PFam Name: Rieske; PFam Description: Rieske [2Fe-2S] domain
  misc_feature: PFam Name: Pyr_redox_2; PFam Description: Pyridine
  misc_feature: GI Number: 28569514; NR Description:
  misc_feature: GI Number: 14719287; NR Description: UDPG-flavonoid 3-O-glucosyl transferase [Zea mays] >gi|1030071|emb|CAA31855.1| UDPglucose:flavonol 3-0-glucosyltransferase [Zea mays] >gi|136743|sp|P16166|UFO1_MAIZE Flavonol 3-O-glucosyltransferase
  misc_feature: GI Number: 55741074; NR Description: bz1 [Zea mays]
  misc_feature: GI Number: 26245715; NR Description: mutant UDP-glucose flavonoid-3-O-glucosyltransferase [Zea mays] >gi|26245711|gb|AAN77508.1| mutant UDP-glucose
  misc_feature: GI Number: 51091119; NR Description: putative UDPglucose:flavonoid-3-oxy glucosyl transferase [Oryza sativa (japonica cultivar-group)] >gi|51090782|dbj|BAD35260.1| putative UDPglucose:flavonoid-3-oxy glucosyl transferase [Oryza sativa
MAAVPHVVVITFPFASHAVKLFRLARALAAAAPAATFSFLSTAGSIAQLQEKNQDALEANLRFVEVPDGLLPPSSGGDGPAPPQNHMARLGLFLAAAEAGGVKVALETARAAAGGARVTCVVGDAFVWMAAEAAAAVGAPWVPVWTGGPSALLAHLCGDALRDDIGDKVASRADELLTSHPGLESYRVRDLPDGCVFGEMHLPIVALFRRVAEQLHVPRAATAVALNTFPGLLPDDVTAALAAELPEVLPIGPFHLLPVPGDDDNAAPADPHGCLAWLDGHPARAVAYASFGTVVTAVVGGQEELRELAAGLEASGAPFLWSLPKEYWPLLPPGFLDLERGKVVSWAPQAAVLRHASVGGFVTHAGWASVLEGVAGGVPMACRPFFSDQRMNARMVEHVWGFGTVFEQPMTRATVAEAVSSLLAGDQGTQMQEMRGMAATAFAPDGGSRKNLDKLLKIVCPPHEHSRGDHVDKTAEVTECAPTTHGLLGASSLAHTVAD

SEQ ID NO: 4235 - DNA, 1431 bp, Triticum aestivum
  misc_feature (1)..(1431): Ceres cDNA ID no. 21705200
  misc_feature (1)..(1431): Ceres CLONE  ID no. 639467
  misc_feature (1)..(1431): Also known as  Ceres CDNA ID no. 24368847
attcacaaaccgtgacggccacccacctgacctcagccgccttcccctctcctcccccgtccgccctccgtctcccgctccccggcctcccgcggacgcgcgctgcagatgggtcccgctacgcagcagcgccaccggacgcgcgctgggcggccggccgccaggcggcccagggcggcggccgacgacgacggcggcgtcaggtgcgaggcgtgcggatccggccgccacgcggacgagctgctgctctgcgacggctgcgaccgcggcctccacatcttctgcctccgccccatcctcccgcgcgtgcccgccggcgactggttctgcccctcctgcgccgccgcaaccaccaccaccgcccattcggccaaatccgccgccgtcgtccagaccaagatgcccaaacagttcccgctgatccagacgaagatcgtcgatttcttcaagatccagcggcgcccggcgttcgcggcccccgagccgccggaggggaggaagaggaagcggaaggccgccagcgcgctggtggtgtccaagaagaagagcaggaagctgctgccattcacccccagcgaggaccccgtccggcgactcacgcagatggcgtccctcgccacggcgctcacggctaccggcgccgtcttcagcaacgacctcacctacgtgcccggcatggcgccccgctccgccaaccaatccgccctcgaggcaggagggatgcaggtgctgccgagggaggatgcagagacattgagcctgtgcaagaggatgatggagcaaggggaatggccccctctcctcgtcgtcttcgatccggtggaaggattcacggtggaggcagacaggcacatcaaggacctgaccatcatcaccgagtacgtcggcgacgtggactaccttcgaaaccgcgagcacgatgatggcgacagtatcatgaccctgctctctgccgcgccgccctccaagagcctggtaatctgccctgacaagcggagcaacattgcgcggtacatcaacgggatcaacaaccacacgccggaaggcaggaagaagcagaacctcaagtgcgtgcggttcgccatcgacggcgagtgccattgcctcctggtggccaacagggacatctccaagggggagaggctgtactacgactacaacggcgacgagcacgagtacccaactcaccattttgtatgacacatgagctgatgtttggtctgcatattcattctatctataatcataggaaggaaaatgattgcgctgatccattccccccaaagccaacatgtagagtcatctaattggttgatagatctggaaattttttacctgcaaaaaggaaaaaggggaattgtaaacattgtgtatccaatggaatggaatgcaatggcaaatgggttggtctgttcaaaaaaaaaaaaaaaa

SEQ ID NO: 4236 - protein, 363 aa, Triticum aestivum
  misc_feature: PFam Name: SET; PFam Description: SET domain
  misc_feature: PFam Name: PHD; PFam Description: PHD-finger
  misc_feature: PFam Name: Pyr_redox_2; PFam Description: Pyridine
  misc_feature: PFam Name: Pkinase; PFam Description: Protein kinase domain
  misc_feature: PFam Name: Atrophin-1; PFam Description: Atrophin-1 family
  misc_feature: GI Number: 34905874; NR Description: P0458E05.13 [Oryza sativa (japonica cultivar-group)] >gi|21902065|dbj|BAC05613.1|
  misc_feature: GI Number: 46402470; NR Description: At5g24330 [Arabidopsis thaliana] >gi|45773812|gb|AAS76710.1| At5g24330 [Arabidopsis thaliana] >gi|15237940|ref|NP_197821.1| PHD finger family protein /
  misc_feature: GI Number: 21464579; NR Description: AT5g09790/F17I14_20 [Arabidopsis thaliana] >gi|17381240|gb|AAL36039.1| AT5g09790/F17I14_20 [Arabidopsis thaliana] >gi|22326695|ref|NP_196541.2| PHD finger family protein / SET
  misc_feature: GI Number: 25989119; NR Description: unknown [Streptomyces
  misc_feature: GI Number: 13592175; NR Description: ppg3 [Leishmania major]
MGPATQQRHRTRAGRPAARRPRAAADDDGGVRCEACGSGRHADELLLCDGCDRGLHIFCLRPILPRVPAGDWFCPSCAAATTTTAHSAKSAAVVQTKMPKQFPLIQTKIVDFFKIQRRPAFAAPEPPEGRKRKRKAASALVVSKKKSRKLLPFTPSEDPVRRLTQMASLATALTATGAVFSNDLTYVPGMAPRSANQSALEAGGMQVLPREDAETLSLCKRMMEQGEWPPLLVVFDPVEGFTVEADRHIKDLTIITEYVGDVDYLRNREHDDGDSIMTLLSAAPPSKSLVICPDKRSNIARYINGINNHTPEGRKKQNLKCVRFAIDGECHCLLVANRDISKGERLYYDYNGDEHEYPTHHFV

SEQ ID NO: 4237 - DNA, 1202 bp, Glycine max
  misc_feature (1)..(1202): Ceres cDNA ID no. 21705201
  misc_feature (1)..(1202): Ceres CLONE  ID no. 655727
  misc_feature (1)..(1202): Also known as  Ceres CDNA ID no. 24367812
agaatagagtaaggaacaagtaataaacaaatagtagcatgcgtgtgggtatattcctggatcggctctttcctcaacaacgccgcgtgcagtcccaaccctaggcagagagaaaattccccaaatcacaaaccctagattgagagaaaccctaacacgccatgggaacacccgagacatctcgcgaaccctgccccgatcgcatcctcgacgacataggcggcgccttcggcatgggagcggtgggtggctccgccttccattttctcaagggtctctacaattcccccaagggcgatcgattcgtcggcgccacccaggccgtgcgccttaacgccccccgcgtcggcggcagcttcgccgtctggggcggcctcttctccgcctttgactgcaccatggtctacgctcgccagaaggaggacccctggaactccatcgtcgccggcgccgccactggcggcttcctctctatgcgccagggcctcggcgcctccgcccgctccgcggcattcggcggcgtcctcctcgccctcatcgagggcgccgggatcatgctcaacaagttcctcagcgcgcagcagcccatgcctatgatcatggacgagccgcagccgcagcctccgcagtcgtccgagcagccgtggctcggagggtggttcggtggagggaacagagaggagaccgccggcagcggcggaagcgagacgaagattctggagagtttcgatgctccccctgtgcccaattttgagtataagtaagtggagagattatcctgtggttcagagttcagaccaaattcctaattgatctccacatgacatgaaattgagtgtcatagttaattgaaatgcttgactagtttcatgtagagattgattgattgagatcataaaacatgtggtggtctgagactatctaataatttctcaagtaattggggtttggttataggggttagttattttttgtggaagagttgagaagttaaatattgaatttgttgttgaacctcacttgatgattgtctatcatacaatgattttgttacttgttttccttttttttttttcgctctcacaataatatgtaatataagtgtagtggtaggctttcatcacatctataatttatgtattgttttcttttgaattgaaattttgatatcatattagatggagccaaaaaaaaaaaaaaaa

SEQ ID NO: 4238 - protein, 200 aa, Glycine max
  misc_feature: PFam Name: Tim17; PFam Description: Tim17/Tim22/Tim23 family
  misc_feature: GI Number: 6103722; NR Description: TIM17 [Arabidopsis thaliana]
  misc_feature: GI Number: 38678772; NR Description: mitochondrial inner
  misc_feature: GI Number: 50916583; NR Description: puative inner mitochondrial membrane translocase [Oryza sativa (japonica cultivar-group)] >gi|41469132|gb|AAS07083.1| puative inner mitochondrial membrane translocase [Oryza sativa (japonica
  misc_feature: GI Number: 31218988; NR Description: ENSANGP00000016107 [Anopheles gambiae] >gi|21299841|gb|EAA11986.1| ENSANGP00000016107
  misc_feature: GI Number: 42551776; NR Description: IM17_NEUCR Mitochondrial import inner membrane translocase subunit TIM17 [Gibberella zeae PH-1] >gi|46124075|ref|XP_386591.1| IM17_NEUCR Mitochondrial import
MGTPETSREPCPDRILDDIGGAFGMGAVGGSAFHFLKGLYNSPKGDRFVGATQAVRLNAPRVGGSFAVWGGLFSAFDCTMVYARQKEDPWNSIVAGAATGGFLSMRQGLGASARSAAFGGVLLALIEGAGIMLNKFLSAQQPMPMIMDEPQPQPPQSSEQPWLGGWFGGGNREETAGSGGSETKILESFDAPPVPNFEYK

SEQ ID NO: 4239 - DNA, 1653 bp, Triticum aestivum
  misc_feature (1)..(1653): Ceres cDNA ID no. 21705203
  misc_feature (1)..(1653): Ceres CLONE  ID no. 677371
  misc_feature (1)..(1653): Also known as  Ceres CDNA ID no. 24368753
atcggatcttccacggctagactttttcccctccaccatcctgcacggtacctttgcctctttctcctccggtcccttctatcttctcccacgctgctctgatctccgacctcctgccccgagctccaatccgaccgatccaatggcgctctaaatcctctcctacactccaccaccacctagatccggccgccccgaggcggcggagctccggagagctcgatgagcagccaggggttcggccccgggagccccaagtccttccgctaccctagagccgactacgatctcgagtccgggatcccccgcaagggccgcaagcccaaggcctcgcatctcgacgcccccgcccccctcagctcggcgctgatgaggatccgcttcttctacgaggcgcaccccgtcgcggtcgccctcatcctgctgtccttcgggctgagcgtcctgatcctcctgtccgtgtacgagacccggttcaggacgatgaggagcggtggcaatgaggtcggggcgcacccgcttccgggccttcgcaacctcgtcatggtggccggccattcgatatacaccagcgcgagctgcgggaagaccgaccgcgaggattcgtggttcttggagccgtaccagaagcaccccggccaggcggccaccttcttggcgcacatcaaggagggggtggagatcgcggcgagggatcagggctcgctcctcttgtttagcggtggggagacgaggaaagatgcagggccgaggagcgaggcgcagagctactgggctattgcagagtcggaaggctggtttggaaatgatgatagtgtaaggagccgggcactgaccgaggagcatgcacgagatagttttgaaaatctcctatttagcgtttgccgtttcagagaactcaccggaacatacccacagaatataactgtcgtaagctatgattttaaggaggaaaggtttgcacaactgcacaggtctgcactcgggttcccagaagaaaggttcttcttctcaggtaccccagctacagctacagcaaaggaggcagctctgaaaggcgaagcctctgtcaggtctcagttccaagaagatccatatggatgtgttggttctcttcgtgtaaagaggctcaagagagacccgtttcaccggaccattccataccccaatggctgccctgaattgaagggtctattctcctattgcggtatggtgccatactctgggaaccttccttggactcagtagcggagaagggcatgatgtttggatcaaacttccactgttcacagtaaaatcccagcattcttgtttcgcccctttttctaagctgacagaatagatatccccattcctgtcttctgtgcgagggagaagagaatttctaagctacactagttagattgttttcgtcacggaagcttgccacatgctccatatatacagattttctttttctcacttctcccgggtctccactgaaaactgtgaatttgttagtagcagtggaagcaagtgaacttataatttataattccagcttgaactgcaccagtaaaaactggaaaccttatgaacatgtaccgtgtaatatcctggtattcttccattgtgaaaaaaggctgttttcgttttctaaaaaaaaaaaaaaaa

SEQ ID NO: 4240 - protein, 341 aa, Triticum aestivum
  misc_feature: GI Number: 37362697; NR Description: Hypothetical ORF;
MSSQGFGPGSPKSFRYPRADYDLESGIPRKGRKPKASHLDAPAPLSSALMRIRFFYEAHPVAVALILLSFGLSVLILLSVYETRFRTMRSGGNEVGAHPLPGLRNLVMVAGHSIYTSASCGKTDREDSWFLEPYQKHPGQAATFLAHIKEGVEIAARDQGSLLLFSGGETRKDAGPRSEAQSYWAIAESEGWFGNDDSVRSRALTEEHARDSFENLLFSVCRFRELTGTYPQNITVVSYDFKEERFAQLHRSALGFPEERFFFSGTPATATAKEAALKGEASVRSQFQEDPYGCVGSLRVKRLKRDPFHRTIPYPNGCPELKGLFSYCGMVPYSGNLPWTQ

SEQ ID NO: 4241 - DNA, 1705 bp, Triticum aestivum
  misc_feature (1)..(1705): Ceres cDNA ID no. 21705204
  misc_feature (1)..(1705): Ceres CLONE  ID no. 677797
  misc_feature (1)..(1705): Also known as  Ceres CDNA ID no. 24369519
atcaaaccctctccctcctccactccccccgaaccagcgcatcacatcttctcttctcttcgtccgttgctcccgttgaagcccaggcaccttcttgctttctcccaccgcttcttcggtctctctccctgtgtcggcccgcgctctcgtcatgacgaaccacgccgcctttgctgccgaggacgcggtcaccgccgtggcggcgccggtgcagccgggtcgccatttcgcgtcgttcccgccgcggagggcccgcgactgcaggaaggccgccctgggccgcatggatctcgccacctcgggggtgctgatggccgggtctctgctggactcgatgaaggcctcctcgccccgccacgccatgccccccgccggcgccgaccacgaggagtggatcgagaagcacccgtcagcattggagtggttcgagggcgtgctcgcggcgaccgaggggaagcagatcgtcatgttcctcgactacgacggcaccctttcgccgatcgtccaggaccccgaccgcgccgtcatgaccgaggagatgagggatgcggtgaggggcgtcgcgcagcatttcccgacggccatcgtgagtgggagatgcagagacaaggtgttcaactttgtgaaactggaggagctgtactacgccgggagccacggcatggacatcaagggccccaccaaagtgtctaaccacaaggcaaaggctgacgaggttctgtgccagccggcgaccgagttcttgcctgtcattcaggaggtgtatgagaagctgacggcgaagatggagtccatcccgggggccatggtggagaacaacaagttttgcctctcggtgcacttccgctgcgtcgaggaggcggaatgggatgctctgggcagggaggtgaaggcagtgctggacgactacccgaaactctgcctcaccaaggggagaaaggtcctcgagatccggccctccatcgagtggaacaagggacacgctctcaagttcttgctcaagtctctcggctatgcggggcgcagcgacgttttcccgatatacatcggggatgaccgcacagatgaggatgcattcaaggtgctgcgcaacatgggacaaggcatcgggatccttgtgaccaagtttccgaaggacacaagcgcatcctactctctgcgtgagcctgctgaggtaaaggagttcctgcgcaagctggtgaagagcaacgcgacaaagaaggggtaattcatcgatcaacagccctctagctctaactcaacatggagatcgagcaacctatatagctagtgcatcaagtctagcttgttccttcctggacttgatggtgtctttggcgtttgattttagtagaacaatgcatgcatgcgtgttgggatccatgtataagatccagatcgagcagtgacccctgccctgctaggccttggctttgaaggtttctattactgtatccttctcgcgaggtcttgtaattagccttccgttattagctattcccttcgttccaaattactcgtcgcagaaatggatgtatctagaactaaaatacatctagatacatccatacctgcgacaagtaattcggaacggagggagtatgacagaaatgggagtgacaaagtagccctcccttttctcaccccgcactgtaaaattgttctcgcttgcttccttccttccttcctaaaaaaaaaaaaaaaa

SEQ ID NO: 4242 - protein, 1705 aa, Triticum aestivum
  misc_feature: PFam Name: Trehalose_PPase; PFam Description:
  misc_feature: GI Number: 50939353; NR Description: putative trehalose-6-phosphate phosphatase [Oryza sativa (japonica cultivar-group)] >gi|33146623|dbj|BAC79911.1| putative trehalose-6-phosphate phosphatase [Oryza sativa (japonica
  misc_feature: GI Number: 50945643; NR Description: putative trehalose-phosphatase [Oryza sativa (japonica cultivar-group)] >gi|37806433|dbj|BAC99626.1| putative trehalose-phosphatase [Oryza
  misc_feature: GI Number: 51972037; NR Description: putative
  misc_feature: GI Number: 50912861; NR Description: putative trehalose-6-phosphate phosphatase [Oryza sativa (japonica cultivar-group)] >gi|46390128|dbj|BAD15563.1| putative trehalose-6-phosphate phosphatase [Oryza sativa (japonica
  misc_feature: GI Number: 50582734; NR Description: putative
ATCAAACCCTCTCCCTCCTCCACTCCCCCCGAACCAGCGCATCACATCTTCTCTTCTCTTCGTCCGTTGCTCCCGTTGAAGCCCAGGCACCTTCTTGCTTTCTCCCACCGCTTCTTCGGTCTCTCTCCCTGTGTCGGCCCGCGCTCTCGTCATGACGAACCACGCCGCCTTTGCTGCCGAGGACGCGGTCACCGCCGTGGCGGCGCCGGTGCAGCCGGGTCGCCATTTCGCGTCGTTCCCGCCGCGGAGGGCCCGCGACTGCAGGAAGGCCGCCCTGGGCCGCATGGATCTCGCCACCTCGGGGGTGCTGATGGCCGGGTCTCTGCTGGACTCGATGAAGGCCTCCTCGCCCCGCCACGCCATGCCCCCCGCCGGCGCCGACCACGAGGAGTGGATCGAGAAGCACCCGTCAGCATTGGAGTGGTTCGAGGGCGTGCTCGCGGCGACCGAGGGGAAGCAGATCGTCATGTTCCTCGACTACGACGGCACCCTTTCGCCGATCGTCCAGGACCCCGACCGCGCCGTCATGACCGAGGAGATGAGGGATGCGGTGAGGGGCGTCGCGCAGCATTTCCCGACGGCCATCGTGAGTGGGAGATGCAGAGACAAGGTGTTCAACTTTGTGAAACTGGAGGAGCTGTACTACGCCGGGAGCCACGGCATGGACATCAAGGGCCCCACCAAAGTGTCTAACCACAAGGCAAAGGCTGACGAGGTTCTGTGCCAGCCGGCGACCGAGTTCTTGCCTGTCATTCAGGAGGTGTATGAGAAGCTGACGGCGAAGATGGAGTCCATCCCGGGGGCCATGGTGGAGAACAACAAGTTTTGCCTCTCGGTGCACTTCCGCTGCGTCGAGGAGGCGGAATGGGATGCTCTGGGCAGGGAGGTGAAGGCAGTGCTGGACGACTACCCGAAACTCTGCCTCACCAAGGGGAGAAAGGTCCTCGAGATCCGGCCCTCCATCGAGTGGAACAAGGGACACGCTCTCAAGTTCTTGCTCAAGTCTCTCGGCTATGCGGGGCGCAGCGACGTTTTCCCGATATACATCGGGGATGACCGCACAGATGAGGATGCATTCAAGGTGCTGCGCAACATGGGACAAGGCATCGGGATCCTTGTGACCAAGTTTCCGAAGGACACAAGCGCATCCTACTCTCTGCGTGAGCCTGCTGAGGTAAAGGAGTTCCTGCGCAAGCTGGTGAAGAGCAACGCGACAAAGAAGGGGTAATTCATCGATCAACAGCCCTCTAGCTCTAACTCAACATGGAGATCGAGCAACCTATATAGCTAGTGCATCAAGTCTAGCTTGTTCCTTCCTGGACTTGATGGTGTCTTTGGCGTTTGATTTTAGTAGAACAATGCATGCATGCGTGTTGGGATCCATGTATAAGATCCAGATCGAGCAGTGACCCCTGCCCTGCTAGGCCTTGGCTTTGAAGGTTTCTATTACTGTATCCTTCTCGCGAGGTCTTGTAATTAGCCTTCCGTTATTAGCTATTCCCTTCGTTCCAAATTACTCGTCGCAGAAATGGATGTATCTAGAACTAAAATACATCTAGATACATCCATACCTGCGACAAGTAATTCGGAACGGAGGGAGTATGACAGAAATGGGAGTGACAAAGTAGCCCTCCCTTTTCTCACCCCGCACTGTAAAATTGTTCTCGCTTGCTTCCTTCCTTCCTTCCTAAAAAAAAAAAAAAAA

SEQ ID NO: 4243 - DNA, 1355 bp, Triticum aestivum
  misc_feature (1)..(1355): Ceres cDNA ID no. 21705205
  misc_feature (1)..(1355): Ceres CLONE  ID no. 677844
  misc_feature (1)..(1355): Also known as  Ceres CDNA ID no. 24368604
attcattcattcacagcacaggagcgctagctagctagctcccttcgcttcacgtgtccatctccatccccggccaccaaccgtcgccaacttgccatggagaagacctagccagctcgcgccttttggtccttgggagttgggagagagatcctccggagctggccaaggcatggcattggaggccgcggtgctctcccgcgctgctgctggtctcttcggtcgctgcgccatggccggggcgggaggagcttggaatggtctcttcggtgggagcgaagggctggcgggcttggacggcggggactgggacgccgccgtcgcggcggcgtgctcgtcgatgctgctgcctccagctgcgttccaggacctggatatctccgctactgcgccgcaggaggagtccggaggtcgcggcgagatgagcgcggccggcgtgggtcaggacgatgctgcgccggtgacggcggcggcgacggggcggaggaagcggcggcggacgaggacggccaagaactcggaggaggtggagagccagcggatgacccacattgccgtcgagcgcaaccgccgcaagcagatgaacgagtacctcgccgcgctccgctccctcatgccgccctcctacgcgctaaggggtgatcaggcgtctatcgtcggaggtgcgatcaacttcgtcaaggagctggagcagctgctccagaccctggagacgcagaggcagacacgggaacgcgcggccgtcgacggcggggaagcgcagccaccgctgttcgccaacttcttcaccttcccgcagtactcaatgagcgttacctcggcaccggcgcctcctccggcgaacaacgacgagggtgccgacggctgcgccgaggcggaggcgtccggatcaaagccgtcggcggtggcggacgtggaggtgaccatggtggagagccacgccaacctgcggatgctgtcccggcggcggccgaggcagctgctgcggctgctggtggggctgcagggacaccggctcacggtgctgcacctcaacatgagcagcgccagccacatggtgctctactcgctcagcctcaaggtggaggacgattgccaacttacctccgtggatgagatcgccaccgcggcccatcagatcatcgagaagatccaagaagagcaagacttcacttcagcttagagtagcatgcatcttaccttatagtagtattattatgcaatgcgcaacattagttattctagcaagtgaagtgactcgtgtgcaaaccaataaagctcatcactgcctaccagcttagtgctgaatccatggatgaaaaataacgaatttgttggtaaaaaaaaaaaaaaaa

SEQ ID NO: 4244 - protein, 336 aa, Triticum aestivum
  misc_feature: PFam Name: HLH; PFam Description: Helix-loop-helix
  misc_feature: GI Number: 50900332; NR Description: helix-loop-helix DNA-binding protein-like [Oryza sativa (japonica cultivar-group)] >gi|47497681|dbj|BAD19748.1| helix-loop-helix DNA-binding protein-like [Oryza sativa (japonica cultivar-group)]
  misc_feature: GI Number: 50946977; NR Description: putative basic-helix-loop-helix (bHLH)transcription factor [Oryza sativa (japonica cultivar-group)] >gi|42408163|dbj|BAD09301.1| putative basic-helix-loop-helix (bHLH)transcription factor [Oryza sativa
  misc_feature: GI Number: 18395124; NR Description: basic helix-loop-helix
  misc_feature: GI Number: 21593808; NR Description: unknown [Arabidopsis thaliana]
  misc_feature: GI Number: 29824221; NR Description: putative bHLH protein [Arabidopsis thaliana] >gi|28392970|gb|AAO41920.1| putative bHLH protein [Arabidopsis thaliana] >gi|20520637|emb|CAD30833.1| basic-helix-loop-helix transcription factor [Arabidopsis
MALEAAVLSRAAAGLFGRCAMAGAGGAWNGLFGGSEGLAGLDGGDWDAAVAAACSSMLLPPAAFQDLDISATAPQEESGGRGEMSAAGVGQDDAAPVTAAATGRRKRRRTRTAKNSEEVESQRMTHIAVERNRRKQMNEYLAALRSLMPPSYALRGDQASIVGGAINFVKELEQLLQTLETQRQTRERAAVDGGEAQPPLFANFFTFPQYSMSVTSAPAPPPANNDEGADGCAEAEASGSKPSAVADVEVTMVESHANLRMLSRRRPRQLLRLLVGLQGHRLTVLHLNMSSASHMVLYSLSLKVEDDCQLTSVDEIATAAHQIIEKIQEEQDFTSA

SEQ ID NO: 4245 - DNA, 1361 bp, Triticum aestivum
  misc_feature (1)..(1361): Ceres cDNA ID no. 21705206
  misc_feature (1)..(1361): Ceres CLONE  ID no. 678577
  misc_feature (1)..(1361): Also known as  Ceres CDNA ID no. 24369615
aaaaaaagagagagagaaagccaaggcaagccgcggcgagcagaagcggtgggcgcgcgacggcggcggcggttggccctctcgagtcatggtgctacccgccaacctctcgcgcgacgtcggagctcactcgtgctctgcgcaggacggccagggggaagcggggccgccgcgcccgcgcagaccgcccgcgttctacagctccgtgttcgcacagatcgaagaggtcgggtgggggcagctagtgagcgccacaggcgatgacggcgtgtcgtgcctcaccttccgcgtcgtggatgagcagcgacggcaacattcactggagatcacactgcccatgaactacccggcatgccctccttcaattgccgcggatgttccttatctccccaaattacagtggtcaaaaagttcaagactgaaggatgttctctgccaattccaagagcacctgaaggtattgcaagattactggtctacaatggatggcattgacaaggccctttgggttgtcgatactacaaagccgacatatgctatgtctcatcgtcgcatagctttgggtgatgattgctatattttactacatgttgatacgcacaagcccaactccttaccagagtgccgcttcctaggcacagatgggaaactggaaaggctgataaagaattggagaaaaaatcgtaagagatggagcgcccacagaaagttccatgaaaacctggcaactgtgttagattttgctctgccgcaacccccttctgtgagcatcaaagatgaccagcaagctgattgtgggatatgttacgccacgcatctgcccgtcgatgacgaacttgggactcagagcgggtgcgcggcggactacaagtgcgaaaaccctagctgcagcagagccttccactccgtgtgcctgagagactggctgcgcaccattactacgacaaggcagtcgttcgatgttctgttcgggaactgcccttactgcagtgagcctgtcgccgtgaagggcaccgacagctgaacccgccttcttcgcatttacaaatcgagatgctgaagttgggttaatgcggaccagtaaaaaggaagagggacgaaataatctaggtcgcctgctgaaggccggtcgtcatgatctagatgtcatcaatggagctgcaaggggtcaaaattcccaattgtttctacgaaattggcgtccacttgtagagatgaaagaagtgtgccagcctaattactgaaaattgatgtctgtcacgcacccttctagattcgggacgaatgcgtagttgctgactggtatacataacagtggtttggatctctgaatgtcaatgcgcataaaaaaaaaaaaaaaa

SEQ ID NO: 4246 - protein, 311 aa, Triticum aestivum
  misc_feature: GI Number: 33416848; NR Description: Zgc:66144 protein [Danio
  misc_feature: GI Number: 44890322; NR Description: Zgc:76938 protein [Danio
  misc_feature: GI Number: 49472819; NR Description: Fanconi anemia, complementation group L; PHD finger protein 9 [Homo sapiens] >gi|32493396|gb|AAH54517.1| Fanconi anemia, complementation group L [Homo sapiens] >gi|46255698|gb|AAH09042.1| Fanconi anemia,
  misc_feature: GI Number: 50738277; NR Description: PREDICTED: similar to
  misc_feature: GI Number: 34879602; NR Description: similar to PHD finger protein 9; proliferation of germ cells; germ cell deficient [Rattus
MVLPANLSRDVGAHSCSAQDGQGEAGPPRPRRPPAFYSSVFAQIEEVGWGQLVSATGDDGVSCLTFRVVDEQRRQHSLEITLPMNYPACPPSIAADVPYLPKLQWSKSSRLKDVLCQFQEHLKVLQDYWSTMDGIDKALWVVDTTKPTYAMSHRRIALGDDCYILLHVDTHKPNSLPECRFLGTDGKLERLIKNWRKNRKRWSAHRKFHENLATVLDFALPQPPSVSIKDDQQADCGICYATHLPVDDELGTQSGCAADYKCENPSCSRAFHSVCLRDWLRTITTTRQSFDVLFGNCPYCSEPVAVKGTDS

SEQ ID NO: 4247 - DNA, 1315 bp, Triticum aestivum
  misc_feature (1)..(1315): Ceres cDNA ID no. 21705207
  misc_feature (1)..(1315): Ceres CLONE  ID no. 683230
  misc_feature (1)..(1315): Also known as  Ceres CDNA ID no. 24368996
aattcacacacacccacacacccaaagaaagacacgcaaacatgccggccaccgcctcgccgccaccgctgctcctcgccgccgcgctcctcctctccgccgcgttgctctgctcggcctgccccgtgccgctgccgaagcagacggccgacaacagcccgcggctgcagcgcgcgtacgtggcgctgcaggccctcaagcgcgccatcaccgacgaccccaagaacctgacgggcaactggtgcggcccggacgtgtgcgcctacttcggcgtcttctgcgcgccgtcccttgacgacccgtgcgcgcgcgccgtggccggcgtcgacctcaatcacggcgacctcgccggcacgctgccgttcgagctcggccacctcactgaactcgccgtcctccacctcaactccaaccgcttcgcaggggggctcccggactccctccccaagctctccctcctccacgagctggacgtcagcaacaacctcctctccggcggcttcccgcagcacatcctctgcctccccaacgtcaagtacgtggacatcaggttcaacaacctgtgcggccccgtgcccccggccatcttcgacaagaagatcgacgcgctcttcatcaacgacaaccacttcgacttcgagctgccggagaactttggcaactcccccgcctcggtcatcgtgctcgccaacctccgcctccgtggctgcatccccgccagcgtggggcgcatgggggccacgctcaacgagctcgtcatgctcaactccggcatccggtcctgcatcccgccggagatcgggtggctgcgcgagctcaccgtgctggacgtgagcttcaaccagctccagggcacactgccggagtccatggcggggatgcacgcgctggagcagctcgacgtcgcgcacaacgagctcgccgggcacatcccggagggcatctgcgcgctgccgcggctggccaacttcacctactcgtacaactacttctgcggcgagccggagcggtgcatggcgctccggcgcaacgacgaccggcagaactgcatcgccggccgcccggaccagcggccggcggaccagtgcctcgcgttcctacaccgcccgccggtgcactgcgacgggcacggctgcctggcgcagcactagtggagatcattcgtttggtggtgtaaaacggggcgagatttcaatcatcgtatatacatacatatatgaacacacactgtaatttttattttttttacagagaggatggtaataatggaatttgtagacatacatgatctcatacatcaaaaaaaaaaaaaaaa

SEQ ID NO: 4248 - protein, 1315 aa, Triticum aestivum
  misc_feature: PFam Name: LRR_1; PFam Description: Leucine Rich Repeat
  misc_feature: GI Number: 50400028; NR Description: putative leucine-rich receptor-like protein kinase [Oryza sativa (japonica
  misc_feature: GI Number: 50934587; NR Description: extensin-like protein [Oryza sativa (japonica cultivar-group)] >gi|34393830|dbj|BAC83434.1| extensin-like protein [Oryza sativa
  misc_feature: GI Number: 9279698; NR Description: extensin protein-like [Arabidopsis thaliana] >gi|15228861|ref|NP_188919.1| leucine-rich repeat family protein / extensin family protein [Arabidopsis
  misc_feature: GI Number: 50933081; NR Description: putative extensin [Oryza sativa (japonica cultivar-group)] >gi|47777453|gb|AAT38086.1|
  misc_feature: GI Number: 9294099; NR Description: extensin-like protein [Arabidopsis thaliana] >gi|15230120|ref|NP_189091.1| leucine-rich repeat family protein / extensin family protein [Arabidopsis
AATTCACACACACCCACACACCCAAAGAAAGACACGCAAACATGCCGGCCACCGCCTCGCCGCCACCGCTGCTCCTCGCCGCCGCGCTCCTCCTCTCCGCCGCGTTGCTCTGCTCGGCCTGCCCCGTGCCGCTGCCGAAGCAGACGGCCGACAACAGCCCGCGGCTGCAGCGCGCGTACGTGGCGCTGCAGGCCCTCAAGCGCGCCATCACCGACGACCCCAAGAACCTGACGGGCAACTGGTGCGGCCCGGACGTGTGCGCCTACTTCGGCGTCTTCTGCGCGCCGTCCCTTGACGACCCGTGCGCGCGCGCCGTGGCCGGCGTCGACCTCAATCACGGCGACCTCGCCGGCACGCTGCCGTTCGAGCTCGGCCACCTCACTGAACTCGCCGTCCTCCACCTCAACTCCAACCGCTTCGCAGGGGGGCTCCCGGACTCCCTCCCCAAGCTCTCCCTCCTCCACGAGCTGGACGTCAGCAACAACCTCCTCTCCGGCGGCTTCCCGCAGCACATCCTCTGCCTCCCCAACGTCAAGTACGTGGACATCAGGTTCAACAACCTGTGCGGCCCCGTGCCCCCGGCCATCTTCGACAAGAAGATCGACGCGCTCTTCATCAACGACAACCACTTCGACTTCGAGCTGCCGGAGAACTTTGGCAACTCCCCCGCCTCGGTCATCGTGCTCGCCAACCTCCGCCTCCGTGGCTGCATCCCCGCCAGCGTGGGGCGCATGGGGGCCACGCTCAACGAGCTCGTCATGCTCAACTCCGGCATCCGGTCCTGCATCCCGCCGGAGATCGGGTGGCTGCGCGAGCTCACCGTGCTGGACGTGAGCTTCAACCAGCTCCAGGGCACACTGCCGGAGTCCATGGCGGGGATGCACGCGCTGGAGCAGCTCGACGTCGCGCACAACGAGCTCGCCGGGCACATCCCGGAGGGCATCTGCGCGCTGCCGCGGCTGGCCAACTTCACCTACTCGTACAACTACTTCTGCGGCGAGCCGGAGCGGTGCATGGCGCTCCGGCGCAACGACGACCGGCAGAACTGCATCGCCGGCCGCCCGGACCAGCGGCCGGCGGACCAGTGCCTCGCGTTCCTACACCGCCCGCCGGTGCACTGCGACGGGCACGGCTGCCTGGCGCAGCACTAGTGGAGATCATTCGTTTGGTGGTGTAAAACGGGGCGAGATTTCAATCATCGTATATACATACATATATGAACACACACTGTAATTTTTATTTTTTTTACAGAGAGGATGGTAATAATGGAATTTGTAGACATACATGATCTCATACATCAAAAAAAAAAAAAAAA

SEQ ID NO: 4249 - DNA, 1262 bp, Triticum aestivum
  misc_feature (1)..(1262): Ceres cDNA ID no. 21705208
  misc_feature (1)..(1262): Ceres CLONE  ID no. 686377
  misc_feature (1)..(1262): Also known as  Ceres CDNA ID no. 24368655
atcacagcatccgaacaagcttaagcagagctgcccaacgagcaaccacaccaccggccgaaatggggcagtccaagccagtcctggtcctcctcctgctcgccgtctccactgcggcgagcagcggcaaaccgctgctcactaagatcaccaaaggcggcgcggcgacggccctgtacacggcgccgctcagcgccggccgcccgctggtcctcgacctctccgccccggccatcacgacgccgtgcagcgggcagacgacgaccgtcacgctctcggccaactctaccgacggcagcaacccgctatccctggtctccttggctgccactgccacctgcgcggcggcaccgtccggtgccgtcggcgtcgcggggctcgcgcgctccagcgcctcgttcccggctcaggtggcgagcacgcaaaaggtggccaactcgttcgctctctgccttccaagcgacggcaggaccgggttcaccggcaacggcgtgggtgcggccatcttcggcggcggcccgttctttctcgcgcccccagcggaccggccgtccatcacgacgctcctctccgacggggttccgctgcgccagcccttcgccggtaaccccggctacttcgtctcagccaccaacggcatcgccatagacgggacgcgcgtggccgtgtccggcaccggcgcgctcgtggtcggcctctccaccacgatctcctacgcgcagctccgtgccgacgtctaccgtcccttcatcacggccttcgaccgcgccatgggctccagcgccaaggtcgcggccgtggcgccgttcgagctgtgctatgactcgtcgaagctggcgccgacgcggttcgggtacctggtgccgaacgtggacttgatgctggagggcgggacgaactggacggtggtgggcggcaactccatggcgcaggtgaacagcggcacggcgtgcttcgcgttcgtccggtctgggagcacggacgcgacgccggcgctggtgatcggagggttccagatggagaacaagctggtggtgctggacaatggcaagaagacgctcagcttcactcagaacctcccgggcatggggttctcctgcagcaacttcaatttcaccaaggccgcctagcgatccacattgtttaagtcgtttgttgcatggtgtgggttgggtgtgtgacactctcacacaagaactttatgttggaataataaatttaaaataaaataaatcaaattgaagtcaaaaaaaaaaaaaaaa

SEQ ID NO: 4250 - protein, 355 aa, Triticum aestivum
  misc_feature: PFam Name: Asp; PFam Description: Eukaryotic aspartyl protease
  misc_feature: GI Number: 34907226; NR Description: putative dermal glycoprotein precursor [Oryza sativa (japonica cultivar-group)] >gi|20160766|dbj|BAB89707.1| putative dermal glycoprotein precursor
  misc_feature: GI Number: 34907222; NR Description: putative dermal glycoprotein precursor [Oryza sativa (japonica cultivar-group)] >gi|20160764|dbj|BAB89705.1| putative dermal glycoprotein precursor
  misc_feature: GI Number: 34907228; NR Description: putative dermal glycoprotein precursor [Oryza sativa (japonica cultivar-group)] >gi|20160767|dbj|BAB89708.1| putative dermal glycoprotein precursor
  misc_feature: GI Number: 47824814; NR Description: xylanase inhibitor
  misc_feature: GI Number: 34907218; NR Description: putative dermal glycoprotein precursor [Oryza sativa (japonica cultivar-group)] >gi|20160762|dbj|BAB89703.1| putative dermal glycoprotein precursor
MGQSKPVLVLLLLAVSTAASSGKPLLTKITKGGAATALYTAPLSAGRPLVLDLSAPAITTPCSGQTTTVTLSANSTDGSNPLSLVSLAATATCAAAPSGAVGVAGLARSSASFPAQVASTQKVANSFALCLPSDGRTGFTGNGVGAAIFGGGPFFLAPPADRPSITTLLSDGVPLRQPFAGNPGYFVSATNGIAIDGTRVAVSGTGALVVGLSTTISYAQLRADVYRPFITAFDRAMGSSAKVAAVAPFELCYDSSKLAPTRFGYLVPNVDLMLEGGTNWTVVGGNSMAQVNSGTACFAFVRSGSTDATPALVIGGFQMENKLVVLDNGKKTLSFTQNLPGMGFSCSNFNFTKAA

SEQ ID NO: 4251 - DNA, 1535 bp, Triticum aestivum
  misc_feature (1)..(1535): Ceres cDNA ID no. 21705209
  misc_feature (1)..(1535): Ceres CLONE  ID no. 686500
  misc_feature (1)..(1535): Also known as  Ceres CDNA ID no. 24369608
cacagaaatccaataaaaccaacaagatctccaaccttctggttgagaattttgaggcaagaggtagctagcctagccatgtctccctctcttgatctgccctcccggatcctgccccgcgtgctcatcgtctcccgccgcaccgtccgcaagaacaagttcgtcgacttcgtcggggagtaccatctggacctggtggtgggctacggcgcggtgccgatcatcgtgccgcgggtcgccggcgtgcacgccatgcttgactccttcgaacccatccatggcgtgctcctttgcgagggcgaggacatcgacccctccctctacgacgccggcggcgacggcatcgacggcgacgcgctctcgccggagcagctcgaggccgtgcggcgcctccacccgagcgacgccgtggtggaccacgagaaggactccatcgagctcctcctagcgcgccgctgcctcgagcgcagcgtcccgttcctcggcatctgccgcggctcgcaggtgctcaacgtcgcctgcggcggctcgctctaccaagacgtcgagcaagagctgcaccccgcggccgacgccaccgtctgccacatggactacgccaactacgacgggcacaggcacccggtgcgcgtgctccccgacacgccgctgcacgactggttcgccgagtcgctgatcggcggcgaccagctgatggtgaacagctaccaccaccagggcgtgcggcgcctggccgagcggttcgtcccgatggcgcatgcgccggacgggctggtcgaagggttctacgaccctgacgcatacaaccccggcgaaggcaagttcctcatggggctccagttccacccggagcgcatgcgcaaggagggctccgacgagttcgactaccccggctgcgccaaggcctaccaggagttcgtccgcgcagtcgtcgcatacaaggcgaagctggccgccgcgcatgctcatgtgcacgtccagagcgcggtcaccacgccggcgaaattgaaccacgaaatggagaagcagcgcaaggtgatcggccggagcgtctcgctcgccaagaacatgtacatgttcggcaacaacaacagcgcgcagcatccggcgcagcaccgggacggggacctggacggcggcgcggagttcctggagtcgaacacggcgctgagcgtgcagcaggagaagtggctgaagcagatgggcgcgacggtgcggaatgcgtcggggtacatgaacaggctcaaggttagcgaggagcgggaggcggcagcgcgggcgctcatggcgaagatgtcggtcgcccagctcgccagcctcgccgccttctaccgcgccatgggcaacgtctgctccgaggtgctcgacgccaagctccagccgccgtctacaaccctgcacgagtgacctgtgcgctctgtctctgtgaacctggccggaaatgcttgctcagttcatcagaaatcaaatgttgcatggcatcctgaattaattaaaccgtgtgatgttgatgcatgtcaaaaaaaaaaaaaaaa

SEQ ID NO: 4252 - protein, 442 aa, Triticum aestivum
  misc_feature: PFam Name: Peptidase_C26; PFam Description: Peptidase C26
  misc_feature: PFam Name: GATase; PFam Description: Glutamine
  misc_feature: PFam Name: Peptidase_S8; PFam Description: Subtilase family
  misc_feature: GI Number: 50900658; NR Description: P0443D08.31 [Oryza sativa (japonica cultivar-group)] >gi|15408748|dbj|BAB64151.1|
  misc_feature: GI Number: 19699174; NR Description: AT5g38200/MXA21_90 [Arabidopsis thaliana] >gi|16604300|gb|AAL24156.1|
  misc_feature: GI Number: 47564910; NR Description: glutamine amidotransferase, class I [Bacillus cereus G9241] >gi|47558283|gb|EAL16607.1| glutamine amidotransferase, class I
  misc_feature: GI Number: 46190778; NR Description: COG2071: Predicted glutamine amidotransferases [Bifidobacterium longum DJO10A] >gi|53690259|ref|ZP_00121949.2| COG2071: Predicted glutamine
  misc_feature: GI Number: 46105813; NR Description: COG2071: Predicted
MSPSLDLPSRILPRVLIVSRRTVRKNKFVDFVGEYHLDLVVGYGAVPIIVPRVAGVHAMLDSFEPIHGVLLCEGEDIDPSLYDAGGDGIDGDALSPEQLEAVRRLHPSDAVVDHEKDSIELLLARRCLERSVPFLGICRGSQVLNVACGGSLYQDVEQELHPAADATVCHMDYANYDGHRHPVRVLPDTPLHDWFAESLIGGDQLMVNSYHHQGVRRLAERFVPMAHAPDGLVEGFYDPDAYNPGEGKFLMGLQFHPERMRKEGSDEFDYPGCAKAYQEFVRAVVAYKAKLAAAHAHVHVQSAVTTPAKLNHEMEKQRKVIGRSVSLAKNMYMFGNNNSAQHPAQHRDGDLDGGAEFLESNTALSVQQEKWLKQMGATVRNASGYMNRLKVSEEREAAARALMAKMSVAQLASLAAFYRAMGNVCSEVLDAKLQPPSTTLHE

SEQ ID NO: 4253 - DNA, 1177 bp, Triticum aestivum
  misc_feature (1)..(1177): Ceres cDNA ID no. 21705212
  misc_feature (1)..(1177): Ceres CLONE  ID no. 700176
  misc_feature (1)..(1177): Also known as  Ceres CDNA ID no. 24368476
acccgaccggacccccttcgccgtctccccgccgcgctcgtcgccgccggccagatacatccaatccaagagccgcccgcgcgcccctgctccgaccccaatggcgtggggggcgcccgcgcgggcgcagtcgtcgcgggtgcaggccctctacgacctctgcaggcgcaccttcccctccccctcctccgccgccgccccggccgcccctccccccgccagcgccgtccgggccatatcctccctcatggatactatcagccccgcggacctcgggctcagggacaacagcctcggggacggcggcggcggcggcggcggcgggcacgggttcttcgactcgaccttcgtcaagggcgcggccagggcggccaggtgggcgcagcccatcacctacctgcacgtctacgagtgcgacgccttctctattggaatattctgcttgccaacttcagccgttattcctctccatgatcatccaggaatgactgtgctgagcaaaatcctgtatggttcgatgcatgtgaaatcgtatgactgggtagagcctactgttctggcgagtaatcaacaagtgagactggccaagttacatgcagatgatgttcttactgctccatgtccaactaccgttttgtatccccaaagtggcgggaacctacactccttcacttcagttgcctcttgtgctgttcttgatgtgcttgccccaccatacgctgaggatgctggtcgaatttgcacctattttaatgattatccgttttctagcttctcaagtggacgcgcaaagacagtcgatagcccagataattatgcctggattgaagccataaactcacctgtgtacattaacatgcgccctggcatgtatactggcccgactgtacaggaccgcctatcataaccgacggaccaaggagcatcaagtgtgtatccgggcagcgaggcaccaatacagttcttccaatgttgtagtgttgtaaatgtaccgtaacctgttacttttctattcagattttgtgctagatggatggctacagtgaatatacagttagaactttctcatgctccgttcagtggaggaatccacattgtgtggcctgagcttgttgtgatactgtttttgcgcccccatagtatatctgtgttggtctggtcaaaaaaaaaaaaaaaa

SEQ ID NO: 4254 - protein, 268 aa, Triticum aestivum
  misc_feature: PFam Name: Extensin_2; PFam Description: Extensin-like region
  misc_feature: PFam Name: Vitellogenin_N; PFam Description: Lipoprotein
  misc_feature: PFam Name: FH2; PFam Description: Formin Homology 2 Domain
  misc_feature: PFam Name: Pkinase; PFam Description: Protein kinase domain
  misc_feature: PFam Name: Pyr_redox_2; PFam Description: Pyridine
  misc_feature: GI Number: 21618020; NR Description: unknown [Arabidopsis thaliana]
  misc_feature: GI Number: 25402861; NR Description: protein F15H18.4 [imported] - Arabidopsis thaliana >gi|6714305|gb|AAF26001.1|
  misc_feature: GI Number: 34912166; NR Description: P0712E02.27 [Oryza
  misc_feature: GI Number: 47085985; NR Description: zgc:77862 [Danio rerio]
  misc_feature: GI Number: 14249486; NR Description: chromosome 10 open reading frame 22 [Homo sapiens] >gi|45709957|gb|AAH67740.1| Chromosome 10 open reading frame 22 [Homo sapiens] >gi|17391452|gb|AAH18660.1| Chromosome 10 open reading frame 22
MAWGAPARAQSSRVQALYDLCRRTFPSPSSAAAPAAPPPASAVRAISSLMDTISPADLGLRDNSLGDGGGGGGGGHGFFDSTFVKGAARAARWAQPITYLHVYECDAFSIGIFCLPTSAVIPLHDHPGMTVLSKILYGSMHVKSYDWVEPTVLASNQQVRLAKLHADDVLTAPCPTTVLYPQSGGNLHSFTSVASCAVLDVLAPPYAEDAGRICTYFNDYPFSSFSSGRAKTVDSPDNYAWIEAINSPVYINMRPGMYTGPTVQDRLS

SEQ ID NO: 4255 - DNA, 1394 bp, Triticum aestivum
  misc_feature (1)..(1394): Ceres cDNA ID no. 21705213
  misc_feature (1)..(1394): Ceres CLONE  ID no. 702907
  misc_feature (1)..(1394): Also known as  Ceres CDNA ID no. 24368688
aacacaaaaccaggcggaaaatttccagtccccctccctccaatcccaaaccccgggacacaaaccgcccgcgtcgcagcctcctctcctccgcctccggtgggcgaaacaatggcgctctccctcgcgcgcagcccgcaccccgccgccgcggcggccctcccgctcccccgcattcaggggcgcatttcccagtacgccccgctcctccactcccctcgccgcgcctaccccggcctccgcctccgcctcccggccgccgccgtcgcggcctcctcgcccccggaggcgctggccgccgagcccgcggccgccgcggagggggacgaggagctgggggagacgcggcggaagctcttcgtcggcaacatgccgtttaccttctccgccgcggagacggagaagctcttcgccgagtgcggcgtcgtcaaggacgtcgaggttatcaagatgaaggacgtgaggaagagggggttcgcgttcgtcaccatggccaccgccgaagaggccgccgccgcagcggagaagttcgacggccatgatgtcatgggaaggatcatcaaggtggaattttcaaagagtttcagaaaaccagctccaccaccatctccggacaccattgtcgcaaagtacaagctttatgtttccaatcttgcatggaaagcaaggtctgctgatctgaaggagttcttctcacagtttaacccagtttctgccaatatagtctttgaagatagaaaatcagctgggtatggttttgtatcttttggaacaaaagaggaagcagaggctgctctcactgaactcaatggaaaggaacttatggaaaggcctgttatcctaagatggcgggaggataaagaaagtgtgaaggctgatggtgaagttgaaggcttgaaggttaatgatcaggcagaaggtgtgacggttgatgacagtggtgtggttgaaggtgaagataaacaggagtagtctaatagtactgtgctgggagaaagttgcagtagcttattgataaaagtgcagatgcggaaactcattgtacagatacagaatagaggtgataattgtaatggaagacttcagcaaaggtttctgtcatgatgctgctaagaaaaatggaaacaaagggcattagccgtgatcaaggtgaaacatcatccttgagcatctggcttcagtatttaatacgagtcatgtgcttattgtagtaatcagtactcatttgtactccattgtgaccatgaactgtgtcgttccgagatacttgtagtctcctgattttggacccagttcactgtaatatctcttagcttgctgatcagctttcggcaatgaggcattctcaagctgcaacttaataaaaaaaaaaaaaaaaaaaaaaaaaaaaaaaa

SEQ ID NO: 4256 - protein, 286 aa, Triticum aestivum
  misc_feature: PFam Name: RRM_1; PFam Description: RNA recognition motif.
  misc_feature: PFam Name: FH2; PFam Description: Formin Homology 2 Domain
  misc_feature: PFam Name: Drf_FH1; PFam Description: Formin Homology Region 1
  misc_feature: PFam Name: TT_ORF2; PFam Description: TT viral ORF2
  misc_feature: PFam Name: Pyr_redox_2; PFam Description: Pyridine
  misc_feature: GI Number: 23198314; NR Description: putative chloroplast RNA binding protein precursor [Arabidopsis thaliana] >gi|3608147|gb|AAC36180.1| putative chloroplast RNA binding protein precursor [Arabidopsis thaliana]
  misc_feature: GI Number: 58532112; NR Description: OSJNBa0009P12.1 [Oryza
  misc_feature: GI Number: 34913270; NR Description: putative 29 kDa ribonucleoprotein A, chloroplast precursor [Oryza sativa (japonica cultivar-group)] >gi|22296371|dbj|BAC10140.1| putative 29 kDa ribonucleoprotein A, chloroplast precursor [Oryza sativa
  misc_feature: GI Number: 50946971; NR Description: putative RNA-binding protein cp33 [Oryza sativa (japonica cultivar-group)] >gi|42408160|dbj|BAD09298.1| putative RNA-binding protein cp33
  misc_feature: GI Number: 3550485; NR Description: cp33Hv [Hordeum vulgare subsp. vulgare] >gi|7446339|pir||T05730 probable RNA-binding
MALSLARSPHPAAAAALPLPRIQGRISQYAPLLHSPRRAYPGLRLRLPAAAVAASSPPEALAAEPAAAAEGDEELGETRRKLFVGNMPFTFSAAETEKLFAECGVVKDVEVIKMKDVRKRGFAFVTMATAEEAAAAAEKFDGHDVMGRIIKVEFSKSFRKPAPPPSPDTIVAKYKLYVSNLAWKARSADLKEFFSQFNPVSANIVFEDRKSAGYGFVSFGTKEEAEAALTELNGKELMERPVILRWREDKESVKADGEVEGLKVNDQAEGVTVDDSGVVEGEDKQE

SEQ ID NO: 4257 - DNA, 1112 bp, Triticum aestivum
  misc_feature (1)..(1112): Ceres cDNA ID no. 21705215
  misc_feature (1)..(1112): Ceres CLONE  ID no. 703331
  misc_feature (1)..(1112): Also known as  Ceres CDNA ID no. 24369718
gcaaaccaacagctgctactccagcatccacccatccatccatctctcatcttcttcttcttgcaacgaaacgagagcatctagcttacagcgagctaaagattcgaacgatggccgttcttgtggcgaggcaggggcgcgagctgcagcggtacagcgcgagcacccgcgggcgcatcgtggtggggtgcatcccctaccgggtgcgcggcggcggcggcgagggcgagggcgagctggaggtgctggtgatcagctcgcagaaggggcacggcatgatgttccccaagggcgggtgggagctggacgagtccatggacgacgccgcccggcgcgaggccctggaggaggccggcgtccgcggggagatgggcaaggtgctcggctgctggcactaccagagccgccgctaccagaccacctacgagggcatcatgtacccgctccgcgtcaccgacgagctccagcagtggcccgagatggcctcccgcaagcgcacctgggccacggtgcagcaggtcatggagggatgccagcactgctggatgcgggaggcgctcgaggagctcgtcgcccggcacgccaagccgcagtccgccctgtgaacgatcaagcaagcgggcgggtggggtgactggagctcgagcgcgcgcgactctcgcgagaagaggcctggagcgagcaccaacgtccgtccgtccgtcgtcctcgtcgtctctctctcctttcctcggtgcagcggcaggcctgccggcgtgtccggcgtcgtacgacgaccggaccggagcatatatttggccgcccttgccggagagacggactggggacgatggcacgcgcgcgtcaaccctttctcgaggcgtagagtcgtcgtcgtcgtcgccgcggcaaataatagggacgaacttagaaatgtgtagatcgaaagcgaacggggcacgaaaacttgacaaaacaccgcccttcctggtggtacgagcaagctcacgattctttctttaggctcttggagtaaaagatcaatcaaattgtaaattaatttaagtagccgcttttctgtggcacgctcgatcaatcaaacgattactacaatctgaaaaaaaaaaaaaaaa

SEQ ID NO: 4258 - protein, 164 aa, Triticum aestivum
  misc_feature: PFam Name: NUDIX; PFam Description: NUDIX domain
  misc_feature: GI Number: 52076410; NR Description: MutT/nudix-like [Oryza
  misc_feature: GI Number: 21595695; NR Description: unknown [Arabidopsis thaliana]
  misc_feature: GI Number: 27765008; NR Description: At1g18300 [Arabidopsis thaliana] >gi|8671772|gb|AAF78378.1| T10O22.27 [Arabidopsis thaliana] >gi|15221055|ref|NP_173266.1| MutT/nudix family protein [Arabidopsis thaliana] >gi|6714298|gb|AAF25994.1| F15H18.18
  misc_feature: GI Number: 31747031; NR Description: MutT-like protein
  misc_feature: GI Number: 50882190; NR Description: MutT-like protein [Oryza sativa (japonica cultivar-group)] >gi|38175436|dbj|BAC16411.2| MutT-like protein [Oryza sativa (japonica cultivar-group)] >gi|50508904|dbj|BAD31700.1| MutT-like protein [Oryza sativa
MAVLVARQGRELQRYSASTRGRIVVGCIPYRVRGGGGEGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAKPQSAL

SEQ ID NO: 4259 - DNA, 1589 bp, Triticum aestivum
  misc_feature (1)..(1589): Ceres cDNA ID no. 21705216
  misc_feature (1)..(1589): Ceres CLONE  ID no. 705406
  misc_feature (1)..(1589): Also known as  Ceres CDNA ID no. 24369682
gaaagccggctcttgctcttgttcttcgtcttcctctacactgcatatttacacatgcaagaattgagaagcacaacaaagagcgcgcagagctaattaagctaagctaggtaaacaaggtagtccacttggttgcaggatggcgtgggtgagggacatgaagacgaagctcgaggacgccgagctgccggacaaggtgcagagatggccgaagcactgcattttcagcgtcccaccgcgcttcaagatggtcgacagcagcgtctacaagccgcagactgtgtctctcggcccattccatcatggcgctcaggacctgaaatccatggaggagcacaagttgagggctgtccgtcacctcctggcccgggacagctacataacctcccttgacgaccttgtcagggccgtggaagaggtggccgacgagctggaggactcctacatggacctaagtggagagtggcgtggcaaggagaacaggggcaagttcctcgagatgatgatcacggacggctgcttcctgctggaggtgatgaggacggacgcgacccaaaaggaggactccgttgtaaagggctatgcgcacgaccccgtcttcagctggtatggcatacaacacatcaagccgttcgtccaacgtgacatgctcttggtagagaaccagctgccactcaggttgctccagagaatcgttgccatggaggaacgcaactctccgaggcagaacacagattccataaattccatggtgctcaagttcctggggcagaaagatgcacagcccagatatgagttgggactccacccgctcgacatctaccggacgagccagttcaggggcatccaagagcatattaacactgccagttgtctgatgatccatcatcaacatatgatgcgggaggagacccatcgtccacagagacccctggcccgatctgcgcgggagctgaccgaggcagggatccggttactgcccatagagacaagccgcctcaacgatttccggttcgataggagtgatgggacgctccaaatgcccaagatccacgtgcatgactccaccgcctacatgttccgcaacatgatggcgttcgaggtgctgcgcgtcggcaccaccaacgacgtgacggcgtacgtcatgtttctcaaggacatcgtcgactccgcctacgatgttcgcctgctggtgaggaacggggtcctggagcacgaccttgccaacgacaacgccgtggtgaggctcttcaacggcctcaccagggacgtgacaaggaactgggagaatcagctggcgtacatgaaggtgcgtgaagacgtggagaactactgcatgacccaccaccgcaccaactgcgtgcgcctctttctcaatcaatcctgggcctacctcatgaccaagtacttgagcaacccctggacattccttggcctcgtcaccgccaccttgctcctcgtcgcagatatcgtgcaggccgtgtatgcagtcaaatcgtacaaagagggcaaatgaatgtattaatcagaagcatttcatacatttgttgtttttattcaattgttttgaattaaaaaaaaaaaaaaaa

SEQ ID NO: 4260 - protein, 458 aa, Triticum aestivum
  misc_feature: GI Number: 34914152; NR Description: P0496H05.27 [Oryza sativa (japonica cultivar-group)] >gi|21743301|dbj|BAC03297.1|
  misc_feature: GI Number: 34894670; NR Description: B1153F04.26 [Oryza
  misc_feature: GI Number: 5852175; NR Description: zhb0005.1 [Oryza sativa
  misc_feature: GI Number: 20466085; NR Description: AT5g22550/MQJ16_9 [Arabidopsis thaliana] >gi|15450645|gb|AAK96594.1|
  misc_feature: GI Number: 34914144; NR Description: P0496H05.21 [Oryza sativa (japonica cultivar-group)] >gi|21743297|dbj|BAC03293.1|
MAWVRDMKTKLEDAELPDKVQRWPKHCIFSVPPRFKMVDSSVYKPQTVSLGPFHHGAQDLKSMEEHKLRAVRHLLARDSYITSLDDLVRAVEEVADELEDSYMDLSGEWRGKENRGKFLEMMITDGCFLLEVMRTDATQKEDSVVKGYAHDPVFSWYGIQHIKPFVQRDMLLVENQLPLRLLQRIVAMEERNSPRQNTDSINSMVLKFLGQKDAQPRYELGLHPLDIYRTSQFRGIQEHINTASCLMIHHQHMMREETHRPQRPLARSARELTEAGIRLLPIETSRLNDFRFDRSDGTLQMPKIHVHDSTAYMFRNMMAFEVLRVGTTNDVTAYVMFLKDIVDSAYDVRLLVRNGVLEHDLANDNAVVRLFNGLTRDVTRNWENQLAYMKVREDVENYCMTHHRTNCVRLFLNQSWAYLMTKYLSNPWTFLGLVTATLLLVADIVQAVYAVKSYKEGK

SEQ ID NO: 4261 - DNA, 1815 bp, Glycine max
  misc_feature (1)..(1815): Ceres cDNA ID no. 21705217
  misc_feature (1)..(1815): Ceres CLONE  ID no. 707142
  misc_feature (1)..(1815): Also known as  Ceres CDNA ID no. 24367341
atctatttggctaggtttgtacagcgtttgctttgggggcgaaaaattcagccttttccgatttgcaccaaattcaacagagaacaacaccatttgcttgcgtgtcaaacagtggattgctgtaaactgcattatttggctgttagctaatggacaagggggtgccacctagcctcttcgtcaatgacggttctttcatggagaggttcaagcaacttcagcaagagcaggagaaagggaagaatgtcaaattggaggattctaaaccaattaaggttaattcagggtctttgtctcccaatcactccattaccaaaacgcccgtggacttgaaggttaatgacacaagaaaaacatctcagggtggttccagtggcaagctagctttcagtttaaaacaaaagtcaaagctggtgccaccccctgttaagttaagtgctgatgaggatgaagaaactgaagctgggtatgtttcaaatgatgcaccactaaaacggcaaaagttaggccaggaggaaggcattgaccaatcatcaagacaacttgatgttgcacctcattccccaagtgatcctacagtgaagaaagttgctgacaaactggcaagttttgtggctaaaaatggaaggcaatttgaggatgtaacacgccaaaaaaatcctggggatacacctttcaaatttttgtttgatgagagatgtgctgaatacaagtattatgaatatcggcttgctcaagaagaagatgctcttgggcaatcaagggaatcacaggtgcctcgtaacgggggtacaagcacttcatcttccaaacaggctagtggtcatcagagatcatctcagcagcatacataccaaattcctgcatctgctttatatgaaagtcctgacaatccaagagcttctggattttcaattcaaacatcaccagtaggaagcagtgaagagcccagtggttcatcaaatgctgattctttggcgctaatggagttctacatgaaaaaagctgcacgggaggagaagtataaacaacctaagcattcaaaagatgagatgccccctcctgcttctcttctaggcaaaaaaggccatcacatgggtgatttcattcctccagaagaactcgagaagttcttggctacctgtaatgatgctgcagcgcagaaagctgctagggaggctgcagagagggctaagattcaggctgataatgtaggccaccggctcctgtcaaaaatgggttggaaagaaggtgagggtttgggtggatccaggaagggtattgcggatcctatcatggctggtaatgttaagaagaataacttgggggttggtgctcaggaacctggggaggtgagtgcagaggatgacatatacgagcagtacaaaaagcggatgatgcttggctaccgttaccgacccaatcccctgaacaatccccgcaaggcttattactgaacttgacagtgggagctgtctgcaagtcttttcaggaaaaaagtgaacttttcacaatgttggatgaactggtgtgttgatagtagggtttttattgtgcgttgcactgcttgtaagtctgctgaacttaagatttgggggagaaaagagggggaagggtgtaatgttcatcacagccgcatttttatccgccaaagaataatgggttttttttttttgttacttttacttgtcagagcttttgaaagatgtttttttatcgctagtatattatgaagtggtacagggatattacggtgtataaggtttgtttaatccgggaaacctagtcttttagatattaaaaaaaaaaaaaaaa

SEQ ID NO: 4262 - protein, 435 aa, Glycine max
MDKGVPPSLFVNDGSFMERFKQLQQEQEKGKNVKLEDSKPIKVNSGSLSPNHSITKTPVDLKVNDTRKTSQGGSSGKLAFSLKQKSKLVPPPVKLSADEDEETEAGYVSNDAPLKRQKLGQEEGIDQSSRQLDVAPHSPSDPTVKKVADKLASFVAKNGRQFEDVTRQKNPGDTPFKFLFDERCAEYKYYEYRLAQEEDALGQSRESQVPRNGGTSTSSSKQASGHQRSSQQHTYQIPASALYESPDNPRASGFSIQTSPVGSSEEPSGSSNADSLALMEFYMKKAAREEKYKQPKHSKDEMPPPASLLGKKGHHMGDFIPPEELEKFLATCNDAAAQKAAREAAERAKIQADNVGHRLLSKMGWKEGEGLGGSRKGIADPIMAGNVKKNNLGVGAQEPGEVSAEDDIYEQYKKRMMLGYRYRPNPLNNPRKAYY

SEQ ID NO: 4263 - DNA, 1435 bp, Glycine max
  misc_feature (1)..(1435): Ceres cDNA ID no. 21705219
  misc_feature (1)..(1435): Ceres CLONE  ID no. 708334
  misc_feature (1)..(1435): Also known as  Ceres CDNA ID no. 25088303
agtggtctagctatctccctagttttctgaggctctagtggaaccgaacagagacaagaacaaccgcccaggaatattccatttcctttatcctcggtgcttctgtcccctttctcggatctcagattcattcattcacacattccacctcaatggccgctcccgcctccaacgctgtgctcctcggagacgttcacttcgacgacgtcgccgcaaagccttgcggcgttcacttccgcggcgaaacgcggcgaggcgcgctccgagccaccgtgaatctccgaaagccgaaaacgttgagcggtattctgaatttcgggtgttccacatcggatgcaagttggaggagctggaatccgagttcgctccacaggaactcgtccttcgcttgctgctccgccgagacaacgccgcatgttcagcacctcgcaacctccaccttctcgattgaccagactaattttggtggcgagaggttgaagctgttttcggggtcatgttacctaccacatccggataaggaggacacaggtggagaggatgcacattttatttgcacagatgaacaagcaattggtgttgcagatggtgtaggtggctgggcagatgttggtgttaatgctggactctttgctcgagaactcatgtctcattctgttagagcaattgaagaggaacccaaaaattctattaatccggctagggttttagagaaggctcactcatgtacaaaggccaagggttcatcaacagcttgtatcattacccttactgacacgggactacatgccattaatttgggtgacagtgggttcatcgtggttagagatggatgcaccattttcaggtcccctgttcaacagcatggcttcaattttacatatcaactggagagtggcaatggaggtgatctacccagctctggtgaggtctttacaatacctgttgccccaggagatgttgtcgttgctggaacagatggattgtttgacaatctgtacaatgatgaggtcactgaagttgttttacattcagttagagctggactagaaccccaagtaactgctcagaagatagcagtactggctcgtcaacgagcactggacaggaataggccgacaccattttctacggctgctcaagaggctgggttccgttattatgttggcaaacttgatgacataacagttgttgtgtcatacataaccggctcaacatgtgtgagtttttcgccatcttagctttgctacattttgtatattcatatttgtctacagggactgggttgccagccttgtctgtcatttttgacctgaatgcactactgcttcaaaattttatctcaaacttgaggtgcttacttgctatagtgatatatttgtatacaaaatcctgggccacgaagatgccttcatctccaaaaaaaaaaaaaaaa

SEQ ID NO: 4264 - protein, 362 aa, Glycine max
  misc_feature: PFam Name: PP2C; PFam Description: Protein phosphatase 2C
  misc_feature: PFam Name: SpoIIE; PFam Description: Stage II sporulation
  misc_feature: GI Number: 42573816; NR Description: 5-azacytidine resistance
  misc_feature: GI Number: 47525231; NR Description: BTH-induced protein
  misc_feature: GI Number: 50910960; NR Description: 5-azacytidine resistance protein-like [Oryza sativa (japonica cultivar-group)] >gi|49388180|dbj|BAD25306.1| 5-azacytidine resistance protein-like
  misc_feature: GI Number: 21464366; NR Description: RE06653p [Drosophila melanogaster] >gi|24655293|ref|NP_647619.1| CG12091-PA [Drosophila melanogaster] >gi|7292094|gb|AAF47506.1| CG12091-PA [Drosophila
  misc_feature: GI Number: 24640366; NR Description: CG15035-PA [Drosophila melanogaster] >gi|7290815|gb|AAF46259.1| CG15035-PA [Drosophila
MAAPASNAVLLGDVHFDDVAAKPCGVHFRGETRRGALRATVNLRKPKTLSGILNFGCSTSDASWRSWNPSSLHRNSSFACCSAETTPHVQHLATSTFSIDQTNFGGERLKLFSGSCYLPHPDKEDTGGEDAHFICTDEQAIGVADGVGGWADVGVNAGLFARELMSHSVRAIEEEPKNSINPARVLEKAHSCTKAKGSSTACIITLTDTGLHAINLGDSGFIVVRDGCTIFRSPVQQHGFNFTYQLESGNGGDLPSSGEVFTIPVAPGDVVVAGTDGLFDNLYNDEVTEVVLHSVRAGLEPQVTAQKIAVLARQRALDRNRPTPFSTAAQEAGFRYYVGKLDDITVVVSYITGSTCVSFSPS

SEQ ID NO: 4265 - DNA, 1260 bp, Glycine max
  misc_feature (1)..(1260): Ceres cDNA ID no. 21705220
  misc_feature (1)..(1260): Ceres CLONE  ID no. 708416
  misc_feature (1)..(1260): Also known as  Ceres CDNA ID no. 24367318
aaaagttgccgaagaaaatataaacccttataaattgatgtagtgctcaataattgatgagacaaattgagaagaaaaatcttcaattgtgactcctcaacccacttgattcaccccaactcaataattttagccaccagtgtgtagataacttaagccaaaacaactcaccaattcttttggataccaccttccatatattgatattgcaaaagatagttaaatttcattccgaaacaatgatcaacaaagtagcagttctattagttgttttgcttttcatcattgctgctttggcttctgatcctgatccagtaatggacttttgcatagccaaatcaccagacaatagcttcagttgcaagaactcatctacagcaacagtggaagatttcacctattctggcataaagtctcctgggaacttcaagcaaactggattctcttctatggcagtgaattcgaatgtctttccgggtttgaacactcttggtgtgtcatttgtgcgagcagattttggtgttggcggcgtcaatgtgccacacttccatccaagagcaacagaggttgcttttgtgctggaaggaaaaatttattcaggatttgtggacaccaacaacaaggtttttgccaaagtattggagaaaggagaggtcatggtgttcccaagaggcctagtgcactttcagatgaatgttggagataggcctgctaccattttgggcagttttgacagccaaaatcctggcctgatgaggattcctaatgcagtttttggctctgacataaaggaggagcttttggagaaggcttttggactgagttctaaggagctttccaagttgaagaagaggttttctcctagttaaaatgcattttctgtttatggagacagtggaaaatttaacatgatacctattattgcagaatgttgctgatgattagttgaaaatacccccatcaatagaaagctattggattgatttgtagttaataattattttttaataattcagcctttcttacttaaagggctgattttagagctagagttatttagtatagaagttattccattttaaaatttcacttcccttcagttaaggaaggagcttaagaggagtttgaactgattagaactttatttccaacttcttgcttttgtcttctgaacatattctaaagtcaatgcagtcattgacatttggttcaattatacacgtttggcacaaaagctaaaaatcaaaaaaaaaaaaaaaa

SEQ ID NO: 4266 - protein, 209 aa, Glycine max
  misc_feature: PFam Name: Cupin_1; PFam Description: Cupin
  misc_feature: PFam Name: Cupin_2; PFam Description: Cupin domain
  misc_feature: GI Number: 6143869; NR Description: germin-like protein [Arabidopsis thaliana] >gi|21554012|gb|AAM63093.1| germin-like protein [Arabidopsis thaliana] >gi|15232830|ref|NP_187619.1| germin-like protein, putative [Arabidopsis thaliana]
  misc_feature: GI Number: 50251393; NR Description: putative germin-like
  misc_feature: GI Number: 27529869; NR Description: germin-like protein
  misc_feature: GI Number: 6429233; NR Description: germin-like protein
  misc_feature: GI Number: 34902528; NR Description: probable germin protein 4 [Oryza sativa (japonica cultivar-group)] >gi|7447337|pir||T02658 probable germin protein 4 - rice >gi|2655291|gb|AAC04835.1| germin-like protein 4 [Oryza sativa] >gi|13486730|dbj|BAB39965.1|
MINKVAVLLVVLLFIIAALASDPDPVMDFCIAKSPDNSFSCKNSSTATVEDFTYSGIKSPGNFKQTGFSSMAVNSNVFPGLNTLGVSFVRADFGVGGVNVPHFHPRATEVAFVLEGKIYSGFVDTNNKVFAKVLEKGEVMVFPRGLVHFQMNVGDRPATILGSFDSQNPGLMRIPNAVFGSDIKEELLEKAFGLSSKELSKLKKRFSPS

SEQ ID NO: 4267 - DNA, 1789 bp, Glycine max
  misc_feature (1)..(1789): Ceres cDNA ID no. 21705221
  misc_feature (1)..(1789): Ceres CLONE  ID no. 708710
  misc_feature (1)..(1789): Also known as  Ceres CDNA ID no. 24367703
aaagtatgcactgtaagaagcagagccaaggttgtatgtgaaagactctgatgtgaggcatgagaatgagatcattagcatttgttgtgattctgctccttctttcacccaccattgtcaaatctctctccctccctcatactccatctccatctccatctccatctccatctcctccttccacatcatcctcatccactttggacccaaaacaagcaacagcccttgaatccctcaacttccccacctcaaaggacccctgcgccaagccctccttccacaatgccaccctctgcgacgccgccaagcccttccgccacctcatctccctccgcctcgccaactgctcctcctacctctccctctccttcactgccctcaagtccctctccaccctccgctccctctccctcctcaactgccccgtcacccccatccgcctccccgccgacctcgccctctccctcacctccttcacctgcgtcaacagcctccgcaaactctccggcgtctggctctccaacctccagaacctcaccgacctcaccgtctccgacgtcaacgtcaaagcctccggccccttcgtcatcctcgcccgcatgaccaagctccaaaccctcaccatctccaacgccaatctcaccggatccctccccggccacctccactccaacctcacacacatcgatttctccaataaccgcctcaaaggcaacattcctccttccataactatgctcgacagcctccagtttttgaatctctcctctaactccctcgccggagaaatacctgcttccatcggtgacctaatttcactcaaaaacctctccctctcctccaactccttctccggttccattcctgattccgtatctgctttaccgagtttgattcacatggatctgagctctaaccagctcaacggcaccatacccaagttcatttcacagatgaagtctcttaagcacctgaatctcgccaacaacaacctccacggggttgtgccttttaacctctctttcattaagcgattagaagtgttcaaggttggtggcaacagtaatctttgctataaccattccatggtgtcttccaagttgaagcttgggatctcgccctgtgataagttcggaatgccggtcactccgccgtcgaaggattcttctgccgatgatagcagcgacgatgattacgatgagggtgatgaggaagggagtaggcacaagaaggagcatcatcatggacctaacaagtttgttcttggtgtcgccattgcgctctcttctattgtctttctcattgttttcttgatcctctgctccaaatgttgtcgttaattagaggaaatttttgatttttggttttgggtttttacagatttttagattaggaatattcataaattcagttgagtgcaacttgtttgatatatttatttatcattattaattaattaattaattattatacagtagtggttacattactacagggtaggttcaaggaaaggaaacataatgaaaatgtaactgccgaaaaaaaaggaaattgttatttacattttggtggggatgtatggaaaaatgaggaaggagagacattaatcaatagcatgtgcagtgcaatgagtttatcatgggatgctagatgctaggtttttattttgacaccgttttattcgttgtttggagtaaaaggtggaggtggtgcatgtgaatgtggtatcttcaagttttatgttacttgtgctataagcgtttgttgttcattaaaaaaaaaaaaaaaa

SEQ ID NO: 4268 - protein, 426 aa, Glycine max
  misc_feature: PFam Name: Pyr_redox_2; PFam Description: Pyridine
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: PFam Name: FH2; PFam Description: Formin Homology 2 Domain
  misc_feature: GI Number: 49333375; NR Description: putative leucine-rich
  misc_feature: GI Number: 49333390; NR Description: putative leucine-rich
  misc_feature: GI Number: 34909552; NR Description: P0046E05.6 [Oryza sativa (japonica cultivar-group)] >gi|15623842|dbj|BAB67901.1| P0046E05.6
  misc_feature: GI Number: 57899152; NR Description: disease resistance
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
MRMRSLAFVVILLLLSPTIVKSLSLPHTPSPSPSPSPSPPSTSSSSTLDPKQATALESLNFPTSKDPCAKPSFHNATLCDAAKPFRHLISLRLANCSSYLSLSFTALKSLSTLRSLSLLNCPVTPIRLPADLALSLTSFTCVNSLRKLSGVWLSNLQNLTDLTVSDVNVKASGPFVILARMTKLQTLTISNANLTGSLPGHLHSNLTHIDFSNNRLKGNIPPSITMLDSLQFLNLSSNSLAGEIPASIGDLISLKNLSLSSNSFSGSIPDSVSALPSLIHMDLSSNQLNGTIPKFISQMKSLKHLNLANNNLHGVVPFNLSFIKRLEVFKVGGNSNLCYNHSMVSSKLKLGISPCDKFGMPVTPPSKDSSADDSSDDDYDEGDEEGSRHKKEHHHGPNKFVLGVAIALSSIVFLIVFLILCSKCCR

SEQ ID NO: 4269 - DNA, 1190 bp, Glycine max
  misc_feature (1)..(1190): Ceres cDNA ID no. 21705222
  misc_feature (1)..(1190): Ceres CLONE  ID no. 708813
  misc_feature (1)..(1190): Also known as  Ceres CDNA ID no. 24367322
ctttcttttggatgtgaatgtccagcggcaacatttgtgttgaataatttactttatttgtggtttgaggagtgagtgagtgagtgatgtctgagtgtggctgttccgagtcagacccttcgtgtggttgttggtcgagcagcagcagcagatctgtggcctcaactgaactgaagctgtaccgagcattcatcttctgtgttcccatcttcttcactctcattctcctctttctcttctatctcttctacctccgaccgcgaactaggctccattggatttcacactttcgccttcccagcaacaacaaccgcaataatgccatctccacattgggtttgggcttgaacaaagaacttagagagatgctgcccattattgtctacaaggaaagcttctccgtcaaagatactcaatgctcagtgtgtcttttggactaccaggcagaggataggctgcaacaaatacctgcatgtggccatacatttcatatgagctgcattgatctttggcttgccacccataccacctgtcctctctgccgcttctccctactaaccactgctaaatcttcaacgcaggcatccgatatgcagaacaatgaagaaacacaagccatggaattctctgaatcaacatctcctagggatctagaaaccaatgtcttccaaaatgtctctggagaagttgccatcagcactcactgcattgatgttgaagggcaaaatgtgcaaaacaatcaataggagcatgatgatgcaaaactctttcaggtgtatcaagttgataatcaattctactatcaaaatgatgaaatccagatatattgacaaacttatcccttccaactcagttgaatgaagcctccagagtgtgcgcagcaactgcacagattgatacttcggcaagaaatgtcttcattcggggaactacagctttgatggtacatttgaattgactcatcattattgtaacttatggtaccctgaatgtgtcttttaagcattctaattttggttaatgtacctaagatagtttacatcacaagtgaaaagtattttatatattgctggtttttcttcttttttttcctgcgttttttcgttaaaaatgcaaagggtttggtttttggatttagatcctgtcttatccattttgtcgttcccactaaaaataaaaaaaaaaaaaaa

SEQ ID NO: 4270 - protein, 219 aa, Glycine max
  misc_feature: PFam Name: zf-C3HC4; PFam Description: Zinc finger, C3HC4
  misc_feature: GI Number: 34365601; NR Description: At1g49230 [Arabidopsis thaliana] >gi|51971166|dbj|BAD44275.1| putative RING zinc finger protein [Arabidopsis thaliana] >gi|51970612|dbj|BAD43998.1|
  misc_feature: GI Number: 29028800; NR Description: At4g24010 [Arabidopsis thaliana] >gi|51316423|sp|Q84TF5|RH4A_ARATH RING-H2 zinc finger protein RHA4a >gi|42573015|ref|NP_974604.1| zinc finger (RING-H2
  misc_feature: GI Number: 18418241; NR Description: zinc finger (C3HC4-type
  misc_feature: GI Number: 21655299; NR Description: AT4g30400/F17I23_260 [Arabidopsis thaliana] >gi|15809840|gb|AAL06848.1|
  misc_feature: GI Number: 18417587; NR Description: zinc finger (C3HC4-type
MSECGCSESDPSCGCWSSSSSRSVASTELKLYRAFIFCVPIFFTLILLFLFYLFYLRPRTRLHWISHFRLPSNNNRNNAISTLGLGLNKELREMLPIIVYKESFSVKDTQCSVCLLDYQAEDRLQQIPACGHTFHMSCIDLWLATHTTCPLCRFSLLTTAKSSTQASDMQNNEETQAMEFSESTSPRDLETNVFQNVSGEVAISTHCIDVEGQNVQNNQ

SEQ ID NO: 4271 - DNA, 1885 bp, Glycine max
  misc_feature (1)..(1885): Ceres cDNA ID no. 21705224
  misc_feature (1)..(1885): Ceres CLONE  ID no. 710055
  misc_feature (1)..(1885): Also known as  Ceres CDNA ID no. 23689584
aataaaaaatcgttcttgacttcttcttaacttccatcgtccatggcggtttcggggttgagaagcggtggtttgcctctcttccaccatcaccaccaccaccaccaccttcgcttccttcaatcccctccttcctttgccaagctcagttttcttggctccaagtcgtcgaagaaggggttcacagtcttctcccgctatgcgcaagcgcgtgaccttttctcctcgcgtagattccaagatagcatggagaagctgccgaacctggtggaggacattgtgcagacatccttaaacactggtccaaggggtgtcctgaggttggctcaaggtgttcaggccttccttggggttggtcaggagtggttaactgatgtctctaagtcagcaaattcatttgctgggttaccgactgaactgcagcttggtttactctcccccttttatttgaggaggttgtttgagcgcatgggtgcaacctatatcaaattgggtcagttcatagcatcagcgccaacgctgtttccacctgagtatgtacaagaattccaaaattgttttgatagagctcctcctgttccttttgaggaaattgaatctatattgcgcaaggaattaggaaagccattagaaagtgtttatgaatacattgacccaacacccattgcttctgcgtctatagcacaggttcatggagcaaggctaaaaggctctagggaggatgtggttataaaggtcttaaaacccggaatagaggacatattagtggcagatcttaattttgtttatgttgttgctaggatattggagttcttgagtcctgaaataagccgaacatcactggttggtattgtcaaagatatacgtgagtctatgcttgaagaagttgacttttacaaggaggctgcaaatattgaggcttttaggagatatttagaaacaatgggacttactgggaatgcaacagctccaaaagtgtatcgatactgcagtacaatgaaagttttaactatgcaaagactatatggagttcctcttactgacctagactccataagttcattagtttctaatccagaaaccagccttataactgctctcaatgtgtggtttggaagtttgcttgcatgtgaatcttttcatgcagatgtacatgcaggaaatctgtggcttctacgtgatggccgtattgggtttcttgacttcggaattgttggtcgtatatcccctaaaacatgggctgctatggaagtcttcttaggatcaattgccattgaagattatgactcaatggcatcttccttaattgaaatgggtgctacaaaccaggatgttgatgctaaggcctttgcaagagatttggaaaaagtattctcatcaattaaggaattggacactgaaatagttgtagcaactacaactggaacagccacaaatgcaactgctgttgctgctaatatagttgttgatgagaggcagatgaatgcactctttcttgatgtggttcgggttagtgaatcatatggattgaagtttcctagagaatttgctcttctcctgaaacagctcttgtactttgaccggtacacacggttgctggctcccaacttgaacatgcttcaggatcagaggatttccattgcttccaatagcagaagcagggtatagagacaatttttaaggagttggtacacaaaatctagatgtaccccatcttagttcaaaatattttatttgtatgattactttggtatataaataaaataatccatagttgtcatgtgagagccaagctcatttggttgggacatttctttgcaagttctcgggatggaattcaacatccttaatagaatattccttcactataaaaaaaaaaaaaaaa

SEQ ID NO: 4272 - protein, 541 aa, Glycine max
  misc_feature: PFam Name: ABC1; PFam Description: ABC1 family
  misc_feature: GI Number: 50935257; NR Description: ABC1 family protein kinase-like protein [Oryza sativa (japonica cultivar-group)] >gi|23617237|dbj|BAC20904.1| ABC1 family protein kinase-like
  misc_feature: GI Number: 24215277; NR Description: ABC1 family protein kinase [Leptospira interrogans serovar Lai str. 56601] >gi|24196371|gb|AAN49776.1| ABC1 family protein kinase [Leptospira
  misc_feature: GI Number: 41689606; NR Description: COG0661: Predicted
  misc_feature: GI Number: 42522036; NR Description: Gene product involved in ubiquinone production. [Bdellovibrio bacteriovorus HD100] >gi|39574567|emb|CAE78409.1| Gene product involved in ubiquinone
MAVSGLRSGGLPLFHHHHHHHHLRFLQSPPSFAKLSFLGSKSSKKGFTVFSRYAQARDLFSSRRFQDSMEKLPNLVEDIVQTSLNTGPRGVLRLAQGVQAFLGVGQEWLTDVSKSANSFAGLPTELQLGLLSPFYLRRLFERMGATYIKLGQFIASAPTLFPPEYVQEFQNCFDRAPPVPFEEIESILRKELGKPLESVYEYIDPTPIASASIAQVHGARLKGSREDVVIKVLKPGIEDILVADLNFVYVVARILEFLSPEISRTSLVGIVKDIRESMLEEVDFYKEAANIEAFRRYLETMGLTGNATAPKVYRYCSTMKVLTMQRLYGVPLTDLDSISSLVSNPETSLITALNVWFGSLLACESFHADVHAGNLWLLRDGRIGFLDFGIVGRISPKTWAAMEVFLGSIAIEDYDSMASSLIEMGATNQDVDAKAFARDLEKVFSSIKELDTEIVVATTTGTATNATAVAANIVVDERQMNALFLDVVRVSESYGLKFPREFALLLKQLLYFDRYTRLLAPNLNMLQDQRISIASNSRSRV

SEQ ID NO: 4273 - DNA, 1600 bp, Glycine max
  misc_feature (1)..(1600): Ceres cDNA ID no. 21705226
  misc_feature (1)..(1600): Ceres CLONE  ID no. 712969
  misc_feature (1)..(1600): Also known as  Ceres CDNA ID no. 0
atcgataacccgtgtctttttctgtgtatccaaggcatcttcaagctctgaatctgcaatggcttctctactcaacatggtttcggttccaccaagaatatcaccaacctcacacaccagaatcgcttcgcttcaagctcgacccgttttgccacccttttctgtctcattttccaggaggagactatcaattagagcaacagaaactgataccaatgaagttcaatctcaggcaccgggtgcagcgccatctaaagatggttcaagcttcaatcagcttcttggtatcaaaggagctgcccaagaaacaaataaatggaagattcgtcttcaactcacaaagcctgtcacttggcctccgttagtttggggtgtagtttgtggtgctgctgcctcgggaaattttcattggaattttgaggatgttgctaaatcaattgtgtgcatgatgatgtccggcccattcctgacaggatatacacagactctgaatgattggtatgaccgagaaattgacgcaataaatgaaccttatagaccaattccttctggggcaatatctgagaatgaggtaatcactcaaatatgggtgttgctgcttggtggtctttctctggctggtatattggacatatgggcagggcatgatttccctatagtattttaccttgcagtgggtggagccctactgtcttatatatattccgcgcctcctttaaagttaaaacaaaatggatggattggaaactttgcccttggagcaagttacattagcttgccatggtgggcaggtcaggctttgtttggaactcttacaccagatataattgttctcacactcctatacagcatagctggattgggaattgctattgtcaatgacttcaaaagtgttgaaggggatagggctctagggcttcagtctcttccagttgcttttggttctgaaactgcaaagtggatatgtgttggcgctattgacattacacaattatctgtagctggatatctacttggggctgataaaccgttttatgcgttagctttacttggcctaataattccacaagtcttttttcagttcaagtatttcctcaaggaccctgtgaaatatgatgttaaatatcaggctagtgcacagccatttttggtgcttggtttgttggttactgctctagcaactagccactgatctttgatgtgcaaaagttgccaaaggggcattaaattcatagaataaagatgaagggagccaccggttagaaggataagagtggcttctcttaggtacctgcattcaagatttgtggcatagcttttgttggccaccctacattcaaggaggagtatgacctaggcttgtccagtattgtgtttttttttttccttatcttgttatcctcttttccacttgttcaagttttgattattttaggatgagaaggggtttctttttaggaagctttaaaagacaataaattgtacaaagggtagacacatacatgttattgttcccttgaatctgggacccttatgtttggcccatcattgatttgagatgaaacgtgaaactttagttaaaaaaaaaaaaaaaaaaaaa

SEQ ID NO: 4274 - protein, 377 aa, Glycine max
MASLLNMVSVPPRISPTSHTRIASLQARPVLPPFSVSFSRRRLSIRATETDTNEVQSQAPGAAPSKDGSSFNQLLGIKGAAQETNKWKIRLQLTKPVTWPPLVWGVVCGAAASGNFHWNFEDVAKSIVCMMMSGPFLTGYTQTLNDWYDREIDAINEPYRPIPSGAISENEVITQIWVLLLGGLSLAGILDIWAGHDFPIVFYLAVGGALLSYIYSAPPLKLKQNGWIGNFALGASYISLPWWAGQALFGTLTPDIIVLTLLYSIAGLGIAIVNDFKSVEGDRALGLQSLPVAFGSETAKWICVGAIDITQLSVAGYLLGADKPFYALALLGLIIPQVFFQFKYFLKDPVKYDVKYQASAQPFLVLGLLVTALATSH

SEQ ID NO: 4275 - DNA, 1499 bp, Glycine max
  misc_feature (1)..(1499): Ceres cDNA ID no. 21705227
  misc_feature (1)..(1499): Ceres CLONE  ID no. 713671
  misc_feature (1)..(1499): Also known as  Ceres CDNA ID no. 0
aatttaattttcttatcaggcccatccaccaaattattgacaagaagaaaaaagccttcttaccgaacatgacttgagctttccatggaagaagaacacgctgcaaaggcgccactgccggacgctttccttcagttcctggagaccaacgggctcgacccttccatttacactgctattgattccaccccacgatacattcggttgaaacccggtttcgaatcatgtattgaagaggttgaagcagaggtgaaatgcaaactcgaaaaattagagtggttaccgggattttactctcttccacctcacgttcaaattgctggttctagggcataccgagaagggaagatatatggaattgatgcagcttctggagctgcagttatggctttaaatatatcacctggggatcatgttctcgacctgtgtgctgctcctggtgccaaactttgtatgattttggaccttcttggtgattcaggctctgtggctggagtggatgttgcaaggcatcgtttggcagcgtgtaggacaatgctgcagaaatatatgattggtggtcggtgccggctttttgttgctgatggaacagcattttcagttattcctagcggattttgttctgactgcaaatcatgtgagtctggattggaaggaagagtggatgtgttcaaggagtggacatctagaagaccatggaaagagaggaaaaaggcaaataaaagtgggactgcacaattggtgtctaggtctcagcctcctgagctcatttattatggacaacattctggagttgttggtcttactaaaggagaattatataggactttatctgacaatgagattgcaaatcatggctatgacaaggtccttgtggatgcagagtgcactcatgacggttcagttaaacatattcagaagtttgaagattggggctggggaactcttcagcgccgtgtactagatgctgagaggactgatgacttgcatactcttcagttgaatcttctcaccaatggtttccgactgctaaaagttggagggtccctcgtctacagcacttgcagcttaactattgcacaaaatgaagatgtggtggaacaattcttgaaggaaaacgaaactgctgagttgacggagatagatgctgccagtgattggccttgcaagggtggtcgcataccgaaaacatggcgatttgaccctttaacatcacaaaccagtggactatttgtagcaaagttcacaaaagttgtcatttgatttttttcttccgtgctcagaaaatattctttttaaatgccggacagatttagtatactcctaatacattagaaagtttcatacaatagataattctttcactattattgttgttcttcttcttttgtagtcaaatacttatatttaatttgtcaagatacatgaagatgtttgtcgacttatttaatttatcaagatgcatgaagaagtttgtcggcttaaaaaaaaaaaaaaaa

SEQ ID NO: 4276 - protein, 392 aa, Glycine max
MEEEHAAKAPLPDAFLQFLETNGLDPSIYTAIDSTPRYIRLKPGFESCIEEVEAEVKCKLEKLEWLPGFYSLPPHVQIAGSRAYREGKIYGIDAASGAAVMALNISPGDHVLDLCAAPGAKLCMILDLLGDSGSVAGVDVARHRLAACRTMLQKYMIGGRCRLFVADGTAFSVIPSGFCSDCKSCESGLEGRVDVFKEWTSRRPWKERKKANKSGTAQLVSRSQPPELIYYGQHSGVVGLTKGELYRTLSDNEIANHGYDKVLVDAECTHDGSVKHIQKFEDWGWGTLQRRVLDAERTDDLHTLQLNLLTNGFRLLKVGGSLVYSTCSLTIAQNEDVVEQFLKENETAELTEIDAASDWPCKGGRIPKTWRFDPLTSQTSGLFVAKFTKVVI

SEQ ID NO: 4277 - DNA, 2002 bp, Glycine max
  misc_feature (1)..(2002): Ceres cDNA ID no. 21705228
  misc_feature (1)..(2002): Ceres CLONE  ID no. 715137
  misc_feature (1)..(2002): Also known as  Ceres CDNA ID no. 24420839
atcccaatcaacacataataaagagagcattacattacaataactctgtctctctttttttaaaattagggaaacaaggaagcaaaatgacacaatagtccttcttccctgtttccactttccaggttttctccttctcgtttgttgagcgcttttctctccctctccctcttcttcactcagtcagagatccaactcctcatataattcaagacaaaatcccgcgttttctgcatttctagacgttctaccctacaagctgccgtagaaattcattatggtggcaacagctgcaacttcatcatttttccctgttacttcaccctcgccggactctggtggagcaggcagcaaacttggtggtgggcctgcgaaccttggaggtctaaaatccaaatctgtgtcttctggtggcttgaaggcaaaggcacaagcccctttgaaaattaatggaaccacagttgttacatctaaagaaatcttgaagcatgaggatgatctaccttcacctccccccaggacttttatcaaccagttacctgattggagcatgcttcttgctgccattacaacaattttcttggcagctgaaaagcagtggatgatgcttgattggaagccaaggcgacctgacatgcttattgacccctttgggataggaaaaattgttcaggatggtctcgtgttccgtgaaaacttttctattagatcatatgagattggtgctgatcgaaccgcatctatagaaacagtaatgaaccatttgcaagaaactgcacttaatcatgttaaaagtgctgggcttcttggtgatggcttcggttccacgccagaaatgtgcaaaaagaacttgatatgggtagttactcggatgcaggttgtggtggatcgctatcctacatggggtgacgtagttcaagtagacacctgggcttctggatcagggaagaatgctatgcgccgtgattgggttttacgtgactgcaaaactggtgaaatcttgacaagagcttccagtgtttgggtcatgatgaataagctgacacggaggctgtctaaaattccagaagaagtcagacaggagataggatcttattttgtggattctgatccaattctagaagaggataacagaaaactgactaaacttgacgacaacacagcagattatattcgtaccggtttaagttctaggtggagtgatctagatatcaatcagcatgtcaacaatgtgaagtacattgactggattctggagagtgctccacagccaatcttggagagtcatgagctttcttccgtgactttagagtataggagggagtgtggtagggacagtgtgctggattccctgactgctgtatctggggccgacatgggcaatctagctcacagtggacatgttgagtgcaagcatttgcttcgactcgaaaatggtgctgagattgtgaggggcaggactgagtggaggcccaaacctatgaacaacattggtgttgtgaaccaggttccagcagaaagcacctaagattttgaaatggttaacggttggagttgcatcagtctccttgctatgtttagacttattctggcccctggggagagttttgcttgtgtctgtccaatcaatctacatatctttatatccttctaatttgtgttactttggtgggtaagggggaaaagctgcagtaaacctcattctctctttctgctgctccatatttcatttcatctctgattgcgctactgctaggctgtcttcaatatttaattgcttgatcaaaatagctaggcatgtatattattattcttttctcttggctcaattaaagatgcaattttcattgtgaacacagcataattattattcttattatttttgtatagcctgtatgcaagaatgacttgtccatccaatacaaccgtgattgtatgctccagcgtgtatttatgcaagcttcccacatgggaattattgtgtgcaaaaaaaaaaaaaaaa

SEQ ID NO: 4278 - protein, 416 aa, Glycine max
  misc_feature: PFam Name: Acyl-ACP_TE; PFam Description: Acyl-ACP thioesterase
  misc_feature: GI Number: 18073131; NR Description: Acyl-ACP thioesterase
  misc_feature: GI Number: 18073133; NR Description: Acyl-ACP thioesterase
  misc_feature: GI Number: 30725684; NR Description: At1g08510 [Arabidopsis thaliana] >gi|17978739|gb|AAL47363.1| putative oleoyl-[acyl-carrier-protein [Arabidopsis thaliana] >gi|16648915|gb|AAL24309.1| putative oleoyl-[acyl-carrier-protein
  misc_feature: GI Number: 2687425; NR Description: FatB thioesterase [Helianthus annuus] >gi|7489341|pir||T12583 oleoyl-[acyl-carrier-protein] hydrolase (EC 3.1.2.14) - common
  misc_feature: GI Number: 804948; NR Description: acyl-(acyl carrier
MVATAATSSFFPVTSPSPDSGGAGSKLGGGPANLGGLKSKSVSSGGLKAKAQAPLKINGTTVVTSKEILKHEDDLPSPPPRTFINQLPDWSMLLAAITTIFLAAEKQWMMLDWKPRRPDMLIDPFGIGKIVQDGLVFRENFSIRSYEIGADRTASIETVMNHLQETALNHVKSAGLLGDGFGSTPEMCKKNLIWVVTRMQVVVDRYPTWGDVVQVDTWASGSGKNAMRRDWVLRDCKTGEILTRASSVWVMMNKLTRRLSKIPEEVRQEIGSYFVDSDPILEEDNRKLTKLDDNTADYIRTGLSSRWSDLDINQHVNNVKYIDWILESAPQPILESHELSSVTLEYRRECGRDSVLDSLTAVSGADMGNLAHSGHVECKHLLRLENGAEIVRGRTEWRPKPMNNIGVVNQVPAEST

SEQ ID NO: 4279 - DNA, 1740 bp, Triticum aestivum
  misc_feature (1)..(1740): Ceres cDNA ID no. 21705230
  misc_feature (1)..(1740): Ceres CLONE  ID no. 738938
  misc_feature (1)..(1740): Also known as  Ceres CDNA ID no. 24369112
tttaagattgcaacagaaagacacggtcaaggagtgaaagaggactgatctcttctcttctccaccctcccccttccccttcctcctgccgccgccatggatggatgaggagcttccttgcaattgctttctttccgagaagcccagatcccctccccacccgtgcgacgccatcggattccccgtcccgcgagctctccgtcgatcccagcctcgctcacctgcattgatctgatctgctctgcgctccggggcaaccgctaggtgctagcacacgaaagtgaggaagggaaaagaaaatcatctgtcggtcgtctccatgaccgacggcggtccggaggcggcgccgctggagttcccctccgcggagtggcggcgcgtgtacgaccggctccaagggctgctgccgcgggtggaggcgctcgccgccgaccgcgcgcgcctggaggaagccatcaagctgtcggacgcccgcgagaagagcctccatgcccgcctcctccaggcggaggcgagcagggagaggtggaaggcggcctacaccgagcttcctcccggtgccaatcccaagctcgccgaacttcaagagcgcgacttggtggattcggaagctcgtgaagctcttcctgatgttgataactctcaactgaaggtgactagtcaaaagcgcaggaagcttaccaatggggagactagtcaaaaaaagcgcatgaagcttaccaatggggacactagtaaagaaaagtgcacgaagcttaccaatgagatgcatcttcaacggtgcacgatgcagatctttgtcaagatcaactgttcaatttttctcaaaaaaagaaagacccactgtttaaagacaatcactcttgaggtcatgagatcaaatacgatctacgatgtcaaggaaaagatacaagacaaggagggcatccctgcagtccagcagagactcatgtttggcagtgagctgctggtggacagctgctgcctggaggactacaacatcgtggaggagtccaccctcacccttgaccttgttccccaagggatgcatatctttatcagggcacggagtggcaagatcatgactattggtgttgacggagaagatagcctatacagtgtcaaggcaaagtttttcgatgaaaccggcatccccccaggcagacagcgtctcttctttgccgggaagcagctggaggatggccgcaccttggctgactacgacgtgcaaaatgaatctactcttcatgttgcgtttcgcggcatcacgcgtcggagcggtcagatgcgcatctctgtcaggacggtgacggggaagaaagtcattgaacgtgcgatgaagcgcagacaggccgttgacaacatcaaagcgtggatctactctgagttgtgcattctcccggaggagcagcagctctctggcgaggacggcgcccccctggcggaagtgatccgtcgttcgtgcatcgttgttctgcagatccgtcctcctggtggttggtgagatggaagtaaattggtcctttgcttttggtggtaccattagtgagagctcagtcaggctcggtagcgattgcacctgaagggcatatattttagtacaacaatatgcagggtgtaaaatgagtgaagtgctgtagtttctgggctcgtaataacagacctgtgtacgtaggtatgcacgtggggtttctctgaaggaaataatatatatgcttgtgtgcaaaaaaaaaaaaaaaa

SEQ ID NO: 4280 - protein, 394 aa, Triticum aestivum
  misc_feature: PFam Name: ubiquitin; PFam Description: Ubiquitin family
  misc_feature: GI Number: 82040; NR Description: ubiquitin precursor - flax
  misc_feature: GI Number: 35187449; NR Description: fiber polyubiquitin
  misc_feature: GI Number: 1800281; NR Description: polyubiquitin [Fragaria x
  misc_feature: GI Number: 902586; NR Description: ubiquitin
  misc_feature: GI Number: 312160; NR Description: ubiquitin [Lycopersicon
MTDGGPEAAPLEFPSAEWRRVYDRLQGLLPRVEALAADRARLEEAIKLSDAREKSLHARLLQAEASRERWKAAYTELPPGANPKLAELQERDLVDSEAREALPDVDNSQLKVTSQKRRKLTNGETSQKKRMKLTNGDTSKEKCTKLTNEMHLQRCTMQIFVKINCSIFLKKRKTHCLKTITLEVMRSNTIYDVKEKIQDKEGIPAVQQRLMFGSELLVDSCCLEDYNIVEESTLTLDLVPQGMHIFIRARSGKIMTIGVDGEDSLYSVKAKFFDETGIPPGRQRLFFAGKQLEDGRTLADYDVQNESTLHVAFRGITRRSGQMRISVRTVTGKKVIERAMKRRQAVDNIKAWIYSELCILPEEQQLSGEDGAPLAEVIRRSCIVVLQIRPPGGW

SEQ ID NO: 4281 - DNA, 1917 bp, Glycine max
  misc_feature (1)..(1917): Ceres cDNA ID no. 21705231
  misc_feature (1)..(1917): Ceres CLONE  ID no. 745857
  misc_feature (1)..(1917): Also known as  Ceres CDNA ID no. 24366412
atccttctcttcagttgggttgtgtcttggctcgctccctctcggatcagatctgcgctctccgttttcagatcgcgttttgtttcaattcgacactttcctcgcttcaaagattaagcgaacaatatggttgtccttgctgcatccattgtgagcaaatctggcaaagtgctagtttctagacagtttgtggatatgactcgcataagaattgagggtcttctagcagcatttcccaagttggtagggactggaaaacagcacacgtatgttgaaactgagaatgtgcgctatgtttaccagccaatagaagcactgtacctgcttcttgtaacaaacaaaaacagcaacatactggaagatttggaaactctgagacttctctctaaacttgtacctgaatattcttactcccttgatgaagagggtatttgcaaacatgcctttgagttgatttttgcatttgatgaagtcatctctcttgggcacaaggaaaatgtgactgttgcacaagttaagcaatactgcgagatggagagtcatgaagagaagctgcacaagttggttttgcagagcaagattaatgaaactaaggatgttatgaagcgaaaagctagtgagattgataaaagcaagattgaaaagaacagaggtgataaaggaggatttggtccattacagtcaatgggctctggaagaattgaaaatagctttagtgatttgagcatatctagcagtggaactggttttggaagtggctctggttttggattgacttctgatgttgattcctttgcaaccaagtctaaaggtcgtccaacttcatcagccactgctccacctaaaggtcttggaatgaagcttggtaaatctcaaaggacaaaccagtttttggaatcattgaaagcagaaggtgaggtcattcttgaagatgttcagccaaaactctcccagtctcgggtttctgccccaccacctactgatcctatcactttgactgttgaggagaaactaaatgtgacactgaaacgagatggtggtgtcagtaattttgatgttcaaggcacattgtctctccaaattcttaaccaagaggatggacatattcaagtacaggtccaaactggtgacaatcaagctgtctctttcaagacacaccctaacatgaataaagaattatttgccaatgattatatactaggcctaaaagatcccaacaggcctttccccactggtcaagccagtgatgctgcaggtgttggtcttttaaagtggagaatgcaaagtactgatgagtcaatggtgcctctgacaatcaactgctggccctcttcttctggaaacgaaacttatgtcagcattgaatatgaggcttcatcaatgtttgatctgcaaaatgttgtgatctcagtacctcttccagctcttcgagaagcgccatctgttaggcagattgatggggaatggaggtatgactctaggaattccattttggagtggtctgtccttctgattgataattccaatcgcagtgggtcaatggagtttgttgttccactagcatattcatcagtgttctttcccatttcagtccgctttatggcaactgatacttttagtgacctgaaggttaccaacatcataccattaaagggtggcaatcctcccaaatttgctcagagaacacagctgataacggatagctaccaagttgtgtgattgactttcttgaatttgagctcctataacagttttgcttttacagtcgtagttcttttatcaataggccatgcaaagttgtacttgcctctattcatgaatttgtacttagttttacttcgcaagacatggcgcaaagtatgatttacataattaatgctaaagcgtgtctgttttactccaaaaaaaaaaaaaaaa

SEQ ID NO: 4282 - protein, 530 aa, Glycine max
  misc_feature: PFam Name: Methyltransf_3; PFam Description: O-methyltransferase
  misc_feature: GI Number: 2960360; NR Description: caffeoyl-CoA 3-O-methyltransferase [Populus balsamifera subsp. trichocarpa] >gi|2960358|emb|CAA12199.1| caffeoyl-CoA 3-O-methyltransferase [Populus balsamifera subsp. trichocarpa]
  misc_feature: GI Number: 30580341; NR Description: Caffeoyl-CoA O-methyltransferase (Trans-caffeoyl-CoA 3-O-methyltransferase) (CCoAMT) (CCoAOMT) >gi|7448241|pir||T09399 caffeoyl-CoA O-methyltransferase (EC 2.1.1.104) - alfalfa
  misc_feature: GI Number: 2960356; NR Description: caffeoyl-CoA 3-O-methyltransferase [Populus balsamifera subsp. trichocarpa] >gi|3334838|emb|CAA11496.1| caffeoyl CoA 3-O-methyltransferase [Populus balsamifera subsp. trichocarpa] 1 (Trans-caffeoyl-CoA
  misc_feature: GI Number: 13249171; NR Description: caffeoyl-CoA
  misc_feature: GI Number: 23506117; NR Description: At4g34050/F28A23_190 [Arabidopsis thaliana] >gi|17065108|gb|AAL32708.1| Phosphoglycerate dehydrogenase - like protein [Arabidopsis thaliana] >gi|20148257|gb|AAM10019.1| phosphoglycerate
MVVLAASIVSKSGKVLVSRQFVDMTRIRIEGLLAAFPKLVGTGKQHTYVETENVRYVYQPIEALYLLLVTNKNSNILEDLETLRLLSKLVPEYSYSLDEEGICKHAFELIFAFDEVISLGHKENVTVAQVKQYCEMESHEEKLHKLVLQSKINETKDVMKRKASEIDKSKIEKNRGDKGGFGPLQSMGSGRIENSFSDLSISSSGTGFGSGSGFGLTSDVDSFATKSKGRPTSSATAPPKGLGMKLGKSQRTNQFLESLKAEGEVILEDVQPKLSQSRVSAPPPTDPITLTVEEKLNVTLKRDGGVSNFDVQGTLSLQILNQEDGHIQVQVQTGDNQAVSFKTHPNMNKELFANDYILGLKDPNRPFPTGQASDAAGVGLLKWRMQSTDESMVPLTINCWPSSSGNETYVSIEYEASSMFDLQNVVISVPLPALREAPSVRQIDGEWRYDSRNSILEWSVLLIDNSNRSGSMEFVVPLAYSSVFFPISVRFMATDTFSDLKVTNIIPLKGGNPPKFAQRTQLITDSYQVV

SEQ ID NO: 4283 - DNA, 864 bp, Triticum aestivum
  misc_feature (1)..(864): Ceres cDNA ID no. 21705234
  misc_feature (1)..(864): Ceres CLONE  ID no. 751428
  misc_feature (1)..(864): Also known as  Ceres CDNA ID no. 24407554
attcattcccacattcccatttttcacaccaccaacacaagatgtttctccacattgtgttcctccttttccttctctcatccacttcccatgccactgtccaagacttctgtgtggcagacctcaaaggtgcagacacccctgcaggctacccctgcaagccacctgctaatgtcacttcagatgactttgtgtacactggcttagctgaagctgcaaatgtcacaaacataatcaatgctgctgtgaccccagcttttgttgctcaattcccaggtctcaatggccttgaactatctgcagcaaggttggaccttggtcctagtggtgttatcccactccacactcatccaggtgccaatgaactactcattgtgcttcaaggtcacatccttgctggattcatatcttcaggtaacatagtttatcagaaggtgctgaaaaagggagagctcatggttttcccacaagggctgttgcacttccaaattgctgttggtaagagaaaggcccttgcttttcctgttttcagcagtgcaaaccctggcctccaaatccttgactttgcactgtttgccagcaacttctccactcctttggtgacacagaccactttccttgatcctgacctagtgaagaagcttaagggtgttcttgggggtagtggctaggctagccttatggttaattaataattgcttattattttgctcaattcattacttttgtgctttcaattcgctaaacttgtccagctcaattgactgagctacgtgagtgactagttttaaatcctttaatatttatgtttgattcttacgtataaaaaaataaattcattagactaaaaaaaaaaaaaaaaaa

SEQ ID NO: 4284 - protein, 209 aa, Triticum aestivum
  misc_feature: PFam Name: Asparaginase_2; PFam Description: Asparaginase
  misc_feature: GI Number: 61656674; NR Description: OSJNBa0065H10.15 [Oryza
  misc_feature: GI Number: 42568695; NR Description: L-asparaginase, putative
  misc_feature: GI Number: 9758469; NR Description: glycosylasparaginase-like
  misc_feature: GI Number: 40882569; NR Description: AT24323p [Drosophila
  misc_feature: GI Number: 54292135; NR Description: aspartylglucosaminidase [Mus musculus] gi|1478357|gb|AAB36101.1| aspartylglucosaminidase; AGA [Mus sp.] gi|2498163|sp|Q64191|ASPG_MOUSE N(4)-(beta-N-acetylglucosaminyl)-L-asparaginase precursor
MFLHIVFLLFLLSSTSHATVQDFCVADLKGADTPAGYPCKPPANVTSDDFVYTGLAEAANVTNIINAAVTPAFVAQFPGLNGLELSAARLDLGPSGVIPLHTHPGANELLIVLQGHILAGFISSGNIVYQKVLKKGELMVFPQGLLHFQIAVGKRKALAFPVFSSANPGLQILDFALFASNFSTPLVTQTTFLDPDLVKKLKGVLGGSG

SEQ ID NO: 4285 - DNA, 1906 bp, Triticum aestivum
  misc_feature (1)..(1906): Ceres cDNA ID no. 21705235
  misc_feature (1)..(1906): Ceres CLONE  ID no. 752318
  misc_feature (1)..(1906): Also known as  Ceres CDNA ID no. 24368489
agtttttcttgacgcacggccgccgtgctcttccttttcttcttggttcttgattcgccggccattgctagcttagcttagtctggtctctggtgtgcgcgcgggcgcgggtactgacgatgatgtgtgcgtgatgctgctgcgcaggagtgagccgggcaacgagctggaggagctgctctgggataacggaccggcgctccggcgggcggcatcgcccttccctcccttctcctgcagcgccgccggcactatgaaggcgcaggagctcgccaagcaccccgcgtcggcgacggcgatggcgcagggacacgacgacgacgccgtgccgtggttgcaacattaccccatcatcggtgtggacgacgacggcagcggcggcgacacggccccgctgccccaggactacttctccaccttgtttcccggtttctccgagctccccgctgcggtggcgagcagagatgccggagcgccatcgacgtctcacgcagcggtcgtcgtgccgccgctgccggagccacctgcgccccccaagcagcagcagcaggcgcctcgatccaccggcgagggcgtcatgaacttctccttcttctcgaggcccctgcagcgctcgctgccgcaggccagcacgagaacgtctgccgcggggagcaagtccgtcgagtcgacgctgctgcagaccaacaggctaagaagcaccccgctgttctcggagcagaggacggcgtggctgcagccgcccaaggagttgcccgccgcggtatccgcatcccgtcctccggcaccgccggtgcctgtccggcatgctgcagaaccggctgcggcgttaccccagagactgcaaccggaagcgagggctgcggcgttaccaccgagattgcaaccggaagtgagggctgcggcgttaccccagagattacaatcggaggcgagggcttccgagatgccaccgccgcccgcaacagcgacgacctcgtctgtctgctccgacaacggtgagcggagccagctgaagaggagcagccaccagactctggagtggtccgtcagtcaggacgacgaggatctcgacgacgaggccggcgggctgagaaggtcggcggcgaggagcaccaagcgcggccgcaccgcggaagtgcacaacatgtcggagaggaggagaagggatcgaatcaacgagaagatgcgcgccctgcaagaactcatccccaactgcaacaagattgacaaggcgtcgatgctggaggaggccatcgagtacctcaagaccctgcagctccaggtccagatgatgtcgacgatggggacggccgggctgtgcatgccgccgatgatggcaatgcagcacatgcagatgccgcccatggcgcacttccaccaccaccacctcggcgccatggggttcggcatgggccccttcgacccgcgcctcgtcgccgccgccggcgccgcgcagttcccttacccgatgatgcccggcgcgcccattttcggcggccacgcgatgcctcccccgccaccgttccaccaggcggcggtggcgggcgctcacatggctcccggccccgtcaccaacgatgccgccaccgcagcgcaggccgagcacgagcagacaccgggcgaccatccgcaggtcccacgaacaatgtaaactagctccaacagcggcggaggtcgacctggctctgtagcaggctaggggcgcacgcagcaaggctcggtaactccgagcagggctgcggcaaaacgtagctgtaaaatctttgtgaaactgtaaaatggttcactgctccggcatcttctccgtgtcagaggataggccgggtacagtgtctgctggagaggatcaatggatcaggatcgcttctgcttcccgctgcagtacacaaaaaaaaaaaaaaaa

SEQ ID NO: 4286 - protein, 506 aa, Triticum aestivum
  misc_feature: PFam Name: HLH; PFam Description: Helix-loop-helix
  misc_feature: GI Number: 56784181; NR Description: putative BP-5 protein
  misc_feature: GI Number: 34902556; NR Description: P0498A12.24 [Oryza sativa (japonica cultivar-group)] >gi|13486760|dbj|BAB39994.1|
  misc_feature: GI Number: 30680903; NR Description: (bHLH015) putative bHLH
  misc_feature: GI Number: 26051284; NR Description: putative bHLH transcription factor [Arabidopsis thaliana] >gi|28372351|dbj|BAC56979.1| PIF3 like basic Helix Loop Helix
  misc_feature: GI Number: 4093153; NR Description: phytochrome-associated
MLLRRSEPGNELEELLWDNGPALRRAASPFPPFSCSAAGTMKAQELAKHPASATAMAQGHDDDAVPWLQHYPIIGVDDDGSGGDTAPLPQDYFSTLFPGFSELPAAVASRDAGAPSTSHAAVVVPPLPEPPAPPKQQQQAPRSTGEGVMNFSFFSRPLQRSLPQASTRTSAAGSKSVESTLLQTNRLRSTPLFSEQRTAWLQPPKELPAAVSASRPPAPPVPVRHAAEPAAALPQRLQPEARAAALPPRLQPEVRAAALPQRLQSEARASEMPPPPATATTSSVCSDNGERSQLKRSSHQTLEWSVSQDDEDLDDEAGGLRRSAARSTKRGRTAEVHNMSERRRRDRINEKMRALQELIPNCNKIDKASMLEEAIEYLKTLQLQVQMMSTMGTAGLCMPPMMAMQHMQMPPMAHFHHHHLGAMGFGMGPFDPRLVAAAGAAQFPYPMMPGAPIFGGHAMPPPPPFHQAAVAGAHMAPGPVTNDAATAAQAEHEQTPGDHPQVPRTM

SEQ ID NO: 4287 - DNA, 1472 bp, Triticum aestivum
  misc_feature (1)..(1472): Ceres cDNA ID no. 21705236
  misc_feature (1)..(1472): Ceres CLONE  ID no. 752439
  misc_feature (1)..(1472): Also known as  Ceres CDNA ID no. 24368493
atgattttctttgtcgtaaatcgattcttcagcaattattatcatggaaggaaattcgggttcggatcctgcgcgtcctcttctggctaatcgtgacaataactccgccgagaacggtggtcagagaagccggctcagtcgccggatatcggttagctcgctcagagcctctttcacgtccaagcttcccgacaaggtccgttctggccttgactccgagtctcccttcgacgttgatctctcctccaccaccgccttaagcaaaggggagaaagagtactatgaaagacaatttgctactctcaaatcgtttgatgaagtggactcggtggaatcatctgactgcattgaggaaagcgatgaggagcaagctcagcaagaaagagcaatgaagatctctaattatgcaaatgtagctctgttgatattaaagatttatgccactgtaaggagtgggtcaatagctattgcagcatcaactctagattctctacttgatctaatggctggtggtatactttggttcactcacctctcaatgaagaacataaatatttataaatacccaattggaaagctaagagtgcagccagttggaataattatttttgcagcaatcatggcaacacttggctttcaggtattaatcacagctgtacaacaactaatacaaaacaatcctgctgaaatgatgaccactgaacagttaatatggttatactctattatgatatttgcaacagtggtgaaacttattctctggctttactgtagaagctcaggaaacaagattgtccgagcctatgcagatgatcaccactttgatgttgtaacaaacatggttggactagttgccgctgttcttggtgataaatattactggtggattgacccagttggagctattttgcttgcaatttacactattacaaactggtcccacactgtcatggaaaatgcagtttcactggttggacaatctgcacctcccgaagttttgcagaagctgacatacctcgttataaggcaccctcgaatcaagcgcgttgacactgtccgcgcatacacatttggggtcctatattttgtggaggttgacattgaactgccagaagatttacccttaaaagaagcacacgctattggagagagcctacagataaagcttgagaaacttccagaagttgagcgggcatttgttcatttagacttcgaatgtgatcataaaccagagcactcagttctcatcaaactgcccaacaatcagccttgagcacattattcaggtcccatatatgaagaatataactttaattaaaagagaaggatttatttagttcggaagagttctatccattggaataataaagagtgtgtttgaaagagtgtgttagagaatgagcaggtaacatttctgaattgaaaaagatcttgaatggaaattattttctgtgttaaaaaaaaaaaaaaaa

SEQ ID NO: 4288 - protein, 409 aa, Triticum aestivum
  misc_feature: PFam Name: Pyr_redox_2; PFam Description: Pyridine
  misc_feature: PFam Name: Extensin_2; PFam Description: Extensin-like region
  misc_feature: PFam Name: Drf_FH1; PFam Description: Formin Homology Region 1
  misc_feature: PFam Name: FH2; PFam Description: Formin Homology 2 Domain
  misc_feature: PFam Name: Pkinase; PFam Description: Protein kinase domain
  misc_feature: GI Number: 32422095; NR Description: predicted protein [Neurospora crassa] >gi|28926713|gb|EAA35680.1| predicted protein
  misc_feature: GI Number: 21992; NR Description: extensin [Volvox carteri]
  misc_feature: GI Number: 7441828; NR Description: extensin-like cell wall protein - sea-island cotton >gi|451544|gb|AAA79364.1| proline-rich
  misc_feature: GI Number: 6630459; NR Description: F23N19.12 [Arabidopsis thaliana] >gi|30696750|ref|NP_176463.2| invertase/pectin
  misc_feature: GI Number: 7441829; NR Description: proline-rich cell wall protein - upland cotton >gi|435039|gb|AAA79360.1| proline-rich cell
MEGNSGSDPARPLLANRDNNSAENGGQRSRLSRRISVSSLRASFTSKLPDKVRSGLDSESPFDVDLSSTTALSKGEKEYYERQFATLKSFDEVDSVESSDCIEESDEEQAQQERAMKISNYANVALLILKIYATVRSGSIAIAASTLDSLLDLMAGGILWFTHLSMKNINIYKYPIGKLRVQPVGIIIFAAIMATLGFQVLITAVQQLIQNNPAEMMTTEQLIWLYSIMIFATVVKLILWLYCRSSGNKIVRAYADDHHFDVVTNMVGLVAAVLGDKYYWWIDPVGAILLAIYTITNWSHTVMENAVSLVGQSAPPEVLQKLTYLVIRHPRIKRVDTVRAYTFGVLYFVEVDIELPEDLPLKEAHAIGESLQIKLEKLPEVERAFVHLDFECDHKPEHSVLIKLPNNQP

SEQ ID NO: 4289 - DNA, 2042 bp, Triticum aestivum
  misc_feature (1)..(2042): Ceres cDNA ID no. 21705237
  misc_feature (1)..(2042): Ceres CLONE  ID no. 752480
  misc_feature (1)..(2042): Also known as  Ceres CDNA ID no. 24368485
acctatcctgctactcacctaagccatctaccagaatcatcctccctcgcatgttcccatggcgccttgggccttgcctcttcgtctccgttgtcgtcgttgtcatcgtcgcttccacgatgccggcacggatgctcgtcgcggcggcggcggcctgcgagccggagcggtgcggcaacgtgaccgtctcagccccgttcggggtcgtctcgggctatgaggagaaccagtgcgcgcagtttgggttccaggtccactgcaccgacggtgtcccctacctcgggtactacgagcgcgggttcggtgtgcagatcctcaacatattctacaacaatgattccctgctcgtctccgacgtccacaagctcggcgacttcaatctcaccggcgagggaggatgccacgtgcccaaggccaacaccgccagcaaaatcggccctccgttctccatgagcggcctcaaccggaacctcatcttctacaactgcgccggggcaccgtcgccggagacggtgcgccgagcggggctggcggcgacggtgtgccggaacaacacctttgtccgcacaggggggcgttacaacgcgacgggcgtgatcgccggcagctaccatttaccgggctgcaacgtcaccgccgtgccggtgcttggggcggctgggaaggtgaatgccagcgactacatagagctcatcagcgatggattcatcctcacatggcggccgccgagtgctgccggtagcggggacagtaaaaggacgaaaacagttttcatagtagttggatcactaggcgctgctcttgcactaatggtgttcgtcatctatgtcttgcaccaacgaaggaggaagaaaaaagctatggcttcaaatgagttcatgcgaagtggatcttcaatgacgacatacagtaaagaccttgagctgggtggttctcctcatatcttcacttttgaggaactcgaagtggctactgatggatttagtgcttcaagggagcttggtgatggtggctttggaactgtttataaaggaaaactcaaggatgggagagtagttgcggtgaaacgcctttacaagaacaactacagacgggttgagcaattcctgaatgaggttgacatcctatcccgcctgctccaccagaaccttgtcatcctatatggctgcacgtctcggatgagccgtgaccttctcctggtgtacgagttcatcgcaaatgggaccgtcgcggaccatcttcatggatcccgttcggcggaacaaggcctcacatggcctctgaggctgaacattgccatagaaacggctgaagcactggcctacctccatgcagtcgagatcatacacagggatgtgaagacaaccaacatattactggacaataacttccatgtcaaagttgcagactttgggctgtcacgcctgttcccgctcgaggtcacccatgtctcgactgttccacagggcacaccgggctacgtcgaccctgtgtaccaccagtgctacaagctgaccgacaagagcgacgtctacagctttggtgtcgtgttggtggagctgatatcctcaaagcctgctgtggacatgagcaggagccacagtgagatcaacctggccaacatggctctcaacaggattcaaaaccatgaagttgttcagctggttgatccggagctcggctatgacaccgatcccgaaacgaagaggacgatcgaccgcgtggccgaggtggccttccagtgcctgcagatggagagggacctgaggccgtcgatcaaggaggtggtggagatcctgacttgcgtcagggacggagactatcaatctaagagcatgaaaaagaaggcttctcagaaagaggacgcgcacttgctcacgaatgacctgcagttttcgcctgactcggtcatccatagattccatagccagtcaactaaccactcggtagcatcgaatgctagcgggttatgatgtgctttgtattgattctgaagaaataaggccgccctgtcgatcggaaaaataaaaaaaaaaaaaaaa

SEQ ID NO: 4290 - protein, 640 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50900614; NR Description: P0443D08.8 [Oryza sativa (japonica cultivar-group)] >gi|15408726|dbj|BAB64129.1| P0443D08.8
  misc_feature: GI Number: 56784949; NR Description: wall-associated kinase
  misc_feature: GI Number: 34911340; NR Description: P0034C09.1 [Oryza sativa (japonica cultivar-group)] >gi|18565401|dbj|BAB84588.1| P0034C09.1
  misc_feature: GI Number: 56784948; NR Description: wall-associated kinase
  misc_feature: GI Number: 50900622; NR Description: P0443D08.12 [Oryza sativa (japonica cultivar-group)] >gi|15408730|dbj|BAB64133.1|
MFPWRLGPCLFVSVVVVVIVASTMPARMLVAAAAACEPERCGNVTVSAPFGVVSGYEENQCAQFGFQVHCTDGVPYLGYYERGFGVQILNIFYNNDSLLVSDVHKLGDFNLTGEGGCHVPKANTASKIGPPFSMSGLNRNLIFYNCAGAPSPETVRRAGLAATVCRNNTFVRTGGRYNATGVIAGSYHLPGCNVTAVPVLGAAGKVNASDYIELISDGFILTWRPPSAAGSGDSKRTKTVFIVVGSLGAALALMVFVIYVLHQRRRKKKAMASNEFMRSGSSMTTYSKDLELGGSPHIFTFEELEVATDGFSASRELGDGGFGTVYKGKLKDGRVVAVKRLYKNNYRRVEQFLNEVDILSRLLHQNLVILYGCTSRMSRDLLLVYEFIANGTVADHLHGSRSAEQGLTWPLRLNIAIETAEALAYLHAVEIIHRDVKTTNILLDNNFHVKVADFGLSRLFPLEVTHVSTVPQGTPGYVDPVYHQCYKLTDKSDVYSFGVVLVELISSKPAVDMSRSHSEINLANMALNRIQNHEVVQLVDPELGYDTDPETKRTIDRVAEVAFQCLQMERDLRPSIKEVVEILTCVRDGDYQSKSMKKKASQKEDAHLLTNDLQFSPDSVIHRFHSQSTNHSVASNASGL

SEQ ID NO: 4291 - DNA, 1659 bp, Triticum aestivum
  misc_feature (1)..(1659): Ceres cDNA ID no. 21705238
  misc_feature (1)..(1659): Ceres CLONE  ID no. 752654
  misc_feature (1)..(1659): Also known as  Ceres CDNA ID no. 24368472
aggtacctctgtgtcatgcagtaaagctcacgagttaccgtcagttccagtaccttatcgctacctcgattttgtttggttactattactcccgcctcatctcagctcgtttcaccgacaatggccatggccaaggtcgccgcggtcgtggcgtcgctctacctatttatcgtgctaacacggtgcgacgctgccgctgctggtgcgggcggttcgacgagctgccacggcggcagagctgtggggaggggcggcggcggccgggcgagggcgccgattgcgaaggccgtgttcgtgttcgggagctcgctggtggacaacggcaacaacaacttcctcaacagcaccggcgtgcgcgccgactacctgccctacggcgtcgacttcccgctcggcccctccggccgcttctccaacggccgcaacaccatcgacgctctcggggagcttctccgcctcccccgcggcggccgcatcccgccgttcgccgacccgggcaccaggggccgcgccgcgctgcatggcgtcaacttcgcgtccggcggctctggaatcctcgaccgcaccggccaggacaccggcaaggtgttgagcctgaaccagcaaatcagcaacttcgaggcagtgactctccccgaccttcgagcaacgacagccagcactcgccagatgaagggccatgatttcttgcacgattgcttcctgcccaggagcctattcgtgatcgggacaggcggcaacgactacctgctcaactactaccggcccagaaatacatccaggccccaattgtcagacttcacacgctcactgatcaccaagctctcggcccatcttcagaggctgtatggtctgggggcgaggaagtttgtgatcttctccatccagcccatggggtgcacccccgtggtgagggcgtccctcaacgtcaccggcgcgggctgcgtcgagccggtgaacggggcggcgctcctcttcaacggcgagctgaggtcgctcgtcgacgccacggggccgcgcatgcccggcgcgagcttcgccgtcgtcgactcctacaagatcatcaaggacctgctggaccacccaaggaaacatggcatcagggagacgtatcgggcttgctgcagtgagctggcgtcatccggggtgctgtgtaagaagggagggcccatctgcagggaccggaccaagtacgtcttcttcgacgggctccacccgacagacgtggtgaacgccaggatcgcgcgcaagggattcggctccgagtcgccgcgggaagcgtaccccatcaacgtcaagaaattggctatgctgtggtagcggcgatcctccagagtataaacagagacacgtggtactagcatttagtattagcactagccgtagtcttatcgtattagtggtaccagctagctttatgatctggcaatgcagcagtagcgttgtaccagtgttctattattcgatcaggattcgccggccaccgtttgtagctctgctccgcacttcctgcggcgaataagagcgtctacagccggacttcaaattcgactttcaaatgtcggcgaacgcgccggtgcatccgcgagcattgaccggatactcttaaataatgtaattcatatttggataaaaaaaaaaaaaaaaaaaaaaaaaaaa

SEQ ID NO: 4292 - protein, 399 aa, Triticum aestivum
  misc_feature: PFam Name: Lipase_GDSL; PFam Description: GDSL-like
  misc_feature: GI Number: 53792727; NR Description: putative proline-rich
  misc_feature: GI Number: 21537027; NR Description: unknown [Arabidopsis thaliana] >gi|18417760|ref|NP_568318.1| GDSL-motif lipase/hydrolase
  misc_feature: GI Number: 21594055; NR Description: lipase/hydrolase,
  misc_feature: GI Number: 22137090; NR Description: At1g29660/F15D2_21 [Arabidopsis thaliana] >gi|15215768|gb|AAK91429.1| At1g29660/F15D2_21 [Arabidopsis thaliana] >gi|12323544|gb|AAG51756.1| lipase/hydrolase, putative;
  misc_feature: GI Number: 21553940; NR Description: GDSL-motif
MAMAKVAAVVASLYLFIVLTRCDAAAAGAGGSTSCHGGRAVGRGGGGRARAPIAKAVFVFGSSLVDNGNNNFLNSTGVRADYLPYGVDFPLGPSGRFSNGRNTIDALGELLRLPRGGRIPPFADPGTRGRAALHGVNFASGGSGILDRTGQDTGKVLSLNQQISNFEAVTLPDLRATTASTRQMKGHDFLHDCFLPRSLFVIGTGGNDYLLNYYRPRNTSRPQLSDFTRSLITKLSAHLQRLYGLGARKFVIFSIQPMGCTPVVRASLNVTGAGCVEPVNGAALLFNGELRSLVDATGPRMPGASFAVVDSYKIIKDLLDHPRKHGIRETYRACCSELASSGVLCKKGGPICRDRTKYVFFDGLHPTDVVNARIARKGFGSESPREAYPINVKKLAMLW

SEQ ID NO: 4293 - DNA, 1267 bp, Triticum aestivum
  misc_feature (1)..(1267): Ceres cDNA ID no. 21705239
  misc_feature (1)..(1267): Ceres CLONE  ID no. 754969
  misc_feature (1)..(1267): Also known as  Ceres CDNA ID no. 24368579
aataaactagaaccaaaagtcagcgcccccctcctttccttcctccatagccagcaagaaccaactctccccgcgcgagccgaccatggacagggacgccgggtgctactacctcggcggcggaggcggcaacgactgggacctcaacgccgtcgtgcgcttcgcctgccgcggccgcgtcctcccgccgccgccctcggaggaccccttctcctccttcttccccccgcccgcgcccgtcgtggaggaccacgggatgcctgacgcggcggcgttgctccctgatcctcccgtcgacgggggctctgctgccgtcgacgagctctccattgccttcttcgcgccgtccgcggcgctgccgtcctcgcctcagccgccgccgccgccgcagcagcagcagcagccagcggcgccaacgaaccaagaaatggtcccgatgcagcaagacgaggcggtgccgcctccgatgctgctgaccgcgggcgggcaaggccctgtcggcgaagggtcgagatccaagagaaagaagaaggtggtgaagaaggtggtgaagcgggtggcggcggacggcacgtcggcggacccgtgggcgtggcgcaagtacgggcagaagcccatcaaggggtcgccgtacccgcgcgggtactaccggtgcagcaccgacaaggcgtgcgaggcgcggaagatggtggagcgctgccgcgacgaccccaactccttcatcctcacctacaccggcggcgagcacagccaccccgcccccgcccaccgcaactccctggccggcaccactcgcaacaggcagcaggcgccggaacctgctgccggacagagcgctcccgccgccaaagccaaggaagagtcgtcgtcggcggcggcggagccgagcccagcgcagtcgacgtcgggcgggatgtccccgacgacgcccctgcgcacgccctccatggaggagtacaaccaagactcagaattcgacgaggccgccggcggcgcaagtcagccgcccatggacgtcgagaaggaccgcgaggatgagctgctgaagatattggaggggtgcgtgcacggcggcgactccagcatcgtcgtcgaggagacgttcgtggtcacgccgtgggtcacggcccccggcggcgcggccgggtggagttgactccgccgttaccgtccgtacattgccatatatagcagcatgctgttcattataatcctggctcgttgcagcagcagcggtagcagtagaaacataaaaaaaaaaaaaaaa

SEQ ID NO: 4294 - protein, 356 aa, Triticum aestivum
  misc_feature: PFam Name: WRKY; PFam Description: WRKY DNA -binding domain
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: Drf_FH1; PFam Description: Formin Homology Region 1
  misc_feature: GI Number: 50251953; NR Description: putative WRKY
  misc_feature: GI Number: 46394316; NR Description: TPA: WRKY transcription
  misc_feature: GI Number: 46394332; NR Description: TPA: WRKY transcription
  misc_feature: GI Number: 52076738; NR Description: WRKY transcription
  misc_feature: GI Number: 19310809; NR Description: putative DNA-binding protein [Arabidopsis thaliana] >gi|15028173|gb|AAK76583.1| putative DNA-binding protein [Arabidopsis thaliana] >gi|7267622|emb|CAB80934.1| putative DNA-binding protein
MDRDAGCYYLGGGGGNDWDLNAVVRFACRGRVLPPPPSEDPFSSFFPPPAPVVEDHGMPDAAALLPDPPVDGGSAAVDELSIAFFAPSAALPSSPQPPPPPQQQQQPAAPTNQEMVPMQQDEAVPPPMLLTAGGQGPVGEGSRSKRKKKVVKKVVKRVAADGTSADPWAWRKYGQKPIKGSPYPRGYYRCSTDKACEARKMVERCRDDPNSFILTYTGGEHSHPAPAHRNSLAGTTRNRQQAPEPAAGQSAPAAKAKEESSSAAAEPSPAQSTSGGMSPTTPLRTPSMEEYNQDSEFDEAAGGASQPPMDVEKDREDELLKILEGCVHGGDSSIVVEETFVVTPWVTAPGGAAGWS

SEQ ID NO: 4295 - DNA, 1027 bp, Triticum aestivum
  misc_feature (1)..(1027): Ceres cDNA ID no. 21705240
  misc_feature (1)..(1027): Ceres CLONE  ID no. 763154
  misc_feature (1)..(1027): Also known as  Ceres CDNA ID no. 24356637
gtagaaaaaaaaaactaacccaaccacgttccttcccagatccttcgatgccgccgccacctgcgcgccgccgccgctgcccgcccgtcccagcaccctgccgccgccgcccgcacgccccgctgcgccgttgtctccaagcaccccgcgcgatcgccaccccaatccttcgccgccgagacccaacctcctagggaacgggcgccggccgccgaccgttcccccaggacccgaccgtctcacacgtacggctacgaccccgcgccatcggcccccaatcgtcgccacgcacctgctcctcgacgccgacaatcccgacaacgtctgctccgacgagaccggcgcgccgcccaacacagatcgatggtggacggtgttgagacctccttcctcccgacgcctctaccgtcgtgcagtaatgagcgtgacgctggctcgcacacccacaaccaccgcatgcaacctccccctgagctctccgactcctggatgccactccgctgccttcaacaacaagaactgacatgctctgtccacggtctacaatttttctcttcgccacttcctcaacttgaattgactccttgttgacctcgcgagagcagatgcgtccacctcccctaatgtcagctaaagacagaagatggagagagatggcgaggatatgtttttgttggtcattcctcccctgatcctgctcttcccccttcttgttggcatcgcgatgcaggcgaacaactgttcaagccaagcccagtgccaccgtagcacccaagaagatggggagaggatgtgcagtgaagagaaaacataggttttcaaattggccattggtggtagcatctaatcattttaccaagtaatgaacatgtgtgtgtatgtacagtagcatattttacccaaactgagttactctattttttcaaaatgcacgtagtctgtgcagccaaaatgtattaaccttctaatgttgcacttggtctgtgcgcattttactttatccatttggccaaaaaaaaaaaaaaaa

SEQ ID NO: 4296 - protein, 1027 aa, Triticum aestivum
  misc_feature: PFam Name: Pyr_redox_2; PFam Description: Pyridine
  misc_feature: PFam Name: Drf_FH1; PFam Description: Formin Homology Region 1
  misc_feature: PFam Name: FH2; PFam Description: Formin Homology 2 Domain
GTAGAAAAAAAAAACTAACCCAACCACGTTCCTTCCCAGATCCTTCGATGCCGCCGCCACCTGCGCGCCGCCGCCGCTGCCCGCCCGTCCCAGCACCCTGCCGCCGCCGCCCGCACGCCCCGCTGCGCCGTTGTCTCCAAGCACCCCGCGCGATCGCCACCCCAATCCTTCGCCGCCGAGACCCAACCTCCTAGGGAACGGGCGCCGGCCGCCGACCGTTCCCCCAGGACCCGACCGTCTCACACGTACGGCTACGACCCCGCGCCATCGGCCCCCAATCGTCGCCACGCACCTGCTCCTCGACGCCGACAATCCCGACAACGTCTGCTCCGACGAGACCGGCGCGCCGCCCAACACAGATCGATGGTGGACGGTGTTGAGACCTCCTTCCTCCCGACGCCTCTACCGTCGTGCAGTAATGAGCGTGACGCTGGCTCGCACACCCACAACCACCGCATGCAACCTCCCCCTGAGCTCTCCGACTCCTGGATGCCACTCCGCTGCCTTCAACAACAAGAACTGACATGCTCTGTCCACGGTCTACAATTTTTCTCTTCGCCACTTCCTCAACTTGAATTGACTCCTTGTTGACCTCGCGAGAGCAGATGCGTCCACCTCCCCTAATGTCAGCTAAAGACAGAAGATGGAGAGAGATGGCGAGGATATGTTTTTGTTGGTCATTCCTCCCCTGATCCTGCTCTTCCCCCTTCTTGTTGGCATCGCGATGCAGGCGAACAACTGTTCAAGCCAAGCCCAGTGCCACCGTAGCACCCAAGAAGATGGGGAGAGGATGTGCAGTGAAGAGAAAACATAGGTTTTCAAATTGGCCATTGGTGGTAGCATCTAATCATTTTACCAAGTAATGAACATGTGTGTGTATGTACAGTAGCATATTTTACCCAAACTGAGTTACTCTATTTTTTCAAAATGCACGTAGTCTGTGCAGCCAAAATGTATTAACCTTCTAATGTTGCACTTGGTCTGTGCGCATTTTACTTTATCCATTTGGCCAAAAAAAAAAAAAAAA

SEQ ID NO: 4297 - DNA, 1840 bp, Triticum aestivum
  misc_feature (1)..(1840): Ceres cDNA ID no. 21705241
  misc_feature (1)..(1840): Ceres CLONE  ID no. 769618
  misc_feature (1)..(1840): Also known as  Ceres CDNA ID no. 24368905
gtcttctcggagaagcttcggcggctaggttacggccggccgccgcccggcgtttcgtccctctctctctctcccgcacgcggcggagggcatggacaccggcgaagaatcagcgacggcggcgggggcgggggcggcagtggcgatggagctggacttctcgcgcggcggcgtggtgcccagcttcgacttcgcgttcgattcggccaccttctccgacagggtgctgcggatagagatcgtcggcggcggccccgcgccgggatcttgcggaggatcttctgccaaccaggagcgccgccgcgaggagcaaggtgagaaagaacagagtgttgactcttcatcgatgatggtgggtacaccagttttacgagaaaaaaacattcatatcaattcagcgattcttgcttcaagaagtcctttctttctaaagtttttctcaaatggcatgaaagaatctgatcagacgaatccaacaattaggattactgattcagaggaaaatgcttttatggagctcttaagctatatgtacagtggaaagttgactacagctgagcccactcgtctgctcgacatcttgatggctgcagacaagttcgaggttctttcttgcatgaggcattgcagtcagctgctcataagcttgcctatgaccacagaatctgcactgctctacatagaccatccttgttctgtttcaatggtcaatgaagttcggcctttgatagatgcatccaaggaattccttgccaacaagtacaaggatttttatgagtttaaaagtgagctgatgaacatttctcttgctgggatagaagccatattttcaagtactgacatacaagtggaaactgaagatgacgtatattacttcatgcttgactgggcccgtgcacgatacgtagaattggaggaaagacgtaagatcttgagttctcgtttacttcctctggtacgcttcagtcatatgacgtgtatgacacttcaggagatattagcaagcactgataatgatatagatcgcgagcaagtaactcatcgtattgctgaggcacttctacccaaggcttacccgaagcagttggaaggtgctcttgcagcagaggtaacaacttgttcgcgatttgctgagcgagcatacgagtacaaacctgtgaaattggttgcctttgatcaaccctgcccacagattatagtttacttggatctaacacgcgatgagtgctcccaactcttcccgtctgggcgtatatgcccgcacccattccggcttctaggatggggcttttatctgatggcaacctgtgaaatggatgagcagagtaagttgtgcagctttggcctctggttaggagtcgccaaaaatatgaagggatcatcatgtttcatggtagattacgagtttgccgcaaggaaaagatcgtcaggaaagtttgtgcgcaaattggagggtaagatctccaccactgacgagacacatggatgcagtgatctatttggcattccatggtcgacgttcattgccaacgacaacctcttcatcaacggcgtgctgcatctgagagctgatttgagggtgttgctggggcagccaaaactacaagcttgatgatatctcactcagcagcaaagtcaggtccatcggtccaatgggatttcagttgttggcttggaatgttggcagcgtggagttctttttagtcgctcatccttatgtggtctcatttcattattttggtgtctgtgctggaaaacttggcttgcctgaatgatgtaaggaggctagctcttacctgcaatgagagacttgaaaactgtgacaaaaaaaaaaaaaaaa

SEQ ID NO: 4298 - protein, 506 aa, Triticum aestivum
  misc_feature: PFam Name: BTB; PFam Description: BTB/POZ domain
  misc_feature: PFam Name: BACK; PFam Description: BTB And C-terminal Kelch
  misc_feature: GI Number: 48093487; NR Description: GAMYB-binding protein
  misc_feature: GI Number: 50906817; NR Description: putative BTB/POZ domain-containing protein [Oryza sativa (japonica cultivar-group)] >gi|47497899|dbj|BAD20083.1| putative BTB/POZ domain-containing protein [Oryza sativa (japonica
  misc_feature: GI Number: 21536778; NR Description: unknown [Arabidopsis thaliana]
  misc_feature: GI Number: 30695452; NR Description: BTB/POZ
  misc_feature: GI Number: 12006855; NR Description: POZ/BTB containing-protein AtPOB1 [Arabidopsis thaliana] >gi|18412063|ref|NP_567115.1| BTB/POZ domain-containing protein
MDTGEESATAAGAGAAVAMELDFSRGGVVPSFDFAFDSATFSDRVLRIEIVGGGPAPGSCGGSSANQERRREEQGEKEQSVDSSSMMVGTPVLREKNIHINSAILASRSPFFLKFFSNGMKESDQTNPTIRITDSEENAFMELLSYMYSGKLTTAEPTRLLDILMAADKFEVLSCMRHCSQLLISLPMTTESALLYIDHPCSVSMVNEVRPLIDASKEFLANKYKDFYEFKSELMNISLAGIEAIFSSTDIQVETEDDVYYFMLDWARARYVELEERRKILSSRLLPLVRFSHMTCMTLQEILASTDNDIDREQVTHRIAEALLPKAYPKQLEGALAAEVTTCSRFAERAYEYKPVKLVAFDQPCPQIIVYLDLTRDECSQLFPSGRICPHPFRLLGWGFYLMATCEMDEQSKLCSFGLWLGVAKNMKGSSCFMVDYEFAARKRSSGKFVRKLEGKISTTDETHGCSDLFGIPWSTFIANDNLFINGVLHLRADLRVLLGQPKLQA

SEQ ID NO: 4299 - DNA, 1712 bp, Triticum aestivum
  misc_feature (1)..(1712): Ceres cDNA ID no. 21705243
  misc_feature (1)..(1712): Ceres CLONE  ID no. 774329
  misc_feature (1)..(1712): Also known as  Ceres CDNA ID no. 24368786
agcaatttggatcgtttgttcggtgaggtgcgtgagtttggtggatctggatcgctaaagctcccatctttcccccatccccacctccaccaccgccgtcaagaagagcaggggagcacgccgcggcagggatctcgaatcgagctccctccctcccatggccaccagggtcctcgacacgctcgccgtcgcggcggagggcgacgggggctgcggcgcgctgccgctcaccttcttcgacgtgccctggatcttcaccggccccgtggagcgcgtcttcttctacccgtacccgcacccgcccgagcggttccgggccgccctcctgccgcgcctcgtctcctccctctccgccgcgctgggcaggttctacccgctcctcggccgcgtccggccctgcccggacggcggcgggtacgagttcttcttgcccgcggggggagggggcggtggtggcgccgtcgagctcaccgtcgccgagagcgaggatgatttcgacgagctctccggcgacgggccccgcgacgtcgcccggctctactcgctcgtgccgcggctcccggtggttgaggggggcggggacggcgggttcgcgctcgccgcggtccaggtcaccgtgttcgccgggcgcggggtcgccgtcggcgtgtcgatacaccacgtcgcctgcgatgactccagctacatgcatttcgtgaagacctgggccggccactgccggttggccgccggtggggaggacgctggcgccgcgctgcccccgccgccgttcctggaccgcgcggtcatcgcggacccccgagggcttgccgccaggacgctcgacgaaatgcggcagctggcggccaacgggcctcctcctccgccaccggcgccggtaggcccgccgcccaagctggtcatccggtcgttcacaatcgcccgcggctgcatcgacaagctgaagcagcgcgtggccgccgacgccaaggacgcgaccacccactgctccgcgttcacggtggcgtgcgcgttcgcgtgggcctgcctggcgcgctccgcctccgccgacgccccctcccccgcctccgacgagcgcgcgcacctgctcttctcagtggagtgccggcgccgcctgtccccgcctgtgccgcaggagtacctgggcaactgcctgcggccctgcttcgtggaggtcggcgcgcgcgacctgctcggcgcggacggggtgaccacggccgccgcggcgatcggcgcggccatccgggcgctggacggggacggcgtgctggcgggcgccgaggggtggttccagaagatcctgtcgctggtgccgcggcggcccatgtccgtgggcggctcgccgcggtacggcgtgtacgacaccgacttcggcctggggcggccgagcaaggtggagctggtgtccatcgacaagacgcccggcacggtgtcgctggccgagggcaccgacgggcagcgcgggattgaggtcggcgtggcgctgccggaggccgacatggcgcggttcgcctcatgcttctccgacggcctgcaccagctatgagcagggagatgatcctgctggtggtcagtgcaagaacaagagaagattattgatcatattgcaaaattgcaattgctcctatactactagtactataatataaaatgtatatttgagagaatggatgctaaaattacaatgaggctttgcgaaaaaaaaaaaaaaa

SEQ ID NO: 4300 - protein, 462 aa, Triticum aestivum
  misc_feature: PFam Name: Transferase; PFam Description: Transferase family
  misc_feature: PFam Name: FH2; PFam Description: Formin Homology 2 Domain
  misc_feature: PFam Name: Pyr_redox_2; PFam Description: Pyridine
  misc_feature: PFam Name: 7tm_1; PFam Description: 7 transmembrane receptor
  misc_feature: GI Number: 51964540; NR Description: PREDICTED OJ1202_E07.32 gene product [Oryza sativa (japonica cultivar-group)] >gi|50915942|ref|XP_468435.1| putative anthocyanin acyltransferase [Oryza sativa (japonica cultivar-group)] [Oryza
  misc_feature: GI Number: 45790002; NR Description: quercetin
  misc_feature: GI Number: 50908391; NR Description: putative quercetin 3-O-glucoside-6''-O-malonyltransferase [Oryza sativa (japonica cultivar-group)] >gi|47847996|dbj|BAD21783.1| putative quercetin 3-O-glucoside-6''-O-malonyltransferase [Oryza sativa (japonica
  misc_feature: GI Number: 50908421; NR Description: putative quercetin 3-O-glucoside-6''-O-malonyltransferase [Oryza sativa (japonica cultivar-group)] >gi|47847573|dbj|BAD21960.1| putative quercetin 3-O-glucoside-6''-O-malonyltransferase [Oryza sativa (japonica
  misc_feature: GI Number: 50908429; NR Description: putative quercetin 3-O-glucoside-6''-O-malonyltransferase [Oryza sativa (japonica cultivar-group)] >gi|47847577|dbj|BAD21964.1| putative quercetin 3-O-glucoside-6''-O-malonyltransferase [Oryza sativa (japonica
MATRVLDTLAVAAEGDGGCGALPLTFFDVPWIFTGPVERVFFYPYPHPPERFRAALLPRLVSSLSAALGRFYPLLGRVRPCPDGGGYEFFLPAGGGGGGGAVELTVAESEDDFDELSGDGPRDVARLYSLVPRLPVVEGGGDGGFALAAVQVTVFAGRGVAVGVSIHHVACDDSSYMHFVKTWAGHCRLAAGGEDAGAALPPPPFLDRAVIADPRGLAARTLDEMRQLAANGPPPPPPAPVGPPPKLVIRSFTIARGCIDKLKQRVAADAKDATTHCSAFTVACAFAWACLARSASADAPSPASDERAHLLFSVECRRRLSPPVPQEYLGNCLRPCFVEVGARDLLGADGVTTAAAAIGAAIRALDGDGVLAGAEGWFQKILSLVPRRPMSVGGSPRYGVYDTDFGLGRPSKVELVSIDKTPGTVSLAEGTDGQRGIEVGVALPEADMARFASCFSDGLHQL

SEQ ID NO: 4301 - DNA, 865 bp, Triticum aestivum
  misc_feature (1)..(865): Ceres cDNA ID no. 21705245
  misc_feature (1)..(865): Ceres CLONE  ID no. 779243
  misc_feature (1)..(865): Also known as  Ceres CDNA ID no. 24766827
ggctcactgctaagaacacactcccgccccacccccaccgacagcagtaatgaaggccctcgccggcgacagcaacgcctccgcgccgcttctgcaggaggccaagatcagcatccccgcctcctccacgggcggggccgcggaggcggcgctcctcgggaagggccggtacaaggtgtgggccctcgccgccatcgcgctcctcgcgctctggtccatgtccgccgcctccgtctccctccgctggtcggccggcgacctggcagccgttatttcaggggacctcgacgcgccactccgcgacgatctagattccctcgagatggaggaaagggagaaattagttggtcggatgtgggacatgtacacacgcaccagcgacgaggtacgccttccacggttctggcaagaagcattcgaggctgcatacgaggagcttgctggtgatgatatgcaggtccgcgacacggccatctctgagattgctcgaatgtcagcccacagacttgagcttgagcagcctgtgaatgcgaacgaggaagagggcaaggtaagcatcaggaataatgatcatggcagagcgaagcagtagcttcaaaactgaagatctataacggttgcggacaacaaatatcagcagctgaacttgaagtttgatgtaaactgaaattttctgtatgggagggcaagcaaaagcttaccatgatgcaaagttttaacttccccgcagtaaagcgttgtattatacgtgtattattcataggtcctgattagaaatgtcatgccatttgctatatgtagtaacgtggaatagaggaagtctagcaagatcatgctgtttttgtttggaaaaaaaaaaaaaaaa

SEQ ID NO: 4302 - protein, 180 aa, Triticum aestivum
  misc_feature: GI Number: 9858772; NR Description: BAC19.4 [Lycopersicon
  misc_feature: GI Number: 45773768; NR Description: At4g36660 [Arabidopsis thaliana] >gi|45752648|gb|AAS76222.1| At4g36660 [Arabidopsis
MKALAGDSNASAPLLQEAKISIPASSTGGAAEAALLGKGRYKVWALAAIALLALWSMSAASVSLRWSAGDLAAVISGDLDAPLRDDLDSLEMEEREKLVGRMWDMYTRTSDEVRLPRFWQEAFEAAYEELAGDDMQVRDTAISEIARMSAHRLELEQPVNANEEEGKVSIRNNDHGRAKQ

SEQ ID NO: 4303 - DNA, 2018 bp, Triticum aestivum
  misc_feature (1)..(2018): Ceres cDNA ID no. 21705246
  misc_feature (1)..(2018): Ceres CLONE  ID no. 780255
  misc_feature (1)..(2018): Also known as  Ceres CDNA ID no. 24368629
atcgtctcgtctcgtctcgtcctactcacactccacctcccctctctccctctccctccctccctcgccgcgccgtgctccctccactccatcccatcgccccagggcgcacacgggatcgcgcgcagatctgcgcccccaatcccacgcgctcgcttcccactccccgcctccccgcggcggcctggctggcttaatttcgctaccaatgcgctctgggtagggcatgagaggcactggcggcggcttgccggcggaccaattcacacccggatggagctcagcgtcgccgccgcagccgtggagctcggcaagcggggccgccccgacgaccagtaccaggagcaggaccaggaccacggggatgccaagcggctggcgctcgtgccgtggccgccgcaccagcagcacccctcctcgcggatctaccgcgtctcgcgcggctccggcggcaaggaccgccacagcaaggtctacacggccaagggcatccgcgaccgccgcgtccgcctctccgtcgccaccgccatccagttctacgacctgcaggatcgccttggctatgaccagcccagcaaggccgtcgagtggctcatcaaggctgccgccgccgcaatcgacaagctccccgagctcgacgccgccgccttccccaaccacccggcctcagcctcagcctcagccaacaaacagtcttctgctcttcacgcggaggccgacgactcgcagccccagcagctcaccagatcgggctgcagcagcacgtccgagaccagcaagggctccgtcctctcgctttctcgctccgacagccgcgtcaaggctagggagcgcgcgcgcgaccggagcgcctctgtgaaggacaaggacgactcggtcaccgccgccgtgcaccgccggcccccctcggcgcaggcggcttccttcaccgagctgctcactggattggcggccgccaccccagctgttgctcagcacaagcagcacaactcgtggcagcagatgaccgcgtctgccaccgcggactacctcggcttcgcccagccccggaaatccgggcacgggatgctgcacaccttcgcctccccggccccgcacctgggcaacattgcgcccgtctccatggccccggcgcagcacttcagcttatcagccggcggcggcgattcgcagacggagatgccgcacttctccttctcgcaagaccactacatgcccgtccatgcggcgccagcgtcgggtccggcagtagactacagtctcaacttctccatgtcctcgggtcttgtgggtgtcaacaacactagggggacccttcagtccaattcgcagccgcacctctccggccaccaccaccaccaccaccaccaccagcagctccagaggctgtctactccactggatgctccgcacatacccttcttgttcagcccagccgtcgcggtggcctcccccaccacagcggagagccacttcggcgcggcggccgcattgcagctctgggaggggttccggcactccgacatgaaggagaagggcaagaactgatcaatggctgtgcgcttcttttggatgctggaagtgaagacgaccaatcatctccctattttcctgtgagctccattcatggcaagggggatgattccctgcgctcttagaagcagaccatcatttggacatctaccatggtcattgaagaacctcatcatcgttactcagatgatcgtgtgctttctttttactccatgttgttgtattaatcttgtttgtggaggtgagggttcctgagcaaaagcttgctggagtgcccttgccatgctttgcattctagaactttgtcaactgatgcacgtgcgccgccctgaattggcagctcttttgacattgttgggatgagttatcccccgtcaatttttcttgttctccgttgtatgttgtgtgactgaactcattgatccaatctataagatgaactatgtatgttgtgtgaccctctctctacaaaaaaaaaaaaaaaa

SEQ ID NO: 4304 - protein, 424 aa, Triticum aestivum
  misc_feature: PFam Name: TCP; PFam Description: TCP family transcription factor
  misc_feature: PFam Name: Pyr_redox_2; PFam Description: Pyridine
  misc_feature: PFam Name: MAGE; PFam Description: MAGE family
  misc_feature: PFam Name: Pkinase; PFam Description: Protein kinase domain
  misc_feature: PFam Name: FH2; PFam Description: Formin Homology 2 Domain
  misc_feature: GI Number: 50934273; NR Description: putative transcription factor PCF6 [Oryza sativa (japonica cultivar-group)] >gi|33146716|dbj|BAC79520.1| putative transcription factor PCF6 [Oryza sativa (japonica cultivar-group)] [Oryza sativa (japonica
  misc_feature: GI Number: 20975255; NR Description: transcription factor
  misc_feature: GI Number: 38304091; NR Description: putative transcription
  misc_feature: GI Number: 20857274; NR Description: AT4g18390/F28J12_50 [Arabidopsis thaliana] >gi|14194171|gb|AAK56280.1| AT4g18390/F28J12_50 [Arabidopsis thaliana] >gi|14194129|gb|AAK56259.1| AT4g18390/F28J12_50 [Arabidopsis
  misc_feature: GI Number: 3328126; NR Description: putative basic helix-loop-helix DNA binding protein TCP2 [Arabidopsis thaliana] >gi|25369264|pir||T52249 probable basic helix-loop-helix DNA
MELSVAAAAVELGKRGRPDDQYQEQDQDHGDAKRLALVPWPPHQQHPSSRIYRVSRGSGGKDRHSKVYTAKGIRDRRVRLSVATAIQFYDLQDRLGYDQPSKAVEWLIKAAAAAIDKLPELDAAAFPNHPASASASANKQSSALHAEADDSQPQQLTRSGCSSTSETSKGSVLSLSRSDSRVKARERARDRSASVKDKDDSVTAAVHRRPPSAQAASFTELLTGLAAATPAVAQHKQHNSWQQMTASATADYLGFAQPRKSGHGMLHTFASPAPHLGNIAPVSMAPAQHFSLSAGGGDSQTEMPHFSFSQDHYMPVHAAPASGPAVDYSLNFSMSSGLVGVNNTRGTLQSNSQPHLSGHHHHHHHHQQLQRLSTPLDAPHIPFLFSPAVAVASPTTAESHFGAAAALQLWEGFRHSDMKEKGKN

SEQ ID NO: 4305 - DNA, 2411 bp, Triticum aestivum
  misc_feature (1)..(2411): Ceres cDNA ID no. 21705249
  misc_feature (1)..(2411): Ceres CLONE  ID no. 788036
  misc_feature (1)..(2411): Also known as  Ceres CDNA ID no. 24368937
actactaggactgtgcactactaatggccccgtagactccacaccagagccaactttggagggagcgagcgacgagggagaagaggtcgacggaggaaggagaagactagactagaccagcacaagcacccaactcttgctgcgtggcggggattggtggtatgaggtgttgctgccgggctagatgagaggaatgccctttgctggagagggtcacgcggggacactgcagcagcccaagctgagcgccggcttctgggcggagcccacgtccgtgctcgaccgccgccacagccccagccccagcccgccctccgaggcttccgcgctgtcgtccgaggtggcgagcctcgcgcccggcggcgacgccaagaacgtctccccgccgccgcagcagcaggcatggccggctggggaggatgctactgctgctgcgccgggggtcaaggaggagtgggcgcaccagctggccccgctcgacatgggcatggaccttggcgccggcgaggggtgggacggcacggcgccttccgggctcgcgggacctgacagcaccttcctccgctggatcattggcggcggggaggacgcgtccgcggggatggccggcgtcatggatccgcctgctctggagctcgaccacgccacgtctatgatgtcgccgcctgcggcgtctctcgggcccagcctgtcgccgttcgcgccggccatggaggacgccaagggggcccctttcggccacgcgcccagcttcctgctccaccagcaccagcaccacccccagccacacgcggccttctttggcgcgcacccgtccttcgagtcggcgccgccgccgcctaagcgccaccacccgatggcaggcgcgccggcgccgaagctgcctgctttccaggggcatcacgctccggcgggcgggttcttccccgccctgaagcccaaggcggggacagcgaacgacgaggcggccgccacggtggaccagctcgccgaggctgccaagtttgccgaggcgggcgacgccttcggcgcacgcgagatattggcgcggctcaattatcggctccccgccgcccccgcggccgggacgccactcctccgctctgccttctacttcaaggaggctttgcgccttgcgctctccccaaacggagagacgcccgcgccgccggcgtccacgccgtacgacgtggtcctcaagctcggcgcgtacaaggccttctccgaggtctccccggtgctccagttcgcgcacctcacctgcgtccaggcggtgctcgacgggctccgcggcgcaggctgcatccacgtgctcgacttcgacatcggcatgggcgagcagtgggcgtcgctgatgcaggagctcgcgcagcgccgcccggcgacggcgctcaaggtcaccgcattggtctcgccggcgtcgcaccacccgctcgagctgcagctcatccacgagaacctatccagcttcgccgcggagctcggcgtgttcttccagttcaccgtattcaacatcgacaccctcgaccccgcggagctcgtggccatcgccggcggggacgcgctcgccgtccacctccccgtcggcgcagcacacgcggccgcaatgcccgccgtcctccgcctcgtgaagagcctcggcgccaaggtggtcgtgtccgtggaccgcgggtgcgaccgcacggagctgcccttcgccgcccacctgttccaggcgttccagtccaccgtgttcctccttgagtccgtggacgccgtggtcacggacccggacacggccggcaagatcgagcggttcctggtccagccggccgtggagcaatgcgtggtcgggcgccaccgcgcgtccatcgagaaggcgccgctgccgtggcgggccgtgttcgcgtcggccgggttcacgccggtgcaggccagcacgttcgcggagtcgcaggccgagtcgctgctgcacaaggtgcccgtccgggggttccgcgtcgagaagcgcgccccgggatcgctctgcctctactggcagcgcgccgagctcgtgtcagtctcggcgtggcggtgctgacaaccccgacctcgccggcgccgtcgccggcgccaaaagaagccgatcggtcttagttaggactaatgatcctactacaaagtatttcgtcgttgtaatgatccgaatccgtctcgcttagtgtcctaaattggaagactatgttaatggtgtcgccttgcatttgccgctggttgctcgatatgctcaaactgtggtgtcagttgatcacgagtagaattggcatggcttggcaggttgcagggtgtgtgcgtgtcgtggtgcactgcgtttctactttctatcctctacgtgttgctactctatagctgtgaaatcaatggttatggcgttttcaaaaaaaaaaaaaaaa

SEQ ID NO: 4306 - protein, 624 aa, Triticum aestivum
  misc_feature: PFam Name: GRAS; PFam Description: GRAS family transcription
  misc_feature: GI Number: 37536694; NR Description: putative Scl1 protein [Oryza sativa (japonica cultivar-group)] >gi|10140637|gb|AAG13473.1| putative Scl1 protein [Oryza sativa
  misc_feature: GI Number: 51964222; NR Description: PREDICTED P0516F12.29-2 gene product [Oryza sativa (japonica cultivar-group)] >gi|50911539|ref|XP_467177.1| Scl1 protein [Oryza sativa (japonica
  misc_feature: GI Number: 50911537; NR Description: Scl1 protein [Oryza sativa (japonica cultivar-group)] >gi|49388512|dbj|BAD25636.1| Scl1 protein [Oryza sativa (japonica cultivar-group)] >gi|50251746|dbj|BAD27679.1| Scl1 protein [Oryza sativa (japonica
  misc_feature: GI Number: 50911543; NR Description: putative Scl1 protein [Oryza sativa (japonica cultivar-group)] >gi|49388515|dbj|BAD25639.1| putative Scl1 protein [Oryza sativa
  misc_feature: GI Number: 4056615; NR Description: Scl1 protein [Oryza sativa] >gi|11358961|pir||T51243 Scl1 protein [imported] - rice
MRGMPFAGEGHAGTLQQPKLSAGFWAEPTSVLDRRHSPSPSPPSEASALSSEVASLAPGGDAKNVSPPPQQQAWPAGEDATAAAPGVKEEWAHQLAPLDMGMDLGAGEGWDGTAPSGLAGPDSTFLRWIIGGGEDASAGMAGVMDPPALELDHATSMMSPPAASLGPSLSPFAPAMEDAKGAPFGHAPSFLLHQHQHHPQPHAAFFGAHPSFESAPPPPKRHHPMAGAPAPKLPAFQGHHAPAGGFFPALKPKAGTANDEAAATVDQLAEAAKFAEAGDAFGAREILARLNYRLPAAPAAGTPLLRSAFYFKEALRLALSPNGETPAPPASTPYDVVLKLGAYKAFSEVSPVLQFAHLTCVQAVLDGLRGAGCIHVLDFDIGMGEQWASLMQELAQRRPATALKVTALVSPASHHPLELQLIHENLSSFAAELGVFFQFTVFNIDTLDPAELVAIAGGDALAVHLPVGAAHAAAMPAVLRLVKSLGAKVVVSVDRGCDRTELPFAAHLFQAFQSTVFLLESVDAVVTDPDTAGKIERFLVQPAVEQCVVGRHRASIEKAPLPWRAVFASAGFTPVQASTFAESQAESLLHKVPVRGFRVEKRAPGSLCLYWQRAELVSVSAWRC

SEQ ID NO: 4307 - DNA, 1773 bp, Triticum aestivum
  misc_feature (1)..(1773): Ceres cDNA ID no. 21705250
  misc_feature (1)..(1773): Ceres CLONE  ID no. 791221
  misc_feature (1)..(1773): Also known as  Ceres CDNA ID no. 24368692
acaaagcgagcggatcagctcagcagcagaagctctccgcccatggccttccttgccgtgctcctcctcgttctcgctgctttgctggtggttgccgccacgaggctgctggagtacggcgtcgtgcgcctcgtatggaggccgtactccatgagcaagtggttcggacagcaagggatccatggaccctcctacagcttcttgaaaggctgcaacgaggacgtgaggagcatgaaggaggagactgaccgtctggtgctggaggttggcgaccacaagtacctcccgcggatcgccccacactacctcaaatggagggctctctacggagaaccgtttctatactggcatgggccacaagcccgaatctgcatatttgactatgaattggcaaggcaaatcctttcaagcaagtccagacatttcgtgaagaacgatgcacaccctactctcttggctttggttggcaaggggctcgggtttatggaaggcgcggattgggtgcgccatcgtaggataatcaaccccgttttcaccattgataagctcaagatgatgacaaaaacaatgatggattttgccgaaagcatggctaaggagttggaagatcaagcgtctcaaaaagagaagcgagaaacaaaagtagatatcaataagcttttcagtgagctaacagttgataatatatcctatgcaatctttggaagcagttataaattaggaaaggaagtcttccgagctcaaactgacctgctggggatcactatggaaactttccttgacgtgccgataccaggattcaaatatcttcccactgaaaggaatcggcgcaaatggatgcttgaaagaaacctcaagagcctactcacacaaatcatacaaccacgattagcaactagtgaatacggaaatgatctgctcggtgtgatgctcgactcttgcattgaaaccaagcaaggagggaagcaagtggatctcagcttgagcatggaggagatcatacatgagtgcaagcttttcttcttcgccggtcatgaaaacacgtctcttctactcacatggtcactgtatttgctgagcatatacccagaatggcaagaaaggctccggaaggaggtcttgaaggaatttgggagggaatctcctaaccccaatgcgctcaataaactgaaagagatgacaatggtgctcttcgagaccttgcggctctacccgcctgctcttttcatgcaaaggaaaaccgtggccgatatcacagtgggatcaataaaactgcccaaaggcatggcaattgtcatacctattccaattatgcatcgagacaaggaggtttggggcgacgacgcagatgaattcaatccgctgagatttaagaatgggatcacgggagcagcaaaggttccacacggcctgctagcgttttcaatgggaccaaggtcttgcatcggtcagaacttctctatgttggaagccaagtcgacgctggccctgatgctccaaaagttctcattcactctttcccctgactatgtgcatgcgcccgtggatctgtttaccctcaaacctaagtttggtcttcctgtatttctaaggccgctggataagtgtaactagactactagtatttgatttgtaatattgccatacctccaagaactgatgaacctgggatgtactccatgatacacagtgtatgtatacagtgaatgtatgactacaagaataaagaaaacaagggagtatagtaatattattacaaaaaaaaaaaaaaaa

SEQ ID NO: 4308 - protein, 523 aa, Triticum aestivum
  misc_feature: PFam Name: p450; PFam Description: Cytochrome P450
  misc_feature: GI Number: 50920615; NR Description: putative cytochrome P450, 5'-partial [Oryza sativa (japonica cultivar-group)] >gi|28927679|gb|AAO62325.1| putative cytochrome P450, 5'-partial
  misc_feature: GI Number: 34913354; NR Description: putative cytochrome P450 [Oryza sativa (japonica cultivar-group)] >gi|22293694|dbj|BAC10039.1| putative cytochrome P450 [Oryza sativa
  misc_feature: GI Number: 50936313; NR Description: putative cytochrome P450 [Oryza sativa (japonica cultivar-group)] >gi|22324446|dbj|BAC10362.1| putative cytochrome P450 [Oryza sativa
  misc_feature: GI Number: 38112707; NR Description: cytochrome P450
MAFLAVLLLVLAALLVVAATRLLEYGVVRLVWRPYSMSKWFGQQGIHGPSYSFLKGCNEDVRSMKEETDRLVLEVGDHKYLPRIAPHYLKWRALYGEPFLYWHGPQARICIFDYELARQILSSKSRHFVKNDAHPTLLALVGKGLGFMEGADWVRHRRIINPVFTIDKLKMMTKTMMDFAESMAKELEDQASQKEKRETKVDINKLFSELTVDNISYAIFGSSYKLGKEVFRAQTDLLGITMETFLDVPIPGFKYLPTERNRRKWMLERNLKSLLTQIIQPRLATSEYGNDLLGVMLDSCIETKQGGKQVDLSLSMEEIIHECKLFFFAGHENTSLLLTWSLYLLSIYPEWQERLRKEVLKEFGRESPNPNALNKLKEMTMVLFETLRLYPPALFMQRKTVADITVGSIKLPKGMAIVIPIPIMHRDKEVWGDDADEFNPLRFKNGITGAAKVPHGLLAFSMGPRSCIGQNFSMLEAKSTLALMLQKFSFTLSPDYVHAPVDLFTLKPKFGLPVFLRPLDKCN

SEQ ID NO: 4309 - DNA, 1747 bp, Triticum aestivum
  misc_feature (1)..(1747): Ceres cDNA ID no. 21705251
  misc_feature (1)..(1747): Ceres CLONE  ID no. 794812
  misc_feature (1)..(1747): Also known as  Ceres CDNA ID no. 23487420
tacaactacacacacaactcggttctctcccccatccctggcgctggcggtcgcggtcgcgggctttcgatagaaccgaaggattctgggttcggcgacatggggatctcggggcggttcctcctcctggccgtggcgctggtgatcgccgccgccgcggtggccgcggatgagcaggcggcggtggacctggcggggcccggggagatcgcggcgggcgtcaaggaggccgccgaggcggccgcgctccgggcggagctggcgcagctcagggagaagatctccgtcttagagtcggacatcgcacagagatcccaggacctgaagagcaaggatgatggcatagcgaagctggagaaggacattggggagaagtcacagaagattgctactctgcagagcgagatcacatctctccagaaaaaaggttctgtggctgctgaggagcaggcaggcaaggccattgctcgggttgttgagcttgaggagcagattgagaagctcaataaagagatcgaagcacaaagtagccagagaacaacacttgaagctagagctaacaaggctgagaagaaggtgcaagatttgaactcgaagcttgagtcacttcaaaaggcaagtggcgagcaaaagcgtatgatccagaaaacggagcgtgctcttaaagttgctgaggaggaattgatgaggctgcaattagaagcaacaacgaaggcaaaacagctgacagaggtacatggagcatggctgccaccttggttggtgacacattctgcccaatatttggaggtggtctcaggtcactggaatgagcatggaaaacctgccatggacatctttttgcagaaggcatcagaaaaatcagcacacgcaaagaaatgggctgaaccacatatcgagaccgcgaagctgaaattggttcctgttaaggagaaactggctgtgctaaagaaaaacgcagaaccttacgtggagaaggcgtcagcaaaatcagtggaagtttatgaagcatccagggatgctattacaccccactttgtaaaatttaaagaagtttctgatccctacttccaggaagctaagaagatctctaaaccttacattgatcaagttgctgaggtcacgaagccacatgttgagaaagttaggagtactcttaagccttacactaaaagagcagttcatgtgtatggaacatttctcgagtctgcaaccacataccatcgacaggctcaagcaaccatttcagattacttgcaccaacatgaaataacaaaatcacttgtgactaaggagttggtttggttcctggcttctgctttgctggctctacctgtgtttattatgtacaggcttctagtagataccttctgcacgaagaagcagaagagatcgcctcttaatggtaacggaaacaatggcaataggagacacaagcgccgacatgctgagaagtaaactatcgtcggctgccatgtagggttgcagaaatcagagcatgtccttccctgatgaggctgcgctcctgttcatggtagaaggatggaacgctgtacaccaccagattttttcgttttccttttgccccctattgtacggactctagtttcagcagcggccttatgtatctgcatcttgccgaggtttaatatgggcttaaacctcggcgtttgttaattgtttattgtaactttgttgatacgcttgagtttgtttgcagcgtgctttgccaaaaaaaaaaaaaaaa

SEQ ID NO: 4310 - protein, 452 aa, Triticum aestivum
  misc_feature: PFam Name: GRP; PFam Description: Glycine rich protein family
  misc_feature: PFam Name: Myosin_tail_1; PFam Description: Myosin tail
  misc_feature: PFam Name: eIF-3c_C; PFam Description: Eukaryotic
  misc_feature: PFam Name: Tropomyosin; PFam Description: Tropomyosin
  misc_feature: GI Number: 50947659; NR Description: putative stress related-like protein interactor [Oryza sativa (japonica cultivar-group)] >gi|42408514|dbj|BAD09693.1| putative stress related-like protein interactor [Oryza sativa (japonica
  misc_feature: GI Number: 29367417; NR Description: unknown [Oryza sativa
  misc_feature: GI Number: 42733520; NR Description: BRI1-KD interacting
  misc_feature: GI Number: 24417320; NR Description: unknown [Arabidopsis thaliana]
MGISGRFLLLAVALVIAAAAVAADEQAAVDLAGPGEIAAGVKEAAEAAALRAELAQLREKISVLESDIAQRSQDLKSKDDGIAKLEKDIGEKSQKIATLQSEITSLQKKGSVAAEEQAGKAIARVVELEEQIEKLNKEIEAQSSQRTTLEARANKAEKKVQDLNSKLESLQKASGEQKRMIQKTERALKVAEEELMRLQLEATTKAKQLTEVHGAWLPPWLVTHSAQYLEVVSGHWNEHGKPAMDIFLQKASEKSAHAKKWAEPHIETAKLKLVPVKEKLAVLKKNAEPYVEKASAKSVEVYEASRDAITPHFVKFKEVSDPYFQEAKKISKPYIDQVAEVTKPHVEKVRSTLKPYTKRAVHVYGTFLESATTYHRQAQATISDYLHQHEITKSLVTKELVWFLASALLALPVFIMYRLLVDTFCTKKQKRSPLNGNGNNGNRRHKRRHAEK

SEQ ID NO: 4311 - DNA, 2026 bp, Triticum aestivum
  misc_feature (1)..(2026): Ceres cDNA ID no. 21705252
  misc_feature (1)..(2026): Ceres CLONE  ID no. 795522
  misc_feature (1)..(2026): Also known as  Ceres CDNA ID no. 24368563
accaagcagagctagcagagccccactcgacaccagagaggaagcagctatagcaatggccgtccccagctcgccgtctcttctcctcgtcgccgcgctgctgctctgcgcgacggcgacgctggccgcggcccaagccgtcaccacgaggaagtaccagttcgatgtgcaaatgacgagcgtgacgcggctgtgcggcaccaagagcatcgcgacggtgaacgggcagttcccggggccgacgctgcacgcgcgggagggcgaccacgtggaggtcaacgtggtcaacaactccccctacaacatgagcatccactggcacggcgtgcggcagctgctcagcgggtggtatgacggcccctcctacgtcacgcagtgtcccatccagccgggccagagctacgtctaccggttccagatcgtcgggcagcgtggcacgctctggtggcacgcgcacatctcctggctccgcgccaccgtgcacggccccatcgtcatcctcccgcccgccggcgtgccctacccgttccccgcgccggagagggaggtgcccctcatgttcggcgagtggtggaggaacgacaccgaggcggtcatcgcccaggcgctgcagaccggcggggggcctaatgtgtccgacgcctacaccatgaacggactccccggcccgctctacgcctgctcggcgaaggacacgtttaggttgaaggtgaagcctggcaagacgtacatgctccggctcatcaacgctgcgctcaacgacgagctcttcttcgcggtggcaaaccacacgctcaccgtcgtcgacgtcgacgcgctctacgtcaagcccttcgccgtcgagaccctcatcatcgcgccgggacagaccagcaacgtgctcctcaccgccaagccggcctaccccggcgccaggtactacatgctggcccgcccctacaccaacacgcagggcaccttcgacaacaccaccgtcgccggcatcctcgagtacgagcatgatgaccccgccaccgccgccggcaacggcaagagcctgccgatctacaggccgaccctgccacagatcaacgacaccagcgccgtgtccaactacaccgcgaagctgcgcagcctggcgagcgcggcgtacccggcgtccgtgccgcaggcggtggaccgggagttcctcttcaccgtcggcctgggcacccacccgtgcgcgccgggctcccccgtgaacgggagcacgtgccagggccccaacgggacgtcccggttcgcggcgtccatcaacaacgtctccttcgtgctcccgaccacggcgctgctgcagtcgcactacaccgggatgtccaagggcgtgtacgcctccaacttccccttcgcgccgccgcgcccgttcaactacacgggcacgccgcccaacaacacgaacgtgatgaccgggaccaaggcgctggtgctgccgttcggcaccgccgtggagctggtgatgcaggacaccagcatcctcggcgccgagagccacccgctgcacctgcacggcttcaacttcttcgtcgtcggccagggcttcggcaactacgacccggccaaggacccggccaagttcaacctcgtcgaccccgtcgagcgcaacaccgtcggcgtccccgccggcggctgggtcgccatccgcttccgcgccgacaacccaggtgtatggttcatgcattgccacttggaggtgcacatgagctgggggctgaagatggcgtggctggtgcaggacggcagccttccgaaccagaagctcccgccgccgccggcagatctcccgaaatgctagacgtgaagatcaagatcgatcgtcggtgaagaagatttgtcgcttcattgattcgcttccgcctcacgttgttttttcaagcttttgctctcgcgtgtccagcgagttcgtcgtcattatctccactacagtgatgtattctttttttacgctaattaatttttcaggcgattcgccgtgcttgttacatgcactttattaaaaaaaaaaaaaaaa

SEQ ID NO: 4312 - protein, 584 aa, Triticum aestivum
  misc_feature: PFam Name: Cu-oxidase; PFam Description: Multicopper oxidase
  misc_feature: PFam Name: Cu-oxidase_2; PFam Description: Multicopper oxidase
  misc_feature: PFam Name: Cu-oxidase_3; PFam Description: Multicopper oxidase
  misc_feature: PFam Name: Mucin; PFam Description: Mucin-like glycoprotein
  misc_feature: PFam Name: Atrophin-1; PFam Description: Atrophin-1 family
  misc_feature: GI Number: 18483217; NR Description: laccase LAC5-6 [Lolium
  misc_feature: GI Number: 1621461; NR Description: laccase [Liriodendron
  misc_feature: GI Number: 1621463; NR Description: laccase [Liriodendron
  misc_feature: GI Number: 1621465; NR Description: laccase [Liriodendron
  misc_feature: GI Number: 1621467; NR Description: laccase [Liriodendron
MAVPSSPSLLLVAALLLCATATLAAAQAVTTRKYQFDVQMTSVTRLCGTKSIATVNGQFPGPTLHAREGDHVEVNVVNNSPYNMSIHWHGVRQLLSGWYDGPSYVTQCPIQPGQSYVYRFQIVGQRGTLWWHAHISWLRATVHGPIVILPPAGVPYPFPAPEREVPLMFGEWWRNDTEAVIAQALQTGGGPNVSDAYTMNGLPGPLYACSAKDTFRLKVKPGKTYMLRLINAALNDELFFAVANHTLTVVDVDALYVKPFAVETLIIAPGQTSNVLLTAKPAYPGARYYMLARPYTNTQGTFDNTTVAGILEYEHDDPATAAGNGKSLPIYRPTLPQINDTSAVSNYTAKLRSLASAAYPASVPQAVDREFLFTVGLGTHPCAPGSPVNGSTCQGPNGTSRFAASINNVSFVLPTTALLQSHYTGMSKGVYASNFPFAPPRPFNYTGTPPNNTNVMTGTKALVLPFGTAVELVMQDTSILGAESHPLHLHGFNFFVVGQGFGNYDPAKDPAKFNLVDPVERNTVGVPAGGWVAIRFRADNPGVWFMHCHLEVHMSWGLKMAWLVQDGSLPNQKLPPPPADLPKC

SEQ ID NO: 4313 - DNA, 923 bp, Triticum aestivum
  misc_feature (1)..(923): Ceres cDNA ID no. 21705253
  misc_feature (1)..(923): Ceres CLONE  ID no. 797840
  misc_feature (1)..(923): Also known as  Ceres CDNA ID no. 24369050
atatcatcaacaaagctagaagaagaagaagaaagaatctgacaaattaagctaggcagcatgtcgatgatctccagcatgctgggccggaagcagccgccgccgcagccccagccgcagcagcacgcggcggcccacaaggccaacggccacggcggcggcggggacgaggtcgtggagccggtgagcatcgacatcctggagccgttcatggaggccatctcactgactgcgttcggcggcggcggcggctgccggccggcgctgggcctgccgttctcgacggcgagcatggactggaaggagacgccgacggcgcacgtgttcatggcggacgtgccgggcctgcggcgggaggaggtgaaggtggaggtggagcaggagcgggtgctccggatcagcgggcagcgcgcgcgcgccgccgaggacaagggcgaccggtggcaccgcgtggagcggagcgccgagaagttcgtgcgcaccgtgcgcctgccgcccaacgccgacgtcgacggcggcagcgtccacgcctcgctcgacaacggcgtgctcaccatcaccatccccaaggacgacggcaagaaggcctacggcaggatcatccccaccaccaactaatgaccagccacgtgcatgcaccatcaactcaatcaatactgcgtactatatgtatcaccactgcttaattatactttactaaagagaaccgtaagacgccggagataagcccggccgcgtatgtatgtgctcagctggaattccggaagatttccgtcaattataccataggcacactcaatcccggcgtctgcaagttgatgcatacaaccatcccactctctagtgggttataggctatacaactgagatatgagatatgactccaataaccaaatgtatatgtagcaaaaaaaaaaaaaaaa

SEQ ID NO: 4314 - protein, 923 aa, Triticum aestivum
  misc_feature: PFam Name: HSP20; PFam Description: Hsp20/alpha crystallin family
  misc_feature: GI Number: 50904981; NR Description: putative heat shock protein 16.9 [Oryza sativa (japonica cultivar-group)] >gi|41053044|dbj|BAD07974.1| putative heat shock protein 16.9 [Oryza sativa (japonica cultivar-group)]
  misc_feature: GI Number: 123555; NR Description: 18.1 kDa class I heat shock protein (HSP 18.1) >gi|169103|gb|AAA33672.1| 18.1 kDa heat
  misc_feature: GI Number: 4836473; NR Description: 17.6 kD class I small heat shock protein [Lycopersicon esculentum] >gi|24954791|gb|AAN64315.1| type I small heat shock protein 17.6
  misc_feature: GI Number: 25044839; NR Description: class-1 LMW heat shock
  misc_feature: GI Number: 25809052; NR Description: heat shock protein
ATATCATCAACAAAGCTAGAAGAAGAAGAAGAAAGAATCTGACAAATTAAGCTAGGCAGCATGTCGATGATCTCCAGCATGCTGGGCCGGAAGCAGCCGCCGCCGCAGCCCCAGCCGCAGCAGCACGCGGCGGCCCACAAGGCCAACGGCCACGGCGGCGGCGGGGACGAGGTCGTGGAGCCGGTGAGCATCGACATCCTGGAGCCGTTCATGGAGGCCATCTCACTGACTGCGTTCGGCGGCGGCGGCGGCTGCCGGCCGGCGCTGGGCCTGCCGTTCTCGACGGCGAGCATGGACTGGAAGGAGACGCCGACGGCGCACGTGTTCATGGCGGACGTGCCGGGCCTGCGGCGGGAGGAGGTGAAGGTGGAGGTGGAGCAGGAGCGGGTGCTCCGGATCAGCGGGCAGCGCGCGCGCGCCGCCGAGGACAAGGGCGACCGGTGGCACCGCGTGGAGCGGAGCGCCGAGAAGTTCGTGCGCACCGTGCGCCTGCCGCCCAACGCCGACGTCGACGGCGGCAGCGTCCACGCCTCGCTCGACAACGGCGTGCTCACCATCACCATCCCCAAGGACGACGGCAAGAAGGCCTACGGCAGGATCATCCCCACCACCAACTAATGACCAGCCACGTGCATGCACCATCAACTCAATCAATACTGCGTACTATATGTATCACCACTGCTTAATTATACTTTACTAAAGAGAACCGTAAGACGCCGGAGATAAGCCCGGCCGCGTATGTATGTGCTCAGCTGGAATTCCGGAAGATTTCCGTCAATTATACCATAGGCACACTCAATCCCGGCGTCTGCAAGTTGATGCATACAACCATCCCACTCTCTAGTGGGTTATAGGCTATACAACTGAGATATGAGATATGACTCCAATAACCAAATGTATATGTAGCAAAAAAAAAAAAAAAA

SEQ ID NO: 4315 - DNA, 1536 bp, Triticum aestivum
  misc_feature (1)..(1536): Ceres cDNA ID no. 21705254
  misc_feature (1)..(1536): Ceres CLONE  ID no. 798084
  misc_feature (1)..(1536): Also known as  Ceres CDNA ID no. 24369042
catttagcccctccctccgtgctggctaatcgcatcacaatatcatatactcgttcatcactcatcactcatacacatacatgggctgagtacatactcgatcagttagcttgctggcgatcgatatggggaaggtggtcgtcgcggaggccacggcgcggcaggtggcgtccttcgtcctcggcgccgccgccgcgctcaccgtcgtcatgctcgtccagtaccgggcgccggccgccgggctcagccgcgccaggacgccggcccacttctccggcttgagattatcatccgacgaccagcaccaccgccgcaacgccacaacaacagcgcgtcccgttgttcatcatcaggcgccaccggtcgccggcagtgctgcccgagacgacgatcgtcgccgtccggcgaacgccacaacaatcacaaagcccaattctaccaccacaagtcatcttcccagcacgcgtcggcatgaagaaaagggagggaaggaggagtcggcggagttccgggggctggcggcggcggtggcacgcgcggcaacggacgaccggacggtgatcatcacgtgcgtgaaccaggcctgggcggcacaaggctccttactggacctgttcctggagagcttccgcatcggcgacggcacggcgcgcctcctcccacacgtgctggtcgtggccatggatcccggcgcccatgcacggtgcctcgccgtgcaccagcactgctaccactacaccatcccgggcctcaacatcgacttcgccgcgcacaagtacttcctctccaaggactacctggagctggtgtggagcaagctgaagctgcagcgccgcatcctggagctcggctacggcttcctcttcaccgacgtcgacatcgtgtggctgcgcgacccgttcaagcacgtgacggcgtacgccgacatgacggtgtccagcgacgtgtacttcggcgaccccgacaacctgggcaacttccccaacacgggcttcttccacgtgaagcccaacgcgcggaccatcgccatgacgaagctgtggcacggtggtaggggcaagtacccgggcgccaacgagcagcccgtgttcaacatgatgaagaagcagatggtggcggagctcgggctccgggtgcagtacctgaacccggcctacgtcggcgggttctgcagctacgggaaggatttggggaagatcgtcaccatgcacgcgaattgctgcgtggggattggaaacaagattagggatttgaagggcgtgctgggtgattggaggaactataccaggatgccgccgtgggagaggcaccgggccaagtggaccgtgcccggcgcctgcattcgagcggaaaaacaagtttgatccatcaattggttgatggattttgcaatcgtctgttacttatagagtagtttaattcttcatatatactccctgtggggatggagagatagaccatagagtatttgttgctatacctctaaaatgctctataatgaaaacatatactgtatctacaaaaaaaaaaaaaaaa

SEQ ID NO: 4316 - protein, 412 aa, Triticum aestivum
  misc_feature: GI Number: 34897440; NR Description: putative regulatory protein [Oryza sativa (japonica cultivar-group)] >gi|28269394|gb|AAO37937.1| putative regulatory protein [Oryza
  misc_feature: GI Number: 34897442; NR Description: putative regulatory protein [Oryza sativa (japonica cultivar-group)] >gi|28269397|gb|AAO37940.1| putative regulatory protein [Oryza
  misc_feature: GI Number: 50902398; NR Description: P0678F11.28 [Oryza sativa (japonica cultivar-group)] >gi|19386738|dbj|BAB86120.1|
  misc_feature: GI Number: 50902396; NR Description: P0678F11.26 [Oryza sativa (japonica cultivar-group)] >gi|19386737|dbj|BAB86119.1|
  misc_feature: GI Number: 50902405; NR Description: P0678F11.31 [Oryza sativa (japonica cultivar-group)] >gi|19386741|dbj|BAB86123.1| P0678F11.31 [Oryza sativa (japonica cultivar-group)] >gi|19386794|dbj|BAB86173.1| OJ1485_B09.2 [Oryza sativa (japonica
MGKVVVAEATARQVASFVLGAAAALTVVMLVQYRAPAAGLSRARTPAHFSGLRLSSDDQHHRRNATTTARPVVHHQAPPVAGSAARDDDRRRPANATTITKPNSTTTSHLPSTRRHEEKGGKEESAEFRGLAAAVARAATDDRTVIITCVNQAWAAQGSLLDLFLESFRIGDGTARLLPHVLVVAMDPGAHARCLAVHQHCYHYTIPGLNIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGGRGKYPGANEQPVFNMMKKQMVAELGLRVQYLNPAYVGGFCSYGKDLGKIVTMHANCCVGIGNKIRDLKGVLGDWRNYTRMPPWERHRAKWTVPGACIRAEKQV

SEQ ID NO: 4317 - DNA, 1823 bp, Triticum aestivum
  misc_feature (1)..(1823): Ceres cDNA ID no. 21705256
  misc_feature (1)..(1823): Ceres CLONE  ID no. 815984
  misc_feature (1)..(1823): Also known as  Ceres CDNA ID no. 24369094
gtttctccctgtctcagtccctagctaccaccaccgcagcgtgcgcagccatggacgcggccacctcgacgacgctcctctacggggcgctgctcgcggctgctttcctctacgtcgccaccatccagcgtggccgcggcaggggcgaaggcggcctgccgccgggccccaggggcctgccgctcttgggcagcctcctgtccctcgacccggacctgcacacctacttcgccggcctcgccaacaagtacagccccatcttctccatccgactcggctccaagctgggtattgtcatcacctccccggcgctggcccgcgaggtgctgcgcgacaacgacctcgtcttctccaaccgggacatcccggacgccgcgcgctccatctcctacggcggtggccagaacatcgtctggaaccccgtcggtcccacctggcgtctgctccgccgcgtctgcgtccgcgagatgctcagccctgctggcctgcagaatgtgcacggcctccgccgccgcgagttcagggccacgctcgcgcacctgcactccatggccagcgccggcatgccggttgacgtcggcgcccagatgttcctcaccaccatgaacgtcatcaccggcacgctgtggggaggcaacatagggaccgagagcgagcggacggcggtgggcaaggagttccgggagcttgtcgcggagatcaccgagatgctcggcgcacccaacgtgtcagacttcttcccggcgctggcgccgttcgacctgcagggaatccggaagaagtcggacgcgctcaaggagcggttcgacgagatcttcggcaggatcatagagaagagggtcgaggccgaccacgccggcggcgacacggcggaagacttcctcgaatacatgctcaagatggagaaggaaggtggcgacgggaaggccgccttcaccatgaccaacgtcaaggccctgctcatggatatggtggttgggggcacagagacgacgtcgaacacggtggaatgggccatggcggagatgctacaaaaccgggggatactgcggaaggtgcgggaggaactcgacgcggtggttggtatcgatggcgtggtggaggaatcggatctcccgcagctgcactatctgcatctggtggtcaaggagacgctccggctgcacccggcgctgccgctcatggtgccgcactgccccagcgaagacacgaccgtcggcggccaccgcgtcccggcgggaagccgcgtgtttgtcaacgcgtgggcgatcatgagggaccccgctgcgtggaaggatccggcgaagttcatcccggagaggttcgcctctcaggcgagcgacggtgacagcgggcggaaggtggacttcaccggcagcgagctggactacgtgccgttcgggtcggggaggaggatctgcgcgggcatcgccatggccgagaggatgacggcatactctgtggccatgctgctgcaggccttcgactgggagctgccggagggagcggcgctggacctgacagagaagttcggcatcgtcatgaagaaggccacgccgctggtcgccgttccgacgccgaggctttccagacccgagctctattccgcatagatagctgatcctactccatgaccatgactccgtgctcgaatcagttcagcctgcagtacatttcccctctcgtgctgttggtccaaacaaaagtttgcttttctacggtttcaattgtctgcttcttctgtagtagcactagcagtgtgcagacagcatctattatatctatatacctattacaatatttatatgaaaaaaaaaaaaaaa

SEQ ID NO: 4318 - protein, 520 aa, Triticum aestivum
  misc_feature: PFam Name: p450; PFam Description: Cytochrome P450
  misc_feature: GI Number: 56785286; NR Description: flavonoid 3'-hydroxylase-like [Oryza sativa (japonica cultivar-group)] gi|56784721|dbj|BAD81870.1| flavonoid 3'-hydroxylase-like [Oryza
  misc_feature: GI Number: 50948251; NR Description: putative P450 monooxygenase [Oryza sativa (japonica cultivar-group)] >gi|42407545|dbj|BAD10750.1| putative P450 monooxygenase [Oryza sativa (japonica cultivar-group)] >gi|42408726|dbj|BAD09944.1|
  misc_feature: GI Number: 34911488; NR Description: putative flavonoid 3',5'-hydroxylase [Oryza sativa (japonica cultivar-group)] >gi|15408772|dbj|BAB64172.1| putative flavonoid 3',5'-hydroxylase [Oryza sativa (japonica cultivar-group)] [Oryza sativa (japonica
  misc_feature: GI Number: 51536592; NR Description: At4g12320 [Arabidopsis
  misc_feature: GI Number: 7267932; NR Description: flavonoid 3', 5'-hydroxylase-like protein [Arabidopsis thaliana] >gi|5281042|emb|CAB45978.1| flavonoid 3', 5'-hydroxylase-like
MDAATSTTLLYGALLAAAFLYVATIQRGRGRGEGGLPPGPRGLPLLGSLLSLDPDLHTYFAGLANKYSPIFSIRLGSKLGIVITSPALAREVLRDNDLVFSNRDIPDAARSISYGGGQNIVWNPVGPTWRLLRRVCVREMLSPAGLQNVHGLRRREFRATLAHLHSMASAGMPVDVGAQMFLTTMNVITGTLWGGNIGTESERTAVGKEFRELVAEITEMLGAPNVSDFFPALAPFDLQGIRKKSDALKERFDEIFGRIIEKRVEADHAGGDTAEDFLEYMLKMEKEGGDGKAAFTMTNVKALLMDMVVGGTETTSNTVEWAMAEMLQNRGILRKVREELDAVVGIDGVVEESDLPQLHYLHLVVKETLRLHPALPLMVPHCPSEDTTVGGHRVPAGSRVFVNAWAIMRDPAAWKDPAKFIPERFASQASDGDSGRKVDFTGSELDYVPFGSGRRICAGIAMAERMTAYSVAMLLQAFDWELPEGAALDLTEKFGIVMKKATPLVAVPTPRLSRPELYSA

SEQ ID NO: 4319 - DNA, 1868 bp, Triticum aestivum
  misc_feature (1)..(1868): Ceres cDNA ID no. 21705258
  misc_feature (1)..(1868): Ceres CLONE  ID no. 818684
  misc_feature (1)..(1868): Also known as  Ceres CDNA ID no. 23729777
acaacgccgcatacccgcacacaacgccgcacgatatgtttccagttccaggcaacacatttttccgttgaatcggacaacacatttccggcggaaggaggatgtctccgtacgccgtcctcgtcgcggtgctcttgaccttctgctacgtcgtttggaaggctcgaggcagcagaagtggcaagctcccgccctcgccgccgtcgcgtccgctgctcggccacctccacctccttggccgccacccgcaccgctccttgcgcgagctgcacgctcggtacggcaccgatggcggcctcctgctgttgcagctcgggcgcaggcggacgctggtggtttccacggcggccgcggcggcgggcctgtacaagaaccacgacctcgccttcgcctcccgcgtgcccagcgcgccggccgacaagctgacgtacggctccaccaacgtctccttcgcaccctacggcgacgcctggcgccgcagcaagaagatggccgtcgtccacctcctctccccgcgccgtgccgactcgttcgcccccgtgcgggccgccgaggcggccgccctcgtcgccggggtgcgccgcgccgcggaggcgggtgagattgtggagctgagggagctcctgtccgcctacagcaacgcggtggtcacccgcgcgaccaccggcgccgcaggtgccacggccgagaagctaaaaaagcttttgggtaactccgcagcgatcatgtcggggctccaggcgggtgacgtgctccccgacgcggcggcgaaggtggttaggtgggcgacgggtctcgagaagaggctcgacgccgagctcgaacagtgggacaagttcctatcagagataatcgcagagcaccttgagaagaagccagacaacggcgcaggggaggagagcttcctcgacgtcctgctgcggcttagggaagaaggcgccgccggactcgagctcaccaacgatcgcatcaaaagcctcatcaaggacatgatagccggcgggacagacacagcatcggtcacgttggaatgggccatggcggagctcgtcgggaacccgcgggcaatagccaagctgcaggacgagatagatcgagtcaccgaaggcaaaccgaccatcgaggaagacgacctgagcaggatggagtacctcagggcggtgctgaaggaggtgctccggctccacccggcggcaccgctcctcatcccgcaccagtcgacgaccgcggcggtcgtgcagggctacgagatcccagctgagactgcgctcttcgtcaacgcgtgggcgatcgggagggacccggcggcgtggggagcaacggcggaggagttctggccggagcgattcctgggcggcggcagcgcgcagggcgtggacctgcgggggaacgactaccagctcctcccgttcggcgccggccggcggctctgccccggcatcagcttcgcgatgccggtgctggagatcgcgctctgcagccttgtgcgccacttcgactggggaaatccccgccgaggcacgtctagacatgaacgaggcgccgggactgatcacgccgccgctggctccgctgcgccttgtccccaagtgcaggaggcagcagtagcagtgccaccaggtgaggtccacgtgcaagctcagaagggcctgcttataaataaaactttgcggtttgcgtttgtgtgaggccagacccgtttaggcgtgtgccggacggccagaccaccccgtcggccacctaggtctgtggtgcataaaaatacaatgctatttatgaagaagttatcagacatatgtattttaacaacttcatttctccggatcaaaattaccgaggttatgttttgaacaaaaaaaaaaaaaaaa

SEQ ID NO: 4320 - protein, 1868 aa, Triticum aestivum
  misc_feature: PFam Name: p450; PFam Description: Cytochrome P450
  misc_feature: GI Number: 50725157; NR Description: putative Cytochrome P450
  misc_feature: GI Number: 50725156; NR Description: putative Cytochrome P450
  misc_feature: GI Number: 25282608; NR Description: cytochrome P-450LXXIA1 [similarity] - avocado >gi|166949|gb|AAA32913.1| cytochrome
  misc_feature: GI Number: 62148966; NR Description: P450 [Triticum aestivum]
  misc_feature: GI Number: 26655531; NR Description: cytochrome P450
ACAACGCCGCATACCCGCACACAACGCCGCACGATATGTTTCCAGTTCCAGGCAACACATTTTTCCGTTGAATCGGACAACACATTTCCGGCGGAAGGAGGATGTCTCCGTACGCCGTCCTCGTCGCGGTGCTCTTGACCTTCTGCTACGTCGTTTGGAAGGCTCGAGGCAGCAGAAGTGGCAAGCTCCCGCCCTCGCCGCCGTCGCGTCCGCTGCTCGGCCACCTCCACCTCCTTGGCCGCCACCCGCACCGCTCCTTGCGCGAGCTGCACGCTCGGTACGGCACCGATGGCGGCCTCCTGCTGTTGCAGCTCGGGCGCAGGCGGACGCTGGTGGTTTCCACGGCGGCCGCGGCGGCGGGCCTGTACAAGAACCACGACCTCGCCTTCGCCTCCCGCGTGCCCAGCGCGCCGGCCGACAAGCTGACGTACGGCTCCACCAACGTCTCCTTCGCACCCTACGGCGACGCCTGGCGCCGCAGCAAGAAGATGGCCGTCGTCCACCTCCTCTCCCCGCGCCGTGCCGACTCGTTCGCCCCCGTGCGGGCCGCCGAGGCGGCCGCCCTCGTCGCCGGGGTGCGCCGCGCCGCGGAGGCGGGTGAGATTGTGGAGCTGAGGGAGCTCCTGTCCGCCTACAGCAACGCGGTGGTCACCCGCGCGACCACCGGCGCCGCAGGTGCCACGGCCGAGAAGCTAAAAAAGCTTTTGGGTAACTCCGCAGCGATCATGTCGGGGCTCCAGGCGGGTGACGTGCTCCCCGACGCGGCGGCGAAGGTGGTTAGGTGGGCGACGGGTCTCGAGAAGAGGCTCGACGCCGAGCTCGAACAGTGGGACAAGTTCCTATCAGAGATAATCGCAGAGCACCTTGAGAAGAAGCCAGACAACGGCGCAGGGGAGGAGAGCTTCCTCGACGTCCTGCTGCGGCTTAGGGAAGAAGGCGCCGCCGGACTCGAGCTCACCAACGATCGCATCAAAAGCCTCATCAAGGACATGATAGCCGGCGGGACAGACACAGCATCGGTCACGTTGGAATGGGCCATGGCGGAGCTCGTCGGGAACCCGCGGGCAATAGCCAAGCTGCAGGACGAGATAGATCGAGTCACCGAAGGCAAACCGACCATCGAGGAAGACGACCTGAGCAGGATGGAGTACCTCAGGGCGGTGCTGAAGGAGGTGCTCCGGCTCCACCCGGCGGCACCGCTCCTCATCCCGCACCAGTCGACGACCGCGGCGGTCGTGCAGGGCTACGAGATCCCAGCTGAGACTGCGCTCTTCGTCAACGCGTGGGCGATCGGGAGGGACCCGGCGGCGTGGGGAGCAACGGCGGAGGAGTTCTGGCCGGAGCGATTCCTGGGCGGCGGCAGCGCGCAGGGCGTGGACCTGCGGGGGAACGACTACCAGCTCCTCCCGTTCGGCGCCGGCCGGCGGCTCTGCCCCGGCATCAGCTTCGCGATGCCGGTGCTGGAGATCGCGCTCTGCAGCCTTGTGCGCCACTTCGACTGGGGAAATCCCCGCCGAGGCACGTCTAGACATGAACGAGGCGCCGGGACTGATCACGCCGCCGCTGGCTCCGCTGCGCCTTGTCCCCAAGTGCAGGAGGCAGCAGTAGCAGTGCCACCAGGTGAGGTCCACGTGCAAGCTCAGAAGGGCCTGCTTATAAATAAAACTTTGCGGTTTGCGTTTGTGTGAGGCCAGACCCGTTTAGGCGTGTGCCGGACGGCCAGACCACCCCGTCGGCCACCTAGGTCTGTGGTGCATAAAAATACAATGCTATTTATGAAGAAGTTATCAGACATATGTATTTTAACAACTTCATTTCTCCGGATCAAAATTACCGAGGTTATGTTTTGAACAAAAAAAAAAAAAAAA

SEQ ID NO: 4321 - DNA, 1671 bp, Triticum aestivum
  misc_feature (1)..(1671): Ceres cDNA ID no. 21705259
  misc_feature (1)..(1671): Ceres CLONE  ID no. 819115
  misc_feature (1)..(1671): Also known as  Ceres CDNA ID no. 24369185
cagtccaacccccagtctggcagtctcccctccctctcccaaatcgaagcgagaaattccccaaaaagctaccccatttccgtcccagccgaggcaccggcgccgcagccgcagccgtgcccgcgcccgcgcgatgccaaacgcgatcccggccttcttccgcgcctcgccggccgcggcgtcgggctccggcgccggggcggggcccagcctcgccacctccgtctacgagacccgcctcggccttgcggcgctctcctggtcgcgcgccgcgttcggcctcagcctccgggccgtgctccgcgtcggggcgctcgcctcttcatcctcggcctccgactacggctgctacgacgacggcccggagttcgacgaggaggccaccatcgccgtgcgcgtccggccctggctcttctggcggcgccgggggtccaagcgtttccacgtgcacgaccgccggatcgacctggcctgggacctcacccgcgcgcggttcgcctcccccggctcgcccgagccgtcgtccgggtatttcgtcgccgtcgtggtcgacggcgagatggcggtcgtggccggggacatgacggaggaggcgtaccggaagacgaaggcccagcggccgacgggccccggtcatgtcctcatctcccggcgcgagcacgtctccatgcgcgacggagggcatggccgcgggcacaagacctgcgtcaaagtccgcggcaaggagcgggagatctcgctggatctcgtctcgcgcgggcacggcaaggatagggaaatggacaaggagaaggacaaggccgaggtcggcctgtcggtctccgtggacggcgagcgcgtcctccacatccgccgcctgcgctggaagttccgcgggagcgagaaggttgacctcggcggcggcgaccgggtccaggtctcctgggacctccacaactggctcttctccgcgcgcgagccggccctcacagacgccgcctccgtcctcgccgcggcgtccccgcccgcgcacgccgtgttcgtcttccgatttgagctcggcgacaccgccggcggcgaagagcgcgactccgcagaggccaaggagaaggagctgctcgacaaggcaagaagaggcggcgccggcgtcttgtcaggctacctagggagatggggcagaggggactggagcgagaccagcagcaatggggagaaccggaggaagagggggcaggcgcggaggctggccaaggcaagctcatcgtcgtcggcatccattgcgtcctcctcggcctcgtgggcgagcagctcgacggtcatggactgggccagccccgaggaggccgagctgcaccgcggcgatggcttctcgctcctcgtctacgcctggaagagctagtaatggctgccacgacggcgtcggcagaagcagctggccggcggcattgttacatttgatgattggttcttcattcagcgggagcttccctcccgattgttgtaagttgcagttgttctccgagcaatgttcgtgtgcagttttgagtgctcggttgaccaaaaaattgttcattacatcaatagctaaggattttcaacagctagatgaaccatattacgacctttgttccgtcaaattcaaaatttaggtggcatattgctggattctgttaatcaaaaaaaaaaaaaaaa

SEQ ID NO: 4322 - protein, 414 aa, Triticum aestivum
  misc_feature: PFam Name: Pyr_redox_2; PFam Description: Pyridine
  misc_feature: PFam Name: HD-ZIP_N; PFam Description: HD-ZIP protein N terminus
  misc_feature: PFam Name: 7tm_1; PFam Description: 7 transmembrane receptor
  misc_feature: PFam Name: Extensin_2; PFam Description: Extensin-like region
  misc_feature: PFam Name: Pkinase; PFam Description: Protein kinase domain
  misc_feature: GI Number: 50902328; NR Description: P0456E05.14 [Oryza sativa (japonica cultivar-group)] >gi|20804936|dbj|BAB92615.1|
  misc_feature: GI Number: 21593854; NR Description: unknown [Arabidopsis thaliana]
  misc_feature: GI Number: 66778264; NR Description: LigA [Anaeromyxobacter dehalogenans 2CP-C] >gi|66856061|ref|ZP_00400131.1| LigA
  misc_feature: GI Number: 66777231; NR Description: Ferric-uptake regulator [Anaeromyxobacter dehalogenans 2CP-C] >gi|66857054|ref|ZP_00401112.1| Ferric-uptake regulator
  misc_feature: GI Number: 5821145; NR Description: RNA binding protein [Homo
MPNAIPAFFRASPAAASGSGAGAGPSLATSVYETRLGLAALSWSRAAFGLSLRAVLRVGALASSSSASDYGCYDDGPEFDEEATIAVRVRPWLFWRRRGSKRFHVHDRRIDLAWDLTRARFASPGSPEPSSGYFVAVVVDGEMAVVAGDMTEEAYRKTKAQRPTGPGHVLISRREHVSMRDGGHGRGHKTCVKVRGKEREISLDLVSRGHGKDREMDKEKDKAEVGLSVSVDGERVLHIRRLRWKFRGSEKVDLGGGDRVQVSWDLHNWLFSAREPALTDAASVLAAASPPAHAVFVFRFELGDTAGGEERDSAEAKEKELLDKARRGGAGVLSGYLGRWGRGDWSETSSNGENRRKRGQARRLAKASSSSSASIASSSASWASSSTVMDWASPEEAELHRGDGFSLLVYAWKS

SEQ ID NO: 4323 - DNA, 1217 bp, Triticum aestivum
  misc_feature (1)..(1217): Ceres cDNA ID no. 21705260
  misc_feature (1)..(1217): Ceres CLONE  ID no. 825460
  misc_feature (1)..(1217): Also known as  Ceres CDNA ID no. 24369582
agcagaaaaggtcacgcctcccagagtccaactacagtactactagtagccaaagccaaaggaaacgggaatatcccgtctttccggccacccggcgtgagccaaaggagacaggatcccggcgatggcggttcccggaggggagggagaggagcgggggcggccggtggttctggtgacaggttgctcggaggggggcatcgggcacgcgatggcgcgcgcgttcgcggcggaggggtgcgcggtcgtggccacggcgcggtcgcgcgcgtccatgcgcgggctcgagggcgacccgcggtaccttcttctggagctcgacgtgcgctccgacgagagcgcgcgccgcgccgtggaggacgccctgcgggagctaggccgcgtcgacgtgctcgtcaacaacgcggggatccacctcgtcgcgccggtcgccgaggtgcccatggagtcgttccaccaggttttcgacaccaatgtctatggaacaatgaggatgattcaagcagttattccccatatgatggaaagaaaagaaggtacaattgtgaatgttggaagcattacagccttggctccaggaccatgggctggtgcgtattcggcatcaaaagctgctcttcatgcattgagcgatacattaagggtggaactaagaaattttggcataaatgtcatgatagttgccccaggaggcacaaagtcaaatataggaagcaattctgcggacaaatatgatcaaataaacgactggaagtactacaaaaaatacgagaaatcacttcgagccaggacggatatatcccagggtgccgggtgtgttgcagcagaagaccttgcaaagagagttgtcaaattggttcttaagaagaatcctcccgcttggttcgcttatggccaattcactgctattctgacgatcctgtattatgccccattgtggttcagagattacttctacaggctggtcatgaaaatgtaatctctggaagatagctcttgcgtgaaccagagagattgccccctcgtgtcccattttcatttcatgagtactacttggtctctcggactctgactacagatatatttcacaatacatgagtacacacacttccagtccatatccatttgtaacgatcagtccaagtgtaaagtcctcccggttattatgtaataatggttttagtaatgtaatattattcctaaaaaaaaaaaaaaaa

SEQ ID NO: 4324 - protein, 1217 aa, Triticum aestivum
  misc_feature: PFam Name: adh_short; PFam Description: short chain dehydrogenase
  misc_feature: GI Number: 20466145; NR Description: AT5g10050/T31P16_40 [Arabidopsis thaliana] >gi|15983432|gb|AAL11584.1| AT5g10050/T31P16_40 [Arabidopsis thaliana] >gi|18424923|ref|NP_569008.1| short-chain dehydrogenase/reductase
  misc_feature: GI Number: 30682984; NR Description: short-chain
  misc_feature: GI Number: 15789624; NR Description: oxidoreductase; YusZ3 [Halobacterium sp. NRC-1] >gi|25283073|pir||D84195 oxidoreductase [imported] - Halobacterium sp. NRC-1 >gi|10579982|gb|AAG18928.1|
  misc_feature: GI Number: 21241213; NR Description: oxidoreductase [Xanthomonas axonopodis pv. citri str. 306] >gi|21106525|gb|AAM35331.1| oxidoreductase [Xanthomonas axonopodis
  misc_feature: GI Number: 53727658; NR Description: COG1028: Dehydrogenases with different specificities (related to short-chain alcohol
AGCAGAAAAGGTCACGCCTCCCAGAGTCCAACTACAGTACTACTAGTAGCCAAAGCCAAAGGAAACGGGAATATCCCGTCTTTCCGGCCACCCGGCGTGAGCCAAAGGAGACAGGATCCCGGCGATGGCGGTTCCCGGAGGGGAGGGAGAGGAGCGGGGGCGGCCGGTGGTTCTGGTGACAGGTTGCTCGGAGGGGGGCATCGGGCACGCGATGGCGCGCGCGTTCGCGGCGGAGGGGTGCGCGGTCGTGGCCACGGCGCGGTCGCGCGCGTCCATGCGCGGGCTCGAGGGCGACCCGCGGTACCTTCTTCTGGAGCTCGACGTGCGCTCCGACGAGAGCGCGCGCCGCGCCGTGGAGGACGCCCTGCGGGAGCTAGGCCGCGTCGACGTGCTCGTCAACAACGCGGGGATCCACCTCGTCGCGCCGGTCGCCGAGGTGCCCATGGAGTCGTTCCACCAGGTTTTCGACACCAATGTCTATGGAACAATGAGGATGATTCAAGCAGTTATTCCCCATATGATGGAAAGAAAAGAAGGTACAATTGTGAATGTTGGAAGCATTACAGCCTTGGCTCCAGGACCATGGGCTGGTGCGTATTCGGCATCAAAAGCTGCTCTTCATGCATTGAGCGATACATTAAGGGTGGAACTAAGAAATTTTGGCATAAATGTCATGATAGTTGCCCCAGGAGGCACAAAGTCAAATATAGGAAGCAATTCTGCGGACAAATATGATCAAATAAACGACTGGAAGTACTACAAAAAATACGAGAAATCACTTCGAGCCAGGACGGATATATCCCAGGGTGCCGGGTGTGTTGCAGCAGAAGACCTTGCAAAGAGAGTTGTCAAATTGGTTCTTAAGAAGAATCCTCCCGCTTGGTTCGCTTATGGCCAATTCACTGCTATTCTGACGATCCTGTATTATGCCCCATTGTGGTTCAGAGATTACTTCTACAGGCTGGTCATGAAAATGTAATCTCTGGAAGATAGCTCTTGCGTGAACCAGAGAGATTGCCCCCTCGTGTCCCATTTTCATTTCATGAGTACTACTTGGTCTCTCGGACTCTGACTACAGATATATTTCACAATACATGAGTACACACACTTCCAGTCCATATCCATTTGTAACGATCAGTCCAAGTGTAAAGTCCTCCCGGTTATTATGTAATAATGGTTTTAGTAATGTAATATTATTCCTAAAAAAAAAAAAAAAA

SEQ ID NO: 4325 - DNA, 1840 bp, Triticum aestivum
  misc_feature (1)..(1840): Ceres cDNA ID no. 21705261
  misc_feature (1)..(1840): Ceres CLONE  ID no. 829604
  misc_feature (1)..(1840): Also known as  Ceres CDNA ID no. 23414781
cccaagccagagataacaaccccagcgagtcggcgacaaccctccctcccgctccgacgtcggagatgggcaccccctcgtaccggctcgcggcggcggtcacggcccccccgggcgccgaggccgagttcctcctcgtccggcagctgcccccgacgcccccgctgggggtggaggaggagggggagtacgggcgctacgtcgacagcgacctctacgacctcccgtcggcgcccctgcggcgcctcgcggatggggagccggcccggccgggcgtggccctcgccggcgcggaggccgagggctccctcgacctctcgcgcctggacgtccccgccgccctccaccagattttgagccaattgggcctgacaaacgcaatgtgcggggagtggaggctcctcaagcatattgtggaggcagagttcggccctgacgcgggcgtcaacacggtgctcatcatcacgtcgctcgagtcgaaaccggaggcattgccagactcctgtaaatggatgtccaaggagggtgctcgggaattgctttctgacgtgaagcccggtggtactcgaattgggccctatgtgcatgttggatttgttaaatcggagctatcttcagattgtacagctggctccacattggtctcccaggagtaccctcccggaataacccttgtaccaatgaagagtagtaccctacggccttttcgcacaactaatctcgtggtaatacaagcaaccagtggtacatgtgcatcgaagcgatctgattattttgcttgtggagatgctttacttatagatcctggatgttgctcacaggttcatacagagcttgcagatcttgtcaattcccttccaaagaagttactggtccttgttacgcatcatcataatgatcatgtcgagggtctttcggttgttcagagatgcaatcctgatgctgttcttttgacacatgaaaacacgatgaagcgcataggaaaagggaattggtcaaccggcaatactgctgtgactggtggtgaaagcatatgcataggtgaccaagaactgcaagtcgtttttgctcctggtcatacagatggtcatatggggcttctccatgtcaataccaatgcactaattgtcggagatcattgtgtagggcatggaagtgcaatattggacaatagagctggtggcaacatgaaggactacttccaaaccacatacaaattcttggagatgtcgccacacgtgctaattccaatgcatggaagaatcaacctatggcccaagcatatgctttgtggatatctcaagaatcgaaaggctagagaagcctccattctgcaatccatagagaatggtgctcaaactttgtttgatatagtttcgaagacttactgtgatgtagacaggaaattgtggattcctgcatccttcaatgttcgccttcatgttgatcatctgaactctcaacataaacttcccaaggacttctcaacggaaaagtttgaatcgagctgcggaacacatttcatattttggtggggcgtagcgtatgcccaagccaggagctcacccgccctcatcatcgcggcaagtgccctcgccgccggtggtctggcgatcgcgtatgccctcagaaggaaaaatggcaaccagccctaggattcttctccaagacccggtaatccccatcttcgagtgcatgcaaccgtcctaagatcgtgttgtttcgtgtgccaagtcagactgtaaactcccaagattgctcatgattgcatactgtatttgcgagctttgctctgtatacacacaagggagaagctcccgatgcaaaaaaaaaaaaaaaa

SEQ ID NO: 4326 - protein, 529 aa, Triticum aestivum
  misc_feature: PFam Name: Lactamase_B; PFam Description:
  misc_feature: PFam Name: Collagen; PFam Description: Collagen triple helix
  misc_feature: PFam Name: DivIVA; PFam Description: DivIVA protein
  misc_feature: GI Number: 23308309; NR Description: At1g25370/F4F7_22 [Arabidopsis thaliana] >gi|16209691|gb|AAL14403.1|
  misc_feature: GI Number: 29831133; NR Description: putative hydrolase [Streptomyces avermitilis MA-4680] >gi|29608247|dbj|BAC72302.1|
  misc_feature: GI Number: 21221990; NR Description: putative hydrolase [Streptomyces coelicolor A3(2)] >gi|7480761|pir||T36557 probable hydrolase - Streptomyces coelicolor >gi|5139626|emb|CAB45552.1|
  misc_feature: GI Number: 50731605; NR Description: PREDICTED: similar to
  misc_feature: GI Number: 57107945; NR Description: PREDICTED: similar to
MGTPSYRLAAAVTAPPGAEAEFLLVRQLPPTPPLGVEEEGEYGRYVDSDLYDLPSAPLRRLADGEPARPGVALAGAEAEGSLDLSRLDVPAALHQILSQLGLTNAMCGEWRLLKHIVEAEFGPDAGVNTVLIITSLESKPEALPDSCKWMSKEGARELLSDVKPGGTRIGPYVHVGFVKSELSSDCTAGSTLVSQEYPPGITLVPMKSSTLRPFRTTNLVVIQATSGTCASKRSDYFACGDALLIDPGCCSQVHTELADLVNSLPKKLLVLVTHHHNDHVEGLSVVQRCNPDAVLLTHENTMKRIGKGNWSTGNTAVTGGESICIGDQELQVVFAPGHTDGHMGLLHVNTNALIVGDHCVGHGSAILDNRAGGNMKDYFQTTYKFLEMSPHVLIPMHGRINLWPKHMLCGYLKNRKAREASILQSIENGAQTLFDIVSKTYCDVDRKLWIPASFNVRLHVDHLNSQHKLPKDFSTEKFESSCGTHFIFWWGVAYAQARSSPALIIAASALAAGGLAIAYALRRKNGNQP

SEQ ID NO: 4327 - DNA, 1628 bp, Triticum aestivum
  misc_feature (1)..(1628): Ceres cDNA ID no. 21705263
  misc_feature (1)..(1628): Ceres CLONE  ID no. 836820
  misc_feature (1)..(1628): Also known as  Ceres CDNA ID no. 0
tccacgcttcaaatttgcgtccgcgtcgatttcacgcgccgctccccccaaatcgagtcccactccgactcctcccccaggcgcataaatacaaatccccaaatctccaaatcccaatcgagaccaaaccctaaccctagcaatccacagcgagagatcgagagagaggcatggcgcgcgccaagggcaggaagcgcgcggccgcggcggccggcgacagccaggcggaggcggcggcgaacggcggccggccgaagcgcgccaaggcgccccccaagcccaagccggagccggagtacgtccacgagccgaggaatctggaggatctttggctgtcggcttttcctatagggactgagtgggaaaatattgataagattaaggagttcaactggaactttgaaaatttagagaaagctctagaagaagggggcaagctgtatgggaagacggtctatgtatttggtagcactgagcctcaactgttgaatgttgacggtgaatcgaagatagtacttattccagttgtagttgcggttgattgccccttccctccatcagataaaattggtataaattctgtccaaagggaaaatgaagaaatagtaccaatgagggcgatgaaaatggcttgggtgccctatgttccactagaggaccggctcagcagaattgacagtttgaaaacaaaaatattcactcttggctgcactcagcgaaggtctgccctgaagcatctcaaagaagaaagagtgaagaagtttgactactgcatgccttattatatgccacttagtcctcctgaagatgaagatgacacagttgtcaatatcatgtatcctctagaacccccgatagtatgcgacttcgactgggaaatggatgatatggaggattttattgatgagaaagtcaaagacgaggtcttgccggaggatgagaaggaaaaattcaaggacttcataaaggagagagttagagaaaggaagagagagctgaagcaggctaaagaagccagaaagaaagctattgatgatatggatccaaagttgaaagaggcatttgaaaatatccggttttacaaattttatcctgtaaaaaccgatgacactcctgatgtgagccaagtacaggcgaagtacattaatagatactaccgccatgcgcatgaactgatgtgatgtccaacttcacaatttgctgtgcgcaatatcaagctatccatccaagctacgggtggaaattttggaagactggagatgtgcctgcttggtaggcatactcaattcggggcttgtattgggccaatggataacttcgttgcgtctgaacgctattgtagtacagtttcacccatgctcctgagtatctcctccttcggcattctatttctctttgtactgcgatatgtaacattatgggagatagttgtagcggccagaaagtagatcctgtaagagcagaagaattgttctaggaacagtttgttccctttctcacccagtacagctctggcttccattattgtttagcttaccctgtgtattttgatcggatccctatatattttgatgctcaaccctatgcgcgttgtgtaaaatttgtgctgcgcaaaaaaaaaaaaaaaa

SEQ ID NO: 4328 - protein, 336 aa, Triticum aestivum
MARAKGRKRAAAAAGDSQAEAAANGGRPKRAKAPPKPKPEPEYVHEPRNLEDLWLSAFPIGTEWENIDKIKEFNWNFENLEKALEEGGKLYGKTVYVFGSTEPQLLNVDGESKIVLIPVVVAVDCPFPPSDKIGINSVQRENEEIVPMRAMKMAWVPYVPLEDRLSRIDSLKTKIFTLGCTQRRSALKHLKEERVKKFDYCMPYYMPLSPPEDEDDTVVNIMYPLEPPIVCDFDWEMDDMEDFIDEKVKDEVLPEDEKEKFKDFIKERVRERKRELKQAKEARKKAIDDMDPKLKEAFENIRFYKFYPVKTDDTPDVSQVQAKYINRYYRHAHELM

SEQ ID NO: 4329 - DNA, 1922 bp, Triticum aestivum
  misc_feature (1)..(1922): Ceres cDNA ID no. 21705264
  misc_feature (1)..(1922): Ceres CLONE  ID no. 837297
  misc_feature (1)..(1922): Also known as  Ceres CDNA ID no. 23397226
atatcccaattcctgtccaacaagttgactcatttcaccgctgctccgagtgtataatccttaattatcaaccaccgacggccgcaattaccaccccccccacacccacacccacacacacacccacccctcgtaaaccccgattcctcgatcgaatctagagaggaggtagtcggcggcgggcgagcggccaagtctctcaggtgtcttcgacgatggggtttatctcgggggtggtgatggggttggtggtcggcgtcgtgatcatggccgggtggagccgcgtgatgcagcggcgcagcaggaagcgcgtcgccaaggctgcggatatcaaggtccttgggtctcttggcagggaggacctcaagaagctctgcggcgacaattttcccgagtggatatccttcccacagtatgagcaggtgaaatggctgaacaagcatctcagcaaactttggccttttgtttcacaagctgcaactgcagttgttaaggaatctgttgaaccactgctagatgattatcgacctccaggaataaaatctctgaagttcaacaaattctctcttggaaatgtctcgccaaagatcgaaggcatccgtatccaaaatcttcagccaggccaaatcataatggatatagatttccgttggggtggtgatccaagcataatccttgctgttgatgctcgagttgcatcactgcctattcagctcaaggatctccaggtctttaccgttgttcgtgtcgtatttcaactatcagaagagattccttgcatctctgctgttgttgttgctctcctcgcagagccagagcctaaaatacagtacacattgaaggctgttgggggtagtctgactgctattccaggactttctgatatgattgatgatactgtcaattcaattgtcaatgacatgctccagtggccacacaggcttgttgttccacttggcgtcaatgttgatacaagtgagctggagcttaaacctgagggaaaactttctgttactgtagtaaaagcaacatctctgaagaataaggagttgattggtaaatctgatccctacgtgaccctgtatgtgcgtcccatgttcaaggtcaaaacaaaagtcatagatgacaacctaaatcctgaatggaatgaaacatttgaactgattgttgaagacaaggaaacccaatctgtcatttttgaggtttatgatgaagacaaccttcagcaagacaagaggctaggtgtggctaaattagcagtgaataatattgtgcccgagactcccagtgaaatcactctgaagcttatgcagtcagtagattcacttaagattaaagactacagggatagaggatcattacatcttaaggtcatgtatcatccatttaccaaggaagaacaactggaagccctggagtcggaaaagaaagcaatagaggagagaaagcggctgaaggaggctggggtaattggcagcacgatggatgcacttggtggcgccgcatcactagttggttcaggtgttggatttgtgggcactggcgttgccgggggtgttgggctcgtgggctcagggcttggtgctggcgctggtctggttggttctggtattggtgccgtgggcagcggccttggtaaagctgggaagttcatggggaggactgtgacagggcacttgggcatgtctcgcaagagtggtagcagctccactgttccccaacctgaccagccttctgcataacttgatgtacagtgagagtagcgtgtcatctttacttttggttaattctgaacatgctttcggtttgcattccagtgtgctgtatttgcggtgcaactaatataaactatttgttggtttctttattgtattttatgtgaacaatatccttgacaggttactgtaaaaaaaaaaaaaaaa

SEQ ID NO: 4330 - protein, 508 aa, Triticum aestivum
  misc_feature: PFam Name: C2; PFam Description: C2 domain
  misc_feature: GI Number: 7488981; NR Description: CLB1 protein - tomato
  misc_feature: GI Number: 1769895; NR Description: CaLB protein [Arabidopsis
  misc_feature: GI Number: 50936275; NR Description: putative CLB1 protein (calcium-dependent lipid binding) protein [Oryza sativa (japonica cultivar-group)] >gi|33354209|dbj|BAC81175.1| putative CLB1 protein (calcium-dependent lipid binding) protein [Oryza sativa
  misc_feature: GI Number: 50508139; NR Description: putative C2
  misc_feature: GI Number: 50943773; NR Description: putative Ca2+-dependent
MGFISGVVMGLVVGVVIMAGWSRVMQRRSRKRVAKAADIKVLGSLGREDLKKLCGDNFPEWISFPQYEQVKWLNKHLSKLWPFVSQAATAVVKESVEPLLDDYRPPGIKSLKFNKFSLGNVSPKIEGIRIQNLQPGQIIMDIDFRWGGDPSIILAVDARVASLPIQLKDLQVFTVVRVVFQLSEEIPCISAVVVALLAEPEPKIQYTLKAVGGSLTAIPGLSDMIDDTVNSIVNDMLQWPHRLVVPLGVNVDTSELELKPEGKLSVTVVKATSLKNKELIGKSDPYVTLYVRPMFKVKTKVIDDNLNPEWNETFELIVEDKETQSVIFEVYDEDNLQQDKRLGVAKLAVNNIVPETPSEITLKLMQSVDSLKIKDYRDRGSLHLKVMYHPFTKEEQLEALESEKKAIEERKRLKEAGVIGSTMDALGGAASLVGSGVGFVGTGVAGGVGLVGSGLGAGAGLVGSGIGAVGSGLGKAGKFMGRTVTGHLGMSRKSGSSSTVPQPDQPSA

SEQ ID NO: 4331 - DNA, 1558 bp, Triticum aestivum
  misc_feature (1)..(1558): Ceres cDNA ID no. 21705266
  misc_feature (1)..(1558): Ceres CLONE  ID no. 859700
  misc_feature (1)..(1558): Also known as  Ceres CDNA ID no. 24369598
agcaagaaagaaagaagaaagaaaacagtccccggccgccgcacctgagagccctcataaaagttcgtcgaaaataattggcgaaaagactggatctttatctgcagcgaggtgcttctggagaagaagggtaagcaggattcagacatccatcagtagatgggggtcaagaagccgcagccggcgccggagaagccaaagccggagccgcaggtgctagtgccgccggtcttcgacttccctcccttggccgcccgcaccaggatgttggtgccggcatatgagctcatgttcggaaagctcgcgcgacgcagcctctttgatgactacctccattctgggggcgtggatgcgcagattgtgttgaagcagctgggagattctcatgctgatctcactgccactatgtctacaaatgggggggaagctcactttcgatggcagagggatttgaaagatcccaatacgtttgtggactttcttgtgtcgacttcaaagcccacaatgcggctgtcttcaagcatttactatccgaagtatcgtattggcgcctttgggacattccctttgaatatggcaaacagggcatgcccagaagattatggtgtcatgggtttaagatatggttcagagaatctaccaattggggcctccttcgtcccatttccttcgcctggtgaggtaccctatggtgcatggttggttgggagaaaagggaatttaagtgcaggcgtacaatacaaaccaataggtggaagcaagcatcctatgccttttactgacttgatgaactggaattgtgcaatcggttatggtgtaggctcaagtagcccactcagcccttcatttaattttgcactagagcttgttagaagttcgcagctggttgcatcgttctatcaacaccatatttctgcaaaggtactaaattatcggggtggagatgaaactttgaactacattgatcttggacttgagctagccacaagggtggataaagacaaaccaacagatgatgctggcaattcatcgtttcaggtagctgcaagttggcagcttcatacagatttacttgtaaaggggaaattaggcccttcgaaatcttctgcagcattggcgtttgaaaatgatcattcgaaaggtacaagatcgtatgggttgggaattcgtgttgaggatttcagagaagccagataccaaacacttaatcgagagtgtacggtcttgaaacaacatgagatagacgttgatgggaagaagcgcaccctcgagtttgactttggtccaggcaactatgacaatttaccaacggagttgaaacctattgacaaagtattgtaattgtaggttgttacacttgctcttcatcatgtagtcgggaagccccataaaactatcagttattatgggtgttagtagattagttgatcgactctgctttgataaggaatgtgttgagacagactgtcattcaaccgtgaaatacaatggtactgtatgcagttatctgtcaaatgttcaagagatagatcttcaactgttaaaaaaaaaaaaaaaa

SEQ ID NO: 4332 - protein, 393 aa, Triticum aestivum
  misc_feature: GI Number: 21536576; NR Description: unknown [Arabidopsis thaliana]
MGVKKPQPAPEKPKPEPQVLVPPVFDFPPLAARTRMLVPAYELMFGKLARRSLFDDYLHSGGVDAQIVLKQLGDSHADLTATMSTNGGEAHFRWQRDLKDPNTFVDFLVSTSKPTMRLSSSIYYPKYRIGAFGTFPLNMANRACPEDYGVMGLRYGSENLPIGASFVPFPSPGEVPYGAWLVGRKGNLSAGVQYKPIGGSKHPMPFTDLMNWNCAIGYGVGSSSPLSPSFNFALELVRSSQLVASFYQHHISAKVLNYRGGDETLNYIDLGLELATRVDKDKPTDDAGNSSFQVAASWQLHTDLLVKGKLGPSKSSAALAFENDHSKGTRSYGLGIRVEDFREARYQTLNRECTVLKQHEIDVDGKKRTLEFDFGPGNYDNLPTELKPIDKVL

SEQ ID NO: 4333 - DNA, 1897 bp, Triticum aestivum
  misc_feature (1)..(1897): Ceres cDNA ID no. 21705267
  misc_feature (1)..(1897): Ceres CLONE  ID no. 860408
  misc_feature (1)..(1897): Also known as  Ceres CDNA ID no. 24368761
accattcgaaagatccaccgaagatttttctcctcactctcctcgacctcacagctctcctctgccagcagcgcagatttatagacacaagctagcacacagcaagctcagagcacctcgctggtctaagtgatccttctcaaggatcatttggatggcctcttcctcctcctcctgtgcatcctcatttctgcggccatcgtgtcctacgcccaccacgtaatccggcggcaacgccagggctgcgctcatggccgccatgagcaagccgccctcaagctgccccctggctccatgggcctgccttacatcggcgagaccctccagctctactcccaggaccccagcgtcttcctctcctccaagcagaagcggtacggcgagatcttcaagacgcacctcctcggctgcccgtgcgtgatgctggcgagcccggaggcggcgcggttcgtgctggtgtcgcgggcaaacctgttcaagccgacgtacccgcggagcaaggagcgcctcatcggcccgtcggcgctcttcttccaccagggcgactaccacctccgtctccgcaggctcgtccagggcccgctcggccccgaggccctgcgcaagctcgtgccggacatcgaggccgccgtgcgggcaaccctcgcggcctgggcggacggcgacgtcgccagcaccttccacgccatgaagaggctctcgttcgacgtcggcatcgtgacgatcttcggcgggcggctggacgagcggcggaaggaggagctccggcggaactacgccgtcgtggagaaaggctacaactccttccccaacagcttccccgggacgctatactacaaggcgatccaggcgaggcggcggctgaacggcgtgctgagcgacatcctgcacgagaggagggagcggggcgagcccggcgacgacctgctcggctgcctcatgcggtcgcgggccggcggcgacgacggcgacgagggcgcgctgttgacggacgagcaggtcgccgacaacgtcatcggcgtgctgttcgcggcgcaggacacgacggccagcgtgctcacctggatcgtcaagtacctccacgaccggccgaagctgctggaggccgtgagggcggagcacgccgcgatccacgaggccaacgacggcgggaggcggccgctgacatgggcgcagacgaggagcatgacgctgacgcacagggtgattttggagagcctgaggatggcgagcatcatctccttcacgttcagggaggccgtggccgacgtggagtacaaagggtttcttatccccaaggggtggaaggtgatgccgctcttcaggaacatccatcacagcccggactacttccaggatccacagaagttcgacccttcgagattcaaggtggcgccgcggccgagcaccttcacgccgttcgggagcggggtgcacgcgtgccccgggaacgagctggccaagctcgagatgctggtgctcatccaccacctggtcaccggctacaggtgggaggttgttggatcgagcgacgacgtcgagtacagcccattccctgttccccagaacggcctgctcgccaggttacggcgggatgacagcgtctgcgtgggtaggaaggggtgcccgactgatgacaactacgacgacgaagacgaagtgatagtgtgattagtcaacgtagatagctagagggctcttctctccctttttgttgttattgttgttgttgttgttgtggcattcttctctaggaaaatcattagagaagaaacaacagaacgactttttaggatgacgatgatcatgtaccgtagtggttatgttgtcaatgatgtattgtcattgatacacgcataaaatgacgcttcctttttccggaaaaaaaaaaaaaaaa

SEQ ID NO: 4334 - protein, 458 aa, Triticum aestivum
  misc_feature: PFam Name: p450; PFam Description: Cytochrome P450
  misc_feature: GI Number: 21537283; NR Description: cytochrome P450, putative [Arabidopsis thaliana] >gi|18402179|ref|NP_566628.1|
  misc_feature: GI Number: 51536307; NR Description: putative cytochrome P450
  misc_feature: GI Number: 50946763; NR Description: putative cytochrome P450 [Oryza sativa (japonica cultivar-group)] >gi|42407378|dbj|BAD09367.1| putative cytochrome P450 [Oryza sativa
  misc_feature: GI Number: 9294629; NR Description: cytochrome P450
  misc_feature: GI Number: 20259299; NR Description: putative cytochrome P450 protein [Arabidopsis thaliana] >gi|15293093|gb|AAK93657.1| putative cytochrome P450 protein [Arabidopsis thaliana] >gi|18415271|ref|NP_567581.1| cytochrome P450 family protein
MGLPYIGETLQLYSQDPSVFLSSKQKRYGEIFKTHLLGCPCVMLASPEAARFVLVSRANLFKPTYPRSKERLIGPSALFFHQGDYHLRLRRLVQGPLGPEALRKLVPDIEAAVRATLAAWADGDVASTFHAMKRLSFDVGIVTIFGGRLDERRKEELRRNYAVVEKGYNSFPNSFPGTLYYKAIQARRRLNGVLSDILHERRERGEPGDDLLGCLMRSRAGGDDGDEGALLTDEQVADNVIGVLFAAQDTTASVLTWIVKYLHDRPKLLEAVRAEHAAIHEANDGGRRPLTWAQTRSMTLTHRVILESLRMASIISFTFREAVADVEYKGFLIPKGWKVMPLFRNIHHSPDYFQDPQKFDPSRFKVAPRPSTFTPFGSGVHACPGNELAKLEMLVLIHHLVTGYRWEVVGSSDDVEYSPFPVPQNGLLARLRRDDSVCVGRKGCPTDDNYDDEDEVIV

SEQ ID NO: 4335 - DNA, 1635 bp, Triticum aestivum
  misc_feature (1)..(1635): Ceres cDNA ID no. 21705268
  misc_feature (1)..(1635): Ceres CLONE  ID no. 860790
  misc_feature (1)..(1635): Also known as  Ceres CDNA ID no. 24368706
attgtgatgttttattgcaatgtactcgaaatgaacaaactctcctactctgcctgccctgcgtccgcgacgggagcccgaccgcacccacgactgccaagccccacgggagcccggcgactacggcggctcacgccggccggctcgctgccctcctcctgacctctcgtccgcctgccttcctcgttccggtctgccgtaacttttgccgcgactgaacaacgcgaccgacggcggtgctccctctcggcgcagctcgtacctcggagttaggatgaagtctaagacgaacaggggcatgcagaaggcaggaagagtagatcatctccaaggaggaggaccaaactggattcttgttgccggaggagttttactaagcactctctccgtcaaacttggatgcaaattaaagcaaatgtttgatacgaaggagcagaatggcttttccaaagccgaaagtaggcctagaggatgtgaattgcactcaaacctatgcaggtttcgtggccaaactagctgctactattgtatttcagggcattcagatggtggagtggaagtcaagcatcctcctgcaagtccatcaaaatcagctgaaccctcgcttccacttgtgaaaataccagtgcaagaatcaagcaaggacaacagtggcgtcatgtggatatcatcacctgaccgccttgaagatcctcgtaaaccatttcagtactcaaacagttctggctctccacgtgtttcagagtcaggatctaacatttatagcaagagagaggtcatacagaagctgaggcagcacctgaagagacgtgatgagatgatcatggagattcaagctcagattgctgaccttaagaactctcttgccatccaggagaaccagtcgtctaatttgcagtctcagctggagtctgctaaccgagatatatttgattctgagcgagagatccagcatctgaggaagatcatcacagaccattgtgttggcgaagcactctctcacgataagccgttgcatgttggacactggcagtcagatgccaccaatgggcatgctaatggctacgccaatagcagcgtcggtgaccctgagctgcattttattggtattgggaggaagaaagaagagttagagaggatggagatgctcaagagggaggtgggtgagctgaaggaagttatcggagggaaagacttcttgcttcacagctacaaggagcagaaggtcgagctctgttctcagatcagggaattgcaggaaaaactctcgtcgcatgtgccgaacatattgtaggatcttctggtaatgttcgtttgccaaaggagcagcagctgtagccctgttcccatgcggtcttgcaccactggtttgcaggaaaatctgtcggtgcacaggccgaacatcctaggatatttgcagaatgttaggttgattggtttctttctttcttggccatattgttaggttggtttgcttcagttcccgccctctgttgcttggaattacaaagggtttctttgctcagttgctggacctagggtagctaaattaatgggaagttgatactccagacttacggtgctgtacagtttttctttttatggtttgcagacaccccaaaaaaaaaaaaaaaa

SEQ ID NO: 4336 - protein, 339 aa, Triticum aestivum
  misc_feature: GI Number: 21536672; NR Description: unknown [Arabidopsis thaliana]
MKSKTNRGMQKAGRVDHLQGGGPNWILVAGGVLLSTLSVKLGCKLKQMFDTKEQNGFSKAESRPRGCELHSNLCRFRGQTSCYYCISGHSDGGVEVKHPPASPSKSAEPSLPLVKIPVQESSKDNSGVMWISSPDRLEDPRKPFQYSNSSGSPRVSESGSNIYSKREVIQKLRQHLKRRDEMIMEIQAQIADLKNSLAIQENQSSNLQSQLESANRDIFDSEREIQHLRKIITDHCVGEALSHDKPLHVGHWQSDATNGHANGYANSSVGDPELHFIGIGRKKEELERMEMLKREVGELKEVIGGKDFLLHSYKEQKVELCSQIRELQEKLSSHVPNIL

SEQ ID NO: 4337 - DNA, 1366 bp, Triticum aestivum
  misc_feature (1)..(1366): Ceres cDNA ID no. 21705269
  misc_feature (1)..(1366): Ceres CLONE  ID no. 861409
  misc_feature (1)..(1366): Also known as  Ceres CDNA ID no. 24368696
aatctaatctgatcaaaacctcaacagccttttctaaaccctagacagatccgtacgatcgacatgggcgtcggcccttccgtcgccgacggcggcgacaccacggcggtgacggggtccatcagcgaggtgcccaaggtgtccggcacccacgagttcacgatccgcgagtacagccgcaccaagggcatgggcgtgggcaagtcgatcctgtcgcagtacttctccgtcgacggccgccgctggtacatccgcttctacccggacggctacagcacggccgacggcgcctggatcgccttctacgcgcagacgctctacaagccgcagttccgccccgtgcgcgccgagttcaccttccagctcctcggccccaacggcgacgtccgccacacgcgccgctccgaccgggcctgcaagtacgacaccttctgcaacagctggggcatccgccgctacatcacccgggagcagctcgagagcgcggcgctcggcgccatccacgccgactccatcaccgtgcgctgcaccgtcacgatccacctggcgcggaggaggagcctcgccatcaaccgcccgggcctcgtccagatgccgccgccgccgccgtccaaccacggggagaacgccctcaggttcctcgccggcgggaaggcccccttcgacgtgcgcttcgacgtggacggcgagatcttcgaggcgcaccggatggtggtggccgcgcagtcggcgtggttcgagagcctcctctacggccacggccgcgaggcgggcaaggacgtgctcgaagtcggcggcggcattgtcaccgcggaggcgttccggggcgtgctccacttcatctacaccgacgagctgccccccgaggccgccaaggggagggggtcgtacgacctgacgctgcggctgttcgaggcggccgactactacctcatcgagaggctgaagctgatgtgcgcgtgcaggctgggagacttcatcaaggactccaccgtggacgagctcatggagatcgcggaggactactcgtgcaaggacctcgggcaggcgtgccggaacttcgcggcgcgcaggggcctgagtttggcagcgataaagaggagattatcgtccagcggcgctgctccggcgacgaggaggatcatggacgttccgactccgtcgacgagcggctgagtgaaaatttcttgtgcatgcatgcatgtggtacgtatacttagtacgtagggtaatctgtcggactacatatattatagcgtagttaattaggttattggtgtgctgaagtactgtttatactccatactccatagtatattaagcaagggtccagtttatgatagttgcctcaaaaaaaaaaaaaaaa

SEQ ID NO: 4338 - protein, 370 aa, Triticum aestivum
  misc_feature: PFam Name: MATH; PFam Description: MATH domain
  misc_feature: PFam Name: BTB; PFam Description: BTB/POZ domain
  misc_feature: PFam Name: BASP1; PFam Description: Brain acid soluble
  misc_feature: PFam Name: Podocalyxin; PFam Description: Podocalyxin
  misc_feature: PFam Name: Pkinase; PFam Description: Protein kinase domain
  misc_feature: GI Number: 50939715; NR Description: putative zinc finger POZ domain protein [Oryza sativa (japonica cultivar-group)] >gi|23617108|dbj|BAC20790.1| putative zinc finger POZ domain
  misc_feature: GI Number: 21536509; NR Description: unknown [Arabidopsis thaliana]
  misc_feature: GI Number: 37534532; NR Description: putative speckle-type protein [Oryza sativa (japonica cultivar-group)] >gi|31432193|gb|AAP53855.1| putative speckle-type protein [Oryza
  misc_feature: GI Number: 50942517; NR Description: putative speckle-type POZ protein [Oryza sativa (japonica cultivar-group)] >gi|38636861|dbj|BAD03127.1| putative speckle-type POZ protein
  misc_feature: GI Number: 50907411; NR Description: putative speckle-type POZ protein [Oryza sativa (japonica cultivar-group)] >gi|46390730|dbj|BAD16239.1| putative speckle-type POZ protein
MGVGPSVADGGDTTAVTGSISEVPKVSGTHEFTIREYSRTKGMGVGKSILSQYFSVDGRRWYIRFYPDGYSTADGAWIAFYAQTLYKPQFRPVRAEFTFQLLGPNGDVRHTRRSDRACKYDTFCNSWGIRRYITREQLESAALGAIHADSITVRCTVTIHLARRRSLAINRPGLVQMPPPPPSNHGENALRFLAGGKAPFDVRFDVDGEIFEAHRMVVAAQSAWFESLLYGHGREAGKDVLEVGGGIVTAEAFRGVLHFIYTDELPPEAAKGRGSYDLTLRLFEAADYYLIERLKLMCACRLGDFIKDSTVDELMEIAEDYSCKDLGQACRNFAARRGLSLAAIKRRLSSSGAAPATRRIMDVPTPSTSG

SEQ ID NO: 4339 - DNA, 911 bp, Triticum aestivum
  misc_feature (1)..(911): Ceres cDNA ID no. 21705272
  misc_feature (1)..(911): Ceres CLONE  ID no. 883520
  misc_feature (1)..(911): Also known as  Ceres CDNA ID no. 24727004
gcaaagtttataatcccggcgccggatcgagagagagatagagagagggtgcaccgtgcatggtttaatctgtggcgcgactgcgggagcgcgggcgcgcgcgttaaatatgggcatcctggatcactcggaggacgaggaggaggaggggagccactacggcggcagcggcggaggcgcgaggttcggcgcgcggcggcagaagccgaggtccaagagccaccaccagctgctgctcatggacagcgtcggcggcggcgcggacggggagtgcgcgtcggaggaggaggaggtcgtgccgctgccggagtacgagcggctgtcccagtccgcgcgcctcccgggcgacgacgacgacccggctggcgccgaggccccgcctcctccggccgagcggagcgcgtccctgacgcccccgccgcggcagcagcagcagcagaagccggcggcgtggcggctgctccagtacgtgcggtccatgcacaggtcttcggcgggggccgtggtggccggcgggtactgcggcggctcgtcggacggcgactccaagagctccgacggagacaaggaggggatcgacggcgataaggaaagggtcgacggcgacggcgacggcgacggcgaggggaggaaggacaagcagcggaagaagaagcgctcctcgtggctgccggaccccgaccgccggtggccggtgcaggggttctactaggggtcttcgccgtgtgtcgtggacttgtcgtcgcgtttaattctcttcgttgatcgtactgtgtctgtacgtgtacgtcgaagctggtacccatgacgtgtcacctactctgggtcttcgctgatcttgttcgagtttgtttcctttccctttcctggtgatttcgatgtcgatgatgagcacaaaaaaaaaaaaaaaa

SEQ ID NO: 4340 - protein, 200 aa, Triticum aestivum
  misc_feature: PFam Name: Aminotran_3; PFam Description: Aminotransferase
  misc_feature: GI Number: 66776633; NR Description: Response regulator receiver [Anaeromyxobacter dehalogenans 2CP-C] >gi|66857630|ref|ZP_00401676.1| Response regulator receiver
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
MGILDHSEDEEEEGSHYGGSGGGARFGARRQKPRSKSHHQLLLMDSVGGGADGECASEEEEVVPLPEYERLSQSARLPGDDDDPAGAEAPPPPAERSASLTPPPRQQQQQKPAAWRLLQYVRSMHRSSAGAVVAGGYCGGSSDGDSKSSDGDKEGIDGDKERVDGDGDGDGEGRKDKQRKKKRSSWLPDPDRRWPVQGFY

SEQ ID NO: 4341 - DNA, 1777 bp, Triticum aestivum
  misc_feature (1)..(1777): Ceres cDNA ID no. 21705273
  misc_feature (1)..(1777): Ceres CLONE  ID no. 884746
  misc_feature (1)..(1777): Also known as  Ceres CDNA ID no. 24368980
accgtctagcgtcttgcttgaagcctaaccccagaatcccattcttctccagtcccttcgtcggcagaggttcctaggtcggcggcgccgccaccggccaccgctcgctacctccgtcgcgggcgcggcagatcctgctgccagatcgccgttcccacttcatctcgttcgcggcacggcactgccggcttatcttgactatctggctcgtcgggaggtcgccgccgccgtgccgtgccgatctgccacggcggaaggtcaccgccgacgcttcctcctcgtatcaggtctcactctgctgctcgagatgcggacggtggctagccttaccgacgacctccttgtcgcgatcctctcccgtctccccgtcaagtcgctccgccgctgcatgtgcgtctccaggacctggcggggcatcatctcgcacccgcacaaccaaaggcagctgccgcagaccctcgagggcttcttctacgtgccccgcagcgagccggcgccagctcccagtttcaccaacgtcaccgggacagtccgccctctggtctctcctctctttgatttcctgccgcagcaccagagcatcttcctgctgtcctgctgcaacggcctcctcctctgccgctgctgggaaggccaggacgacttccattacgtcgtgtgcaatccagccacggaggagtgggtccggttgcccgactcgatcaatgccggcaccgagtgcatggcacgtctgggttttgacccagctgtgtcggatcacttccatgtgtttgagttctccgaggatcacgacatcagccaacccggaatggaggtgtattcctctgaaacaggggaatgggttcacaaggagaacggatggattgatacggaagatgatgaagcatttgtttcccttgttggtcatcactcgggagatgtgtttcttaacggctgtctgcattttctcaccatggatgatgatatagccgtggtggacaccgaggggaaaacatggaggaagatacctatccctgaactttgcactgttggtctcattcagaaatctcagggttctttgcattttgtcagttttcttgaaactgatgaaagtatggttgaactggtggtttatgttcttgagaactaccgcagtcaagaatggatattgaagcatagcaccgacgcttcatatatatttggagagagagagattgatcttatacagggttttcagtgggttgcaatgcatccagactgtaacatcatcttcttaactgtggggtgggataatacattggtctcttatgatatggatcatcacaaaattcaagagatctgtgatcttggaggagacgacaatccgcgatatctgccatatgtgccattgtactctgagttacaaactctgcacgcatgacataaaaattgaggagccaggtcttgaggaaagtgcttttcttcattaggaggttgagaccccttttccaaggactggatgatacctaaggcagaagagttggctacagtacccttgaggttggattcaggatgacagcatcagtaaggttatggggcgcttgcgtggttactgttggtatgctcctggggacaaacacatttgcatgtgacagttaatctcttgttggcagataaataagtcgtgaggaggatggtcgtatgcatggttctttcttttgtatttataattttcttcacttcaccgaacctgtcaaacaacatgttttttttttcctgaatagtatgttatctgatggtgctaaaaaaaaaaaaaaaa

SEQ ID NO: 4342 - protein, 363 aa, Triticum aestivum
  misc_feature: PFam Name: F-box; PFam Description: F-box domain
  misc_feature: GI Number: 50938037; NR Description: receptor-like kinase-like [Oryza sativa (japonica cultivar-group)] >gi|33146479|dbj|BAC79588.1| receptor-like kinase-like [Oryza sativa (japonica cultivar-group)] >gi|50508392|dbj|BAD30392.1|
  misc_feature: GI Number: 34914902; NR Description: B1096D03.14 [Oryza sativa (japonica cultivar-group)] >gi|22535607|dbj|BAC10781.1|
  misc_feature: GI Number: 38260652; NR Description: F-box protein [Capsella
  misc_feature: GI Number: 38260688; NR Description: F-box protein
  misc_feature: GI Number: 38260634; NR Description: F-box protein
MRTVASLTDDLLVAILSRLPVKSLRRCMCVSRTWRGIISHPHNQRQLPQTLEGFFYVPRSEPAPAPSFTNVTGTVRPLVSPLFDFLPQHQSIFLLSCCNGLLLCRCWEGQDDFHYVVCNPATEEWVRLPDSINAGTECMARLGFDPAVSDHFHVFEFSEDHDISQPGMEVYSSETGEWVHKENGWIDTEDDEAFVSLVGHHSGDVFLNGCLHFLTMDDDIAVVDTEGKTWRKIPIPELCTVGLIQKSQGSLHFVSFLETDESMVELVVYVLENYRSQEWILKHSTDASYIFGEREIDLIQGFQWVAMHPDCNIIFLTVGWDNTLVSYDMDHHKIQEICDLGGDDNPRYLPYVPLYSELQTLHA

SEQ ID NO: 4343 - DNA, 1367 bp, Triticum aestivum
  misc_feature (1)..(1367): Ceres cDNA ID no. 21705274
  misc_feature (1)..(1367): Ceres CLONE  ID no. 885995
  misc_feature (1)..(1367): Also known as  Ceres CDNA ID no. 24369458
agatcccatccttccatcccagttctcccagccgccgccgccgccagtcctggccgccgcagtaaccgattcgattcgtcgagtcctcccctgctgcagggcaggtaaatgagggcggcgcggcagttcgtgaacgtggtgatgcgcacaggcaccacctactcggtgagccgcatcaagcctgaggagaagctcttctacgcatccgtggaggaagcgcgagccgcggcggcgcccaagaagaagattccggccctgtcgaggatgcccgcgcccaagctcaggctcgaggcgtacggcctggacgacatgcggctcgatttcctgcccttgtacgggcggggcggcggcggcggcggcggcgacagcagcagcgggatcctctccgtcgactcggcaggccacaccatcctctgcgacgcgagctcgggctgcgtccagcctgcccccagcctccgcgagcccaagggggacagccccatctcgttcaccatcgctcgcgccggcggccccgacccccgcgtcgccgtggctctgtacgtcatggacaggttccccaccggccgcagctcctgcagcttcgagtccctcgcctacggcgagaacagctgctgggagtggagccggctcccgccgccgccctatgtcaacgacccggcctacgactgcaccgctatccactcctacacgctgctcaatgcaggctccaccatctgcgtatcctcctccgggcgcagccccgtcgggacctactgcttcgacacgtctagccgccagtggaggaaggctggccgctgggcgctgcccttctgcggcagggccgagcatgtccccgagcttgacaacctctggttcggcatggctgacagcagccccaacaacctgtgtgcgtcggacctctccagcctcgacggcggggctcccaggatgctacgcgagtggcaagtccttgacccgcctcggggctgggtgcaaataaggggctgcctgctctacctgggagccggcaggttttgcatcaacaaagttttcgacattggggacgagggcaggaccaagagtgacaagcaggctgctgtcatcaccggtgtggaggtggtacatgatgaaacagcccaactccagatgatcaagcacaagtcctgtgtcagctatgcaggcatccagtgtatcctttagatcaatagtgctcctcccatatgagttgttttcttctttctctaaccatgttcttatactgcagcagttcacagcaccatgtatattaaatttaattgtgctctgttccttcttatatgtatgatacagtttgctgttcacagcaccatgtatattaaatttaattgtgcccaaaaaaaaaaaaaaaa

SEQ ID NO: 4344 - protein, 356 aa, Triticum aestivum
  misc_feature: PFam Name: Pyr_redox_2; PFam Description: Pyridine
  misc_feature: PFam Name: BASP1; PFam Description: Brain acid soluble
  misc_feature: GI Number: 34907072; NR Description: OSJNBa0093F16.25 [Oryza sativa (japonica cultivar-group)] >gi|20161829|dbj|BAB90743.1| OSJNBa0052O12.1 [Oryza sativa (japonica cultivar-group)] >gi|20805238|dbj|BAB92905.1| OSJNBa0093F16.25 [Oryza sativa
  misc_feature: GI Number: 32487803; NR Description: OSJNBa0035I04.14 [Oryza
  misc_feature: GI Number: 57834054; NR Description: OSJNBa0035I04.15 [Oryza
  misc_feature: GI Number: 34907070; NR Description: OSJNBa0093F16.24 [Oryza sativa (japonica cultivar-group)] >gi|20805237|dbj|BAB92904.1|
  misc_feature: GI Number: 34014801; NR Description: MUC19 [Mus musculus]
MRAARQFVNVVMRTGTTYSVSRIKPEEKLFYASVEEARAAAAPKKKIPALSRMPAPKLRLEAYGLDDMRLDFLPLYGRGGGGGGGDSSSGILSVDSAGHTILCDASSGCVQPAPSLREPKGDSPISFTIARAGGPDPRVAVALYVMDRFPTGRSSCSFESLAYGENSCWEWSRLPPPPYVNDPAYDCTAIHSYTLLNAGSTICVSSSGRSPVGTYCFDTSSRQWRKAGRWALPFCGRAEHVPELDNLWFGMADSSPNNLCASDLSSLDGGAPRMLREWQVLDPPRGWVQIRGCLLYLGAGRFCINKVFDIGDEGRTKSDKQAAVITGVEVVHDETAQLQMIKHKSCVSYAGIQCIL

SEQ ID NO: 4345 - DNA, 1247 bp, Triticum aestivum
  misc_feature (1)..(1247): Ceres cDNA ID no. 21705275
  misc_feature (1)..(1247): Ceres CLONE  ID no. 886310
  misc_feature (1)..(1247): Also known as  Ceres CDNA ID no. 24369252
acggcttgattttccatcgcccccagcgatatctatctatccgatcgaaatccagacaagaaagcggtccttcgctcactcatacgagcttcaacttttgcgaaccgaaacgggtgcgagctggtatataaagtgcgtgcagcgcgcgcaggcccgcggccacattatagcagccgctcctacgtccacgtccttctacaagcgagcgactggtgcccatacctccggcgcataattgccgcggcaagggaggcgatgggcgcgcacacccggtccatgagctggtacatgggccagacgggctcgcaggcgccgtcgagcgccgagaacggcgcgcagcgcgcgctcagcagcggcggcggcggcgacgccagcttcgacaccaacatggtcatcatcctcgccgcgctgctcttcgccctgctcttcgcgctggggctcaactccctcgcgcggtacgtcatccggtgggcgcggcgcgcgtcgctggaggcgtcgggcggcggggagctggacggcgcggcgtcggcggcgtcggcgggcgggcggggcgggctcaagaagcgcacgctcaggagcctccccatcgaggtgtacggcgcgtgcgcggccgcgggcgggggcggcgccgcgccggcggacgacgtctgcgccatctgcctcggcgagttcgaggacggcgagaaggtgcgcgtgctgccgcgctgcggccacgagttccacgtccgctgcgtcgacacctggctcgtctcgcacgactcctgccccacctgccgggactcggtgctcagcggcgcggccgccgccgggcgcagcggcgggcggcccgggagcgccgacgccgcggccgtcgaggtggtcatcgccgcgtgaccgcgtggacgggtgggcgccatccgtggtgggcccgcagataggattgtttcgcttggagtacagtagaaactatcctggccgtgaccgcgtctgtctgtgtgactgtgagagagagatatttttttgacgttggtggtctgcttagcttcggtcacggtcaggctttaccgctcgtcgacggcacgtacatgtaccgccttgtgcatcttccgcttactgtactgtcgctgttccgtgtgtgtatatacaaagtggagatggtattaataggatagtggagttcaaatcgcgctctgtgtttgcatcctctgttttgtacatacatgcgggatcttccaccaagttttgttgccataaaaaaaaaaaaaaaa

SEQ ID NO: 4346 - protein, 205 aa, Triticum aestivum
  misc_feature: PFam Name: zf-C3HC4; PFam Description: Zinc finger, C3HC4
  misc_feature: PFam Name: Peptidase_S8; PFam Description: Subtilase family
  misc_feature: GI Number: 34907826; NR Description: P0485B12.26 [Oryza sativa (japonica cultivar-group)] >gi|19571069|dbj|BAB86495.1|
  misc_feature: GI Number: 6630539; NR Description: putative RING zinc finger protein [Arabidopsis thaliana] >gi|28466857|gb|AAO44037.1| At3g10910 [Arabidopsis thaliana] >gi|15228395|ref|NP_187702.1| zinc finger (C3HC4-type RING finger) family protein [Arabidopsis
  misc_feature: GI Number: 50911567; NR Description: putative ring finger protein [Oryza sativa (japonica cultivar-group)] >gi|41052716|dbj|BAD07573.1| putative ring finger protein [Oryza
  misc_feature: GI Number: 50252215; NR Description: putative RING-H2 zinc finger protein [Oryza sativa (japonica cultivar-group)] >gi|50251291|dbj|BAD28071.1| putative RING-H2 zinc finger protein
  misc_feature: GI Number: 10176740; NR Description: RING zinc finger protein-like [Arabidopsis thaliana] >gi|15239062|ref|NP_196147.1| zinc finger (C3HC4-type RING finger) family protein [Arabidopsis
MGAHTRSMSWYMGQTGSQAPSSAENGAQRALSSGGGGDASFDTNMVIILAALLFALLFALGLNSLARYVIRWARRASLEASGGGELDGAASAASAGGRGGLKKRTLRSLPIEVYGACAAAGGGGAAPADDVCAICLGEFEDGEKVRVLPRCGHEFHVRCVDTWLVSHDSCPTCRDSVLSGAAAAGRSGGRPGSADAAAVEVVIAA

SEQ ID NO: 4347 - DNA, 1217 bp, Triticum aestivum
  misc_feature (1)..(1217): Ceres cDNA ID no. 21705276
  misc_feature (1)..(1217): Ceres CLONE  ID no. 887723
  misc_feature (1)..(1217): Also known as  Ceres CDNA ID no. 24369410
atcctactcctcccccacttttgacccagctccagagttccccacgaagcgagcgtgcgcgacctgaccgaattccccccaccccaaaccctagcccgcccgcccgccgggcccccggcgccgatgccgaggcggctcctggagggcgccatggcgctggcggtgacgccggacgccgccaactcgtcgggctccggcgccgcccccgggtcgggccccctgtggtgggtgtccggctgccacggggcctggtacagcctgtcggtgatgctgccgtcgctggccttcgtcgggttcctggcgtggcaggcccgccgcagcttccgccgcctcagctacggccgctcccacgtcgtcgtcgtcgcctactacgcgctcctctgggccgtcgccctcctcaacctcctctggtgcttcctgcaggcatggcagtgtatgcctgaaagggccttctcatggaatgtgctttcattgtttaccaaatctggaatgttattcttggaagttagtcttatagcatttctacttcaaggaaatgaagccagtggttatgagtctttgggacgtacctttgttatctctggtgctgtagttagtgctgatgtattgctcaagaccatatatgtattcggatttggtgttcctttgtttatcgatgctgaccaaggaactggtgggaaatggggcctatggattctccacaaattggtgcttacaggagtctatggcttgattattttcatgcatcactcaaggtggaaagacaggctacctgcaaaaccagcatattaccagtatgtgtgcgcaatgctggcacttaacggcctgtcgctgtttggctgtttccttgttgcatgtggagctggatttggtttatggctgtacaacctcactgctgtctgttaccatgctctttaccttccacttctgtatgtgactttcatggcagacttcttccaggaggaagatatgcttctagagaacgtatactactccgagatgaaagacgccgggttctttgatgctgactgggattaaacctgcctgcagatcccgttccacgctgtatgacttatttgtatgtgaatttgcacggagtagcttcatcctggagattgaatgaatcttagaacagagattgtaccctaacaagcaacaaccattataatcaatggaaatgtgtaaatttatcgatacactcaaaaaaaaaaaaaaaa

SEQ ID NO: 4348 - protein, 304 aa, Triticum aestivum
  misc_feature: PFam Name: FH2; PFam Description: Formin Homology 2 Domain
  misc_feature: GI Number: 21618098; NR Description: unknown [Arabidopsis thaliana]
  misc_feature: GI Number: 14532472; NR Description: AT5g27210/T21B4_120
  misc_feature: GI Number: 66911034; NR Description: Unknown (protein for
  misc_feature: GI Number: 6755859; NR Description: transmembrane domain protein regulated in adipocytes; transmembrane domain protein regulated in adipocytes 40 kDa [Mus musculus] >gi|4321619|gb|AAD15788.1| seven transmembrane domain orphan
  misc_feature: GI Number: 62647620; NR Description: PREDICTED: transmembrane
MPRRLLEGAMALAVTPDAANSSGSGAAPGSGPLWWVSGCHGAWYSLSVMLPSLAFVGFLAWQARRSFRRLSYGRSHVVVVAYYALLWAVALLNLLWCFLQAWQCMPERAFSWNVLSLFTKSGMLFLEVSLIAFLLQGNEASGYESLGRTFVISGAVVSADVLLKTIYVFGFGVPLFIDADQGTGGKWGLWILHKLVLTGVYGLIIFMHHSRWKDRLPAKPAYYQYVCAMLALNGLSLFGCFLVACGAGFGLWLYNLTAVCYHALYLPLLYVTFMADFFQEEDMLLENVYYSEMKDAGFFDADWD

SEQ ID NO: 4349 - DNA, 1812 bp, Triticum aestivum
  misc_feature (1)..(1812): Ceres cDNA ID no. 21705279
  misc_feature (1)..(1812): Ceres CLONE  ID no. 894457
  misc_feature (1)..(1812): Also known as  Ceres CDNA ID no. 24369221
actcccctcctccgcctccccgccagtctcgacagtcaccgccggccgcctcgctctcagctactcgccgccgccgcccccccaccccccacccccgcgtcctcctgttgtctgcttatcaattgaatttcggaccccatttcggattgggaagccgagcgcccccagggccccaaccctaggcaaggtaacccgccgccctctcgccggccgcgacgatgccgagcttccctccgccgggcggcgtcaccgtctgcgagatcaaccgcgacctcgttgtggcggactccctgtcggaggatcgcgccaaggaggcctacggggatgtcctcgggatggtgttcagcccaattcctttccagccggatgatctcctagccaagcacgaggctcctgctccagacgaagctgagctccctgagagtgtccccagaacaagtttggtgtccaccatagccgagtccttcaagcaaatgcttttcccttcttgcaatccaaaactgctagaagaatttgatacccagaaagtaagctggaatccacacaaacactgtttagcatttgtatctgggaaggaccaggttacggtccatgactttgaggattcagatggtaaagaatcgtgcattctaacaagtgaacatcaaaaggaagttaaagctattgaatggaggccaaatagcgggaagatgattgcagttggctgcaacggaggtatatgcctctggtcagcatcatatcctggcaatgttgcatccatgaaatctggtgtcacctcttcttcctttggtgccttccctagaggttctagtggtcagtggattctggtggatgttcttcgtggttcttctcctgagctagtcagtgcactttgctggaaacctgatggaagatacttggcctcggcctcttgtaatggccagtcattcacaatttgggatgtttctcaaggattgggaactcctatacgacgcggattgagtagcatatcattggtgcggtggtcacctagtggagattactttttgactgctaaattcgatggaacttttcacttatgggaaaccaacacatggacgtcagaaccctggtcttcatccaatggatatgtaactggagcaaactgggacccagaaggtcgtgttgcattgttatccttttctaactcaaccacactaggttcagttcacttctcatcaaagccaccatctttagatgctcatctcctaccagtggagcttccagaaatttcctctctgattgttagtcgaggcatagagaaattagcatgggatgctgcaggagagcgtctggcagtgtcattcaaagatggtaatgaaacatatcagggacttgttgctgtctatgatgtgagaagatctccacttgtttcagtttctctggttggattcatcagaggacctggagagggcgtgaaggcgctcgcgttcgccttccacaacaaattcaagcaaggaccgctgctttctgtgtgctggagcagcggctggtgttgcacatacccactgatactccgctcccattaactatctgctggacactcgtggcgttttgctccccgagacctatttctgatttcggcaatatatgtgtactctttagagatgacgggcttctgatacctccctactacatagcactttcttggtttgtttgtgctcctttttctttttgcattgggagtgtcttgtatatcggctgtctttattactagtattggtagtgacggtggcggtgcttagagcatctacaaccgaatcccttaaaccctctccaaaaaaaaaaaaaaaa

SEQ ID NO: 4350 - protein, 442 aa, Triticum aestivum
  misc_feature: PFam Name: WD40; PFam Description: WD domain, G-beta repeat
  misc_feature: GI Number: 23510311; NR Description: achalasia, adrenocortical insufficiency, alacrimia; aladin; adracalin [Mus musculus] >gi|19343738|gb|AAH25501.1| Achalasia, adrenocortical
  misc_feature: GI Number: 34868591; NR Description: similar to RIKEN cDNA
  misc_feature: GI Number: 62653125; NR Description: PREDICTED: similar to Achalasia, adrenocortical insufficiency, alacrimia [Rattus
  misc_feature: GI Number: 61872412; NR Description: PREDICTED: similar to achalasia, adrenocortical insufficiency, alacrimia (Allgrove, triple-A), partial [Bos taurus] gi|61830296|ref|XP_583023.1| PREDICTED: similar to achalasia, adrenocortical insufficiency,
  misc_feature: GI Number: 47086031; NR Description: achalasia, adrenocortical insufficiency, alacrimia [Danio rerio]
MPSFPPPGGVTVCEINRDLVVADSLSEDRAKEAYGDVLGMVFSPIPFQPDDLLAKHEAPAPDEAELPESVPRTSLVSTIAESFKQMLFPSCNPKLLEEFDTQKVSWNPHKHCLAFVSGKDQVTVHDFEDSDGKESCILTSEHQKEVKAIEWRPNSGKMIAVGCNGGICLWSASYPGNVASMKSGVTSSSFGAFPRGSSGQWILVDVLRGSSPELVSALCWKPDGRYLASASCNGQSFTIWDVSQGLGTPIRRGLSSISLVRWSPSGDYFLTAKFDGTFHLWETNTWTSEPWSSSNGYVTGANWDPEGRVALLSFSNSTTLGSVHFSSKPPSLDAHLLPVELPEISSLIVSRGIEKLAWDAAGERLAVSFKDGNETYQGLVAVYDVRRSPLVSVSLVGFIRGPGEGVKALAFAFHNKFKQGPLLSVCWSSGWCCTYPLILRSH

SEQ ID NO: 4351 - DNA, 1448 bp, Triticum aestivum
  misc_feature (1)..(1448): Ceres cDNA ID no. 21705280
  misc_feature (1)..(1448): Ceres CLONE  ID no. 906348
  misc_feature (1)..(1448): Also known as  Ceres CDNA ID no. 25088388
atatacacgatcttggacatcagaggtttactgaaaatgaaatccatacaggctcaggccctataagatcaatgaataagttatgattttgggtcaggaaagagaaaatcttgggttcaacagccaaggagtatatccacaacctccaagcacaccatatattgcagcaaaagaggatgtcactgtgattttcagaaggagaggaggagatgatttagttcaaagtcattctgagtgggcaagaactgttaactcagcgcctgatgttatacatatgacccttttccctctaacgactctgttggaagcagccatccctggaaaagaccatctcatccgggcgatcaacctttatctagaatataaacctccaattgaggagctgcgttacttcctagagttccagcttcccagagtttgggcaccaattcgtgatgagcaccctctccatcaaaggaaagagcctgtgtgcccatccttgcagttcagcttgatggggaaaaagctgtacatcagccaagaacaggtgtcagtgggtcgcaagccaataactggcctaaggttatgcttggaaggtgctaagcaggacaggctatgcatccaactgcagcatctagcatctcttccaaagatcctcaagccttactgggatgcacacatcacgattggtgcagcgaaatggcaggggccggaggagcaggacagccgctggttcgagcctgtgaagtggaatagcttctcccacgtcagcacagctccagttgagcaccacgaggtgctcatcggggatgcctccggcgtgtacattgtcactggggcacagctcggggtgtgggactttggtttgaagaacgtcctgtacatgaagcttctctactcgagggtccccggttgcaccacccggagatcgctgtgggatcacagccctgccgccgccagcagccatccaacagttggtccttctaacatcatgtatctggacccggggggttctggcgtaggctcgagcgatgcagggaagttcgtgaagatcgtggacaggtcggagctgtgcaaaggccctgacgacatgccggggcactggctggtgacgggcgggaagcttggtgttgaaaaggggaggattgttctgagagtgaagtattccttgttgaattactgacagcgttatctgtgttgttgaaaacttcggagtgcagcatatggtgttttaagtgcagttgcagttgtgatttccttttctttttttggtagtcaagtgatagattaatctggtgcgtagctgtttgcagccgatcgctgttcctatggtttttacaagagatttttctccatgcaacggaacaattttggtggagttcttcccggtgtttgtacagggcttcagtcttgtaaaatgcatatttgtcattcaagatcgacactctttcttaaaaaaaaaaaaaaaa

SEQ ID NO: 4352 - protein, 359 aa, Triticum aestivum
  misc_feature: PFam Name: MACPF; PFam Description: MAC/Perforin domain
  misc_feature: GI Number: 34909512; NR Description: P0481E12.26 [Oryza sativa (japonica cultivar-group)] >gi|14209545|dbj|BAB56041.1|
  misc_feature: GI Number: 8778214; NR Description: F10B6.18 [Arabidopsis thaliana] >gi|25333973|pir||H86281 protein F10B6.18 [imported] -
  misc_feature: GI Number: 15809820; NR Description: At1g29690/F15D2_24
  misc_feature: GI Number: 34905760; NR Description: P0401G10.6 [Oryza sativa (japonica cultivar-group)] >gi|20146216|dbj|BAB88998.1| P0401G10.6
MILGQERENLGFNSQGVYPQPPSTPYIAAKEDVTVIFRRRGGDDLVQSHSEWARTVNSAPDVIHMTLFPLTTLLEAAIPGKDHLIRAINLYLEYKPPIEELRYFLEFQLPRVWAPIRDEHPLHQRKEPVCPSLQFSLMGKKLYISQEQVSVGRKPITGLRLCLEGAKQDRLCIQLQHLASLPKILKPYWDAHITIGAAKWQGPEEQDSRWFEPVKWNSFSHVSTAPVEHHEVLIGDASGVYIVTGAQLGVWDFGLKNVLYMKLLYSRVPGCTTRRSLWDHSPAAASSHPTVGPSNIMYLDPGGSGVGSSDAGKFVKIVDRSELCKGPDDMPGHWLVTGGKLGVEKGRIVLRVKYSLLNY

SEQ ID NO: 4353 - DNA, 1143 bp, Triticum aestivum
  misc_feature (1)..(1143): Ceres cDNA ID no. 21705281
  misc_feature (1)..(1143): Ceres CLONE  ID no. 906632
  misc_feature (1)..(1143): Also known as  Ceres CDNA ID no. 24369698
ccacttagaccgcctccgcccacgcatcatcgacggtgaagcgtaggtagcgagcgcctccacagatcgggatcaggcggcgatcgacttctccggcgatgtcaagcaggcgatcccccgcccggccgtcgctttcggcggcgtcggcagcgctggcgatcacggcggtgcacaaggtcgcccagggtccccggtgcagggctttccagcagcagggacagctcctggccgctgcgcgcggcgccgacgggggcaatgccaagttcgcgtggtacggcgcgccgtcggcggacgtggccgcggcggtggagcacgggttcgggaggaccaacagccgggtcctcggccatcgcgcgcacggcgacagcgtccacctctcgccgcctcagtctccttacgccagcgcaatgctagcaaatgcagatgagaacggcgaggcgcacatcgtgctgtgccgtgttctgatgggccggccagaggccatcccagccgggtcctcccagctccaccccagcagtgacgattacgacagcgccgtcgacaacatgcagaatccccagtggtacgttgtttggagcaaggatatgaacacgaggatcctcccagagtacgtcgtcagcttcaagtgccccagcctccatcagatgcaaggatcatcgggagcgacctccgccctaaagaagccttcgccggtggctcgtgacatgtttccgacgcttctagcagagatccagcggttcgtgccatcctccaagctggagacattgcaggggacctacaatcgcttcaagaaagggcagatgaagaaggatcagttcatccggttcttgcgcgccttcatcggcgacagggtgttgacagcagttgccaagaaactccgaggatactgatggacagtgcaagggtgttcttctgctagttctgttgtcgtcaaagtggtgtgctggtggtgaggtggtagctcattcggctgactccatagaaccggaagggtgtgcgtgtcgggtatcaaccagatagttcttcatttcttatgtcgccgtagtttagccgagaatcgttgttgatctcaagaacatagaggggttacgggcaatcttccattaaccaacacaaagttagatttcaaaaaaaaaaaaaaaa

SEQ ID NO: 4354 - protein, 263 aa, Triticum aestivum
  misc_feature: PFam Name: PARP; PFam Description: Poly(ADP-ribose)
  misc_feature: GI Number: 8778582; NR Description: F28C11.18 [Arabidopsis
  misc_feature: GI Number: 21592445; NR Description: unknown [Arabidopsis thaliana]
  misc_feature: GI Number: 11044957; NR Description: ceo protein [Arabidopsis
  misc_feature: GI Number: 46397597; NR Description: radical-induced cell death 1-1 [Arabidopsis thaliana] >gi|19715643|gb|AAL91641.1| At1g32230/F3C3_1 [Arabidopsis thaliana] >gi|18398335|ref|NP_564391.1| WWE domain-containing protein / ceo
  misc_feature: GI Number: 50920187; NR Description: putative CEO protein [Oryza sativa (japonica cultivar-group)] >gi|29126336|gb|AAO66528.1| putative CEO protein [Oryza sativa
MSSRRSPARPSLSAASAALAITAVHKVAQGPRCRAFQQQGQLLAAARGADGGNAKFAWYGAPSADVAAAVEHGFGRTNSRVLGHRAHGDSVHLSPPQSPYASAMLANADENGEAHIVLCRVLMGRPEAIPAGSSQLHPSSDDYDSAVDNMQNPQWYVVWSKDMNTRILPEYVVSFKCPSLHQMQGSSGATSALKKPSPVARDMFPTLLAEIQRFVPSSKLETLQGTYNRFKKGQMKKDQFIRFLRAFIGDRVLTAVAKKLRGY

SEQ ID NO: 4355 - DNA, 1401 bp, Triticum aestivum
  misc_feature (1)..(1401): Ceres cDNA ID no. 21705284
  misc_feature (1)..(1401): Ceres CLONE  ID no. 909659
  misc_feature (1)..(1401): Also known as  Ceres CDNA ID no. 23466014
accgaatcattcccctcacccccacaccggccgcctctcctccacttgcccagaaccctaacccccatggatccccagaaaaacgcattctctagatttgccacacccgccagcaacatttgacgcgacggaattgccggacgggacgacggcgcctccagaggaactgcacatcacagcaagcaaagagcaatggcgtcaaccaccgaatcggcatgcacaactcagacggtgcaaggcacacatcggttccagatatgtcagttcagttatgggaatgttggtgatgaggattacatccgctccggcaccttcagggtggggggattcgactgggttattgtatactgcccggacgctgatggcgatgatggggtggaatacatatcagtttatctggagttgatgagcaagtatgcggaggcgttggcgttcgtagacctgagactgatcaaccaagtcactggagatgcgtgtacaatatatgcagagaacagggtgccgaatcagttcaagtctaccagcttcgaagaggcttcctgggggcgtgaaaaatttatcagtaaacgtgctttgaaagattcagggtatatccgagataaccgccttgttattgagtgtgtcgttactgtggtacacgaactaagggtgtctgaaaacaaagcatcctgcgaaattgaagtccctcccccaaatgcattagagcattttggcaagatgctgaaggataagtccagagcagatgtgaccttcaaagttggaggagaaatgtttcctgcccacagggcagtgctctctgccaggtcgccagttttcaaagcgcagctaagtgaacccatgaaggagaacaagatgcggcacataaccgttgatcgcatggaaccggtggttttcgaggctctgctccatttcgtttacactgattccttgcctacaatggatgatcttgacagatctgaaagaaatgccgtggtccagcatctatttgcagcagcggagcaatatggtctagagaggttgaagcttatgtgtgaacgcatcttgtgcctgaaccttgatgttgataatgtggctgttgtactgcgtctagttgatcgatacgactgccagaagctcaaagaagcctgtgtcgactttttggttccttcagagagaatcgatgctgttgtggcaagccgagaatacgagtcaataaagttggtttctccctctccattagccgatttgtgggagaagaatactcgtccccccaaacgttccttttagaacatgtgtaagcttggaggagaagcaagttcagtcagcagatgtgttatgagtacttctgtcaacaaaaccacttgtattggtgatcgtaattccaccagtagagtattatgcttaccaaaaaaaaaaaaaaaa

SEQ ID NO: 4356 - protein, 357 aa, Triticum aestivum
  misc_feature: PFam Name: BTB; PFam Description: BTB/POZ domain
  misc_feature: PFam Name: MATH; PFam Description: MATH domain
  misc_feature: GI Number: 50940775; NR Description: putative spop [Oryza sativa (japonica cultivar-group)] >gi|29467516|dbj|BAC66705.1|
  misc_feature: GI Number: 50942543; NR Description: putative speckle-type POZ protein [Oryza sativa (japonica cultivar-group)] >gi|38175683|dbj|BAD01392.1| putative speckle-type POZ protein [Oryza sativa (japonica cultivar-group)]
  misc_feature: GI Number: 50940787; NR Description: putative spop [Oryza sativa (japonica cultivar-group)] >gi|29467523|dbj|BAC66712.1|
  misc_feature: GI Number: 50942517; NR Description: putative speckle-type POZ protein [Oryza sativa (japonica cultivar-group)] >gi|38636861|dbj|BAD03127.1| putative speckle-type POZ protein
  misc_feature: GI Number: 50942509; NR Description: zinc finger POZ domain protein-like [Oryza sativa (japonica cultivar-group)] >gi|38636858|dbj|BAD03124.1| zinc finger POZ domain protein-like [Oryza sativa (japonica cultivar-group)] [Oryza sativa (japonica
MASTTESACTTQTVQGTHRFQICQFSYGNVGDEDYIRSGTFRVGGFDWVIVYCPDADGDDGVEYISVYLELMSKYAEALAFVDLRLINQVTGDACTIYAENRVPNQFKSTSFEEASWGREKFISKRALKDSGYIRDNRLVIECVVTVVHELRVSENKASCEIEVPPPNALEHFGKMLKDKSRADVTFKVGGEMFPAHRAVLSARSPVFKAQLSEPMKENKMRHITVDRMEPVVFEALLHFVYTDSLPTMDDLDRSERNAVVQHLFAAAEQYGLERLKLMCERILCLNLDVDNVAVVLRLVDRYDCQKLKEACVDFLVPSERIDAVVASREYESIKLVSPSPLADLWEKNTRPPKRSF

SEQ ID NO: 4357 - DNA, 1216 bp, Triticum aestivum
  misc_feature (1)..(1216): Ceres cDNA ID no. 21705285
  misc_feature (1)..(1216): Ceres CLONE  ID no. 911645
  misc_feature (1)..(1216): Also known as  Ceres CDNA ID no. 23466244
gccgtagagagttctgctagatttgcggctgctcgagccaggaaagcccaagaacaacgcacacggagatgagcttagcgcttctagggggctactcctccgccgaggacgacgactccgccgccggcgccggcgccgagctgagcgactccggcgactcatcagccgaagaggccggatctgacggagacgagaagtccgctccatcgaagccggctgcgaagccccgcccccgcgtaaaccctagccccggagatggggactcctcgctgccctcggcgctagatgtcttcgccgagatctccgggcccccggctttcctcaaccgcagggtggcccagcccgaggaggtcggggaggcgctcggcgtgctcgatcaccgctccgactccaagaggagaaagccgccacctcccggtgcggttgtggcggcgaaaccacagatggttgccatccgtgaacgagttagcagtgacgtgaagaatggtgccaatcctccagttgctgttgtgtcggcgaaaccacagttggttgctggtcatgaacgagttaccagtgacacgaagaatggtgccaatcctccaggttcagttgaaggaaagagaaaaataggggctgcaaatcctggtccagaagatgctgccgagcttctaagaatgtgcctccagtgtggtataccaaagacctattcacacgcgcaaggaatggtatgccctgtttgcaacgacagaccggtgcaggcaaaagagccggagaagaagaagggttctgctgtcaaagacaaggagaaagtgaagaggatgagagggcagtcgtcacatgcatcttggaagagtgaaactgagatggctctgcggcaacaattcgactgacgggtgtcaccgggagtgctggtgcactcagtctgtacactaggtagaatcgaatctctttgcttgttccattgcgtcgcgtggcttccagattgccatcgttttgtttcttgtatttgcagctctctgacatgcacggattaagtttcgcaagctgtatacgttaaaatgttttccagcccagccatgtttcgagtaagttactcagggcccctttgcttcagggacattttcctgtgcccatcagtaactggatgacctatgagattcccatgagatttttgcgtatcatagaagaatccctgaatactgaactggttgtgcttccaaaaaaaaaaaaaaaa

SEQ ID NO: 4358 - protein, 267 aa, Triticum aestivum
MSLALLGGYSSAEDDDSAAGAGAELSDSGDSSAEEAGSDGDEKSAPSKPAAKPRPRVNPSPGDGDSSLPSALDVFAEISGPPAFLNRRVAQPEEVGEALGVLDHRSDSKRRKPPPPGAVVAAKPQMVAIRERVSSDVKNGANPPVAVVSAKPQLVAGHERVTSDTKNGANPPGSVEGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 4359 - DNA, 1290 bp, Triticum aestivum
  misc_feature (1)..(1290): Ceres cDNA ID no. 21705287
  misc_feature (1)..(1290): Ceres CLONE  ID no. 912180
  misc_feature (1)..(1290): Also known as  Ceres CDNA ID no. 24369270
gactaggacagtcatctatacacggacagtagctactgctataacactagcatcaacgagggtgaggagacaagcgagtcgagaatggcttacctccagcaagcgccggcatggttcctctggctggcctccctcggcgcgctatacgtctcggcattcttgccccgcctcctcgtctacctcacgcactgcctgcgccggcccgaggacctccgcctgcgctacggcacgtgggccgtcgtcaccggcccgacgtctggcatcggccggtccgtcgccctggagctcgcacgccggggcctcaaccttgttctggttgacctcgacgccgccaatctccacgaagtctccggcacgatcatgtctcgccacgccgtgcagaccatggccgtggtattcgacctctcgctcgtctccactcctaaaggtgacgaggcgttgcggcggctccgggatgccgtgaagaagctggacgtggggattctggtgaacaacgccgggatagcgaagccgggtgcggtgttcctgcatgaggccgacgtggaggcgtgggtgaggatgattcgcgtgaacctgtgggcggtgacggaggtgaccgccgcggtgctgcccgggatgctgcggcggggcaggggcgccatcgtcaacatgggatcggcgtcgtccgagggcatcaactccttccccctccacaccatgtattccgccaccaaaaggtacgtcgctcagttctccaggagcctttacgttgagtacaaaagcaaggggatagatgtccaatgccaggcgccgttcttcgtgtcgactacgatggcttccggcttcgccgcggcctggcggtcgtcggcgttggtgcccacagccgacacgtacgcgcgcgcggctgtgggctggatcggcaagggcggcccgctctgcgtgcccaacctcaggcaccggctcctggggtggtatttggccgccgtgccaggcggcgtgcaagactggttctgcctgcgcgagaacctgcggcacagaaagatgctccggagcgcgagatcgccgagggcgtcagcgtgcaggccgcatggacatgggataccatccattgagtaggcgctctgcattgtttcgaaactctctggattgtaatgcatgccagttattctatcggaaaaatatgagtatcagacatcacgaatctgtttcttactacatatgttaccctagatttcgttattaaagaagtacgtcccactttcccagctcagttgccaaacctcatttgctgcatgaaaaaaaaaaaaaaaa

SEQ ID NO: 4360 - protein, 336 aa, Triticum aestivum
  misc_feature: PFam Name: adh_short; PFam Description: short chain dehydrogenase
  misc_feature: GI Number: 53792518; NR Description: putative b-keto acyl
  misc_feature: GI Number: 53792512; NR Description: putative b-keto acyl
  misc_feature: GI Number: 53792509; NR Description: putative b-keto acyl
  misc_feature: GI Number: 53792508; NR Description: putative b-keto acyl
  misc_feature: GI Number: 53792520; NR Description: putative b-keto acyl
MAYLQQAPAWFLWLASLGALYVSAFLPRLLVYLTHCLRRPEDLRLRYGTWAVVTGPTSGIGRSVALELARRGLNLVLVDLDAANLHEVSGTIMSRHAVQTMAVVFDLSLVSTPKGDEALRRLRDAVKKLDVGILVNNAGIAKPGAVFLHEADVEAWVRMIRVNLWAVTEVTAAVLPGMLRRGRGAIVNMGSASSEGINSFPLHTMYSATKRYVAQFSRSLYVEYKSKGIDVQCQAPFFVSTTMASGFAAAWRSSALVPTADTYARAAVGWIGKGGPLCVPNLRHRLLGWYLAAVPGGVQDWFCLRENLRHRKMLRSARSPRASACRPHGHGIPSIE

SEQ ID NO: 4361 - DNA, 1941 bp, Triticum aestivum
  misc_feature (1)..(1941): Ceres cDNA ID no. 21705288
  misc_feature (1)..(1941): Ceres CLONE  ID no. 912565
  misc_feature (1)..(1941): Also known as  Ceres CDNA ID no. 25088339
ttttataatgtccagtttttgtaaaaaaacaaagatttaaatttttatccatttcttgtgttgtctctttgtataaactgcaagatatgacatgtaccaaacatgtaaaattggaagaattataattggctatattgaacaagtttcattcgaggcaaggctgcctgtcatttacaatttaatagcatcagcattgcttggatagatgtccgcaaactgtgtagtccatttcgtgttgggcatataaccaactgcttagtagaagccttttgttgctactgccgatgtcttccttacttcttatctttcttgtattgtcaatttcaggccgtggtcgttgttatggggttttacctgttttaagtgctatagttcctgtactgaaggttactgataagggaaccggggttgaatgtgatatttcagtcgaaaacaaagatggcatgtcaagatcgatgatatttaaacttgtttcttcaattgatgaaagatttcagatactttgttatctgataaagttctgggctaagacacatgatgttaattgtcccaaagatcgaacgatgagctcgatggcaattatctccttagttgctttccatttacagacccggcatcctccaatattacctgcattttccggcttactgaaagatggtgcagactttgcaagtgtccagagaaacgttgtgctattcaagggatttgggagcactaataaagaatccgttgctgaactttttgtatcactaatgagtaaactactagcagtaaaggatttatgggagcaagggctttgtgccagcaattttgatggattctggatctcaaagacctggaacagaggaattggtaacttgagtgtggaagacttcttggaccgatctcagaattttgccagatcagtagggaaggtggagatgcagaacatctgtgaatgcctaaaggatactgtttccaaattgactgatttctttaggggtaaaattgatgcaccgacactgaagatcctcatttttggggcgttaaatcaggatgtgccagtcagtcaccccagtccaaaacatgttaagagcaagaggaagagggagttgcgacatgaccctgcaaacagtgagaagcagcaaaagaaagtgaagcacgctgcacaacgcggccgcgctgctaacaggattgattctattttaccaactcccactgtatttatgcctcatgtgcatcaagtaggttctacccaaccatttaatcagattgtgcatccatctcagcttccgattcctcagctttcctacgggttgccacaagcacactttcatccaggtcctcatatgataggacaacctcatggtagtttcatctactcgacggatcctgggattcaactgcagcagcaagcccggcatatgtttgttcctttgccagtccaccagccagcgattaataggtcgtttcacccccatggtttcaacggggcacatgaggtcctgtatgatgacaatagctggttaccttacggaatcaatccgaattacaggagggtatgacaggtgcagcagcttgaagggggcggtgtagccagctaattggtggggaattgtggtgttgatgtgttgtagaatgaaatgtgcattagcattcatgtaacaagttgttgttttgtccaaattgacggcgaaagggaaaccgaaagcttttctatgttggtctgcggtgagcagattgtaagtttattctagccttggtaattgctcagcttgaaatatttttggttaggagcctgggtgaagatttgagatggccaggtagatagcactgcagcaaagggcaaactagagtagctgctgctaactgtttgcccatgtctgttttgtaatgaatgagtgagcctatcagttcgtatgaagcaactgttgtaatgcagctgcaaaaaaaaaaaaaaaa

SEQ ID NO: 4362 - protein, 419 aa, Triticum aestivum
  misc_feature: GI Number: 53850481; NR Description: At2g39740 [Arabidopsis
  misc_feature: GI Number: 50904869; NR Description: putative caffeine-induced death protein 1 [Oryza sativa (japonica cultivar-group)] >gi|41052754|dbj|BAD07610.1| putative caffeine-induced death protein 1 [Oryza sativa (japonica
  misc_feature: GI Number: 34908258; NR Description: P0446B05.18 [Oryza sativa (japonica cultivar-group)] >gi|20160623|dbj|BAB89569.1|
  misc_feature: GI Number: 34876220; NR Description: similar to RIKEN cDNA
  misc_feature: GI Number: 55234202; NR Description: ENSANGP00000012042
MSSLLLIFLVLSISGRGRCYGVLPVLSAIVPVLKVTDKGTGVECDISVENKDGMSRSMIFKLVSSIDERFQILCYLIKFWAKTHDVNCPKDRTMSSMAIISLVAFHLQTRHPPILPAFSGLLKDGADFASVQRNVVLFKGFGSTNKESVAELFVSLMSKLLAVKDLWEQGLCASNFDGFWISKTWNRGIGNLSVEDFLDRSQNFARSVGKVEMQNICECLKDTVSKLTDFFRGKIDAPTLKILIFGALNQDVPVSHPSPKHVKSKRKRELRHDPANSEKQQKKVKHAAQRGRAANRIDSILPTPTVFMPHVHQVGSTQPFNQIVHPSQLPIPQLSYGLPQAHFHPGPHMIGQPHGSFIYSTDPGIQLQQQARHMFVPLPVHQPAINRSFHPHGFNGAHEVLYDDNSWLPYGINPNYRRV

SEQ ID NO: 4363 - DNA, 1260 bp, Triticum aestivum
  misc_feature (1)..(1260): Ceres cDNA ID no. 21705289
  misc_feature (1)..(1260): Ceres CLONE  ID no. 913522
  misc_feature (1)..(1260): Also known as  Ceres CDNA ID no. 24369173
acgttgcgctcgcagctaggtagctactctactagctagtctgaaaaatctgatccatccagaagatggggctgctgtccgacaccccggtgcaccacgccgtgccggacgagtacgtcctgccgccggagaagcgccccgaaaccgacgagttcgtggatcccaccgtaaccctgcctgtcatcgacctcgccgccggccgcggccgccacctcgtcgtcaacgagatcatcaaggccggcaaagagttcggcttcttccaggttgtgaaccatggcgtgcgcgacgaggtggtcggggcgttccggtccgcggcggcggagttcttcgcgatgccggcggaggagaagctcccctactactccgatgacctcaccaaaccgttccgcgtggacactagcaccacctacgtcctcgaccgtagcagcggcggtcggtactggcgcgactacctccagctgcagtgcttccccgttgacaggtactcgcaggactggccggccgagccagccgccttcgtgccaagcctggccgcgtacgccaaagcagtgcagacgctggccgcaacgttgctcgggctcatcgccgaggggctcgggctggaggagagcttcttccgcggcgagctcaccggcggcggcacgctgatgaacgtgaactggtacccgccgtgcccggacccgagcctgacgctgggcctgctgccgcactgcgaccgaccactcctgaccgtgctgtcgcagggcgacgtcagcggcctccaggccaagcacaagggccggtggatcgccgtgcagcccgtcccaaacactttcgtcatcaacttcggccacctgatggagattgtgaccaacgggttccttcagagcgtagagcaccgggcagtgaccaactccagtgcggcgaggttgtcggtggtgaccatcatgttgccgaacatggactgccgcatcgagcccgcgccagcgctggtgaccgagggggagcaggccaagttcaggccgttcctcttccgagagttcaacgaggcgtacgccgccgctgcagccaaccgggaggacgtgctccagcgctttaggatccaccctgctggtacaatggagtgaccgcatacttgctttggttccggccattaacggctccaataaacttttcttaatttattatttttagtttggaggtgtgttataagttgtttctcttcccttcaaccttttgtttttgcatcgtaatcccactgtttcaaaaaaaaaaaaaaaa

SEQ ID NO: 4364 - protein, 346 aa, Triticum aestivum
  misc_feature: PFam Name: 2OG-FeII_Oxy; PFam Description: 2OG-Fe(II)
  misc_feature: GI Number: 50934433; NR Description: putative iron deficiency protein Ids3 [Oryza sativa (japonica cultivar-group)] >gi|50509732|dbj|BAD31784.1| putative iron deficiency protein Ids3
  misc_feature: GI Number: 9711238; NR Description: IDS3 [Hordeum vulgare
  misc_feature: GI Number: 7433181; NR Description: iron deficiency protein Ids3 - barley >gi|520582|dbj|BAA07042.1| Ids3 [Hordeum vulgare
  misc_feature: GI Number: 4514655; NR Description: IDS3 [Hordeum vulgare
  misc_feature: GI Number: 1076723; NR Description: dioxygenase, iron defiency-specific (clone 2) - barley >gi|285634|dbj|BAA03647.1|
MGLLSDTPVHHAVPDEYVLPPEKRPETDEFVDPTVTLPVIDLAAGRGRHLVVNEIIKAGKEFGFFQVVNHGVRDEVVGAFRSAAAEFFAMPAEEKLPYYSDDLTKPFRVDTSTTYVLDRSSGGRYWRDYLQLQCFPVDRYSQDWPAEPAAFVPSLAAYAKAVQTLAATLLGLIAEGLGLEESFFRGELTGGGTLMNVNWYPPCPDPSLTLGLLPHCDRPLLTVLSQGDVSGLQAKHKGRWIAVQPVPNTFVINFGHLMEIVTNGFLQSVEHRAVTNSSAARLSVVTIMLPNMDCRIEPAPALVTEGEQAKFRPFLFREFNEAYAAAAANREDVLQRFRIHPAGTME

SEQ ID NO: 4365 - DNA, 1592 bp, Triticum aestivum
  misc_feature (1)..(1592): Ceres cDNA ID no. 21705291
  misc_feature (1)..(1592): Ceres CLONE  ID no. 915185
  misc_feature (1)..(1592): Also known as  Ceres CDNA ID no. 24369558
cccaagaaatctcgatcgcgagtgaggcaatgggcagcatcgagcacatggaagctcccggcactgtcctgaactcctgatcgtatcccggcgcatggtccggccgtcgagccgtggctgcacgccgtcggaggtcatccacttaacgccatgggacctccgcctcctcaccatagaccacatccagaagggcatcctcctgcccaagccccccatcggcggcaagcgcctcgtagacgccctcgcgtcctccttggcgcgcgccctggaccggtactgccacgttgcaggccggctcgccgtcgaggagctcggcgacgggacggtcaccgtcgctctgcgctgcaccggggaaggcgccgagctcgtccatgcggcggcgcccggcgtggccgtcgcggacctcgtgggctcggtgcacaccccatcgccggtggtctgggacttgttctcgctgaacggtgtgcttgacgcggacgcggccatcgagtctctccccgtgctgtctgcgcaggtcactgagctcgccgacggcgtcttcgtggccgtgtccatgaaccactccgtcggcgacggcacctccttctgggagttcttcaacgcatggtcggagatccaccgacaccgaggcgacgtcaatggcaacggcctaaacaaggtgaagatggtctcgacgccctcgccggtgctcgcgaggtggttcgtcgagacgagccccgtgccgatccccttgccgttcagcaagctgcagcacgtcctgcggcggttcgagctcccgccggtgcgagaaggcttcttcaccttctcggccgcgagcgtgaagaagctcaaggcgagggcgaacgccgagatgaccggcgtggccacggcgaccatctcgtcgctgcaggccctgctcgcgcacctctggcgggcagtgtgccgggctcggcgcctcgcaccggggcaggagacgttctacgccgtcatcatcgggtgccgggggcgcgtgcgcggcatcccgccgggctacgtgggcaacgccgtggtgcccggcagggcggtgtgcgcggccggcgatgtcctggagaaggggctgggctggacggcttggcagctgaaccgcgccgtggcgtcgttcgacgaggcggcgctgagggggttcctggaacgctgggtccgggagccgacgttctcgttcaccggggacctgtcgtcggcggcggcagggggcgcggggctggagaccgggagctcgccgcggttcgacgtgttcgggaacgacttcgggtggggacggccggtgggcgtgcggagcggcctcggcgacaagacggacgggaaggcgacggtgttcgaggggccggagcggggagggagcatgtcgctggaggtgtgcctggcgccggacgcgctggagaggctggtcgcggaccacgagttcatggacgcggtgacccttcccgcgcgcgtgtgacccttcccgcgggcgtgtgacccttccagctgatgagggattgctcggcttgcggtgtagtgtcgcgtgcgcgtatgcattgccatgtcatcacgtcaaaacatcctttcgtgtcctctgaaaaaaaaaaaaaaaa

SEQ ID NO: 4366 - protein, 453 aa, Triticum aestivum
  misc_feature: PFam Name: Transferase; PFam Description: Transferase family
  misc_feature: GI Number: 50940423; NR Description: putative AER [Oryza sativa (japonica cultivar-group)] >gi|42408346|dbj|BAD09498.1| putative AER [Oryza sativa (japonica cultivar-group)] >gi|42408393|dbj|BAD09544.1| putative AER [Oryza sativa (japonica
  misc_feature: GI Number: 50940441; NR Description: putative AER [Oryza sativa (japonica cultivar-group)] >gi|42408355|dbj|BAD09507.1|
  misc_feature: GI Number: 21636163; NR Description: HCBT-like putative
  misc_feature: GI Number: 50940435; NR Description: putative AER [Oryza sativa (japonica cultivar-group)] >gi|42408352|dbj|BAD09504.1|
  misc_feature: GI Number: 47779044; NR Description: HCBT-like putative PR
MVRPSSRGCTPSEVIHLTPWDLRLLTIDHIQKGILLPKPPIGGKRLVDALASSLARALDRYCHVAGRLAVEELGDGTVTVALRCTGEGAELVHAAAPGVAVADLVGSVHTPSPVVWDLFSLNGVLDADAAIESLPVLSAQVTELADGVFVAVSMNHSVGDGTSFWEFFNAWSEIHRHRGDVNGNGLNKVKMVSTPSPVLARWFVETSPVPIPLPFSKLQHVLRRFELPPVREGFFTFSAASVKKLKARANAEMTGVATATISSLQALLAHLWRAVCRARRLAPGQETFYAVIIGCRGRVRGIPPGYVGNAVVPGRAVCAAGDVLEKGLGWTAWQLNRAVASFDEAALRGFLERWVREPTFSFTGDLSSAAAGGAGLETGSSPRFDVFGNDFGWGRPVGVRSGLGDKTDGKATVFEGPERGGSMSLEVCLAPDALERLVADHEFMDAVTLPARV

SEQ ID NO: 4367 - DNA, 1373 bp, Triticum aestivum
  misc_feature (1)..(1373): Ceres cDNA ID no. 21705292
  misc_feature (1)..(1373): Ceres CLONE  ID no. 915941
  misc_feature (1)..(1373): Also known as  Ceres CDNA ID no. 24369405
accatcgttcttgcccccaagcttcatttttgcgatccacttgctcccagttcccggtgtagtaattctttgcccttgtgagtagtactgctatcaatcaagggtgggaaacagagctgctatttagagaatggagtgcagcggcgacgaggtggtggagctgagctgtgcccgcgccggcggagaccccggggagtacgccgcggtgctgaagaggaagctgcaactgtactgcgccgccgtggccaagaccatggaagctaaacctcaagaatcttctttgaactgcctcaattcacaagcttcggacacttcgccattggtttctcaagcttcttttgattgtgacggtactgttgttcaaggaaagccagctaatagttgtacatcaaaggagcagtcagatgatgacgatggggatctcgaggaaaatacagaccctgccagtgccaagcgcgtgaagaggatgctgtcaaatcgagaatctgccaggaggtcaaggaaaaggaagcaagcccaccaaaatgatatagaatcacaggttacccagttaagagctgagaatgcatctttgctaaagcgcctgactgacatgactcagaaatacaaggaagcttcccttggcaacaggaatcttacagttgatattgagactatgaggagaaaggtgaatatagctgaagaagctgtcaggagagtaactggagcaagcttgatgttctccactacatcaaacaacgtgcccttgtcttcatgtgtatctgttgcagcttctgctgatgctgttcccactgaggaaaacatgagccatttcctccagggtttacttgaagacaatctgatcaaacatgacctctcagaggtagcaacccctttgcccaatggggaagagatgacctcaaggccagcccctttgcaacgcgtcgcgagcctggagaacctgcagaagaggatccatagagattcagtgcacactgaggacacgtcgagtttcccggaccatgaagtccctgccaatggttagtaactggactgtataattctccagtgggctaagttttgtcgtaaagtatggaggctgtggcgtccgtgtatatctggatgctgaactttgtgtatactattttgaaggtaaataacctgcacttcagtcttcttatcctgcttcttcgggcttctcagccttgtgaatatcgtgcacaagcagataactgtactgcacatgtcagtgatgagcctgaactgtgttttccatttggtgaactttgtgatggtactgaggaattgtgcctaaattttgagagggctgttgaactctctcactgaactcattatatatggggaactatttgatcacaaaaaaaaaaaaaaaa

SEQ ID NO: 4368 - protein, 297 aa, Triticum aestivum
  misc_feature: PFam Name: bZIP_1; PFam Description: bZIP transcription factor
  misc_feature: PFam Name: bZIP_2; PFam Description: Basic region leucine zipper
  misc_feature: GI Number: 7258365; NR Description: bZIP transcription factor-like protein [Arabidopsis thaliana] >gi|15982805|gb|AAL09750.1| bZIP transcription factor-like protein [Arabidopsis thaliana] >gi|30694089|ref|NP_567003.2| bZIP
  misc_feature: GI Number: 37936162; NR Description: bZIP protein BZ2
  misc_feature: GI Number: 1905785; NR Description: G/HBF-1 [Glycine max]
  misc_feature: GI Number: 18698991; NR Description: bZIP protein [Oryza sativa]
  misc_feature: GI Number: 16797791; NR Description: bZIP transcription
MECSGDEVVELSCARAGGDPGEYAAVLKRKLQLYCAAVAKTMEAKPQESSLNCLNSQASDTSPLVSQASFDCDGTVVQGKPANSCTSKEQSDDDDGDLEENTDPASAKRVKRMLSNRESARRSRKRKQAHQNDIESQVTQLRAENASLLKRLTDMTQKYKEASLGNRNLTVDIETMRRKVNIAEEAVRRVTGASLMFSTTSNNVPLSSCVSVAASADAVPTEENMSHFLQGLLEDNLIKHDLSEVATPLPNGEEMTSRPAPLQRVASLENLQKRIHRDSVHTEDTSSFPDHEVPANG

SEQ ID NO: 4369 - DNA, 1661 bp, Triticum aestivum
  misc_feature (1)..(1661): Ceres cDNA ID no. 21705293
  misc_feature (1)..(1661): Ceres CLONE  ID no. 916547
  misc_feature (1)..(1661): Also known as  Ceres CDNA ID no. 24369546
acttttataaaagccgcctcccctcgccgttgccggacactgccaaaaagcaggggccgccaagctccgctccgctcgccattgtcgtccggtgaagctgccaaggaggaagaagcaatggcccgttgtggggtcgccgttctcgtgctgatcctgctggcctgtgtcgctgcggcggccgctggcggtagggatcaccaccaccggcggggcagcagggcgtcggcgcggctgcagctggtgcccgccgccccgggcgcgtcgctggccgagcgcgcgcgggacgaccggcaccggcacgcctacatctcccggaggctggcgtcgtcggcgtcgtctagccggcggcgcgcggccgagacgtcgacggccccggggccggaggcgtcggcgttcgcgatgccgctgacgtcgggcgcgtacacgggcacggggcagtacttcgtgaagttccgcgtgggcacccccgcgcagcccttcgtgctcgtcgccgacaccggcagcgacctcacctgggtcaagtgccgcggcgcgtcctcgccgtcggccgcgtccccgtcgggctcgccgcgcgtgttccggcccgccgactccaagtcgtgggcgcccttcccgtgctcctccgacacgtgcaagtcctacgtccccttctccctcgccaactgctccgccggcaccgccccctgcgcctacgactacaggtacaaggacaactcgtcggcccgcggcgtggtgggcacggacgcggccaccgtcgcgctgtccggctccagaggcggcggcgcggacaggaaggccaagctgcagcaggtggtgctgggctgcaccacctcctacgacggccagagcttccaggcctccgacggcgtgctcagcctcggcaacagcaacatctccttcgccgcccgcgccgccgcgcgcttcggcggccgcttctcctactgcctcgtcgaccacctcgccccgcgcaacacctccagctacctcaccttcggccccgacgccaacggcgccgcttcatcgtcgaggacgccgctgctgctcgacgcccaggtggccccgttctacgccgtcacggtcgacgccgtctccgtcgccggggaggccctcgacatccccgccgaggtgtgggacgtcaaaaagagcggcggcgccatcctcgactccggcaccagcctgaccatcctcgccaccccggcgtacaaggctgtcgtggccgcgctgagcaagcagctcgcgggagtgccgcgggtaaccatggacccgttcgagtactgctacaactggacggccacgagcacgccgccggccgtcccgaagctggaggtgcggttcgccgggtcggcgcggctccagccgccgaccaagagctacgtcatcgacgcggcgcccggcgtcaagtgcatctggctgcaggagggcgtgtggcccggggtgtccgtcatcggcaacatcctgcagcaggagcacctctgggagttcgacctcgccaaccgctggcttaggtttaaggagagccgttgtgcacagtaattaattgttaggcatcttctgattccgttctcgttctttcccgtaagggtctctgattctgtaaggctctttcataagcaagtgttaatgaaaatgggatgaagatatctggaaaaaaaaaaaaaaaa

SEQ ID NO: 4370 - protein, 471 aa, Triticum aestivum
  misc_feature: PFam Name: Asp; PFam Description: Eukaryotic aspartyl protease
  misc_feature: PFam Name: Pyr_redox_2; PFam Description: Pyridine
  misc_feature: PFam Name: Pkinase; PFam Description: Protein kinase domain
  misc_feature: PFam Name: FH2; PFam Description: Formin Homology 2 Domain
  misc_feature: PFam Name: Extensin_2; PFam Description: Extensin-like region
  misc_feature: GI Number: 34911162; NR Description: putative chloroplast nucleoid DNA [Oryza sativa (japonica cultivar-group)] >gi|20161107|dbj|BAB90037.1| putative chloroplast nucleoid DNA
  misc_feature: GI Number: 11994412; NR Description: chloroplast nucleoid DNA binding protein-like [Arabidopsis thaliana] >gi|30682289|ref|NP_187876.2| aspartyl protease family protein
  misc_feature: GI Number: 11994761; NR Description: chloroplast nucleoid DNA binding protein-like; nucellin-like protein [Arabidopsis thaliana] >gi|15230868|ref|NP_189198.1| chloroplast nucleoid DNA-binding
  misc_feature: GI Number: 50932953; NR Description: unknow protein [Oryza sativa (japonica cultivar-group)] >gi|47777372|gb|AAT38006.1|
  misc_feature: GI Number: 49328116; NR Description: putative nucleoid
MARCGVAVLVLILLACVAAAAAGGRDHHHRRGSRASARLQLVPAAPGASLAERARDDRHRHAYISRRLASSASSSRRRAAETSTAPGPEASAFAMPLTSGAYTGTGQYFVKFRVGTPAQPFVLVADTGSDLTWVKCRGASSPSAASPSGSPRVFRPADSKSWAPFPCSSDTCKSYVPFSLANCSAGTAPCAYDYRYKDNSSARGVVGTDAATVALSGSRGGGADRKAKLQQVVLGCTTSYDGQSFQASDGVLSLGNSNISFAARAAARFGGRFSYCLVDHLAPRNTSSYLTFGPDANGAASSSRTPLLLDAQVAPFYAVTVDAVSVAGEALDIPAEVWDVKKSGGAILDSGTSLTILATPAYKAVVAALSKQLAGVPRVTMDPFEYCYNWTATSTPPAVPKLEVRFAGSARLQPPTKSYVIDAAPGVKCIWLQEGVWPGVSVIGNILQQEHLWEFDLANRWLRFKESRCAQ

SEQ ID NO: 4371 - DNA, 1488 bp, Triticum aestivum
  misc_feature (1)..(1488): Ceres cDNA ID no. 21705294
  misc_feature (1)..(1488): Ceres CLONE  ID no. 918674
  misc_feature (1)..(1488): Also known as  Ceres CDNA ID no. 24368598
gctcacaccaaaacatatagctcggctagccaaggtctgcagagctccggccgtctgtcaactgcacgtacgtgtgtatatacacacagcccgccagccatgtctgccgccgcgtgcgtccccttctgcccctcccccgcgtcttctcgccacggcgccgggccgatcgtcgacgtcgctgggctgccgccggccacggaggcggaggagcacggcgccgggagggacctcctggagttcggggtcaacggggtgatcggcgccaacagtgacagtgacgatgctgctgctgctgagatcgatgacgaggaggagcactcggtgaggaggccacgggcggtggttcagaagttcatgtgcgaacgcaaggctgtcggcgacggcttcgctctccggaggagcattggcaggcccgagttgcagagcttggatcctttcatctccttggatgagtttgaattttctcgtccagccggctttactgatcatccacaccgaggattcgagaatgttacctacatgcttgagggaggcttgagttaccatgacttttcaggccacaagggcacgatcaacaccggagatgttcagtggatgacggccgggcgtggtgtggtgcacgcagagatgccgggtggtgagggggtgcagaggggcctcaacctctggctcaacctctcctcaaaagacaagatggtggcgccgaggtaccaggagctgaggagccgcgacatccccacggcggagaaggacggcgtgtccgtcaaggtcatcggcggcgaggccctgggcgcgcgctcgccgatccagacgcgcaccccggccatgtggctcgacgtgaccatgcggcccggcgcgcgcctgcgccagcccgtcccggccggctggagcgcgtgcgcctacgtcctcgacggcgaggccagcttcggccagccaggggacgaggcggccggcgcgcatcactgcgtcgtgttcggcaacgacggcgatggcgtggacgtgcggagcgaaggcgcgggggcccggttcttgctgctggtggcgcggccgcacggcgaggcggtggcgctggacgggcccttcgtgatgaacacgagcgaggaggtgcagcaggccagggaggattacctgaaccgccgtaacggcttcgagatggccgccggctggacctctggccagtgaccgaccacagccgtgcttcaccaacattggcggggcaacgacaacagaaagggaggccgtggcagtagacgtcacaatgggctgcactgcatgcattttttttcctggtcatgaccggtcttcaaagtcgaatccaaaggcccaggggattatttgtcctagtcaagatattagtgttgtttcccgcaaaagaaaaatataaatattattacatgatggtcacatttttaaaataatactcacaaactgtaaaaagaatattcacaagattcaaaaatattccacattccaaaaaaaaaaaaaaaa

SEQ ID NO: 4372 - protein, 1488 aa, Triticum aestivum
  misc_feature: PFam Name: Pirin; PFam Description: Pirin
  misc_feature: PFam Name: Pirin_C; PFam Description: Pirin C-terminal region
  misc_feature: GI Number: 50944913; NR Description: putative pirin [Oryza sativa (japonica cultivar-group)] >gi|25553644|dbj|BAC24898.1| putative pirin [Oryza sativa (japonica cultivar-group)] >gi|38637594|dbj|BAD03876.1| putative pirin [Oryza sativa
  misc_feature: GI Number: 50920071; NR Description: putative pirin-like protein [Oryza sativa (japonica cultivar-group)] >gi|41469639|gb|AAS07362.1| putative pirin-like protein [Oryza
  misc_feature: GI Number: 6651245; NR Description: pirin [Lycopersicon
  misc_feature: GI Number: 49066057; NR Description: Putative pirin-like
  misc_feature: GI Number: 30689259; NR Description: pirin, putative
GCTCACACCAAAACATATAGCTCGGCTAGCCAAGGTCTGCAGAGCTCCGGCCGTCTGTCAACTGCACGTACGTGTGTATATACACACAGCCCGCCAGCCATGTCTGCCGCCGCGTGCGTCCCCTTCTGCCCCTCCCCCGCGTCTTCTCGCCACGGCGCCGGGCCGATCGTCGACGTCGCTGGGCTGCCGCCGGCCACGGAGGCGGAGGAGCACGGCGCCGGGAGGGACCTCCTGGAGTTCGGGGTCAACGGGGTGATCGGCGCCAACAGTGACAGTGACGATGCTGCTGCTGCTGAGATCGATGACGAGGAGGAGCACTCGGTGAGGAGGCCACGGGCGGTGGTTCAGAAGTTCATGTGCGAACGCAAGGCTGTCGGCGACGGCTTCGCTCTCCGGAGGAGCATTGGCAGGCCCGAGTTGCAGAGCTTGGATCCTTTCATCTCCTTGGATGAGTTTGAATTTTCTCGTCCAGCCGGCTTTACTGATCATCCACACCGAGGATTCGAGAATGTTACCTACATGCTTGAGGGAGGCTTGAGTTACCATGACTTTTCAGGCCACAAGGGCACGATCAACACCGGAGATGTTCAGTGGATGACGGCCGGGCGTGGTGTGGTGCACGCAGAGATGCCGGGTGGTGAGGGGGTGCAGAGGGGCCTCAACCTCTGGCTCAACCTCTCCTCAAAAGACAAGATGGTGGCGCCGAGGTACCAGGAGCTGAGGAGCCGCGACATCCCCACGGCGGAGAAGGACGGCGTGTCCGTCAAGGTCATCGGCGGCGAGGCCCTGGGCGCGCGCTCGCCGATCCAGACGCGCACCCCGGCCATGTGGCTCGACGTGACCATGCGGCCCGGCGCGCGCCTGCGCCAGCCCGTCCCGGCCGGCTGGAGCGCGTGCGCCTACGTCCTCGACGGCGAGGCCAGCTTCGGCCAGCCAGGGGACGAGGCGGCCGGCGCGCATCACTGCGTCGTGTTCGGCAACGACGGCGATGGCGTGGACGTGCGGAGCGAAGGCGCGGGGGCCCGGTTCTTGCTGCTGGTGGCGCGGCCGCACGGCGAGGCGGTGGCGCTGGACGGGCCCTTCGTGATGAACACGAGCGAGGAGGTGCAGCAGGCCAGGGAGGATTACCTGAACCGCCGTAACGGCTTCGAGATGGCCGCCGGCTGGACCTCTGGCCAGTGACCGACCACAGCCGTGCTTCACCAACATTGGCGGGGCAACGACAACAGAAAGGGAGGCCGTGGCAGTAGACGTCACAATGGGCTGCACTGCATGCATTTTTTTTCCTGGTCATGACCGGTCTTCAAAGTCGAATCCAAAGGCCCAGGGGATTATTTGTCCTAGTCAAGATATTAGTGTTGTTTCCCGCAAAAGAAAAATATAAATATTATTACATGATGGTCACATTTTTAAAATAATACTCACAAACTGTAAAAAGAATATTCACAAGATTCAAAAATATTCCACATTCCAAAAAAAAAAAAAAAA

SEQ ID NO: 4373 - DNA, 1697 bp, Triticum aestivum
  misc_feature (1)..(1697): Ceres cDNA ID no. 21705295
  misc_feature (1)..(1697): Ceres CLONE  ID no. 919574
  misc_feature (1)..(1697): Also known as  Ceres CDNA ID no. 24368832
actagacgatcgactacgatccacgtccaaggctaactaagcagcagcagcaggcttaaaccggtgatctagcgctactagctactatggtcgccacgtccctggcattcgtggcgcgccgcggcgagccggagctggtcgcgccggccgggccgacgccgcgcgagctcaagcggctctcggacctcgacgaccaggagagcctccggttctaccgctccgtcatctacttctaccggggcctcccctcgcggccgcgcgccgacccggccagggtcgtacgcgatgggctggccgcggcgctcgtgcactactaccccatagccgggcggctccgcgagctgcccggcaggaagctcgccgtggactgcaccggcgagggggtgtggttcgtccaggccgacgcggacgtcgcgttggacgagttcggcgacaggctgtgcccgccggtcccttgcgccggccagctcctgtgcttgccggagagcaactccgccgtcgtcgtcgaccggccactgctctacgttcaagtgacgagattgaggtgcggaggcttcgtgttaggcatccaggtgttccataacctggtggacgcgccgggcgtcacgcagttcctgcaggccgtcagcgagctggcgggcggcatggaggcgccaagcgtgcggccggtgtgggcgagggagctgctcgacgcgcgcgaccccccgtgccccatctaccatcaccccgagtacgagctggcggctgacgcggccaacgacaagctccgtccgggcgccgtgctcgtgcaccgggcgttcctcttcggccccgaggagttgtcctcgctgagggaccagctaccgccgcagatgaggtcgaggtgctcccggttcctgctcctgtcggcgttcgcgtggcgctgccggacctcggcgctcggctacgagcccggcgacgaggtgcggttcatgttcgtggtgaacgcccgcgggaagcgcggccgcccgctccccgaggggttctacgggaacgcgctcaccttcggcgtggcgcggacgacggccggcgagctctgctcgggatctctgggccacgccgtggagctgatcgtggccgcgaaggcgcgggtcgccgccgacgactacgcgcagtcggtggccgacgcgctggtgctgcgcgggcggccgcggttcacgacggcgcggacgtatcttgtgacggatctcaccaagtcgaacctgcacgaggtggacctcgggtggggccttccggtgtatggcgggccggccacgacgacgctggccactttccacattcctgcggccggcggggggatcaccgtgccgatgtgcctgcctccgcgcgccatggagaggttcgcggccaatgtgcgcgcggggctctcggaggcttcttcgcaccgtgggcgttctagtggcgtggagttggccgtgctgtccaggatgtaggaatgtaatctgatagcacaactcctaacattctctctctcaaaaataaaataaaatcctaacgtaatcacttttccttgtggaacatttcaaacaaataatttcttttttttgaggatatcaaacaataatttcggatccaaataagcatacgtaacatgatttggctttctaaagtgtagttggttttaggagatactattcacttagaccactttattttttattccaaaaaaaaaaaaaaaa

SEQ ID NO: 4374 - protein, 454 aa, Triticum aestivum
  misc_feature: PFam Name: Transferase; PFam Description: Transferase family
  misc_feature: GI Number: 57471999; NR Description: putative alcohol
  misc_feature: GI Number: 53792630; NR Description: putative benzoyl coenzyme A, benzyl alcohol benzoyl transferase [Oryza sativa
  misc_feature: GI Number: 22854880; NR Description: benzoyl coenzyme A:
  misc_feature: GI Number: 1171577; NR Description: hsr201 [Nicotiana tabacum] >gi|7489142|pir||T03274 hsr201 protein,
  misc_feature: GI Number: 51556912; NR Description: benzoyl-CoA:benzyl alcohol/phenylethanol benzoyltransferase; BPBT [Petunia x hybrida] >gi|49798480|gb|AAT68601.1| benzoyl coenzyme A: benzyl alcohol
MVATSLAFVARRGEPELVAPAGPTPRELKRLSDLDDQESLRFYRSVIYFYRGLPSRPRADPARVVRDGLAAALVHYYPIAGRLRELPGRKLAVDCTGEGVWFVQADADVALDEFGDRLCPPVPCAGQLLCLPESNSAVVVDRPLLYVQVTRLRCGGFVLGIQVFHNLVDAPGVTQFLQAVSELAGGMEAPSVRPVWARELLDARDPPCPIYHHPEYELAADAANDKLRPGAVLVHRAFLFGPEELSSLRDQLPPQMRSRCSRFLLLSAFAWRCRTSALGYEPGDEVRFMFVVNARGKRGRPLPEGFYGNALTFGVARTTAGELCSGSLGHAVELIVAAKARVAADDYAQSVADALVLRGRPRFTTARTYLVTDLTKSNLHEVDLGWGLPVYGGPATTTLATFHIPAAGGGITVPMCLPPRAMERFAANVRAGLSEASSHRGRSSGVELAVLSRM

SEQ ID NO: 4375 - DNA, 1221 bp, Triticum aestivum
  misc_feature (1)..(1221): Ceres cDNA ID no. 21705296
  misc_feature (1)..(1221): Ceres CLONE  ID no. 919882
  misc_feature (1)..(1221): Also known as  Ceres CDNA ID no. 24369325
gcaacctcacgcatggaggagagggagcatggtgcagcccaagagtaggccccgcgagtgagcccgcccgccctccgccctgcctgccatggcagcctccctcctcctcctctccccctcgcctcactgccactgcattaccacgcccaccaggggaaccggaacgccgctgccttccccgcggtgccacccaccagctccgcggcgccggccgcggccgcggggcgcggggctggtggcgagaggcgccgcggtgcctcccgagcaaagcttagcgcctcactacaagactctgggcgacgccaagtctgcgctgtaccaagctctggaaggtatcgacagaggaatatttggcataacctccgcgaaaaggtccgagattcatgctctggtggagctcttggagtcccggaatcctacaccgaatcccaccgacaaattgcacgacaaggtggacggctgctggaggctcatctatagcaccatctcgattctggggaaaaggagaaccaagttaggcctgcgagatttcatcagcctgggggatttcttccagataatcgatgtcaaggaggaaaaggcggtgagtgtcataaagttcagcgcaagagcattgaagatattctcaggccaacttgctattgaagcatcctacactatcacgacaaaaacaagagtgggtatcaagcttgagagttcaacaatcaccccagatcagttgatgaatatcttccagaagaactacgacatgctccttgccatattcaacccagaaggttggcttgagataacatatgttgacgaatctctacggatcggcagagatgacaaggcaaacatctttgttctggagaaaacagacccatctcaagtgtaagaagatctacgaagcaaaatgtgtgcaaatattcgtaatttctgacaatgagtgcatcgacactcagagaagaggccacattaacgtattccgcggcacaaatgattgttaacagctcagtgcagatcatcgattcaaccactcatcaatttctcctgaaaaggataagcagcattcttttttacgactgtagaaacatttgttttttggattttttagctgtgcactgtcaatgtatcaatgtaagtatgtaactatgaaagttcagttacatagagaatcaaactgccccatcacagggagcaattaaacaaatatccaattttgcaaaaaaaaaaaaaaaa

SEQ ID NO: 4376 - protein, 262 aa, Triticum aestivum
  misc_feature: PFam Name: PAP_fibrillin; PFam Description: PAP_fibrillin
  misc_feature: GI Number: 42567755; NR Description: plastid-lipid associated
  misc_feature: GI Number: 16329838; NR Description: fibrillin [Synechocystis sp. PCC 6803] >gi|7469320|pir||S75332 fibrillin - Synechocystis sp. (strain PCC 6803) >gi|1652323|dbj|BAA17246.1| fibrillin
  misc_feature: GI Number: 5020103; NR Description: fibrillin [Nostoc sp. PCC 8009]
  misc_feature: GI Number: 17231810; NR Description: fibrillin [Nostoc sp. PCC 7120] >gi|25354850|pir||AG2345 fibrillin [imported] - Nostoc sp. (strain PCC 7120) >gi|17133454|dbj|BAB76017.1| fibrillin
MAASLLLLSPSPHCHCITTPTRGTGTPLPSPRCHPPAPRRRPRPRGAGLVARGAAVPPEQSLAPHYKTLGDAKSALYQALEGIDRGIFGITSAKRSEIHALVELLESRNPTPNPTDKLHDKVDGCWRLIYSTISILGKRRTKLGLRDFISLGDFFQIIDVKEEKAVSVIKFSARALKIFSGQLAIEASYTITTKTRVGIKLESSTITPDQLMNIFQKNYDMLLAIFNPEGWLEITYVDESLRIGRDDKANIFVLEKTDPSQV

SEQ ID NO: 4377 - DNA, 1741 bp, Triticum aestivum
  misc_feature (1)..(1741): Ceres cDNA ID no. 21705299
  misc_feature (1)..(1741): Ceres CLONE  ID no. 922249
  misc_feature (1)..(1741): Also known as  Ceres CDNA ID no. 24369728
atccttcgccggttcccttcctgcctgcctccctaggttcgttcaaacagattcgctcagcacaggcagctcgacgacgtagcagaaaaagagaactagagaagcgatcagttagccatggcctcctcgtcgctggacacggaggcgggagccggagtgcagcacaaggccggcggcgacggcagcgggtacaccaccgcggccaccgcccacgcggtagacacagattcatggcagcaggttgggctgctgctggtgacggggttcaactgcgcctacgtgctcagcttctccaacctgatgatggtgccgctggggtgggggtggggcgccgcctgcctgctgctcctcgccgccgccgcctggtacgccaactggctcctcgccggcctccacgtcgtcgacggccagaggttcatccgctacagggacctcatgggcttcgtcttcgggaggaaaatgtactacctcacctggttcctgcagttcaccaccctgctcctgggaagcatgggcttcattctgctcggcggaagagcactcaaggcgatcagcgcggagttcacccagacgcctccgcggctgcagtggttcatcgccgcgacggggttcgtctacttcgccttcgcctacttcgtgcccaccatctccgccatgaggaactggctggccacctccgccgcgctcaccgtcaccttcgacgtggcgctgctggccgtcctcgtcagagacggccggtcgaacgatcggagcgggagggactacagcatccacgggacgggggcggagaaggcgttcaacgcgctgggggccgtggcggcgatcctggtgtgcaacacctcgggcctgctcccggagatccagtcgacgctgcgtaagccggcggtgggcaacatgcggcgggcgctggcgctgcagtacacggtgggcgccgcggggtactacgggatcagcgtggccgggtactgggcgtacggcgccgccgcgtccgagtacctccccaaccagctctccggcccgcgctgggcctccgtgctcatcaacgccaccgccttcctccagagcatcgtctcgcagcacctgttcacggtgccgatccacgagggcatggacacggggctgcagcggctggaggagggcatgttctcgcgctacaacatgacgcgcaggctcttcgccagggggctgctcttcggggtcaacgtcttcgtcaccgcgctcttcccattcatgggcgacttcgtcaacctcttcggctccttcgcgctcttcccgctcaccttcatgttccccagcatgatcgtcctcaagatcaaaggggagtgcgacgggagatggggcaggctctggcactggggcatcatcgtcgtctcctccgccgtcggcctcgccacctccgccgccgccgtcagactcatcctgcacaacgccagcgtctaccgcttcttcgccgacacctagagcacgactatcccgccgcgcaggacggcaggatgatgatgcagtacgtgcgcccaaccgtgacataacagttactactaccaccaccaccagaccatcgtatccgtgtcaattcgtgggcacgttaacatgccaaacgtgagaccaaaaaatagcagtactcatagtcatagtagtggtggtgaaccacctgcattggacgccatttgagcaagaagcagcttccatttcggaacgaaaaccaaagataaaataaaataatgcaaaaaaaaaaaaaaaa

SEQ ID NO: 4378 - protein, 447 aa, Triticum aestivum
  misc_feature: PFam Name: Aa_trans; PFam Description: Transmembrane amino
  misc_feature: PFam Name: Extensin_2; PFam Description: Extensin-like region
  misc_feature: PFam Name: Peptidase_C1; PFam Description: Papain family
  misc_feature: PFam Name: Sporozoite_P67; PFam Description: Sporozoite P67
  misc_feature: PFam Name: PP2C; PFam Description: Protein phosphatase 2C
  misc_feature: GI Number: 50902312; NR Description: proline transport protein-like [Oryza sativa (japonica cultivar-group)] >gi|20804893|dbj|BAB92574.1| proline transport protein-like [Oryza sativa (japonica cultivar-group)]
  misc_feature: GI Number: 53749423; NR Description: proline transporter, putative [Oryza sativa (japonica cultivar-group)] >gi|11358960|pir||T50690 proline transport protein [imported] -
  misc_feature: GI Number: 21593453; NR Description: proline transporter 1
  misc_feature: GI Number: 16215723; NR Description: proline transporter
  misc_feature: GI Number: 31376371; NR Description: At3g55740 [Arabidopsis thaliana] >gi|7263562|emb|CAB81599.1| proline transporter 2 [Arabidopsis thaliana] >gi|1769903|emb|CAA65053.1| proline transporter 2 [Arabidopsis thaliana] >gi|19698891|gb|AAL91181.1|
MASSSLDTEAGAGVQHKAGGDGSGYTTAATAHAVDTDSWQQVGLLLVTGFNCAYVLSFSNLMMVPLGWGWGAACLLLLAAAAWYANWLLAGLHVVDGQRFIRYRDLMGFVFGRKMYYLTWFLQFTTLLLGSMGFILLGGRALKAISAEFTQTPPRLQWFIAATGFVYFAFAYFVPTISAMRNWLATSAALTVTFDVALLAVLVRDGRSNDRSGRDYSIHGTGAEKAFNALGAVAAILVCNTSGLLPEIQSTLRKPAVGNMRRALALQYTVGAAGYYGISVAGYWAYGAAASEYLPNQLSGPRWASVLINATAFLQSIVSQHLFTVPIHEGMDTGLQRLEEGMFSRYNMTRRLFARGLLFGVNVFVTALFPFMGDFVNLFGSFALFPLTFMFPSMIVLKIKGECDGRWGRLWHWGIIVVSSAVGLATSAAAVRLILHNASVYRFFADT

SEQ ID NO: 4379 - DNA, 1218 bp, Triticum aestivum
  misc_feature (1)..(1218): Ceres cDNA ID no. 21705300
  misc_feature (1)..(1218): Ceres CLONE  ID no. 927648
  misc_feature (1)..(1218): Also known as  Ceres CDNA ID no. 24368968
gtggtgttctcgaaacatctcctccctgcctctgcctagctcttctcgctcccgcttgtctccgccgcggccggcgctcggccgtccgcacaggaagcaccgccccgcgccgccctccgctcccattggtcggtcggcccaagatcctcatccgaacttaagacaaaatgggctcaagactttttgctttgttcatcactggcgttgtccttttgggcagtagaatcttggccttggaccatactgttgtcgaaaagagattaaatgagaacacggtatctcttacaacaaagggaagtccacaactatgccaactttgtgagcagtttgccacagaaaccctcttctatttgaaggagaatgagacacggatcgaaattatagatactcttcaccaagcttgtttgaaatttcattcacttaagttagagtgtacaaagttggttgattattatgcagcactgttcttcgaacaaattgattctctaagccctgaagaattttgcgtatcagcaagtctttgtgaggaagttacatacattcgcctcccaggacatgaacatgcttgcaccctttgccatgaggttgttgatgagattcgtgctggtcttgaagaccctgagatggagctcaagataatcgagatacttctgaaaggatgcaacaacacagagagtttcgtacagaagtgcaagaagatgataatccaaaacacaccggtcatactagaagatatcaagaagtttctcaagaagagagatttctgcgactctatccgtgtctgtggaggcaagattgttcgccctcgaggaggaggcctaagaggcatgtatactgcctgagcttttctctcctgaacacgcatgacaattgcgtgtcatttcatgaagaacacgcgtgagggctgggctctccaacctcttgcagtgatgtttacaagagagattggtggtgtacgtgtacgaaacaaaaggtcttcctgattatttccgagcagtgtatatattatagtacagcattggctgtgtacctggaaagaagtgaaatgaaatttccactggaaagcatgcacgccctccgtgatagttggtcctacatgattgttatgaaacacgagcagaatgtatgcttaaagtgtacagtatgtctgtatgtaaacaaattattaattatgtgcagtggacgtttatttatgatgattcaaaaaaaaaaaaaaaa

SEQ ID NO: 4380 - protein, 224 aa, Triticum aestivum
  misc_feature: PFam Name: SapB_1; PFam Description: Saposin-like type B, region 1
MGSRLFALFITGVVLLGSRILALDHTVVEKRLNENTVSLTTKGSPQLCQLCEQFATETLFYLKENETRIEIIDTLHQACLKFHSLKLECTKLVDYYAALFFEQIDSLSPEEFCVSASLCEEVTYIRLPGHEHACTLCHEVVDEIRAGLEDPEMELKIIEILLKGCNNTESFVQKCKKMIIQNTPVILEDIKKFLKKRDFCDSIRVCGGKIVRPRGGGLRGMYTA

SEQ ID NO: 4381 - DNA, 1342 bp, Triticum aestivum
  misc_feature (1)..(1342): Ceres cDNA ID no. 21705301
  misc_feature (1)..(1342): Ceres CLONE  ID no. 934643
  misc_feature (1)..(1342): Also known as  Ceres CDNA ID no. 24369491
gagattccgcaccccgtcccactcccgtcgcctcaccagataaattccctccgccaccgccgcctccctctctccccctccctctcctccgcgtccgccccggccagagtcctccccccgccgccggaccgccggccccggaacgcggctactccacggacggtcttcgtagcaggtgcaaggcccctgcggctaggccagcgatggacgacggggacatcgacttctccaacccgcagacgttcctgtgcgaggccatgggcaacgacccgccggccagctgttccatggggagctacttcgacgacatcctcaacagcgacgccgaccacctcgcctgcacgcacacccacacctgcaacccgccagtccacgacctcgcgcaccacacccacacctgcgtgcacgtccacaccaagatcctctctgcctccgacgacgccgccgagacctccgagtcgctgccggagggcggcgccaccaagaagcagcgcccctccggtaaccgcgcggccgtcaggaagtaccgcgagaagaagaaggcccacacggcgctgctcgaggaggaggtggctcacctcaaggccgtcaaccagcagctcgtcaagaagctccagagtcactccgcgctcgaggccgaggtcgccaggctccgctgcctgcttgttgacatcagagggaggatcgaaggggagattggcactttcccttaccagcggacggtgaaaagcaacgattttgtcgatcaggggagcttcctcggtggtgcccaggtcatgaattcctgcgatttcagatgcaacgatcagttgtactgcaacccaggaatacagcaggccagaactatggaagacgatggtgttatgagtggccaggttttggggcaaggtgccggtgactctatgggctgtgtaaaaccaggttctttaaaccccccaggctgccgcgggggccaaatgctgtaaacaggtcgaggaccatgaggtgcttatcttctccttgcgagagactattggcttccccgtacaaggaagactgtataaattgctggcttctaccagagggcccaatttggtttaaactgtcatgtttgtggctctgttgcccatgatgccttctatgatgcctggggcgctgcaagttcgttagctcggatgctatcaggacatccctttattgttgcttagttccagcctcggtaatgttcttggagtttgacagcctttgctcctagtcctagatgctcgctgataattagtactgtagaacagactgcgttcgaaggtatcttcaataatttagatttcggcatccaggttttgtgggaaaaaaaaaaaaaaaa

SEQ ID NO: 4382 - protein, 253 aa, Triticum aestivum
  misc_feature: PFam Name: bZIP_2; PFam Description: Basic region leucine zipper
  misc_feature: PFam Name: Mucin; PFam Description: Mucin-like glycoprotein
  misc_feature: PFam Name: Extensin_2; PFam Description: Extensin-like region
  misc_feature: PFam Name: FH2; PFam Description: Formin Homology 2 Domain
  misc_feature: GI Number: 18855044; NR Description: putative transcription
  misc_feature: GI Number: 21554283; NR Description: putative transcription
  misc_feature: GI Number: 30693563; NR Description: bZIP family
  misc_feature: GI Number: 34908964; NR Description: P0003D09.19 [Oryza sativa (japonica cultivar-group)] >gi|19570998|dbj|BAB86425.1|
  misc_feature: GI Number: 56283929; NR Description: CG3047-PA [Drosophila melanogaster] gi|55380421|gb|AAF50957.4| CG3047-PA [Drosophila
MDDGDIDFSNPQTFLCEAMGNDPPASCSMGSYFDDILNSDADHLACTHTHTCNPPVHDLAHHTHTCVHVHTKILSASDDAAETSESLPEGGATKKQRPSGNRAAVRKYREKKKAHTALLEEEVAHLKAVNQQLVKKLQSHSALEAEVARLRCLLVDIRGRIEGEIGTFPYQRTVKSNDFVDQGSFLGGAQVMNSCDFRCNDQLYCNPGIQQARTMEDDGVMSGQVLGQGAGDSMGCVKPGSLNPPGCRGGQML

SEQ ID NO: 4383 - DNA, 1209 bp, Triticum aestivum
  misc_feature (1)..(1209): Ceres cDNA ID no. 21705303
  misc_feature (1)..(1209): Ceres CLONE  ID no. 937111
  misc_feature (1)..(1209): Also known as  Ceres CDNA ID no. 24369383
aatacaaaaataagcggcatttcctattttaagacctctgttctttcccttgcgcacgaacagcccctccgacggcggcgaggcgggcgaattggcatcctccctcctcgactcgacgcgcgcgtaatccgagactaccttcaagaggacaagatgctgtggcgcacgattcgcagtatggaggtgatggcgcattcttctagtttccttcttccgaaattgcatcagcctgccaagactccagcaaacaactatactctggttgttcttaaccagcagcttccacggttcatgcctcgcctctgggctcaagcaaagatgagaatatgtgctgatggtggagccaatcgtatttttgacgagatgtctcaaatgacaaatgacctggacagaaataggtatattccagaaatagttgaaggggatatggattctataaggccagaagttaaaagattttactctagtcagggatccaaaatttctgataaatcacataaccaagagacaacagatttgcacaagtgtatttccagtatccgccatcgcacacctgatcatgaaaaagctaatctttgtgttcttgttactggagcacttggtggaaggtttgatcatgaggctgcaaatatcaatgttctctatgtgttctcggacatgcgaattgtccttctgtcagatgattgcttgatccaacttcttcccaaaacgcatcaccatgagatctatattgagtcctctgtagaaggaccgcattgtggaatttttcctattggagcaccatctacaagcactacaaccactggcctcaagtggaacctgagtgatgcagagatgagatttgggagcatgataagcacatccaacatcgtggattcagataaagtaaccgtgcagtcagatgcagatcttctgtggacaatttctcttcgaaatctgacctgaagagcatgcacttaactggaatcgactgctgtgtttccttttttgtaaaatctttgttgatcttgtatgctatcagctcagctcttgtacagtgcagctgtgtttgtgctcataagttgttctgtatctgataagtaaaggatatcttgtggcttgtggttgaaacctctgttgtcagatagatggggacctctccagattatcataaggatgcccaatagtatgttttctgtgcgtttatgagtgacaaaaaaaaaaaaaaaa

SEQ ID NO: 4384 - protein, 1209 aa, Triticum aestivum
  misc_feature: PFam Name: TPK_catalytic; PFam Description: Thiamin
  misc_feature: PFam Name: TPK_B1_binding; PFam Description: Thiamin
  misc_feature: GI Number: 53792333; NR Description: putative thiamin pyrophosphokinase [Oryza sativa (japonica cultivar-group)] >gi|53792130|dbj|BAD52763.1| putative thiamin pyrophosphokinase
  misc_feature: GI Number: 34915046; NR Description: putative thiamin
  misc_feature: GI Number: 30678415; NR Description: thiamin
  misc_feature: GI Number: 30689827; NR Description: thiamin
  misc_feature: GI Number: 7488367; NR Description: probable thiamin
AATACAAAAATAAGCGGCATTTCCTATTTTAAGACCTCTGTTCTTTCCCTTGCGCACGAACAGCCCCTCCGACGGCGGCGAGGCGGGCGAATTGGCATCCTCCCTCCTCGACTCGACGCGCGCGTAATCCGAGACTACCTTCAAGAGGACAAGATGCTGTGGCGCACGATTCGCAGTATGGAGGTGATGGCGCATTCTTCTAGTTTCCTTCTTCCGAAATTGCATCAGCCTGCCAAGACTCCAGCAAACAACTATACTCTGGTTGTTCTTAACCAGCAGCTTCCACGGTTCATGCCTCGCCTCTGGGCTCAAGCAAAGATGAGAATATGTGCTGATGGTGGAGCCAATCGTATTTTTGACGAGATGTCTCAAATGACAAATGACCTGGACAGAAATAGGTATATTCCAGAAATAGTTGAAGGGGATATGGATTCTATAAGGCCAGAAGTTAAAAGATTTTACTCTAGTCAGGGATCCAAAATTTCTGATAAATCACATAACCAAGAGACAACAGATTTGCACAAGTGTATTTCCAGTATCCGCCATCGCACACCTGATCATGAAAAAGCTAATCTTTGTGTTCTTGTTACTGGAGCACTTGGTGGAAGGTTTGATCATGAGGCTGCAAATATCAATGTTCTCTATGTGTTCTCGGACATGCGAATTGTCCTTCTGTCAGATGATTGCTTGATCCAACTTCTTCCCAAAACGCATCACCATGAGATCTATATTGAGTCCTCTGTAGAAGGACCGCATTGTGGAATTTTTCCTATTGGAGCACCATCTACAAGCACTACAACCACTGGCCTCAAGTGGAACCTGAGTGATGCAGAGATGAGATTTGGGAGCATGATAAGCACATCCAACATCGTGGATTCAGATAAAGTAACCGTGCAGTCAGATGCAGATCTTCTGTGGACAATTTCTCTTCGAAATCTGACCTGAAGAGCATGCACTTAACTGGAATCGACTGCTGTGTTTCCTTTTTTGTAAAATCTTTGTTGATCTTGTATGCTATCAGCTCAGCTCTTGTACAGTGCAGCTGTGTTTGTGCTCATAAGTTGTTCTGTATCTGATAAGTAAAGGATATCTTGTGGCTTGTGGTTGAAACCTCTGTTGTCAGATAGATGGGGACCTCTCCAGATTATCATAAGGATGCCCAATAGTATGTTTTCTGTGCGTTTATGAGTGACAAAAAAAAAAAAAAAA

SEQ ID NO: 4385 - DNA, 1652 bp, Triticum aestivum
  misc_feature (1)..(1652): Ceres cDNA ID no. 21705305
  misc_feature (1)..(1652): Ceres CLONE  ID no. 937495
  misc_feature (1)..(1652): Also known as  Ceres CDNA ID no. 25401180
aagaagacacggaatcaaacccgaaaacgtagaagaaaaatggcaaccgtgccatgccgcgcgtcccttctcatgctactaatgctcgtgcacccctgctgctgcgcagcaccggccgccgatgagaggcggcttctcatccagatcaagcgcgcgtggggcgacccgtccacgctcgcggcatgggacggctcggccgaccactgcacctggccctacgtcacctgcgtcgcgccatccgggcctgtcacaagcctctccctcgccagcacaaacgtagacggcccgttcccggacgccatcggcgccctctccggcctcacgagcctcgacatctccaacaacggcgtcaccggcgcctttccgacaagcgtataccgatgcgcttctctccggtatctggatttgtcccataactacctcggcggcgagctacccgccgacatgggcggcgcgctcggggagaacctcacctctctagtgctcaacggcaaccactttaacggtaccatccccacctccttgtcccggttacgtaacctccattcgcttgcgctggacaacaaccacctcgccggcaccatcccggcagagctcggcgacctcacgggccttcagacgctcacgctcctgaacaacttgttcagcgttggcgagctgccggcgtcgttcaagaacctgaccaagctgaaaaaattctgggcggctaactgcaacctcaccggcgacttcccgagctatgtggccgagatgccggagttggaggcgctcgacctctcgggcaacgccttgaccggaagtatacctccggggatttggaacctccccaagttgcaaaaggtggatctatctgccaacaacctcgccggcgaggtcgtggcaaccgatggtgccttcggcgccgcgaatttggtgacgatcgatctgtccttgaatcacaggctacgtgggctgattccggagggcctcggtcacttaccgaaccttgaaactctcaacttgtccggtaaccagctctttggcaggatcccgaggagcatagccaagctcggcttgctgacgcagctggacctgagcaggaatcagctcgtcggcgaaataccggcagaattgggcgacatgcagatgctcaacgcacttgacctgtcgtcgaacaagctatctggcgacataccactgccgcttgccgggctacagctccgttcgctcaacctgtcatccaaccagctcgaaggccaggtaccggcagggctcgccaccgccgcttacgaccggagcttcctcgacaaccccggcctctgccttgccggtacggagttcggcttcgtcgcaggcgttcgctcctgctccatgccatcacaagtcgcctcttcccccggggtccgctcgacggctctccttgccctcaaggccgccgcctgcgtggtcgtcgtcctcgtcgtggcagtggttttcttcgtcgtccacgacaggaaaaagaagcgcgctgcacaggatggttccgaggagaatcagtcggcagcggcgggtcggggcctgcttaatgctactacctccgtcctggtttataggttctctttatagtttgtgtcaaattttgactaaagatttaactaataaaatattaatgcatgacaaaaaaaaaaaaaaaa

SEQ ID NO: 4386 - protein, 514 aa, Triticum aestivum
  misc_feature: GI Number: 57899962; NR Description: putative LRK1 protein
  misc_feature: GI Number: 57899963; NR Description: putative LRK1 protein
  misc_feature: GI Number: 34909394; NR Description: putative receptor-like
  misc_feature: GI Number: 53792965; NR Description: putative serine-threonine protein kinase [Oryza sativa (japonica
  misc_feature: GI Number: 50906435; NR Description: putative CLAVATA1 receptor kinase [Oryza sativa (japonica cultivar-group)] gi|46806526|dbj|BAD17639.1| putative CLAVATA1 receptor kinase
MATVPCRASLLMLLMLVHPCCCAAPAADERRLLIQIKRAWGDPSTLAAWDGSADHCTWPYVTCVAPSGPVTSLSLASTNVDGPFPDAIGALSGLTSLDISNNGVTGAFPTSVYRCASLRYLDLSHNYLGGELPADMGGALGENLTSLVLNGNHFNGTIPTSLSRLRNLHSLALDNNHLAGTIPAELGDLTGLQTLTLLNNLFSVGELPASFKNLTKLKKFWAANCNLTGDFPSYVAEMPELEALDLSGNALTGSIPPGIWNLPKLQKVDLSANNLAGEVVATDGAFGAANLVTIDLSLNHRLRGLIPEGLGHLPNLETLNLSGNQLFGRIPRSIAKLGLLTQLDLSRNQLVGEIPAELGDMQMLNALDLSSNKLSGDIPLPLAGLQLRSLNLSSNQLEGQVPAGLATAAYDRSFLDNPGLCLAGTEFGFVAGVRSCSMPSQVASSPGVRSTALLALKAAACVVVVLVVAVVFFVVHDRKKKRAAQDGSEENQSAAAGRGLLNATTSVLVYRFSL

SEQ ID NO: 4387 - DNA, 1374 bp, Triticum aestivum
  misc_feature (1)..(1374): Ceres cDNA ID no. 21705306
  misc_feature (1)..(1374): Ceres CLONE  ID no. 937971
  misc_feature (1)..(1374): Also known as  Ceres CDNA ID no. 24369359
atagtgtgacgtccccgtctcctccgcctaaccaaacccgcctctctgttgtctctttcgtatatggccggcgcaagatcggcggcaaccaggctcacacactcttcgctattcctactgtctcgcgccgccgcagcggcagcgacccgccatcccaatctcccctcccccccgagagattattcaaagatggctagttcagttggaggcaatggctacagtgatgttacacgggtgctattctgtggccactattggcctgcttctactatttatacgaaggagtacttgcaaaactatccatttattcaggttgacgaagtaggtcttgagcacgtacccgatgttattcaaaactaccatatatgtgtagtgaaaaataaatgtatagattcagatatcattgccaaagcaactaagatgaagattattatgcagtatggtgttggtttagaaggtgttgacataaatgctgctacagaacagaaaatcaaagttgcacggatacctgggagtactacaggaaatgcaattgcttgcgcagaaatggctatctatctaactctaggtgttctgcggaagcaaaaggaaatggatactgctgtcattcagaaggacttgggccttccagttggagaaacaatattcgggaaaacaatacttatcctggggttcggagccattggcatggaaattgccaagagactaagaccatttggagtgaaaattcttgctacaaaaagaaactggtcatcatatacagtgtcttgtgatcttgatgggctggttgacaagaaaggtggtccagaagatatgtacgaactcgctagagaagctgacatagttataacttgcatgacgttaaacaatgaatcagttgggattgtggatcacaagttcctgtcagctttgaaaaagggatcatatctcatcaatattgccagaggacgcctactggactatacggctgtgtttaatcaccttgagtcaggtcatttaggtggtttgggcattgatgttgcttggacggagccattcgatccagaggatccaattctgaaattcccaaatgttattataacaccacatgttgcaggaatcacagaatactcttacagaaccatggcaaaggttgttggtgatgtcgctctcaagcttcatgcaggagagccattcaccgaaatagaatttgtgaactaggcaaactgagtagatggcgttattgttgatttaatttaagacgtattactagtgaacagaattaccaaataaaggcaaatgttatggacgattgcattactggagaatcataggaattcaaccggtttatttgatgtataaagcattgttgtctgtctaaaaaaaaaaaaaaaa

SEQ ID NO: 4388 - protein, 378 aa, Triticum aestivum
  misc_feature: PFam Name: 2-Hacid_dh_C; PFam Description: D-isomer specific
  misc_feature: PFam Name: 2-Hacid_dh; PFam Description: D-isomer specific
  misc_feature: GI Number: 50510002; NR Description: phosphoglycerate dehydrogenase-like protein [Oryza sativa (japonica cultivar-group)] >gi|50509022|dbj|BAD31969.1| phosphoglycerate dehydrogenase-like
  misc_feature: GI Number: 34901058; NR Description: putative phosphoglycerate dehydrogenase [Oryza sativa (japonica
  misc_feature: GI Number: 34901040; NR Description: putative phosphoglycerate dehydrogenase [Oryza sativa (japonica cultivar-group)] >gi|24414081|dbj|BAC22329.1| putative phosphoglycerate dehydrogenase [Oryza sativa (japonica
  misc_feature: GI Number: 30698851; NR Description: oxidoreductase family
  misc_feature: GI Number: 20808347; NR Description: Lactate dehydrogenase and related dehydrogenases [Thermoanaerobacter tengcongensis] >gi|20516955|gb|AAM25122.1| Lactate dehydrogenase and related
MAGARSAATRLTHSSLFLLSRAAAAAATRHPNLPSPPRDYSKMASSVGGNGYSDVTRVLFCGHYWPASTIYTKEYLQNYPFIQVDEVGLEHVPDVIQNYHICVVKNKCIDSDIIAKATKMKIIMQYGVGLEGVDINAATEQKIKVARIPGSTTGNAIACAEMAIYLTLGVLRKQKEMDTAVIQKDLGLPVGETIFGKTILILGFGAIGMEIAKRLRPFGVKILATKRNWSSYTVSCDLDGLVDKKGGPEDMYELAREADIVITCMTLNNESVGIVDHKFLSALKKGSYLINIARGRLLDYTAVFNHLESGHLGGLGIDVAWTEPFDPEDPILKFPNVIITPHVAGITEYSYRTMAKVVGDVALKLHAGEPFTEIEFVN

SEQ ID NO: 4389 - DNA, 1149 bp, Triticum aestivum
  misc_feature (1)..(1149): Ceres cDNA ID no. 21705308
  misc_feature (1)..(1149): Ceres CLONE  ID no. 940431
  misc_feature (1)..(1149): Also known as  Ceres CDNA ID no. 25401182
ctcggttcggctgtccacacccacccacgcgcccgtccccaacccgttcggcgaaatgccgccgccgctctccgtctcgctcccctcgccgcagcccctctccctcctcccgcgccacgccagggccgcccactcccaccccctcgccttggcccagcccctctccaccagggcgccgccctcctccgcctgctccgtcgtgcccgcgcgccactccgactacttcgacccccgggccccgccgtcgcagcgcgacgcgtacgggcagccgccgctggagagggagccgccggtgccgggcggccaggccgggagggtgttcgccagctacagcatctacaagggcaaggccgcgctggccttcgaccccaggccgccgcagttcgtgccgctcgaatcaggggcgtacaaggtggccaaggaggggttcgtgctgctccagttcgcccccgccgtggggccacggcagtatgattggactcgcaagcaggtgttctcattatctgtctgggagatgggaaccttgcttactcttggtctaacagattcgtgcgagttctttcatgaccctttcaaggggaggagcgatgaaggtaaagtgcgcaaggttctaaaggttgagccaacaccagatggcaacggtcgctttttcaacctcagtgttcaaaaccgtcttttgaacgttgatgagaacatttacatccctataaccaaaggagaatatgcggtcattgtatcgactttcaattacatcataccgcacatcatgggctggagcacgtttacaaattctatcaagcccgaggagtcgcagccatacaataggccgcagtcctctcccgaattggagtggcgaaggtgaagaatgacagcactctcggagggagatggcaggaagaatgatacttttggcggtcttccttccagaaaagaaatttttggtggtggtgtttggaaagtattttggtgcataatttggctggtaatttctggtttagttattaggaagttaatgtttttggttctgccatattcgtttggtttctcattacagctggcgggagttgtgttagtcaaatacctagtcatcacttcttaatgcaggaatggctttacatgagacttattattgcaaaaaaaaaaaaaaaa

SEQ ID NO: 4390 - protein, 1149 aa, Triticum aestivum
  misc_feature: PFam Name: FH2; PFam Description: Formin Homology 2 Domain
  misc_feature: PFam Name: Extensin_2; PFam Description: Extensin-like region
  misc_feature: PFam Name: Lipoprotein_5; PFam Description: Transferrin
  misc_feature: PFam Name: Pyr_redox_2; PFam Description: Pyridine
  misc_feature: PFam Name: 7tm_1; PFam Description: 7 transmembrane receptor
  misc_feature: GI Number: 55297130; NR Description: putative DNA-binding protein p24 [Oryza sativa (japonica cultivar-group)] gi|55296373|dbj|BAD68418.1| putative DNA-binding protein p24 [Oryza
  misc_feature: GI Number: 9651810; NR Description: DNA-binding protein p24
  misc_feature: GI Number: 51972072; NR Description: At2g02740 [Arabidopsis thaliana] gi|51536442|gb|AAU05459.1| At2g02740 [Arabidopsis thaliana] gi|42568881|ref|NP_178377.2| transcription factor,
  misc_feature: GI Number: 12083312; NR Description: putative DNA-binding protein p24 [Arabidopsis thaliana] gi|16323418|gb|AAL15203.1| putative DNA-binding protein p24 [Arabidopsis thaliana] gi|13877787|gb|AAK43971.1| putative DNA-binding protein p24
  misc_feature: GI Number: 21730639; NR Description: Chain C, Structure Of
CTCGGTTCGGCTGTCCACACCCACCCACGCGCCCGTCCCCAACCCGTTCGGCGAAATGCCGCCGCCGCTCTCCGTCTCGCTCCCCTCGCCGCAGCCCCTCTCCCTCCTCCCGCGCCACGCCAGGGCCGCCCACTCCCACCCCCTCGCCTTGGCCCAGCCCCTCTCCACCAGGGCGCCGCCCTCCTCCGCCTGCTCCGTCGTGCCCGCGCGCCACTCCGACTACTTCGACCCCCGGGCCCCGCCGTCGCAGCGCGACGCGTACGGGCAGCCGCCGCTGGAGAGGGAGCCGCCGGTGCCGGGCGGCCAGGCCGGGAGGGTGTTCGCCAGCTACAGCATCTACAAGGGCAAGGCCGCGCTGGCCTTCGACCCCAGGCCGCCGCAGTTCGTGCCGCTCGAATCAGGGGCGTACAAGGTGGCCAAGGAGGGGTTCGTGCTGCTCCAGTTCGCCCCCGCCGTGGGGCCACGGCAGTATGATTGGACTCGCAAGCAGGTGTTCTCATTATCTGTCTGGGAGATGGGAACCTTGCTTACTCTTGGTCTAACAGATTCGTGCGAGTTCTTTCATGACCCTTTCAAGGGGAGGAGCGATGAAGGTAAAGTGCGCAAGGTTCTAAAGGTTGAGCCAACACCAGATGGCAACGGTCGCTTTTTCAACCTCAGTGTTCAAAACCGTCTTTTGAACGTTGATGAGAACATTTACATCCCTATAACCAAAGGAGAATATGCGGTCATTGTATCGACTTTCAATTACATCATACCGCACATCATGGGCTGGAGCACGTTTACAAATTCTATCAAGCCCGAGGAGTCGCAGCCATACAATAGGCCGCAGTCCTCTCCCGAATTGGAGTGGCGAAGGTGAAGAATGACAGCACTCTCGGAGGGAGATGGCAGGAAGAATGATACTTTTGGCGGTCTTCCTTCCAGAAAAGAAATTTTTGGTGGTGGTGTTTGGAAAGTATTTTGGTGCATAATTTGGCTGGTAATTTCTGGTTTAGTTATTAGGAAGTTAATGTTTTTGGTTCTGCCATATTCGTTTGGTTTCTCATTACAGCTGGCGGGAGTTGTGTTAGTCAAATACCTAGTCATCACTTCTTAATGCAGGAATGGCTTTACATGAGACTTATTATTGCAAAAAAAAAAAAAAAA

SEQ ID NO: 4391 - DNA, 1831 bp, Triticum aestivum
  misc_feature (1)..(1831): Ceres cDNA ID no. 21705309
  misc_feature (1)..(1831): Ceres CLONE  ID no. 940673
  misc_feature (1)..(1831): Also known as  Ceres CDNA ID no. 25088347
ccctgaccgaaagcgtcgacggaccggaccacacacagtcgacatccactactccacacccccacaacacatccagtcggcgacaccatgacccgccgccgccgccgccgcggcgctcgccccgcctcggccccggcggcgctggaagacgacgacctcctacggaagattttcctcctcctcccgcctcatccctccacccttccccgcctctccgtcgtctgcaagcagtggcgcgacgtcgtcaccgacccccaattcctccgcggcttccgcgaccaacaccggaaacctcccctcctcggcctcgtaatgggccacaccgggcaccgctacttcaggtccgatctcgaccctccagaccacatcccgcacgagcgcttcttccctcgagacatccgcagcatgaacatggacatattcgactgccgccatgggcgcgtcgtcttcttcgcccaacagctgggcgaggtcgtgctgtttgaccccgccacgggaggccgccgttgtgtggtcgttccaccagtgtttaccggaaaggagattggcgtcttcaacgccgccgtgatttgcgtttccggcgacgaaggccacgtgcacggcgattgccacaccagcccatttcaggtggtcttgatgggcatcagtgacgactatagacaagctttcgcctctgtctactcatcggagtctggcatatggggcgatatcatctccattgagaatcgtgagatgtatgatttgaggcaacccagtacacttattggaaatgccctttactggttgtttcctggagatgttggggaaggcatactggagtttgatttgggtaggcagagcctagccaacatagagatgccgcacggtctggagtactataggcatcgcagtcttcaggtcattttagcagacgatggctgtgtcggcctcgccattttgtcgtgctataaatttgaaatgtgggagaggaaggtcagttgtgatgatggtgttgctggatgggtattgcagaagaccattcaactgaacacgatccttggattggggcctatggggggactgcacaatttattaatggggtatgatgaagttgatcatgtgatttatataaggacggacatcggtttctgcatggttcgacttgagtcaatgcagtccaggaatctcggcaaagagaatttcagcaatactgcctatcttccctacagaagtttctatactgcagtgagtgacttggcggtatgcgagagggggactggtgacctctttgcacctcttgcggatgattacctccttgcttcatggggtgtaggagcagtaggaggtaacgaagcagctacctcgagtgaaaccttaccggaaggaggaacgttcggcaagccaaagcacgaagatcaaggaatggatgcagatcttgtgcctagccgggtactcaagcaaactcgaattgatgtgatgttcaagaaggagacggagacaagatcaaaacttagcaaagcttgggcaaaatggtttcggagcaatggtgttcctggaaataaagcagactgcccacacttccgtagtgccttgaagctaacacaggagctaggtacccgcttcattgttcctacaggcaacgaaatagacggtgcagatctggatgccagtgatgaagaacttccataggtatttggaaggcagactgcttgaggatatgggaagtttaactagtttatatcatattttggacaaacagattttggctatgaactgatgatccatgcttttgtaagttgggtgtagggctagttgagtaatgcttcatgaaagtgcaaaaaaaaaaaaaaaa

SEQ ID NO: 4392 - protein, 526 aa, Triticum aestivum
  misc_feature: PFam Name: F-box; PFam Description: F-box domain
  misc_feature: PFam Name: Extensin_2; PFam Description: Extensin-like region
  misc_feature: PFam Name: FH2; PFam Description: Formin Homology 2 Domain
  misc_feature: PFam Name: 7tm_1; PFam Description: 7 transmembrane receptor
  misc_feature: GI Number: 34914028; NR Description: OJ1014_G12.29 [Oryza sativa (japonica cultivar-group)] >gi|20146312|dbj|BAB89094.1| OJ1014_G12.29 [Oryza sativa (japonica cultivar-group)] >gi|21328077|dbj|BAC00661.1| B1144D11.8 [Oryza sativa (japonica
  misc_feature: GI Number: 17945382; NR Description: RE17165p [Drosophila melanogaster] >gi|21355745|ref|NP_647902.1| CG15021-PA [Drosophila melanogaster] >gi|23093008|gb|AAF47902.2| CG15021-PA [Drosophila
  misc_feature: GI Number: 14017929; NR Description: KIAA1856 protein [Homo
  misc_feature: GI Number: 42657819; NR Description: PREDICTED: KIAA1856 protein [Homo sapiens] >gi|42658190|ref|XP_379774.1| PREDICTED:
  misc_feature: GI Number: 5852176; NR Description: zhb0006.1 [Oryza sativa
MTRRRRRRGARPASAPAALEDDDLLRKIFLLLPPHPSTLPRLSVVCKQWRDVVTDPQFLRGFRDQHRKPPLLGLVMGHTGHRYFRSDLDPPDHIPHERFFPRDIRSMNMDIFDCRHGRVVFFAQQLGEVVLFDPATGGRRCVVVPPVFTGKEIGVFNAAVICVSGDEGHVHGDCHTSPFQVVLMGISDDYRQAFASVYSSESGIWGDIISIENREMYDLRQPSTLIGNALYWLFPGDVGEGILEFDLGRQSLANIEMPHGLEYYRHRSLQVILADDGCVGLAILSCYKFEMWERKVSCDDGVAGWVLQKTIQLNTILGLGPMGGLHNLLMGYDEVDHVIYIRTDIGFCMVRLESMQSRNLGKENFSNTAYLPYRSFYTAVSDLAVCERGTGDLFAPLADDYLLASWGVGAVGGNEAATSSETLPEGGTFGKPKHEDQGMDADLVPSRVLKQTRIDVMFKKETETRSKLSKAWAKWFRSNGVPGNKADCPHFRSALKLTQELGTRFIVPTGNEIDGADLDASDEELP

SEQ ID NO: 4393 - DNA, 1436 bp, Triticum aestivum
  misc_feature (1)..(1436): Ceres cDNA ID no. 21705310
  misc_feature (1)..(1436): Ceres CLONE  ID no. 941012
  misc_feature (1)..(1436): Also known as  Ceres CDNA ID no. 25088348
ctagcggtcaatcagccgccgccgccgccgcgacgcgatgctccatctccggaagctcttcctctccgcatctcatgtccgcacaccctccctctcgcccctttccccgctccaccgcctcctcgccgccaccgcacccgcatccccagagccgttcgccgtcgaggactacctcgtcaccacctgcggcctctcccggcccaaggcgcgcaaggcgtccaagaagctcgcccacctcaagtccccctccaagatcgacgccgtcctcgccttcctcgccgcgctcggcatctccccctcaggcaccgccgccatcgtcgccgccgacccgcagttcctctgcgccgatgtggagctgaacctggccaagcgcgtcgccgagctcacggtcctcggcctcaagcgctcccagatcgcgcgtctcatcccgctcgcccgcgccaccttccgcagctcctccctcggccccaacctcgccttctggctcccggtcttcggctccttcgagaagctcctcggggccatcaaggtgaacggcggcatcctcggagcggacctcgagaaggtcgccaagcccaacctggccatcctccagcaatgcgggataagtgtccaagaattttcagatacataccttacccgggtgctcactcggctccccgagtacgtccagagtgccgtgctatacatcgataagcttggcgtgccccgggattccccaatgtttcgctatgcgatcatggcgttcgcgtttcagagccaggagaaaattgacaggaaaatggggatccttgaaatgcttggttggtcacaggatgatgtgttgactgctgtgaggaagatgccgtgtatcctcactatgtccgaggaaaggatgcagacagctgtgaatttcttgacaagggatgttgggctggagataccctatatagctcaaaggccagttctggtcatgtatagctatgagcgccggttgctgccacggcattccttgctaaatattctcaactcgaaggatttgctttatcctgagcttgacttctattctattgttgcactaactgagaagaagtttctggacaagtatgtgcatccttatgagaagagtattccaggccttgctgcaacttatgcatcttactgtgctgagaaggtgccgaatgaagtttctacctgaaaagacaagatggaaaaagagactctgtgcatgcttggtctgggagcatgttgctggattgtcgtgttggaataacatttaaggtttgtcacccccttgacccatgtttcgaatgttcatcagtttgctatgggtgatactgtgtaacaccgcctagttaacgaatagcagagcaacaaatgtgatcagcatctagatagacatggattgtggagtgccatttccagtgaacatggttgatctaaaaaaaaaaaaaaaa

SEQ ID NO: 4394 - protein, 379 aa, Triticum aestivum
  misc_feature: PFam Name: mTERF; PFam Description: mTERF
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: GATase_2; PFam Description: Glutamine
  misc_feature: GI Number: 51536070; NR Description: mitochondrial transcription termination factor-like [Oryza sativa (japonica
  misc_feature: GI Number: 51536073; NR Description: mitochondrial transcription termination factor-like [Oryza sativa (japonica cultivar-group)] >gi|51535003|dbj|BAD37287.1| mitochondrial transcription termination factor-like [Oryza sativa (japonica
  misc_feature: GI Number: 51536063; NR Description: mitochondrial transcription termination factor-like [Oryza sativa (japonica
  misc_feature: GI Number: 51536067; NR Description: mitochondrial transcription termination factor-like [Oryza sativa (japonica
  misc_feature: GI Number: 51536066; NR Description: mitochondrial transcription termination factor-like [Oryza sativa (japonica
MLHLRKLFLSASHVRTPSLSPLSPLHRLLAATAPASPEPFAVEDYLVTTCGLSRPKARKASKKLAHLKSPSKIDAVLAFLAALGISPSGTAAIVAADPQFLCADVELNLAKRVAELTVLGLKRSQIARLIPLARATFRSSSLGPNLAFWLPVFGSFEKLLGAIKVNGGILGADLEKVAKPNLAILQQCGISVQEFSDTYLTRVLTRLPEYVQSAVLYIDKLGVPRDSPMFRYAIMAFAFQSQEKIDRKMGILEMLGWSQDDVLTAVRKMPCILTMSEERMQTAVNFLTRDVGLEIPYIAQRPVLVMYSYERRLLPRHSLLNILNSKDLLYPELDFYSIVALTEKKFLDKYVHPYEKSIPGLAATYASYCAEKVPNEVST

SEQ ID NO: 4395 - DNA, 1674 bp, Triticum aestivum
  misc_feature (1)..(1674): Ceres cDNA ID no. 21705312
  misc_feature (1)..(1674): Ceres CLONE  ID no. 942251
  misc_feature (1)..(1674): Also known as  Ceres CDNA ID no. 24369367
ccccccctcccctcgcctcgcctccccttccttccttcttccccacgcgcacgcgcaacgcggccgccgcacactcaaacctcccacccctctcccctctccccctctctctccccccacaccgcccaagaagaggtctcaggagccgccatggactgctgcttcccctgcctgggcgccaggaagaagcgcaagacgccggcgcggccggagaagccccagatccctcccgccgcagacaataaagcgaagccggggtgctcctcgtcgtcgacgagcgcggcggcggcggcgcggcaggactcgctgtcggaggccaagaaggagttcgtcctcagcaacgggtccgagcaccgccacattgccgcgcagaccttcaccttcagggagctcgcggcggcgaccaacggtttcagggccgactgccttctcggggagggtggcttcggccgggtctacaaggggtacctggagagcatcaaccaggttgtcgccataaagcagctcgatcgaaatggactgcaaggcaacagggagtttcttgttgaggtcctcatgctgagcttgctgcaccacccacacctggtcaaccttattggctattgcgccgatggcgaccagaggcttttggtttacgagtatatgccgctgggttctttggaagaccaccttcacgatccttccccagataaaccccgccttgactggaatacacggatgaagatagccgctggtgcagctaaagggctggagcatttgcatgacaaaacaaatcctcctgtcatataccgggacttgaaatgttcaaacatcttgctcggagagggataccacccaaagctgtctgactttggattggcaaagcttggcccagttggtgataagacacatgtttccaccagagtgatgggtacatacgggtattgtgcccccgagtatgctatgactggtcagctgactctgaagtcagatgtttacagctatggtgttgttctattggagatcatcacaggacgaagggctatcgacaacacccgagctgcgggggagcaaaatcttgttgcatgggcccggcccttgttcaaggacaggaggaagttcccccagatggcagacccggcgctggagggctggtacccgccaaggggactgtaccaggccctggccgtcgctgcaatgtgcgtgcaagaacagccgaccctgagaccgttgatcggcgacgtcgtcacagccctgagctaccttgcctcccagccctacgatccggaggtgcacggcgtccaccgcccgtcgcgcctgacggcttccggcacgccgccccgagcccggaaccacggcgccgatcatcaaagaggaggaagcgagtgaggttgggcggctttgggagaagcctgaattttgtggcgatacgagtccagaatggagctgaagaggaattttgtggatagcaaggcggcttttgcggttacatgttgggaggaattgtgaatcggtgatgtatgttgatcagttggtctatctgttggagatggtgcttagagatgatgcatgcatgtgctctccggtcgaagtctgtatctaggtagatgatgaggcagtcggtgtaaccacccatgactttacagttcgatcagtctatggactaccatttctccttcaaaaaaaaaaaaaaaa

SEQ ID NO: 4396 - protein, 405 aa, Triticum aestivum
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase family
  misc_feature: GI Number: 30679773; NR Description: protein kinase family
  misc_feature: GI Number: 7413555; NR Description: protein kinase-like [Arabidopsis thaliana] >gi|11259782|pir||T48301 protein kinase-like
  misc_feature: GI Number: 37625033; NR Description: protein kinase-like
  misc_feature: GI Number: 10445209; NR Description: protein serine/threonine
MDCCFPCLGARKKRKTPARPEKPQIPPAADNKAKPGCSSSSTSAAAAARQDSLSEAKKEFVLSNGSEHRHIAAQTFTFRELAAATNGFRADCLLGEGGFGRVYKGYLESINQVVAIKQLDRNGLQGNREFLVEVLMLSLLHHPHLVNLIGYCADGDQRLLVYEYMPLGSLEDHLHDPSPDKPRLDWNTRMKIAAGAAKGLEHLHDKTNPPVIYRDLKCSNILLGEGYHPKLSDFGLAKLGPVGDKTHVSTRVMGTYGYCAPEYAMTGQLTLKSDVYSYGVVLLEIITGRRAIDNTRAAGEQNLVAWARPLFKDRRKFPQMADPALEGWYPPRGLYQALAVAAMCVQEQPTLRPLIGDVVTALSYLASQPYDPEVHGVHRPSRLTASGTPPRARNHGADHQRGGSE

SEQ ID NO: 4397 - DNA, 2413 bp, Zea mays
  misc_feature (1)..(2413): Ceres cDNA ID no. 21705314
  misc_feature (1)..(2413): Ceres CLONE  ID no. 988464
  misc_feature (1)..(2413): Also known as  Ceres CDNA ID no. 23865982
gtcgtctccgtcctctgtttcgcagccatcctgacgccagcccccgccgctgtagcagcagcagcatcaggggacgcggacggaggaggaggaggagaaggcggcgtcatcaggatcaggactgccgctgtcgccagattagttgaagggtgggcctagtgcagcggtagagcctaccgtctgtaaccggaaggtcccgggttcgagccctagcctctacatattatgcgggcatggccatcaaaatgtaaatggttgcccttacagaacagtgggaggtgtctttcgtatactcatgtttgcaaataccacaagatttggaaggacacgaagccatttatttctgcaaaagatgccctgaagaaagaaccaattagcgatgtgattgctttaaaggattccatgaagtactttgatgctgagttcttcaatgattcaaaactacgtgagatggaagatggtgcaaaggaattcaatgtacccgcattcagagaaaatcggaaattggttgcgacggagaatggtgggttgcacaacccttctgttttactcttcaaatcatcatggagtagtggcagtatgacaagtgagactagaagtttcgagtaccctcgtgcgtcttctgtacatcgtccaactaatgatgaagatattgcatttatgtcggtaatcgagcttggagagcttattaggacaaagcaaataacatcacgtgaacttacagatatatttctgaggagattaaagaggtacaatcctgttctagaagctgttattacatatactgaagatttagcatacaaacaagccaaggaggcagatgacttgctggcacaaggaaaatatcttggtcctttgcatggcattccatatggcctcaaagatataattgcggtaccacactataagaccacttggggctcaaggacgtttaaaaaccaagtccttgatagtgaagcttatgtgtacagaagattgaagtccgctggagcagtcctggtagcaaagcttgtcacgggctcacttgcctatgatgacatatggtttgggggaaggacacgaaacccttggaacatcgaggaattctctactggctcatcggcaggtccagcggctagcacctctgcaggaatggttccatttgcaattggttcagaaactgcaggatccatagcatacccagccgctagatgtggagtaactgcattgcgcccaacatttggaacagttgcacgaaccgatgtcatgagcatttctgagagtttggataagcttggtcctttctgtagaagcgcagtagattgtgctgttgtattagacacaattcgcggaacggatgccggtgatccatcatcgcgtgaggttgctttgggtgatccatttcatgttgacatcaccaaactcactgtaggctacctcgatgacgctgagatggaggttgtcgatgttctttcctctaaaggtgtcaagctggtccccttcaagctgaactacactgtggaatcagtccagtccatcctgaacataacgatggacactgatatgcttgcgcacttcgataactggcagcgggaaggacatgatgatgactatgaggcgcaagaccagtggccggtagagcttcgtcgtgcacggttaatcccagcggtagattatatacaggcgcagcgagcacggggcaagttgatcagagaaatcaaagatagcttcactgttgatgcgtttgttggcaacgtgactgactgggagcgtgtctgtctcgggaaccttgttgggatgcctgtggtcgtggtgccgacaggcttgaagagcatcgagaacccgcctaaaggcggtaccaagagaagaacaacagtgacgacaggcatctacgctcctcctgaccacgaccacattgctctggcgctggcaatggcgtaccagtccgtcactgatcacaacaaacagcggccgccgatcgatgatctggggccgaatgatgtcatacaaagatagttcaacctgctcatggaccgcgatgatccggtgatggtagcacgagggtcgttatggttatggaagctgaagttgaagacgatcagtgagccagaatggctggccacctggcagaagacatcagctgtggaagtatcaagtaccaatccacatacgggcttcttcatcagctcaaataactcagcacgtttttttttctgaagcaggcagcattgtatcaccttaacatacgttacaaaggaggttctggatttcatctggggcctcatcagaccaaaccgagccaaagaactgatcagctagcctagccattacatgagctgcaacttctctgggagggtatttgatttctatggactagtccatctattttattctaaaaatttttattctattttagttaaaaaaaaaaaaaaaa

SEQ ID NO: 4398 - protein, 589 aa, Zea mays
  misc_feature: PFam Name: Amidase; PFam Description: Amidase
  misc_feature: GI Number: 42567719; NR Description: amidase family protein
  misc_feature: GI Number: 27529830; NR Description: amidase-like protein
  misc_feature: GI Number: 2462927; NR Description: putative amidase
  misc_feature: GI Number: 7576174; NR Description: putative amidase [Arabidopsis thaliana] >gi|11358634|pir||T49875 probable amidase -
  misc_feature: GI Number: 66776780; NR Description: Amidase [Anaeromyxobacter dehalogenans 2CP-C] >gi|66857431|ref|ZP_00401481.1| Amidase [Anaeromyxobacter
MRAWPSKCKWLPLQNSGRCLSYTHVCKYHKIWKDTKPFISAKDALKKEPISDVIALKDSMKYFDAEFFNDSKLREMEDGAKEFNVPAFRENRKLVATENGGLHNPSVLLFKSSWSSGSMTSETRSFEYPRASSVHRPTNDEDIAFMSVIELGELIRTKQITSRELTDIFLRRLKRYNPVLEAVITYTEDLAYKQAKEADDLLAQGKYLGPLHGIPYGLKDIIAVPHYKTTWGSRTFKNQVLDSEAYVYRRLKSAGAVLVAKLVTGSLAYDDIWFGGRTRNPWNIEEFSTGSSAGPAASTSAGMVPFAIGSETAGSIAYPAARCGVTALRPTFGTVARTDVMSISESLDKLGPFCRSAVDCAVVLDTIRGTDAGDPSSREVALGDPFHVDITKLTVGYLDDAEMEVVDVLSSKGVKLVPFKLNYTVESVQSILNITMDTDMLAHFDNWQREGHDDDYEAQDQWPVELRRARLIPAVDYIQAQRARGKLIREIKDSFTVDAFVGNVTDWERVCLGNLVGMPVVVVPTGLKSIENPPKGGTKRRTTVTTGIYAPPDHDHIALALAMAYQSVTDHNKQRPPIDDLGPNDVIQR

SEQ ID NO: 4399 - DNA, 711 bp, Glycine max
  misc_feature (1)..(711): Ceres cDNA ID no. 21705315
  misc_feature (1)..(711): Ceres CLONE  ID no. 1023219
  misc_feature (1)..(711): Also known as  Ceres CDNA ID no. 24367457
gccaacgcaccagcacaaccgatcgctgatctcagattacctgcggcttctctccttcgttccttggtttggtctgctctgatcggcatggcgacccagatggacgcgtacgtgatgttccgccgcgccgcggagatgatgatggtggcgccgcccggggccgcctacgacgagcaggacgaggacatcggctccgcgtccgactccgagtgcacgtcgacgtcctcctcctccgacctcgccgacgacgccagctcctcgtcctcctcctccagctccggtgaccacttcgagatgtccgccctcatgacgcagctccccatcaagaggggattgtccatgttcttcgacggcaagtcgcagtcgttcgcgtcgctggcggccgtggcctccctggaggacttggccaagccggccaagaagcgcctcaagccgtcgcggagctgcgagggcggcctggacgcgcaccgtggcaggttcctctcgccgcgccggcattgctccaaggccgccgccgcaagtaaggcgtccgcgagggccgccctctcagtgctcggcacctcgccgaggaccgcgaggctggccgccaactccctcatgtttagctaggttctgtaccactgttaggtgttcgtgttcttcgtagagggagatgtattaggatcccataatggaaataccatccaccttcagcgaaaaaaaaaaaaaaaa

SEQ ID NO: 4400 - protein, 711 aa, Glycine max
  misc_feature: PFam Name: FH2; PFam Description: Formin Homology 2 Domain
  misc_feature: PFam Name: Extensin_2; PFam Description: Extensin-like region
  misc_feature: PFam Name: Drf_FH1; PFam Description: Formin Homology Region 1
  misc_feature: PFam Name: Pyr_redox_2; PFam Description: Pyridine
  misc_feature: PFam Name: 7tm_1; PFam Description: 7 transmembrane receptor
GCCAACGCACCAGCACAACCGATCGCTGATCTCAGATTACCTGCGGCTTCTCTCCTTCGTTCCTTGGTTTGGTCTGCTCTGATCGGCATGGCGACCCAGATGGACGCGTACGTGATGTTCCGCCGCGCCGCGGAGATGATGATGGTGGCGCCGCCCGGGGCCGCCTACGACGAGCAGGACGAGGACATCGGCTCCGCGTCCGACTCCGAGTGCACGTCGACGTCCTCCTCCTCCGACCTCGCCGACGACGCCAGCTCCTCGTCCTCCTCCTCCAGCTCCGGTGACCACTTCGAGATGTCCGCCCTCATGACGCAGCTCCCCATCAAGAGGGGATTGTCCATGTTCTTCGACGGCAAGTCGCAGTCGTTCGCGTCGCTGGCGGCCGTGGCCTCCCTGGAGGACTTGGCCAAGCCGGCCAAGAAGCGCCTCAAGCCGTCGCGGAGCTGCGAGGGCGGCCTGGACGCGCACCGTGGCAGGTTCCTCTCGCCGCGCCGGCATTGCTCCAAGGCCGCCGCCGCAAGTAAGGCGTCCGCGAGGGCCGCCCTCTCAGTGCTCGGCACCTCGCCGAGGACCGCGAGGCTGGCCGCCAACTCCCTCATGTTTAGCTAGGTTCTGTACCACTGTTAGGTGTTCGTGTTCTTCGTAGAGGGAGATGTATTAGGATCCCATAATGGAAATACCATCCACCTTCAGCGAAAAAAAAAAAAAAAA

SEQ ID NO: 4401 - DNA, 1293 bp, Triticum aestivum
  misc_feature (1)..(1293): Ceres cDNA ID no. 21705316
  misc_feature (1)..(1293): Ceres CLONE  ID no. 1041640
  misc_feature (1)..(1293): Also known as  Ceres CDNA ID no. 24369515
ctggcccgcctctcactgtcactcacttgtagctagagtgaccagtgaggcagcagcagcttgtagctatagctgccttctccccacgggaaaccaaaattcgattccaacacgcacgcgcaagcaccgcacctctgagcggctgagctccagggccagggccagggccatggagcagcggagaaggggcagctgcttctgcttgctcgccgtgacggcggtggtggtggtggcggcggcgtccggcggcgaggcgaagctgtcgccggaccactaccgcaggacgtgcccgcgcgtggagtcgatcgtgcggtcggccgtggccaggaaggtgagggcgaccttcgtcaccgtccccgccacgctcaggctcttcttccacgactgcttcgtccagggctgtgacgcgtcggtgatgatcgcgtcaagcagcaacgacgccgagaaggacgcgccggacaaccagtccctcgccggcgacggcttcgacaccgtcgtgcgcgccaaggccgccgtcgagaaggcatgccccggcgtcgtctcctgtgccgacatcctcgccctcgccgcccgggacgtcgtctccatgtcgtcgggcccgagctggaaggtggagctcggccggctggacgggctcgtctccaaggccggcgacgtcacgggcaggctaccgggcccagacatgcagccggacgccatcaccgcgctgttcgacggcaacggcctcgccgtgcgcgacatggtcgcgctctcgggcgcgcacaccgttggcttctcccactgcgagcgcttcgccggccggctctaccggcacggcgcggtggacccgtcgttgagcccgtcgtacgcgcggcagctgatggcggcgtgcccgccggacgtcgacccgaccatcgccgtcgacatggaccccgtcacgcccaccgtcttcgacaacaaatactacgccaacctggccgcgggcctggggctgttcgcctccgaccaggcgctgcacgacggcgccgcgtcgcggccggccgtggaggggttcgccgggaaccagacgctcttcttcgaggcgttcaaggaggccatggtgaagctcgggagggtcggggtgaagagcggcggggacggggagatcagacgagactgcaccgcgttcaactagtaggagaggaaaccggccgccaggcacggtgacactagctggtactgtaactgagaagaaaagttataaggtctcgatgcattgataaaacaattttttttttataaatgcaccgcacgtaagcaaaaaaaaaaaaaaaa

SEQ ID NO: 4402 - protein, 327 aa, Triticum aestivum
  misc_feature: PFam Name: peroxidase; PFam Description: Peroxidase
  misc_feature: PFam Name: Peptidase_S8; PFam Description: Subtilase family
  misc_feature: PFam Name: HlyD; PFam Description: HlyD family secretion protein
  misc_feature: GI Number: 55701113; NR Description: TPA: class III
  misc_feature: GI Number: 50947943; NR Description: putative peroxidase [Oryza sativa (japonica cultivar-group)] >gi|42761386|dbj|BAD11654.1| putative peroxidase [Oryza sativa
  misc_feature: GI Number: 34915320; NR Description: putative peroxidase [Oryza sativa (japonica cultivar-group)] >gi|22831350|dbj|BAC16194.1| putative peroxidase [Oryza sativa
  misc_feature: GI Number: 28629828; NR Description: peroxidase 1 [Artemisia annua]
  misc_feature: GI Number: 971564; NR Description: peroxidase2 [Medicago sativa] >gi|2117624|pir||JC4782 peroxidase (EC 1.11.1.7) 2
MEQRRRGSCFCLLAVTAVVVVAAASGGEAKLSPDHYRRTCPRVESIVRSAVARKVRATFVTVPATLRLFFHDCFVQGCDASVMIASSSNDAEKDAPDNQSLAGDGFDTVVRAKAAVEKACPGVVSCADILALAARDVVSMSSGPSWKVELGRLDGLVSKAGDVTGRLPGPDMQPDAITALFDGNGLAVRDMVALSGAHTVGFSHCERFAGRLYRHGAVDPSLSPSYARQLMAACPPDVDPTIAVDMDPVTPTVFDNKYYANLAAGLGLFASDQALHDGAASRPAVEGFAGNQTLFFEAFKEAMVKLGRVGVKSGGDGEIRRDCTAFN

SEQ ID NO: 4403 - DNA, 997 bp, Glycine max
  misc_feature (1)..(997): Ceres cDNA ID no. 21705317
  misc_feature (1)..(997): Ceres CLONE  ID no. 1044073
  misc_feature (1)..(997): Also known as  Ceres CDNA ID no. 24367479
acccaagcccctctctccgaagttgggaacatgagttggcggtcggtgaggggaagccgtaagaggaagatggatttcgaactggacctcaaccgtgatccgccgctggttcgagaagaggaggaggaggaggaggagggggggccctcaaggcatcagcagcaccaccaccaccaacaagaacctcaaactcccattgtcgatgtcgacgccattgacgacgatgttgttgaaagctcgcctaggtctttcgctcaggctaagagcaatgctgatgagaggaggagagttcgcaggaggacgactattgttgatttggactcagaagatgggaccggaggagttcctcaaaaccaaacaatcatcaatggcgatctttatgtaaatttggccaacaacagcagttctgcgagtgaaaatgctaagaagacacctgaacctcccaaggagcctgaagctcctaaggagcctgtttttaattgcccaatatgtatgtcccctttggttgaagaaatgtcaacaaggtgtggtcatattttttgcaagaattgcatcagggctgctatatctgcacaggctaaatgccctacctgtagaaaaaaggttacaaagaactcactaataagggtgtttcttcctgcaactagttaaaggatctctatccaatcattaattgaggagaatcaggatttaggaatgtgagaagaagcttcattgtactctgcagaatgctgagtggctctgttgttgctgacatgtttgttgtagcggatgcttatttattttcaaggagctgtttctcctcattaatttgtcatgtaatacatagggatgctctgttttttatttaaattgttcataaacctcagttttttttactttttatatttattggtcaaagaataatcttataaacaatttatgaatgtgtagtttttttttttttttgtcataatatcaatatgaaatatccattagctgaaaaaaaaaaaaaaaa

SEQ ID NO: 4404 - protein, 997 aa, Glycine max
  misc_feature: PFam Name: zf-C3HC4; PFam Description: Zinc finger, C3HC4
  misc_feature: GI Number: 21537318; NR Description: unknown [Arabidopsis thaliana]
  misc_feature: GI Number: 6642645; NR Description: putative RING zinc finger protein [Arabidopsis thaliana] >gi|15231414|ref|NP_187376.1| zinc finger (C3HC4-type RING finger) family protein [Arabidopsis
  misc_feature: GI Number: 50902376; NR Description: P0678F11.16 [Oryza sativa (japonica cultivar-group)] >gi|19386727|dbj|BAB86109.1|
  misc_feature: GI Number: 61097975; NR Description: similar to RING finger
  misc_feature: GI Number: 50747306; NR Description: PREDICTED: similar to
ACCCAAGCCCCTCTCTCCGAAGTTGGGAACATGAGTTGGCGGTCGGTGAGGGGAAGCCGTAAGAGGAAGATGGATTTCGAACTGGACCTCAACCGTGATCCGCCGCTGGTTCGAGAAGAGGAGGAGGAGGAGGAGGAGGGGGGGCCCTCAAGGCATCAGCAGCACCACCACCACCAACAAGAACCTCAAACTCCCATTGTCGATGTCGACGCCATTGACGACGATGTTGTTGAAAGCTCGCCTAGGTCTTTCGCTCAGGCTAAGAGCAATGCTGATGAGAGGAGGAGAGTTCGCAGGAGGACGACTATTGTTGATTTGGACTCAGAAGATGGGACCGGAGGAGTTCCTCAAAACCAAACAATCATCAATGGCGATCTTTATGTAAATTTGGCCAACAACAGCAGTTCTGCGAGTGAAAATGCTAAGAAGACACCTGAACCTCCCAAGGAGCCTGAAGCTCCTAAGGAGCCTGTTTTTAATTGCCCAATATGTATGTCCCCTTTGGTTGAAGAAATGTCAACAAGGTGTGGTCATATTTTTTGCAAGAATTGCATCAGGGCTGCTATATCTGCACAGGCTAAATGCCCTACCTGTAGAAAAAAGGTTACAAAGAACTCACTAATAAGGGTGTTTCTTCCTGCAACTAGTTAAAGGATCTCTATCCAATCATTAATTGAGGAGAATCAGGATTTAGGAATGTGAGAAGAAGCTTCATTGTACTCTGCAGAATGCTGAGTGGCTCTGTTGTTGCTGACATGTTTGTTGTAGCGGATGCTTATTTATTTTCAAGGAGCTGTTTCTCCTCATTAATTTGTCATGTAATACATAGGGATGCTCTGTTTTTTATTTAAATTGTTCATAAACCTCAGTTTTTTTTACTTTTTATATTTATTGGTCAAAGAATAATCTTATAAACAATTTATGAATGTGTAGTTTTTTTTTTTTTTTGTCATAATATCAATATGAAATATCCATTAGCTGAAAAAAAAAAAAAAAA

SEQ ID NO: 4405 - DNA, 1333 bp, Glycine max
  misc_feature (1)..(1333): Ceres cDNA ID no. 21705318
  misc_feature (1)..(1333): Ceres CLONE  ID no. 1044433
  misc_feature (1)..(1333): Also known as  Ceres CDNA ID no. 24367861
agagggatacgtaccatatcgaggatcctgattcagtacttcattgcagtgataagttattgtactctttctaatagtaatgggtatccatttgaacagggtcatcaataatgttgggattgtgcttcgatttttcgtagtcttggtcctgttttttagcatttcaacttcagacgatctccctgcaacttttgtattcggagattcccttgttgacgtgggaaacaataattaccttgtttccctctcaaaggctaattatctacccaatggcattgattttggaagaccaacgggaaggttcactaatggaagaaccatcgtggacatagttggtcaggaattgggtaccggtttcaccccaccttacttggcaccctccacaattggaccagtagttctgaagggtgtaaactatgcttctggtggaggtggaattctcaatttcactggaaaagtctttggtggtcgactgaacttcgacgcacagatagataattttgcaaataccaggcaagacatcatatcccacattggagctcctgcggctcttaatctactcaagagggcattgctcaccgtgacaataggctcaaatgatttcataaataactacttagcaccagcactcacattttccgagcggaaatcagcgtctccagaaatctttgtgaccaccatgatatcaaaactcagagttcagctcactaggttattcaatctgggagctagaaaatttgttgtggcaaatgtggggcctattgggtgtataccaagccagagggatgcaaacccaggtgcaggagatagctgtgttgctttccccaatcagctagcacagttatttaattcccagttaaagggcattattatagatctcaactcaaatttggagggtgcagtgtttgtttatgcagatgtctaccaaattttagaagacattctccagaattatttagcacttggttttgataatgcagtttctgcttgctgtcacgtggctgggcgctttggaggtctgatcccctgtggtcctacatcgagactttgctgggaccgatctaagtatgttttttgggacccttaccatccttctgatgctgcaaacgttatcatcgctaagcgtctcttagatggtggttccaattatatttggccaaagaacattcgccaactctttcaatcttaaacctgtttcttccggtgacaatggatgcttggaggagtcatgacattttctgattgaaatcacgggaaaataatgtatttatagatgtccataataattgaagcggaggagtgggtatttaatctttcaaaaaaaaaaaaaaaa

SEQ ID NO: 4406 - protein, 369 aa, Glycine max
  misc_feature: PFam Name: Lipase_GDSL; PFam Description: GDSL-like
  misc_feature: GI Number: 22136366; NR Description: putative GDSL-motif lipase/hydrolase [Arabidopsis thaliana] >gi|20466296|gb|AAM20465.1| putative GDSL-motif lipase/hydrolase [Arabidopsis thaliana] >gi|3242717|gb|AAC23769.1| putative
  misc_feature: GI Number: 7268372; NR Description: proline-rich, APG like protein [Arabidopsis thaliana] >gi|2244981|emb|CAB10402.1| proline-rich, APG like protein [Arabidopsis thaliana] >gi|15234857|ref|NP_193358.1| GDSL-motif lipase/hydrolase family
  misc_feature: GI Number: 21537027; NR Description: unknown [Arabidopsis thaliana] >gi|18417760|ref|NP_568318.1| GDSL-motif lipase/hydrolase
  misc_feature: GI Number: 18086455; NR Description: At1g29670/F15D2_22 [Arabidopsis thaliana] >gi|12323546|gb|AAG51758.1| lipase/hydrolase, putative; 118270-120144 [Arabidopsis thaliana] >gi|15220514|ref|NP_174260.1| GDSL-motif lipase/hydrolase family
  misc_feature: GI Number: 21592417; NR Description: lipase/hydrolase,
MGIHLNRVINNVGIVLRFFVVLVLFFSISTSDDLPATFVFGDSLVDVGNNNYLVSLSKANYLPNGIDFGRPTGRFTNGRTIVDIVGQELGTGFTPPYLAPSTIGPVVLKGVNYASGGGGILNFTGKVFGGRLNFDAQIDNFANTRQDIISHIGAPAALNLLKRALLTVTIGSNDFINNYLAPALTFSERKSASPEIFVTTMISKLRVQLTRLFNLGARKFVVANVGPIGCIPSQRDANPGAGDSCVAFPNQLAQLFNSQLKGIIIDLNSNLEGAVFVYADVYQILEDILQNYLALGFDNAVSACCHVAGRFGGLIPCGPTSRLCWDRSKYVFWDPYHPSDAANVIIAKRLLDGGSNYIWPKNIRQLFQS

SEQ ID NO: 4407 - DNA, 830 bp, Triticum aestivum
  misc_feature (1)..(830): Ceres cDNA ID no. 21705319
  misc_feature (1)..(830): Ceres CLONE  ID no. 1048624
  misc_feature (1)..(830): Also known as  Ceres CDNA ID no. 24369128
gagtcaaacaaacaaacctccccaattccatccccattcccttccccaaaaatttccccaccggcgacgacgccctccccaaatccgatccgccgccgcccgccgttgacgccagccatggccgccgccgcccgccgcgccctgctcctcctcctcgccgccgccgccgtggccctcctcgcggcgcccccggcggccgccgcccgcccctgcggccgcgcgcagacgctgctcatctccttctcctccttctcccgccccaacccggaccccgccgacccgtcgccgctcaccaccaccgtcgtcaccgtcctccgcgtccgccgcctcggcccgcaccgcttccacgcccacgaccagaaccgcctccagatccgccgccccgccgagcccctccccgccgttggcacccccgagcgcgacgccgacgccgacgccgcctcctccttccaggagcgcgccaaggacatcctcgtcgtcgtctcgggcctgctcttcggcttcggctgcggcgccctcaccgccgcctccatgtacctcgtctggtccctcgtcgcctccaccggcgccgccggcccctacgaggagctctacagcgacgacgacgacgaggacaacgtctccgacgacggcgccgagagccccaagaaggccggctacgtcatcatccacggcgccgaggacgtcgccgccgccgccggtaagaactaactaggatcgggccttgccgtcgtcggcaggcagaggattcgggttgcataactacatggaattgtggagtactgttattactatatattcgcacctatgatgcaaaaaaaaaaaaaaaa

SEQ ID NO: 4408 - protein, 197 aa, Triticum aestivum
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
  misc_feature: GI Number: 14253159; NR Description: VMP3 protein [Volvox
  misc_feature: GI Number: 6523547; NR Description: hydroxyproline-rich
  misc_feature: GI Number: 60678627; NR Description: plus agglutinin
  misc_feature: GI Number: 21992; NR Description: extensin [Volvox carteri]
MAAAARRALLLLLAAAAVALLAAPPAAAARPCGRAQTLLISFSSFSRPNPDPADPSPLTTTVVTVLRVRRLGPHRFHAHDQNRLQIRRPAEPLPAVGTPERDADADAASSFQERAKDILVVVSGLLFGFGCGALTAASMYLVWSLVASTGAAGPYEELYSDDDDEDNVSDDGAESPKKAGYVIIHGAEDVAAAAGKN

SEQ ID NO: 4409 - DNA, 1210 bp, Triticum aestivum
  misc_feature (1)..(1210): Ceres cDNA ID no. 21705322
  misc_feature (1)..(1210): Ceres CLONE  ID no. 1065257
  misc_feature (1)..(1210): Also known as  Ceres CDNA ID no. 24369162
ctaccgccgcgcgagactgagcctcgcctaggccccgaatggcgacccagcttctgtccaccgtcgcgcaccgcgataccctcccggagggctacacgcggcccgagaacgaccggccgcagctcgccgatgttgtgactgacagcaacatccccctcatcgacctcgcctcgccggacaagcatcgcgtcatcgctgagatagaccaggcttgccgcacctacggcttcttccagatcataaaccatgggatatcagaggagctgctggagaaggtgatggctgtggggcttgagtttttccggctcccgccggaagagaaggccaagctctattctgatgagccatccaaaaagataaggctttctacaagcttcaacgtccgcaaggagacagtgcacaactggcgggactatctgcgccttcattgccacccgttggaggagttcgtgcccgactggccgtccaatcctgaaacgttcaaggagatcatcagcacctactgctgcgaagttcggctgctcggcctccgactcctgggcgcgatctccctgggcctgggcctcgaggaggactacatcgagaatgtgctgggcgagcaggagcagcacatggccgtgaactactacccgcggtgccctaagccggacctcacctacggcctgcccaagcacacggaccccaacgccctcaccattctcctcatggacccccacgtctccggcctgcaggtcctcaaggacggcgcccagtggatcgccgttgacccccggcccaacgccctcgtcgtcaacctaggcgaccagttgcaggcgctgagcaacggcgcgtacaagagcgtctggcaccgcgcggtggtcaatgcggcgcgggagcgcctgtcggtggcatctttcctgtgcccgtgcaacagcgcggtgatcggcccggtggccaagctcgtcggcgacggggacgagcccgtgtaccgcagctacacctacgacgagtactacaagaagttctggagcaggaacctggaccaggaccattgcctggagctcttcacgggtcagaagtgatccgtgtgcacaagcttgcctcatccacgacgcagcattactcaaataataaatgcccccaatgtgcggggttactcgagttgtttgaacttgtttttgcttgagcacaacgtatttatcgatgttcatcttgtaaaaaaaaaaaaaaa

SEQ ID NO: 4410 - protein, 340 aa, Triticum aestivum
  misc_feature: PFam Name: 2OG-FeII_Oxy; PFam Description: 2OG-Fe(II)
  misc_feature: GI Number: 21553527; NR Description: flavanone
  misc_feature: GI Number: 28827438; NR Description: putative flavanone 3-beta-hydroxylase [Arabidopsis thaliana] >gi|4539409|emb|CAB40042.1| putative flavanone 3-beta-hydroxylase [Arabidopsis thaliana] >gi|7267746|emb|CAB78172.1| putative
  misc_feature: GI Number: 34365697; NR Description: At4g10500 [Arabidopsis thaliana] >gi|4539410|emb|CAB40043.1| putative Fe(II)/ascorbate oxidase [Arabidopsis thaliana] >gi|7267747|emb|CAB78173.1| putative Fe(II)/ascorbate oxidase [Arabidopsis thaliana]
  misc_feature: GI Number: 50916346; NR Description: Putative flavanone 3-hydroxylase [Oryza sativa (japonica cultivar-group)] >gi|25446682|gb|AAN74829.1| Putative flavanone 3-hydroxylase [Oryza
  misc_feature: GI Number: 50932077; NR Description: putative leucoanthocyanidin dioxygenase (EC 1.14.11.-) [Oryza sativa (japonica cultivar-group)] >gi|46391159|gb|AAS90686.1| putative leucoanthocyanidin dioxygenase (EC 1.14.11.-) [Oryza sativa
MATQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEEFVPDWPSNPETFKEIISTYCCEVRLLGLRLLGAISLGLGLEEDYIENVLGEQEQHMAVNYYPRCPKPDLTYGLPKHTDPNALTILLMDPHVSGLQVLKDGAQWIAVDPRPNALVVNLGDQLQALSNGAYKSVWHRAVVNAARERLSVASFLCPCNSAVIGPVAKLVGDGDEPVYRSYTYDEYYKKFWSRNLDQDHCLELFTGQK

SEQ ID NO: 4411 - DNA, 748 bp, Zea mays
  misc_feature (1)..(748): Ceres cDNA ID no. 21705323
  misc_feature (1)..(748): Ceres CLONE  ID no. 1065786
  misc_feature (1)..(748): Also known as  Ceres CDNA ID no. 24365061
ctcctcctaactgctcgcgttgatgcccagcagcgcctcacccttcaagcttctcccggcgccggcgccgtcatcgtccctagccaggtccggcgcaggcccctgcctggttggaaccgccccgtcgccctccccttcctcgccttcgtttggatccgtcgctgtcgtggccttcccggccggatccgacattccccttcttttctgccgcgggcgcggacaccttgaccagcgcagccgcgtgcgctgctgtcggcctctctggcggggctccttgacgtctggtcgatcgaagaagcaggaaggtcggcctgtcggtgcccttttgctgtgtcgccctgccgatcgttgacgctcgaacgtcgacccctcccgaagatcagacttttgctgcgcgtcttccgaccgcgaccacctcgacttcggctacctcggcatctaggggctatcgtcttcttggagcacacaccgttctctactccagccgcaacattcgcaccatcacgacgctgcgactgcggggggatttcaacccgtcggctcctaccttcggcctctactccagtctcatcgtgtgtggtgcccccgttgcgactgcggggggatgttagactatgtgtgtgtgagtgtgtgtgggccggcaccactgttgggctgccggcccattagggttagggttgagtctatatattgtacccattctctatgcaatacaacagttcatcttcctacaaaaaaaaaaaaaaaa

SEQ ID NO: 4412 - protein, 109 aa, Zea mays
MPSSASPFKLLPAPAPSSSLARSGAGPCLVGTAPSPSPSSPSFGSVAVVAFPAGSDIPLLFCRGRGHLDQRSRVRCCRPLWRGSLTSGRSKKQEGRPVGALLLCRPADR

SEQ ID NO: 4413 - DNA, 863 bp, Zea mays
  misc_feature (1)..(863): Ceres cDNA ID no. 21705324
  misc_feature (1)..(863): Ceres CLONE  ID no. 1065830
  misc_feature (1)..(863): Also known as  Ceres CDNA ID no. 24364893
ctttccgcaaaggcccagccgaggcccaccgccaccgccaccgccgtcccgctccacgcgtccgcaccctctgcgcggcgccggtcgagaactcgtgatgccccgcgaccgcgacgagccagccgccgtgcgcgtctacaccgtctgcgacgagtccaggtacctgatcgtgcgcaacgtgccgtcactcggatgcggtgacgacctcgccagtctcttcgggacgtacggccccgtggaggagtgcacgcccatggatgcagaggactctgagccctacactgacgtcttcttcgtcaagttctcacaggtcaacaacgccaggtttgcaaagaggaagcttgacgagtctgtgtttcttggcaaccgcctgcaggtgacctatgcccctcaatttgagagccctcaagataccaaggagaaactggaagttaggagaaaagaagtccttggccgaataaaatcatctgctggcagacctgaaggatcatctccagctcagggatcatctagtgggaatcaccaccaaatgaactctaataagagggaatatatgaagacaattcatgcttctcctattgaagatcctcgtttcagtcatgtgtcctcagacaaggattattttccatccgagtcgatgaatgctactgtaaagctagtcagagggaagcttgataagatacaatctggtggtgataattccagtacctcagcagcatccaggaaaccaggggttgataagcgcaggcgaatttgattgcagataatgccgagcacgcgttcaatgttttggtgtaatgttgatattagcataacataccaggattttaatggacttttttctatcaaaaaaaaaaaaaaaa

SEQ ID NO: 4414 - protein, 219 aa, Zea mays
  misc_feature: GI Number: 50904647; NR Description: pentatricopeptide (PPR) repeat-containing protein-like [Oryza sativa (japonica cultivar-group)] >gi|40363770|dbj|BAD06280.1| pentatricopeptide (PPR) repeat-containing protein-like [Oryza sativa (japonica
  misc_feature: GI Number: 34365675; NR Description: At2g27790 [Arabidopsis
  misc_feature: GI Number: 15240481; NR Description: pentatricopeptide (PPR)
  misc_feature: GI Number: 50732483; NR Description: PREDICTED: similar to
  misc_feature: GI Number: 61402428; NR Description: Unknown (protein for
MPRDRDEPAAVRVYTVCDESRYLIVRNVPSLGCGDDLASLFGTYGPVEECTPMDAEDSEPYTDVFFVKFSQVNNARFAKRKLDESVFLGNRLQVTYAPQFESPQDTKEKLEVRRKEVLGRIKSSAGRPEGSSPAQGSSSGNHHQMNSNKREYMKTIHASPIEDPRFSHVSSDKDYFPSESMNATVKLVRGKLDKIQSGGDNSSTSAASRKPGVDKRRRI

SEQ ID NO: 4415 - DNA, 644 bp, Glycine max
  misc_feature (1)..(644): Ceres cDNA ID no. 21705326
  misc_feature (1)..(644): Ceres CLONE  ID no. 1101129
  misc_feature (1)..(644): Also known as  Ceres CDNA ID no. 24726465
atagaaacacgggtcccgaagcatccaacacatagtattttaaagagcaaaagaaaactcagaaatccaagctttgttagtgtcccagaagagaaagagaaagagaaagcagagagtgatgataccagagagacaacaaggtggaggtgcgccacacgggatcctcctggctctggtggtggcaatcgtgctcatagtgcccttcttccttggggatcagggccaggccataacgcaggcattatcggacctgctaagcccattcggcctactccttctgcccatccttctccttctcaccattcagttcctctcctccgatcggggctccttcgtctccgccctcttctccaccggcgaacccgacaccatccaccgcctcagcggctcccccttcggcgtcgcactcttcctcatcctcattctcttcctcttgttcaaccgccgcctctccatcttcggcggcgacgattccgatgactgaaaccttctggatctgcctctcctttctcgttaccttttcttttcacacgttcgttgtacatctaccttttttttttttttttaattgctttttttcttgctgttacatttgaatttctgttgagtaaataatagtattattattaaaaaaaaaaaaaaaa

SEQ ID NO: 4416 - protein, 644 aa, Glycine max
  misc_feature: GI Number: 24762385; NR Description: CG11300-PA [Drosophila melanogaster] gi|7291634|gb|AAF47057.1| CG11300-PA [Drosophila melanogaster] gi|21430504|gb|AAM50930.1| LP08443p [Drosophila
ATAGAAACACGGGTCCCGAAGCATCCAACACATAGTATTTTAAAGAGCAAAAGAAAACTCAGAAATCCAAGCTTTGTTAGTGTCCCAGAAGAGAAAGAGAAAGAGAAAGCAGAGAGTGATGATACCAGAGAGACAACAAGGTGGAGGTGCGCCACACGGGATCCTCCTGGCTCTGGTGGTGGCAATCGTGCTCATAGTGCCCTTCTTCCTTGGGGATCAGGGCCAGGCCATAACGCAGGCATTATCGGACCTGCTAAGCCCATTCGGCCTACTCCTTCTGCCCATCCTTCTCCTTCTCACCATTCAGTTCCTCTCCTCCGATCGGGGCTCCTTCGTCTCCGCCCTCTTCTCCACCGGCGAACCCGACACCATCCACCGCCTCAGCGGCTCCCCCTTCGGCGTCGCACTCTTCCTCATCCTCATTCTCTTCCTCTTGTTCAACCGCCGCCTCTCCATCTTCGGCGGCGACGATTCCGATGACTGAAACCTTCTGGATCTGCCTCTCCTTTCTCGTTACCTTTTCTTTTCACACGTTCGTTGTACATCTACCTTTTTTTTTTTTTTTTAATTGCTTTTTTTCTTGCTGTTACATTTGAATTTCTGTTGAGTAAATAATAGTATTATTATTAAAAAAAAAAAAAAAA

SEQ ID NO: 4417 - DNA, 1003 bp, Glycine max
  misc_feature (1)..(1003): Ceres cDNA ID no. 21705327
  misc_feature (1)..(1003): Ceres CLONE  ID no. 1104525
  misc_feature (1)..(1003): Also known as  Ceres CDNA ID no. 24367549
aaaaaataaattgatttctaagcatttgttttagcaaaatgagcacctgtccggggatatattttgatattggcaagaaggctaaagatgttcttcacacggactattcaaatctatctccaattcattttcactaccaattcatggactataatgtagacctctcttgtaaagtagatgaacttgtacctggattcaagagccttttcaaatgcaccatacctgattctgggaagttggaactacaacacttgagcaactacactgggattactgggtgcattggattagaaggaaacctagaaaaaggatatgaccctgttctaaacttatcaggtcttgtaggaacaaacattctgtctctaggaggcaatgttgcacttgacctaccaacaagaacaatcagcaagctgaatgcaggcttaggcctcaacactaacttccttgttgcttccttgaccatgcatgacagctttgacatagtgaaagcctcttgttatcatgaagtgaacctcctaaccaagaccgccattgcagcagagctgaagcatagcttgtcaatgggggagactagtggcaccattggtgctcagcatgcattttttccacaaacattgctaaaggctcgatttgacacctttggcagggcaggtgctcttattcaacaagggttctgggagagatgttttgtaactatggctggagaagtggaatttaagaactcagataataatttgcatcccaaggttggagtctctgtggctttaaaaccctagtcaataccatttagataagcttccatctccaattgagaggttgttggatgtaaggagacttcaaaatgacggcacaaactggatgaaacttgttgattttccccatccattttcttcaatattcaacaactgtatgagtaccatgtgtagttctactcacaatttttattaataaaattattataatactagtggtaggtatttgtttatcaaaaaaaaaaaaaaaa

SEQ ID NO: 4418 - protein, 245 aa, Glycine max
  misc_feature: PFam Name: Porin_3; PFam Description: Eukaryotic porin
  misc_feature: GI Number: 5031279; NR Description: porin [Prunus armeniaca]
  misc_feature: GI Number: 36957170; NR Description: VDAC1.1 [Lotus
  misc_feature: GI Number: 515360; NR Description: 36kDA porin II [Solanum tuberosum] >gi|1172556|sp|P42056|POR6_SOLTU 36 kDa outer mitochondrial membrane protein porin (Voltage-dependent
  misc_feature: GI Number: 515358; NR Description: 36kDa porin I [Solanum tuberosum] >gi|1076680|pir||C55364 porin (clone pPOM 36.1) - potato
  misc_feature: GI Number: 36957198; NR Description: VDAC1.3 [Lotus
MSTCPGIYFDIGKKAKDVLHTDYSNLSPIHFHYQFMDYNVDLSCKVDELVPGFKSLFKCTIPDSGKLELQHLSNYTGITGCIGLEGNLEKGYDPVLNLSGLVGTNILSLGGNVALDLPTRTISKLNAGLGLNTNFLVASLTMHDSFDIVKASCYHEVNLLTKTAIAAELKHSLSMGETSGTIGAQHAFFPQTLLKARFDTFGRAGALIQQGFWERCFVTMAGEVEFKNSDNNLHPKVGVSVALKP

SEQ ID NO: 4419 - DNA, 1797 bp, Glycine max
  misc_feature (1)..(1797): Ceres cDNA ID no. 21705328
  misc_feature (1)..(1797): Ceres CLONE  ID no. 1116211
  misc_feature (1)..(1797): Also known as  Ceres CDNA ID no. 23709417
agagaaacagagaaaagtaaggtgcgaaaagagtgaggcggagaaaaatgaagtgcccgtattgttcggcggcgcaggggcgttgcgccaccacgagcggcgggcgttcgatcacggaatgcacgtcttgcgggcgcgtggtggaagagcgacagtcgcatccccaccacgtgttccacgtgcgcgcccaggacaaccctctgtgtctcgtcacatcggatctcgctctccccgcgctcaatcaaaacaacgacgaggaggaccctttcgagcccacgggcttcatcaccgccttctccacctgggccctcgagcccaacccactttacctccagtcctccctctccttctccggctacctcgccgagctcgaacgcactctcgaatcatcatcatcatcatcctcttccttcacttcttcttcttcttcttcgtcgacggtggtggttgataatttgagggcgtacatgcagattatcgatgtggcgtcaattctagggttggactgcgatatctccgaccacgcttttcagttattcagggattgttgctccgctacgtgtttgagaaaccgcagtgtggaggcgcttgctactgcagctctcgttcaggccattagagaggctcaagagcccagaacccttcaggaaatttcaattgctgccaatgtaccgcaaaaggaaattgggaaatacattaagatactgggagaggctttgcagctaagtcaacctattaacagcaattccatttcagttcatatgccaagattttgcacgcttcttcagctcaataaatctgctcaggaactggctactcacataggagaggttgtgatcaacaaatgcttctgcacccgcaggaatccgattagcatctcagctgctgctatatatttggcttgccaacttgaagacaaacgcaaaacccaggcagaaatttgtaaggtaactggtcttactgaggtcactctccgtaaagtgtacaaggaactattggagaattgggatgatttacttccctctaattacaccccagctgttcctccagagagggcatttcccacaacggtaattgcttctggtcgttcttcaacggctaaggttgatgctgtagaggttatttcttctttggacccagaaaagttgccagatattaaacatagcaaacctaatgagggcccgggcatggttcatcatcccagagggaaggatgaggctgttggtggttatcatgcaagccattccacactgaatcaacagtcaactttttggcaatcccagcttcccagtgggacacacaatcatcagaatgttttgcaaggaatggatattgatgtatcgcagcgaaaccaccaacagccagaacacatggcagaggatacaacaaatggtgctgccaatggtagttctctaaaatcaaaccaactttgtagtcctcctgcttctagtgcaagttctgttatgaggcagttttcagctcccccttcatctgggccttcaaatgttcgataagtacagtcacctaagataatgccaggttatccggatcactgaagaacaatgaaatctaaatggttggggaaataccggttccttgtgccaacacctaacctagcacggataaaattacttcgcctcttttaagtatactattgtgtatatatatgtatgcattatgtcatttgatttgtttctgatgtgtgaactttgctgtggttattgccagaactggtatcattcatagacgctaggaaaataataatttatggcggttttactaaaaaaaaaaaaaaaa

SEQ ID NO: 4420 - protein, 488 aa, Glycine max
  misc_feature: PFam Name: TFIIB; PFam Description: Transcription factor
  misc_feature: GI Number: 9858771; NR Description: BAC19.3 [Lycopersicon
  misc_feature: GI Number: 16516651; NR Description: TFIIB-related protein
  misc_feature: GI Number: 39545884; NR Description: TFIIB5/pBrp [Arabidopsis thaliana] >gi|30102720|gb|AAP21278.1| At4g37010 [Arabidopsis thaliana] >gi|2464915|emb|CAB16810.1| transcription initiation
  misc_feature: GI Number: 16516653; NR Description: TFIIB-related protein
  misc_feature: GI Number: 61821411; NR Description: PREDICTED: similar to Transcription initiation factor IIB (General transcription factor
MKCPYCSAAQGRCATTSGGRSITECTSCGRVVEERQSHPHHVFHVRAQDNPLCLVTSDLALPALNQNNDEEDPFEPTGFITAFSTWALEPNPLYLQSSLSFSGYLAELERTLESSSSSSSSFTSSSSSSSTVVVDNLRAYMQIIDVASILGLDCDISDHAFQLFRDCCSATCLRNRSVEALATAALVQAIREAQEPRTLQEISIAANVPQKEIGKYIKILGEALQLSQPINSNSISVHMPRFCTLLQLNKSAQELATHIGEVVINKCFCTRRNPISISAAAIYLACQLEDKRKTQAEICKVTGLTEVTLRKVYKELLENWDDLLPSNYTPAVPPERAFPTTVIASGRSSTAKVDAVEVISSLDPEKLPDIKHSKPNEGPGMVHHPRGKDEAVGGYHASHSTLNQQSTFWQSQLPSGTHNHQNVLQGMDIDVSQRNHQQPEHMAEDTTNGAANGSSLKSNQLCSPPASSASSVMRQFSAPPSSGPSNVR

SEQ ID NO: 4421 - DNA, 1360 bp, Glycine max
  misc_feature (1)..(1360): Ceres cDNA ID no. 21705329
  misc_feature (1)..(1360): Ceres CLONE  ID no. 1120646
  misc_feature (1)..(1360): Also known as  Ceres CDNA ID no. 24367590
ttttttcatttggatggtgtttatctgaactgaagtaaatggcagagaacgaagatgcaagaaggagcgatgaatcgctgaagcttgcgttggcgatatcgcttctgcgatcaaaggttttgaaaagcgtaaaggagtccagtgcgctatctccttcgcaatctgacgctcttctccgttggaagcgaaaggctaaggaaagaaagcaagagatcctgaggctcagagaagatctcaaagacgctcaagatgcttcgcactgcgatctcttccctgagagtgctgcttgtaagtgttatttcttcgacaatttcggagaattaagccctaagcatcatggaactgcctttgacaacagatttagcgatgtccttcgacgcagatttctaagacaagtgcgatttaaggaaaggaggagaagggtaggttcttcttcttcttcaagtcagcagcggaattctttaggtttaattgaggaggatgaaacagagcagcttagggcctccgttgattttctcgtggaaatctgtgactctgtatcatcggtggatgattccaagtttgcaaatctggcacatcaagctgtggactttatattggttacattgaagaatcttttatctatgggaaggaacctggaacttgttgaaggaattatcaacagcctagttacacgtttgatcaggcagatgtgctcgtccttgtcagaaaatgggtctcaacacacgggaaccaatgctcaattttgtattcaacatttgatccgtaaacttggaagtaagccttatattggtcagcgggcaattcttgcagtttgtcaaagaattttggtactagctgagcgtttgcttttctctgatccttttgatgatggctttcctcacatgcatgaaagtatgttcataatgatccagcttatcgagttcttggtgacggattacttattagagtggtcaaaagctgaagattttgacaacatgctccttgaagattgggtgacatcaattgtccaggcaagaaaagcattagaacttctggaaagcagaaatggactatatgcgctttatatggaccgagtcacaggtgaattggcaaaacaacttggcggtgtctcatcgtttctgaagcttaaaccggatatcattaattgcctctttcgctaaacatgcatggtgagtagcatttgctcttggcgtcccctagcttgttagtgcatgtttttggattataatttgtacatctcagacaatggttgagtgtaaatataatttcgtcaacaaaaaatatcagggatggatcaccatcatttcaattaaactgacgaaaaagcagagcattgttattaaaaaaaaaaaaaaaa

SEQ ID NO: 4422 - protein, 374 aa, Glycine max
MAENEDARRSDESLKLALAISLLRSKVLKSVKESSALSPSQSDALLRWKRKAKERKQEILRLREDLKDAQDASHCDLFPESAACKCYFFDNFGELSPKHHGTAFDNRFSDVLRRRFLRQVRFKERRRRVGSSSSSSQQRNSLGLIEEDETEQLRASVDFLVEICDSVSSVDDSKFANLAHQAVDFILVTLKNLLSMGRNLELVEGIINSLVTRLIRQMCSSLSENGSQHTGTNAQFCIQHLIRKLGSKPYIGQRAILAVCQRILVLAERLLFSDPFDDGFPHMHESMFIMIQLIEFLVTDYLLEWSKAEDFDNMLLEDWVTSIVQARKALELLESRNGLYALYMDRVTGELAKQLGGVSSFLKLKPDIINCLFR

SEQ ID NO: 4423 - DNA, 1292 bp, Glycine max
  misc_feature (1)..(1292): Ceres cDNA ID no. 21705331
  misc_feature (1)..(1292): Ceres CLONE  ID no. 1168812
  misc_feature (1)..(1292): Also known as  Ceres CDNA ID no. 24367431
aatttatacaatatgattatatgcaccatgttaatattataatatatcgctgggacagtttttgtttgacagcacagcactcggaaatttctggcgatctctgcgttttcccctattttttctgaatctaacaacaaacatccctcaggcaacaatcatcactattaataagagttccttccttcactctcacccaagccaaagaaaggaacaagaacaagaacaacaaagtaacgtgaaagagagagagatggaggcgattgttccagtggtggatttccagaggctttcagaggaagaggagcgcaagaagctgagaaaaacatgtgagaaaccagggtgtttcagaatcatcaaccactcaattccactaacactcatggctgacatgaagtcagtggttaaatacttgcatgaccttcccacggaaatcaaaatgcgcaacaaaccctccgtccctgagagtggctatagggcggcatcgccaacaagtcctctatacgagggcatgggaatatatgacatgcatgcctcaccacaagcatttgaagatttctgctccaacttgaatgtgtcaccccgtcacaggcaaataataaaggaatatggtcaagcaattcatgacttggcatcaaatttatcacaaaaaatggctgagtctttgggtataatggataatgatttcaaggactggccattcattttgaggactattaaatatagttttaccccagatgttataggctccacgggagcacaattgcattcagatacaggatttatcactctacttcaagatgatgaacatgttagtggtcttgagatgatggatgattttggctcatttaaggcagttcctcccataccaggggccttcctttgcattgttggagatgttggacatgtttggagcaatggaaaattttggaatgccagacatcgtgtaatatgcaaggaaacgggtactcgttattcatttggtgcatttatgttatcaccaagggatggtaatgttgaggccccaaaaaaattggtggaagttgaccatgtacaacgctatcgaccatttaagtacgaagatttgagggatttcagaatcaccacaggaaagagggatggcgaagtccttgatcaatatcgcatttgttagtcattttatgcatcgaaatacatcgccaatagaactttattttgaaaaataagttggcgataaaataaatgttgcatccattctaaataatttaaatagtttggtgtccttgttcgttcatgaaataaaaaaaaaaaaaaaa

SEQ ID NO: 4424 - protein, 299 aa, Glycine max
  misc_feature: PFam Name: 2OG-FeII_Oxy; PFam Description: 2OG-Fe(II)
  misc_feature: GI Number: 3492806; NR Description: adventitious rooting related oxygenase [Malus x domestica] >gi|7433208|pir||T17000
  misc_feature: GI Number: 5080789; NR Description: Very similar to adventitious rooting related oxygenase [Arabidopsis thaliana] >gi|26451604|dbj|BAC42899.1| putative dioxygenase [Arabidopsis thaliana] >gi|28973391|gb|AAO64020.1| putative dioxygenase
  misc_feature: GI Number: 5080788; NR Description: Very similar to adventitious rooting related oxygenase [Arabidopsis thaliana] >gi|24030341|gb|AAN41336.1| putative dioxygenase [Arabidopsis thaliana] >gi|21553384|gb|AAM62477.1| dioxygenase-like protein
  misc_feature: GI Number: 16118978; NR Description: 2-oxoglutarate-dependent
MEAIVPVVDFQRLSEEEERKKLRKTCEKPGCFRIINHSIPLTLMADMKSVVKYLHDLPTEIKMRNKPSVPESGYRAASPTSPLYEGMGIYDMHASPQAFEDFCSNLNVSPRHRQIIKEYGQAIHDLASNLSQKMAESLGIMDNDFKDWPFILRTIKYSFTPDVIGSTGAQLHSDTGFITLLQDDEHVSGLEMMDDFGSFKAVPPIPGAFLCIVGDVGHVWSNGKFWNARHRVICKETGTRYSFGAFMLSPRDGNVEAPKKLVEVDHVQRYRPFKYEDLRDFRITTGKRDGEVLDQYRIC

SEQ ID NO: 4425 - DNA, 1430 bp, Glycine max
  misc_feature (1)..(1430): Ceres cDNA ID no. 21705333
  misc_feature (1)..(1430): Ceres CLONE  ID no. 1236617
  misc_feature (1)..(1430): Also known as  Ceres CDNA ID no. 24367716
ttcttcgttgttactcccttcgatcttactgcctttgtgcaaccgccaattgacctcagaggcaaattgagcttatcaacacacacctcccgacttgtagcacaatggcatctgcctcacgaagcttctcccgcgccctgcgcaccgccgctccctcgttccgtaccacctcaacccgctcctctgcccgcttcgtcgcacccacacagaacgccttccgcagccagcaacgcggatacgcttctcagcaggaaggaccagacaagcacgagggcaacccaactggcctagcctggggtgctggtgccctcctcgttggtgctggtgtatacagcctgtacacatacaagcccgaattgtttggtcagaccagcagcaggaagatcttcacacctaggttcgaggactaccagaaggtctacgatcatatcgcaaagaggctcgaggagcacgacgactacgacgatggcagctacggacctgtactgctgcgtctggcatggcacgcttcgggaaccttcgacaagttgaccggaactggtggctccaacggtgctactatgcgcttcgctcccgaaggcgaccacggcgccgatgctggtctcaaggctgcccgcgacttccttgagcccgtcaaggaggctttcccgtggatcacatactccgacctgtggattcttgctggtgtctgcgccatccaggagatgcagggtcccaagattccataccgagctggacgctccgaccgcgacgtctcctactgcacgcccgacggtcgtctgcccgacgcaagcaaggacgctagccacattcgcgccatcttcggccgcatgggcttcgatgaccgcgccatggtcgccctctctggtgcacacgccctaggccgttgccacaccgaccgctctggctttgacggcccctggaccttctcccctactaccctgaccaacgactactacaagctcctggttgaggagaagtggtcatggaagaagtggaacggccccaagcagtttgaagacgtcaagaccaagagcttgatgatgttgccgaccgacatggagcttgtcaaggataaaagcttcaggaagtacactgatttgtacgcaaaggacaacgacgctttcttcaaggacttctctgaaagcgtaatgacgctgttcgagcttggtgtaccattccaacaacctgaggatcagcgatacgtcttcaagagctctttcgactaagtttgtacaagagagtgcgagggaagattggggttttactttgagccagagatatccatctagattattagaccgttgcttttcttaggcagcatgtgctagatcactttcggagattacttgtttaatagtccgcattgtagacttttgagcatacagcacaagaacaagatttttgaaacgttaaaaaaaaaaaaaaaa

SEQ ID NO: 4426 - protein, 374 aa, Glycine max
  misc_feature: PFam Name: peroxidase; PFam Description: Peroxidase
  misc_feature: GI Number: 66849548; NR Description: cytochrome c peroxidase,
  misc_feature: GI Number: 38426868; NR Description: mitochondrial cytochrome
  misc_feature: GI Number: 66848866; NR Description: cytochrome c peroxidase,
  misc_feature: GI Number: 6322919; NR Description: Cytochrome-c peroxidase; Ccp1p [Saccharomyces cerevisiae] >gi|543969|sp|P00431|CCPR_YEAST Cytochrome c peroxidase, mitochondrial precursor (CCP) >gi|538536|pir||OPBYC cytochrome-c peroxidase (EC 1.11.1.5)
  misc_feature: GI Number: 171177; NR Description: cytochrome c peroxidase
MASASRSFSRALRTAAPSFRTTSTRSSARFVAPTQNAFRSQQRGYASQQEGPDKHEGNPTGLAWGAGALLVGAGVYSLYTYKPELFGQTSSRKIFTPRFEDYQKVYDHIAKRLEEHDDYDDGSYGPVLLRLAWHASGTFDKLTGTGGSNGATMRFAPEGDHGADAGLKAARDFLEPVKEAFPWITYSDLWILAGVCAIQEMQGPKIPYRAGRSDRDVSYCTPDGRLPDASKDASHIRAIFGRMGFDDRAMVALSGAHALGRCHTDRSGFDGPWTFSPTTLTNDYYKLLVEEKWSWKKWNGPKQFEDVKTKSLMMLPTDMELVKDKSFRKYTDLYAKDNDAFFKDFSESVMTLFELGVPFQQPEDQRYVFKSSFD

SEQ ID NO: 4427 - DNA, 926 bp, Zea mays
  misc_feature (1)..(926): Ceres cDNA ID no. 21705335
  misc_feature (1)..(926): Ceres CLONE  ID no. 1278769
  misc_feature (1)..(926): Also known as  Ceres CDNA ID no. 24365123
agtttgtgttggccgtagcggctaggcgtgcaaggggcctatatctgtgtaaatcgtacacatctaataatcaaaatggttcagaagaagcccaagaagaagatcggcaagaaggtcgccgccgctcctttggccgtgaagaagcctgaggttaagaaagttgtaaaccctcttttcgagaagagacccaagaatttcggcattggtcaggacattcagcctacccgtgatttaagccgcttcgtgaaatggcccaagtacattcgcattcagcgccagaaggctgttcttcagaagcgtctgaaggtccctcccccaatcaaccagttttcacagaccctggacaagcaaacagctgttcagctgttcaagcttttggacaagtacagacctgagacacctgaggccaagaaggcccgtctccgtgcccgtgctgagaagaaggctgccactaagaccgatgcccctaccaagaggccaaacacagtccgtgctggtgtcaacactgttgtcaagctagttgaacaaaagaaggcccaacttgttgtcatcgcccatgatgttgagccccttgaagttgttttgttcctgccagccctctgccgtaagatgggcgttccatactgcattgtcaagggcaaggctcgtctgggtgcccttgttaggcgtaagacctgcacatctcttgcacttactcaggttgattctggtgaccgatcacagtttgtgaagttggtagagagtatcaagactaacttcaatgaccgtgctgatgaaatcagaagacactggggtggtggtgcccttggctccaaatctgctgctaggattgcgaaattggaaaaggccaaagcccgtgaattagcccagaaacaaggctaattttacccaataaaattaatctttgtccaaaaaaaaaaaaaaaa

SEQ ID NO: 4428 - protein, 268 aa, Zea mays
  misc_feature: PFam Name: Ribosomal_L7Ae; PFam Description: Ribosomal
  misc_feature: GI Number: 62083327; NR Description: ribosomal protein L7a
  misc_feature: GI Number: 48105889; NR Description: similar to 60S ribosomal protein L7a (Surfeit locus protein 3) (PLA-X polypeptide) [Apis
  misc_feature: GI Number: 806545; NR Description: ribosomal protein L7a [Drosophila melanogaster] >gi|1173062|sp|P46223|RL7A_DROME 60S
  misc_feature: GI Number: 50368683; NR Description: LOC447981 protein
  misc_feature: GI Number: 61886865; NR Description: PREDICTED: similar to
MVQKKPKKKIGKKVAAAPLAVKKPEVKKVVNPLFEKRPKNFGIGQDIQPTRDLSRFVKWPKYIRIQRQKAVLQKRLKVPPPINQFSQTLDKQTAVQLFKLLDKYRPETPEAKKARLRARAEKKAATKTDAPTKRPNTVRAGVNTVVKLVEQKKAQLVVIAHDVEPLEVVLFLPALCRKMGVPYCIVKGKARLGALVRRKTCTSLALTQVDSGDRSQFVKLVESIKTNFNDRADEIRRHWGGGALGSKSAARIAKLEKAKARELAQKQG

SEQ ID NO: 4429 - DNA, 607 bp, Zea mays
  misc_feature (1)..(607): Ceres cDNA ID no. 21705337
  misc_feature (1)..(607): Ceres CLONE  ID no. 1281514
  misc_feature (1)..(607): Also known as  Ceres CDNA ID no. 24364968
ctatacagagcgccatgaccgaaatggtcaaggtcaaaactgagcacaccagttatcattgcgaaatcggcaagctgagttcaaagttagtggagaatatggcttcctcctccagagccggtgcactgcttgatgaaaaagatgaagctgcagcacggctcgaggaagaacttgtgagtattcgccaagaaagccagaaaatcgcaaaggagaaggaaaaaatagatgcagaggtcgtgagtatcaagacagcatgtagcgggtatgaggatttgtgcagcggtgtggaacgcaagtttaaggaagtcttggctgggctgcagcggaagaggctaacctgatgcgcaaggtgttgatgtcatttcgctgcttcaaagttctaattctgaccactgtttctgcttttgggctgtaggtcatctatgtatcacggtaggttcagatcgatgtgctgtgcttagtttgtgcaagtcattcggtaccttttatatatctgtatggtgatcatgatggcttagggagcctgatgaagatcgactcttgataattgttactgctatattagttggaccgtatttatttgcctgcggcaaaaaaaaaaaaaaaa

SEQ ID NO: 4430 - protein, 607 aa, Zea mays
CTATACAGAGCGCCATGACCGAAATGGTCAAGGTCAAAACTGAGCACACCAGTTATCATTGCGAAATCGGCAAGCTGAGTTCAAAGTTAGTGGAGAATATGGCTTCCTCCTCCAGAGCCGGTGCACTGCTTGATGAAAAAGATGAAGCTGCAGCACGGCTCGAGGAAGAACTTGTGAGTATTCGCCAAGAAAGCCAGAAAATCGCAAAGGAGAAGGAAAAAATAGATGCAGAGGTCGTGAGTATCAAGACAGCATGTAGCGGGTATGAGGATTTGTGCAGCGGTGTGGAACGCAAGTTTAAGGAAGTCTTGGCTGGGCTGCAGCGGAAGAGGCTAACCTGATGCGCAAGGTGTTGATGTCATTTCGCTGCTTCAAAGTTCTAATTCTGACCACTGTTTCTGCTTTTGGGCTGTAGGTCATCTATGTATCACGGTAGGTTCAGATCGATGTGCTGTGCTTAGTTTGTGCAAGTCATTCGGTACCTTTTATATATCTGTATGGTGATCATGATGGCTTAGGGAGCCTGATGAAGATCGACTCTTGATAATTGTTACTGCTATATTAGTTGGACCGTATTTATTTGCCTGCGGCAAAAAAAAAAAAAAAA

SEQ ID NO: 4431 - DNA, 1448 bp, Triticum aestivum
  misc_feature (1)..(1448): Ceres cDNA ID no. 21705338
  misc_feature (1)..(1448): Ceres CLONE  ID no. 1316189
  misc_feature (1)..(1448): Also known as  Ceres CDNA ID no. 24361571
gtctttctgcattcaaacccccccaacaccatgaactctgccctcaggcttgtctctttccagtctccctctttcaacctaaaacaacgcgcactgtcccagcgccagcagataagcgtcgagtgggggaagaggcaacaatattcgccaaagcccagacgagcgataccagggccaaatgcaacggggggactcaacaatgctgactgcggaggtaataccttaccatcttcacccatgacaaatgtgatccaggagttctactcttccctcaatgacaaggacatcacacggctcacggagctgattgaccctgattgcaccgtcaagcacacttcatattataaaccactggacatcaaggatactattgcatacttcgcaaggcttatggaagctatgagaaaaaatgtcaaatttgctattgatgaggtttgtcaaggagtagaacccactgttgctgcagcaatatggcaccttgagtggaacggtaagatcatcccatttaccaaaggatgcagtttctacatgtgttcagcaaaaggggaagcgcttcttattaggaaggtccacatcttcaacgagtcacctgtgaaaccagtaaatctggcattggacatacttctatttgttacctttttgttcgacctacttccaaaacaagctgaagattttctacagaatccagaagcactagtccagtcctttgtgaagttttacaaattcctcctggagcctgttatcgtgtatcttgttgcatattctatccgcttctggtcatttgttgtgaagctttacaaattatacgtggagcctattatcgtgcatcttcttgcatataatttccgcttctggtcatttgtggcacgaagactggatacggtgctcgacgtgttgtataacattttcaagcagttcatgtaaggaactaatatcccagaaaagtctacattcagaagaatagtgattctcgcagatacaccacgtggatgcaatcaattaccgacaatatcacgagtggaggatccgagaagggcttcggcaaatgtcgatggatcagaatcttccacatgatctttatttgtttcccgaggcttatcccatccttgccctgtgaagcagaaatggacattcaaccttataagaaaattgctgttagagcagggacgtatatatataaccacaagatagatattgctgtaacaagtactcagaaattctgcctatgtatttcttctgaaaaagctgctgtgtcattctacaatctatctgttcgcgtagtgtaggtttttctttaagaggccaccccacaatctgtatactacacaagctatttatttctgtatgtaacgcaggagtaaaatatatatccaggcaaagagtgtcaattcaatgcaagacagaagcatcataatttagagtttaaaaaaaaaaaaaaaaaaaaaaaa

SEQ ID NO: 4432 - protein, 297 aa, Triticum aestivum
  misc_feature: PFam Name: NTF2; PFam Description: Nuclear transport factor
  misc_feature: GI Number: 51536248; NR Description: nuclear transport factor
  misc_feature: GI Number: 51536247; NR Description: nuclear transport factor
MNSALRLVSFQSPSFNLKQRALSQRQQISVEWGKRQQYSPKPRRAIPGPNATGGLNNADCGGNTLPSSPMTNVIQEFYSSLNDKDITRLTELIDPDCTVKHTSYYKPLDIKDTIAYFARLMEAMRKNVKFAIDEVCQGVEPTVAAAIWHLEWNGKIIPFTKGCSFYMCSAKGEALLIRKVHIFNESPVKPVNLALDILLFVTFLFDLLPKQAEDFLQNPEALVQSFVKFYKFLLEPVIVYLVAYSIRFWSFVVKLYKLYVEPIIVHLLAYNFRFWSFVARRLDTVLDVLYNIFKQFM

SEQ ID NO: 4433 - DNA, 1036 bp, Triticum aestivum
  misc_feature (1)..(1036): Ceres cDNA ID no. 21705342
  misc_feature (1)..(1036): Ceres CLONE  ID no. 1328201
  misc_feature (1)..(1036): Also known as  Ceres CDNA ID no. 24361536
cccggttttgcccctgccaagtcaattgaccaggagagggacgcgttcgtgttccctgctcttcgtcgacgccgacggggggtctccacggcgacataccggcggacggcggcggatccctcccggtgaaggcgacgttgttacatttgcaaatgtcaaattctgtcatgaataccactcagaaagttgatccaacggaaccagctgctaagattgctcagcaagcctcacagttcaaacgatggggacgcaagcatccatttgttcgatatggccttccgctcatttctttgacagtgtttggtgcggttggtctagctcatctcatacagggaagcaaagaagtaacaaaggaaaaggaggacatggaatgggaggtcgtagagaaaacaaaagctctgagccgaacaggaccagtggaaggggcttataagcctaagaagctctcgctagaggacgaactgaaggctttgcagcaaaaggtggacataaacagctacgactacaagagaattcccaaacaaaatgaaaacaagtgaagtaaagcactgtttatcatgctaaggggtgggggattttcttaaaatccttgaagtagtttcttggtcctgtttcttcatgagttccttgggatgttgtccaagtgtcaaaatgagattgcggagacattatcatcagaactctgtgcttcgtcagccattagcagtagagagttagtcgaggatccttgtgaaggcttgaaccgtaggaataatctttgtagccatggccgatgggagataggcattttcacggtccaccaagtgagtctttttttagttgatcgaatactgccttctttaccatggggccaataaattgtaggtaacacagtactctgacgtgcgagcaatcaaattttgtatgccatttcttggaagctaattagctgtgtcacgatcactaaacaaaggggaggaaacaggaaagttcatatttcatatgtatattttgagactccgaagctcgtattcggctgacaaaaaaaaaaaaaaaa

SEQ ID NO: 4434 - protein, 128 aa, Triticum aestivum
  misc_feature: GI Number: 7268120; NR Description: kinesin like protein [Arabidopsis thaliana] >gi|2244771|emb|CAB10194.1| kinesin like protein [Arabidopsis thaliana] >gi|7428718|pir||H71402 probable
  misc_feature: GI Number: 26453208; NR Description: putative kinesin
MSNSVMNTTQKVDPTEPAAKIAQQASQFKRWGRKHPFVRYGLPLISLTVFGAVGLAHLIQGSKEVTKEKEDMEWEVVEKTKALSRTGPVEGAYKPKKLSLEDELKALQQKVDINSYDYKRIPKQNENK

SEQ ID NO: 4435 - DNA, 1163 bp, Triticum aestivum
  misc_feature (1)..(1163): Ceres cDNA ID no. 21705343
  misc_feature (1)..(1163): Ceres CLONE  ID no. 1314044
  misc_feature (1)..(1163): Also known as  Ceres CDNA ID no. 24361556
accaccaccacttcaccggagcaggaacatagaaccacctccaccgaccgacgggaggaaagaaacaaggccgaccgacgatgcgggcgagctgcaacggctgccgggccctgcgcaagggctgcgccgacgactgcaccatccgcccctgcctcacctggatccggggcgccgacgcgcaggccaacgccaccgtcttcctcgccaagttctacggccgcgcggggctgctcaacctcctcgccgccggcaccgaccccgccctccgcccggcgctcttccgctcgctgctctacgaggcgtgcggccgggtggccaaccccgtctacggcgccaccgggctcttcacgacgggccagtgggaggcgtgccaggacgccgtccaggccgtgttcgagggccgccgcatccccgtcccgtccggggccgtcaggcatcccggcttcgtggcggcgttcgacgtccgccgccatgtgcccaggcccaatgtcgtccctgcgcctgcacaagcccccggcccgctcggcgtctcgcgcgctgggcgcaccatgttcaagcgcgcgccctcctcttcgacggacaaacccaggatctcctccggcgccaagcgcggcgagcacgacgctgacctcgagcgcgtgccgagccatggcgagtcggccggcagccacgaccacgtcgaagacgacggcgtggcagtggcagtggcagtggcagtggcagtggcagccaagcaggtgatgggagagtcgggggacaccgaggctgaggcggcctcgcacgtcagccaagcagagcagaaccccccagtgccgcagctggcccgggaagacgacgacgaaattggactggagctgacgctcgggtttgggccgtcaacgcgcgtgctgaggtcgccgccggcgcgctccgacgcggccagcagctcgggcgccgagtgcggccacatcggcctgctgcttgagctgccggtgtgagagaagagacgcggccacggtgccgtccttcgtactgctagctgtgagagagagagagagagagagagacaaaaatggcagttttaggatcaatgtgagtattagagaagaataatgcagtatctgaaacctggaaattttcaaattaaattcaagaagtttttgtgtaaaaaaaaaaaaaaaaaa

SEQ ID NO: 4436 - protein, 298 aa, Triticum aestivum
  misc_feature: PFam Name: FH2; PFam Description: Formin Homology 2 Domain
  misc_feature: PFam Name: Aldedh; PFam Description: Aldehyde dehydrogenase family
  misc_feature: GI Number: 34914608; NR Description: P0520B06.17 [Oryza sativa (japonica cultivar-group)] >gi|20804498|dbj|BAB92193.1|
  misc_feature: GI Number: 32395577; NR Description: seed specific protein
  misc_feature: GI Number: 21554191; NR Description: unknown [Arabidopsis thaliana]
  misc_feature: GI Number: 21593577; NR Description: unknown [Arabidopsis thaliana]
  misc_feature: GI Number: 21553886; NR Description: unknown [Arabidopsis thaliana]
MRASCNGCRALRKGCADDCTIRPCLTWIRGADAQANATVFLAKFYGRAGLLNLLAAGTDPALRPALFRSLLYEACGRVANPVYGATGLFTTGQWEACQDAVQAVFEGRRIPVPSGAVRHPGFVAAFDVRRHVPRPNVVPAPAQAPGPLGVSRAGRTMFKRAPSSSTDKPRISSGAKRGEHDADLERVPSHGESAGSHDHVEDDGVAVAVAVAVAVAAKQVMGESGDTEAEAASHVSQAEQNPPVPQLAREDDDEIGLELTLGFGPSTRVLRSPPARSDAASSSGAECGHIGLLLELPV

SEQ ID NO: 4437 - DNA, 420 bp, Zea mays
  misc_feature (1)..(420): Ceres cDNA ID no. 21705344
  misc_feature (1)..(420): Ceres CLONE  ID no. 1352315
  misc_feature (1)..(420): Also known as  Ceres CDNA ID no. 24373716
tcaccaggaaatgtgtatgggttttgattgattactaattcagactttcgtttgggttcttatacgaacaggaattgtcctgtgtgatgtcgggcattgtattaaggctatttttgggttcaaactcatctagaggtccttttgtgtttgtacagtatattactgtaggcaaccatgaaaaccaaaggtttaggctgacctacgtttaggcctcatttctgatacggctccggagcgagcaaatgcagtgccgtagaaggtgatatcagtcgtatgcatgcctgtttcttcgtctcttgtactgtaacatgtcttaaatttacctagtgatggcgcatgtacttctgtcgatctgtaccattgttgctgttgaagacaaagtgcgccaaacaaacacgaaccaaaaaaaaaaaaaaaaaa

SEQ ID NO: 4438 - protein, 40 aa, Zea mays
  misc_feature: PFam Name: Pkinase_Tyr; PFam Description: Protein tyrosine kinase
  misc_feature: PFam Name: Pkinase; PFam Description: Protein kinase domain
  misc_feature: GI Number: 52077200; NR Description: putative serine/threonine-specific protein kinase [Oryza sativa (japonica cultivar-group)] >gi|52076153|dbj|BAD46666.1| putative serine/threonine-specific protein kinase [Oryza sativa (japonica
  misc_feature: GI Number: 40781634; NR Description: CTR1-like protein kinase [Lycopersicon esculentum] >gi|40781628|gb|AAR89820.1| CTR1-like
  misc_feature: GI Number: 7340658; NR Description: SERINE/THREONINE-PROTEIN KINASE CTR1 [Arabidopsis thaliana] >gi|1169128|sp|Q05609|CTR1_ARATH Serine/threonine-protein kinase CTR1 >gi|11346407|pir||T48400 serine/threonine-protein kinase
  misc_feature: GI Number: 50909127; NR Description: putative CTR1-like protein kinase [Oryza sativa (japonica cultivar-group)] >gi|49388297|dbj|BAD25412.1| putative CTR1-like protein kinase [Oryza sativa (japonica cultivar-group)]
  misc_feature: GI Number: 13936371; NR Description: CTR1-like protein kinase
MSGIVLRLFLGSNSSRGPFVFVQYITVGNHENQRFRLTYV

SEQ ID NO: 4439 - DNA, 2046 bp, Glycine max
  misc_feature (1)..(2046): Ceres cDNA ID no. 21705345
  misc_feature (1)..(2046): Ceres CLONE  ID no. 1371848
  misc_feature (1)..(2046): Also known as  Ceres CDNA ID no. 24367816
acggttacggttacttcttctgtgtttattttcgctacaaactctgcctctgctatttcgtttcacagtttccgccatcttctttcgttctgttgttctttttcctatctgaaaaccttctttgaagaaaatccgtggattttgctgttctccgcagttcgatcatcatggggggagcgtgttctaggaagcaagagcgggacaacaaagatagtcctaccagaggactatcacgaagatattgcaaaagcgggactttgaaatggtggacatcctctttttcttatccatctgtagattttcacctacgaaaaggagaatgtccaccactgttggacttgtgcatacagaaaataaatgaggatattgataaatataacacattttctatgctaccacgagatataagtcagctaattttcaataatttggtttactcccgacgtctaaccagtgcttcccttgaagcttttcgagattgtgctctccaggatctttacttgggagagtatgatggtgttaatgataattggatgggtgtcatctcatcccagggttcatctttgctttctgtagatctttctgggtctgatgtcactgattttgggctgacataccttaaagattgtgaaagtctcatttccttaaatctaaattactgtgaccaaatttcagatcgtggactagagtgtatcagtggtctgtcaaacttgacaagtttgagtttcagaagaaatgattcaatttctgctcaaggaatgagtgccttttctggtcttgttaacttggtcaagttggatttggagagatgtcctgggattcatggaggccttgttcatcttcgaggtttgaccaagttggaatctctcaatttaaagtggtgtaattgcataacagattatgatatgaaacctctttcagagcttgcaagcctgaaaagtctagagatttcttccagtaaagtcactgattttggcatcagttttctaaaagggttacagaagcttgcccttttaaatttggaagggtgccttgtaacagctgcatgcttggattctcttgcagagcttcctgcactgtcaaacttgaatcttaatagatgcaatctctctgacaatggatgcaaaaaaatttcacgactggaaaatttgaaagtattaaacttgggatttaatgtcataacagatgcatgtttagttcacttgaaaggattgacaaagttggagagcttgaaccttgattcgtgtaagattggtgatgaaggattggtcaatttggctggccttgagcaattgaactgcttggaattgtccgatacagaagttggaagcaatgggctacaccatttatcaggtttgtctagtctgcagaaaataaatctgtcttttaccatgattagtgatagcagtttaaggaaattgagtggactctcgtctttgaagtcacttaatttggatgcttaccaaattactgatgctgggctggcaaaccttacaagtttaactggcctcactgacctagatttgtttggtgcacgaatcacagattttgggacaaactatttgaaaaaatttaagaacctgaggtccttggaaatatgcggtggagtattgactgatgctggtgtgaaaaatatcaaagagctttcttctctagtgtgcttaaatttatctcaaaacagcaaccttacagacaaaaccctggagttaatttctgggcttactgggttggtttctttgaatgtttcaaattctcgtatcactaatgctggactgcagcatttgaaaacactgaagaacttgagatctctgacattggagtcctgtaaggtgacagcaaatgacatcaagaaactgaaatcgatatacctccctaatttggtaagctttcggccagggtagttattgcggtattctgatatgtgtatatgtatatattatatgtcagtggtactgaagtatcttacagaagaatggaaagacaacctcaaatttacataggctataataatatgactttatggaaggagtaaaaaaaaaaaaaaaa

SEQ ID NO: 4440 - protein, 577 aa, Glycine max
  misc_feature: PFam Name: LRR_1; PFam Description: Leucine Rich Repeat
  misc_feature: GI Number: 51979270; NR Description: PREDICTED OJ1004_A05.39 gene product [Oryza sativa (japonica cultivar-group)] >gi|51978852|ref|XP_506866.1| PREDICTED OJ1004_A05.39 gene product [Oryza sativa (japonica cultivar-group)] [Oryza sativa
  misc_feature: GI Number: 59802533; NR Description: putative regulatory
  misc_feature: GI Number: 33943993; NR Description: leucine-rich repeat protein 1 [Trypanosoma brucei] >gi|33348176|gb|AAQ15503.1|
  misc_feature: GI Number: 17546519; NR Description: PROBABLE GALA PROTEIN
  misc_feature: GI Number: 51850106; NR Description: leucine-rich repeat
MGGACSRKQERDNKDSPTRGLSRRYCKSGTLKWWTSSFSYPSVDFHLRKGECPPLLDLCIQKINEDIDKYNTFSMLPRDISQLIFNNLVYSRRLTSASLEAFRDCALQDLYLGEYDGVNDNWMGVISSQGSSLLSVDLSGSDVTDFGLTYLKDCESLISLNLNYCDQISDRGLECISGLSNLTSLSFRRNDSISAQGMSAFSGLVNLVKLDLERCPGIHGGLVHLRGLTKLESLNLKWCNCITDYDMKPLSELASLKSLEISSSKVTDFGISFLKGLQKLALLNLEGCLVTAACLDSLAELPALSNLNLNRCNLSDNGCKKISRLENLKVLNLGFNVITDACLVHLKGLTKLESLNLDSCKIGDEGLVNLAGLEQLNCLELSDTEVGSNGLHHLSGLSSLQKINLSFTMISDSSLRKLSGLSSLKSLNLDAYQITDAGLANLTSLTGLTDLDLFGARITDFGTNYLKKFKNLRSLEICGGVLTDAGVKNIKELSSLVCLNLSQNSNLTDKTLELISGLTGLVSLNVSNSRITNAGLQHLKTLKNLRSLTLESCKVTANDIKKLKSIYLPNLVSFRPG

SEQ ID NO: 4441 - DNA, 1765 bp, Zea mays
  misc_feature (1)..(1765): Ceres cDNA ID no. 21705346
  misc_feature (1)..(1765): Ceres CLONE  ID no. 1374393
  misc_feature (1)..(1765): Also known as  Ceres CDNA ID no. 24371878
atatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccacccgctgtcccgcctggccgccgcgtcgctggcccgcgcgttgcacctcaagcgccgggaccccaaccaccacagccagaaaggatcaggcggccacccgtcagtaccagccaccgccgcgctgtacccgcactcctacggcggctacgccttcacggcgtcgctcggcacgccgccgcagccgctccccgtgctgctcgacaccggcagccacctcacgtgggtgccatgcacctcgagctacgagtgccgcaactgctcctccccatccgcctccgccgtcccggtcttccaccccaagaactcctcctcctcccgcctcgtgggctgccgcaacccctcctgccagtgggtccactctgccgcgaacctcgccaccaagtgccgccgcgccccctgctcccccggcgccgccaactgccccgccgccgccagcaacgtctgcccgccctacgccgtggtctacggctccggctccacagccggtctgctcatcgccgacaccctgcgcgcgccgggccgcgccgtccccggcttcgtcctcggatgcagcctcgtgtccgtgcaccagccgccgtcgggcctcgcgggcttcggccgcggcgcgccgtccgtgcccgcgcagctcggcctcccgaagttctcctactgcctcctgtcccgccgcttcgacgacaacgccgccgtgagcggctcgctagtcctcggtggcaccggaggcggcgagggcatgcagtacgtgcccttggtgaagagcgcggcgggcgacaagctgccgtacggcgtgtactactacctggcgctgaggggcgtgacggtgggcgggaaggcggtgcggctcccggcgcgggcgttcgcgggcaacgcggcggggtccggcggcaccatcgtggactccggcaccacgttcacgtacctggacccgaccgtgttccagcccgtggcggacgcggtggtggctgcggtgggcgggcggtacaagcggtccaaggacgcggaggacgggctggggctgcacccctgcttcgcgctgccgcagggcgccaggtccatggcgctgccggagctgtcgttccacttcgagggcggggcggtgatgcagctcccggtcgagaactacttcgtggtcgcggggcgcggcgccgtggaggccatctgcctcgccgtcgtcaccgacttcggcggaggctccggggctgggaacgagggcagcggcccggccatcatcctcggcagcttccagcagcagaactacctggtggagtacgacctggagaaggagaggctggggttccgccggcagtcatgcacgtcgtcgccgtcgtgaggtctcacgacgtcggcatggcggggatcggagtggaggccagtaattactccagagtccagtccacgtaacactccaaattccaattccaaaagctggctgcttgatcttttgttagtgctcgtgtactgctaataaaaaactaaatttactgtcatctactactactattaagttattgaaagacgtggcttgctttgggtttcaaaaaaaaaaaaaaaa

SEQ ID NO: 4442 - protein, 491 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: GI Number: 16209647; NR Description: AT3g52500/F22O6_120
  misc_feature: GI Number: 44890125; NR Description: aspartic protease-like
  misc_feature: GI Number: 9758987; NR Description: chloroplast nucleoid DNA-binding protein-like [Arabidopsis thaliana] >gi|15242307|ref|NP_199325.1| aspartyl protease family protein
  misc_feature: GI Number: 18377815; NR Description: AT4g16560/dl4305c [Arabidopsis thaliana] >gi|15809800|gb|AAL06828.1| AT4g16560/dl4305c [Arabidopsis thaliana] >gi|18414692|ref|NP_567506.1| aspartyl protease family protein
  misc_feature: GI Number: 34898762; NR Description: putative nucleoid DNA-binding protein cnd41 [Oryza sativa (japonica cultivar-group)] >gi|22831049|dbj|BAC15912.1| putative nucleoid DNA-binding protein
MAPPPLFPLPPLLILLVIVPLFPTAAPTATTLPLYRHLPHVAEAVASHHHPLSRLAAASLARALHLKRRDPNHHSQKGSGGHPSVPATAALYPHSYGGYAFTASLGTPPQPLPVLLDTGSHLTWVPCTSSYECRNCSSPSASAVPVFHPKNSSSSRLVGCRNPSCQWVHSAANLATKCRRAPCSPGAANCPAAASNVCPPYAVVYGSGSTAGLLIADTLRAPGRAVPGFVLGCSLVSVHQPPSGLAGFGRGAPSVPAQLGLPKFSYCLLSRRFDDNAAVSGSLVLGGTGGGEGMQYVPLVKSAAGDKLPYGVYYYLALRGVTVGGKAVRLPARAFAGNAAGSGGTIVDSGTTFTYLDPTVFQPVADAVVAAVGGRYKRSKDAEDGLGLHPCFALPQGARSMALPELSFHFEGGAVMQLPVENYFVVAGRGAVEAICLAVVTDFGGGSGAGNEGSGPAIILGSFQQQNYLVEYDLEKERLGFRRQSCTSSPS

SEQ ID NO: 4443 - DNA, 2142 bp, Zea mays
  misc_feature (1)..(2142): Ceres cDNA ID no. 21705348
  misc_feature (1)..(2142): Ceres CLONE  ID no. 1387127
  misc_feature (1)..(2142): Also known as  Ceres CDNA ID no. 25088177
cttctgccattccgccgaacaccttccccaatcgtgcgcctccggccatgggggaagcctccgacgcggcggtagccgtatctgcgcggctcctggagctggcggccgaagacgactctgcagcgctcggtgacctccttgcggcacacccgtcgcttgctgacgagcccgcgccgtggtactccccggcgcgcggcgcggagcctatgaccccgctcatggtcgcggcggcgtacgggtccgtggcctgcatcgatgtcctactctctccgccccaccagaccgaccccaaccgcgcctcaccgtcgtccctctccaccgcgcttcatcttgcagccggcggcggcgcctccgctgcgccggctgcggtatcccgtctcctagctgctggcgccgaccccacgttggtcgaccacctccatcgccgaccgtccgacgtcgtcaccctcccacccaactcgctcccgctcaagaaccaccttctctctctcctcggagggcgcaaggagtggccgccggatccctccctccccgacatcaagaatggtgcctacgcctccgacgacttccgcatgtactccttcaaggtgcgcgcgtgctcgcgcgcctactcccacgactggaccgagtgccccttcgtccaccccggcgagaacgcgcggcggcgggacccgcgcatgtaccactacagctgcgtgccgtgccctgagttcaagaaaggggcggggtgccggaggggcgacatgtgcgagtacgcgcacggggtgttcgagagctggcttcacccggcgcagtatcggacgcgtctgtgcaaggacggcatcggctgcgcgaggcgcgtctgcttcttcgcgcacacgcctgaggagctccggccactctacgtgtcgtcggcagggtcgcgcagcgcgatggagatggcagcggcgatgggcatgggactgtcttcgccgggtgcgtcgttcacgccgccgctgtcaccttgcgccggcggaagcggcgtgaccggcgcgtggccgcagcccaacgtgcccgcgctgtgcctccccgggagcgcggggaaccttcacctgagccggttgcgtacttcgctgagcgcgcgcagcatggcagtggacgagctgctcgcctcagcggattacgacgggctcgtcggatcgccagcctctgtgcggtcggcgaggggaaagacgctcgcgccatccaatcttgatgatctgttctccgcggagatggcgggcgccgcggcatctcactcgcctcggtacgcagaccagggcggctctgctttctcgccgacgcgtaaggccgccatgctgaaccagttccagcagcagcagagcttgctgtctcctcgggccacggctatccctgagccagtgtctccgatgagctccaggctgctcgcggcccttgcgcagcgagagaagatgcagcagcagacgctgagaagcatgagctcccgtgactttgcctctggcgcctccgtcctggttgggtcaccggttacctctagctggtccaaatggggaatccccccgagcacaccagattggggtgctgacgacgaggaactcggccgcctcaagcgatcctcgtcctttgagctccggagcggtgccaacggagatgagccggacctctcatgggtcaatacccttgtgaaggagccgacgccggagaagccattcatcaacgggacaactgcaaaggagaccattgcttctttgagtgaggccgcgagtcatgaggacatcggcggcgaggacgacacagccggggtcatcggtggctggcttgaacagctccagctggatgagatggtagtctagaacaaacataaacataaatcaaaggtgccattttttttttttgttgtgattcaccagttgcttctacagctaactacatctaccaaccttcatacctcgctggtaattactggtgatacattctgttggagttggttagtgtaggtgttgagatttgcaccaccatttagaattccccgcaagtgagagaaatgaaggaaatggaaaccaatgcaactatatggaatttcaggtttcggtaggtggacattgtgtttctccttgtactttccacatccatatcctttgctcaacaaaaaaaaaaaaaaaa

SEQ ID NO: 4444 - protein, 594 aa, Zea mays
  misc_feature: PFam Name: Ank; PFam Description: Ankyrin repeat
  misc_feature: PFam Name: zf-CCCH; PFam Description: Zinc finger
  misc_feature: GI Number: 20334714; NR Description: At2g41900/T6D20.20 [Arabidopsis thaliana] >gi|20198317|gb|AAB63552.2| putative CCCH-type zinc finger protein [Arabidopsis thaliana] >gi|14335106|gb|AAK59832.1| At2g41900/T6D20.20 [Arabidopsis
  misc_feature: GI Number: 25408764; NR Description: probable CCCH-type zinc
  misc_feature: GI Number: 21655307; NR Description: AT5g58620/mzn1_70 [Arabidopsis thaliana] >gi|8843784|dbj|BAA97332.1| zinc finger transcription factor-like protein [Arabidopsis thaliana] >gi|17064830|gb|AAL32569.1| zinc finger transcription factor-like
  misc_feature: GI Number: 51963484; NR Description: PREDICTED OJ1092_A07.129 gene product [Oryza sativa (japonica cultivar-group)] >gi|34899832|ref|NP_911262.1| CCCH-type zinc finger protein-like protein [Oryza sativa (japonica cultivar-group)]
  misc_feature: GI Number: 7630041; NR Description: zinc finger transcription factor-like protein [Arabidopsis thaliana] >gi|11358930|pir||T49899 zinc finger transcription factor-like protein - Arabidopsis thaliana >gi|15239917|ref|NP_196789.1| zinc
  misc_feature: Phenotype: Useful for increasing chlorophyll and
  misc_feature: Phenotype: Useful for making ornamental plants with modified leaves
  misc_feature: Utility: Useful for making plants tolerant to low nitrogen
MGEASDAAVAVSARLLELAAEDDSAALGDLLAAHPSLADEPAPWYSPARGAEPMTPLMVAAAYGSVACIDVLLSPPHQTDPNRASPSSLSTALHLAAGGGASAAPAAVSRLLAAGADPTLVDHLHRRPSDVVTLPPNSLPLKNHLLSLLGGRKEWPPDPSLPDIKNGAYASDDFRMYSFKVRACSRAYSHDWTECPFVHPGENARRRDPRMYHYSCVPCPEFKKGAGCRRGDMCEYAHGVFESWLHPAQYRTRLCKDGIGCARRVCFFAHTPEELRPLYVSSAGSRSAMEMAAAMGMGLSSPGASFTPPLSPCAGGSGVTGAWPQPNVPALCLPGSAGNLHLSRLRTSLSARSMAVDELLASADYDGLVGSPASVRSARGKTLAPSNLDDLFSAEMAGAAASHSPRYADQGGSAFSPTRKAAMLNQFQQQQSLLSPRATAIPEPVSPMSSRLLAALAQREKMQQQTLRSMSSRDFASGASVLVGSPVTSSWSKWGIPPSTPDWGADDEELGRLKRSSSFELRSGANGDEPDLSWVNTLVKEPTPEKPFINGTTAKETIASLSEAASHEDIGGEDDTAGVIGGWLEQLQLDEMVV

SEQ ID NO: 4445 - DNA, 1936 bp, Zea mays
  misc_feature (1)..(1936): Ceres cDNA ID no. 21705349
  misc_feature (1)..(1936): Ceres CLONE  ID no. 1390609
  misc_feature (1)..(1936): Also known as  Ceres CDNA ID no. 24365181
gagctgagctctagtgatagactggtaggtcctagctgcgcgcacgtgcactaggagggagccatactgcgcgcgcggcattccgtccatcgtcggtcgattggtatggcgggtcgtcggggcgactcggcgcctgcggcgccgttgctggagaacaaggcggcgccggcgtcggaggcggaggcgggcggcgggtaccaccaccacaactactactactacgtggacgggtgccccgggtgcgccgtggaccggcgcaaggcggcgagcccgggcatcccctacgccaacttcatctacgtctggatcgtcaccctctgcacagccctacccatctcatcgctgttccccttcttgtatttcatgataagggacctgaacgtcgctgaaagaaccgaagacatcggcttctacgccggcttcgtaggtgcctcgttcatgttcggtagatgcttgacttcaaccgcctggggaatagcggcggaccgcatcgggaggaaacctgtcgtcgtgttcggcatctcctctgtggtcgtgttcaacacgctgtttggcctgagcgtcaactactggatggcaatcgccacacggttcctgtttggtgctttgaacggcttgcttggaccaataaaggcttatgccatcgaagtctgccggcctgaacatgaagctctagcgctatcacttgtcagcacggcatgggggataggcctcatcatcggcccagctcttggaggctaccttgcactgcctgcagagaacttcccggctatcttttcacctgactcggtatttggaaggttcccgtatttcctaccatgcctttgcacgtcggtcttcgctgctgctgttctagtgagctgcatatggatgccggagactctgcacaggcacaaagttcacgagagtacgagccaggacgttgaaaaggttcaagaaagcggcattaggaagaagaagagcttattcaggaactggccgttgatgtcgtcgataattgtctactgcatcttctcgttccatgacatggcttacacagaggtgttctctctatgggctgaaagtgacaagaagtatggtggactgagcttatcatctgaggacgttggtcaagttcttgcagtcactggtgccagtcttcttgtttatcaactctttctataccctagaatcaataaggttctcgggccgatcaaatcttctcgaattgcagctatcctgtgcatatctatcctctttgcctacccctacatgacatacatctcagaaccaggactgtcaatcattttgaacattgcgtcagtgataaagaataatcttgctgtgacgatcattacaggcactttcatccttcaaaacaatgcagtgcctcaggatcaacgaggagctgcgaacggactgtccatgacagggatgtccttcttcaaggcacttgctccggcaggagcgggcattgtgttctcgtgggcgcagaaacgccagcatgcctttttcttcccaggtgatcagatggtgttcttcctgctgaacgtcgttgagctggtcgggctcatcctcacattcaaaccctttctggcagtgccagagcgatgcgatagtagatagctgttctttggaggatgaactatagaagttttggaatgattcaaaatttcatcgtgtatggcagcaataccagtgagacccaggaagaagcaagagctgtgtactggtaaccgtaagcggtgtatgcagtatcgctgcattagcatttgtgcttacgaaatgcacatgtatgtaggtgataaatgactaaatgtggccagtggatcgagttgttgctgcactgtgagtagtggtagtgtaagattcagcgactcgaaattgtctgttggaaataaaattggtaggtgttagacgcgcggtatgagcgccaatcagaaaaaaaaaaaaaaaa

SEQ ID NO: 4446 - protein, 499 aa, Zea mays
  misc_feature: PFam Name: MFS_1; PFam Description: Major Facilitator Superfamily
  misc_feature: PFam Name: Sugar_tr; PFam Description: Sugar (and other)
  misc_feature: GI Number: 20857393; NR Description: AT5g13750/MXE10_2 [Arabidopsis thaliana] >gi|17065582|gb|AAL32945.1| transporter-like protein [Arabidopsis thaliana] >gi|14517414|gb|AAK62597.1| AT5g13750/MXE10_2 [Arabidopsis
  misc_feature: GI Number: 23452821; NR Description: major facilitator
  misc_feature: GI Number: 23452823; NR Description: major facilitator
  misc_feature: GI Number: 56783728; NR Description: putative major facilitator superfamily antiporter [Oryza sativa (japonica
  misc_feature: GI Number: 22326785; NR Description: sugar transporter family
MAGRRGDSAPAAPLLENKAAPASEAEAGGGYHHHNYYYYVDGCPGCAVDRRKAASPGIPYANFIYVWIVTLCTALPISSLFPFLYFMIRDLNVAERTEDIGFYAGFVGASFMFGRCLTSTAWGIAADRIGRKPVVVFGISSVVVFNTLFGLSVNYWMAIATRFLFGALNGLLGPIKAYAIEVCRPEHEALALSLVSTAWGIGLIIGPALGGYLALPAENFPAIFSPDSVFGRFPYFLPCLCTSVFAAAVLVSCIWMPETLHRHKVHESTSQDVEKVQESGIRKKKSLFRNWPLMSSIIVYCIFSFHDMAYTEVFSLWAESDKKYGGLSLSSEDVGQVLAVTGASLLVYQLFLYPRINKVLGPIKSSRIAAILCISILFAYPYMTYISEPGLSIILNIASVIKNNLAVTIITGTFILQNNAVPQDQRGAANGLSMTGMSFFKALAPAGAGIVFSWAQKRQHAFFFPGDQMVFFLLNVVELVGLILTFKPFLAVPERCDSR

SEQ ID NO: 4447 - DNA, 2157 bp, Zea mays
  misc_feature (1)..(2157): Ceres cDNA ID no. 21705350
  misc_feature (1)..(2157): Ceres CLONE  ID no. 1393779
  misc_feature (1)..(2157): Also known as  Ceres CDNA ID no. 0
ctaactacttccctgtacgtggacgaggaccaaggagacagagagaaagcctggccgcgccgcccaccgtcgcctcgtcagtcgcctcctccatcctccctccccatcgacttcccaaatcccatccagatctcctcgtcctctggcccattctcttcatctccatgcatggatgaacaagagacggagggagacagatgcaaacatcgagactggggttgttatctgtctttgtagcagaagaaacagtcctaaaaaagaatggagagctcctcagataggagcaacgtttctcaggggaaccacctgggttatgcgagaagcacatccatggattccactggtcctcagttagctggtaggtctagctcaatgttgagtaggagaagtagcagacagggctcaaggggatccatcagcctctcaagggagatgggggactccatactgagctcaatgaggcattctcttcagtcggcggatcaattgctaggagacatcgatagctcagttctggctcaactcatcgaaagtggtcgagttctatcacccgaaggcgatgttgatgaggatacagtaagaatctctgaacatcataaggttggccctgttccagatgatgcaataaagcaaaccagtgacaattttgcatcagcacctatatcttcagcggagacaaaagacactatttctaacgtcctagcagattcatctactaaggttgaaccatataagctttctctgaggctagactatgctgcttacatgatccatttagctgtctttggctttttcggggtattcacaaggtatgggctccaaaagctgtttggcccagactgtttggcactcacttcagatcaaagcccactttaccctgatcttccatctaatatgcttgggtctttcttgatgggctggtttggtatcattttcaaggctgatatacgatacatatctgaccatcttattgtcggaatcacaactggatacatgggaagccttacaaccttcagtgggtggaaccagaaaatggttggtttgtcttccaaaggccattgggtatatgctatagcgggcgtagtactagggatgttcattgtcaacgagtccattacggttggtgctgagacgggcgagcgcctacggagtttgatcctgaaatacatcagggagaagagtttgataggtcacaagtatgattgggagcactggagggtgaataccagggctaagcagtcagtgcttttgtcagtgatgataattttgatgtctttcttttggattttgagcattgtgctgactgtagtaaagatgcatagtcttgctgatggtgctgtcctatggatgggctgctcggtagcacctccaggtgtttggttacgctggtacctggcaaggctcaatggccagggaattggcaaacagagatccttgaaatggctgcccactgggactctggtagccaatgttcttgctgcaggcataatggcagttcttgctgtaacatccaaagcggtagatacaaagcgatcaacaactattcttagtggaatacagctcggcttccttggttgcctaagcacagtgtctacttttgctgctgaagtgtatacaatgagaagaagcgggcagattgccagggcctttgtttatgccgcatccaccttcctgctttcttttctgctaggaactctagtgtattctgtgccagtttgggaaaagcattataaatgacctattgcaacttccagattcaacattttaccagatggcttaaatgtgcaatgggaaagagagcatcaacttcctgaacaaagtacaagatacagagccaagacctcaaaggttcacagatgcaaaagagagcatcaacacaaacgtttgcagaatggacccacagaaccatctatatacctggctgggaaaaacagagtaaactttgcttagtagaatatgtagtggcgtggaataatttttgtcttggagaatggagtacatgtatgtatctgtgaactagatgtatcattaatgcatgagatatgcatagatgaatttaattagtgtgggattagctccactttattctcatgctgtctcatgtaaatgcaggacatctagaaatgtttttcttgttactcaaaaaaaaaaaaaaaa

SEQ ID NO: 4448 - protein, 491 aa, Zea mays
MESSSDRSNVSQGNHLGYARSTSMDSTGPQLAGRSSSMLSRRSSRQGSRGSISLSREMGDSILSSMRHSLQSADQLLGDIDSSVLAQLIESGRVLSPEGDVDEDTVRISEHHKVGPVPDDAIKQTSDNFASAPISSAETKDTISNVLADSSTKVEPYKLSLRLDYAAYMIHLAVFGFFGVFTRYGLQKLFGPDCLALTSDQSPLYPDLPSNMLGSFLMGWFGIIFKADIRYISDHLIVGITTGYMGSLTTFSGWNQKMVGLSSKGHWVYAIAGVVLGMFIVNESITVGAETGERLRSLILKYIREKSLIGHKYDWEHWRVNTRAKQSVLLSVMIILMSFFWILSIVLTVVKMHSLADGAVLWMGCSVAPPGVWLRWYLARLNGQGIGKQRSLKWLPTGTLVANVLAAGIMAVLAVTSKAVDTKRSTTILSGIQLGFLGCLSTVSTFAAEVYTMRRSGQIARAFVYAASTFLLSFLLGTLVYSVPVWEKHYK

SEQ ID NO: 4449 - DNA, 1839 bp, Zea mays
  misc_feature (1)..(1839): Ceres cDNA ID no. 21705351
  misc_feature (1)..(1839): Ceres CLONE  ID no. 1393827
  misc_feature (1)..(1839): Also known as  Ceres CDNA ID no. 0
atccactgtaccggagctccaccacgtcctccggcaagaaacagatgaaagacagcgacgacgagggcgccggcgatggcgtcaaccgcccgcacccgtccaacaaccttccactgccggctccacactccgacccgaacctccagttctcgggtgggacggacgatgagtcctcgaaccgggacagcagctcctctgccaccggcggcgcgagcccggggtactactccgactacccgtccagcttcagcggcgagtgctcgccgtacaacatgtccccctggaaccagaccatggcgtctccctggtcgcaccacagcgaggccgccgggctcggaggcggcccgcccacgatggcgccggggacgagtctcatcagctcgctggtgagggaggaaggccacatctactcgctcgccgccaagggcgacacgctgtacaccggctcggacagcaagaacatccgcgtctggcgcaagcagaaggactcgggagggttcaagtcctcgagcggcctcgtgaaggcgatcgtcatgtccggcgagcgcatcttcacgggccaccaggacggcaagatcagggtgtggaaggtgtcggccaagaacggcatgcacaagcgcgtcggcagcctgccccgcctgcgcgacttcctgcgcggctcgctgaacccgtccaactacgtggaggtgcgcaagaaccggtcggcgctgtggatccggcacagcgacgccgtgtcgtgcctgagcccgacggacccggcgcaggggctgctctactccggctcgtggtaccgcaccttcaaggtgtggcgcatcagcgactccaagtgcctcgagtcggtggtggcgcacgacgacaacgtcaactccgtcgtggcggcgttcgacgggctggtgttcacgggctcggccgacggcacggtcaaggtgtggcggcgcgagcagcaggggaagggcaccaagcacacggccgtgcagacgctgctgaagcagcacgcggtgaacgcgctcgccgtgagcgccgtcgcgcccgtgctctactgcggctcctccgacggcctggtcaacttctgggagggcgaccgccacctcgtccacggcggcgtcatgcgcggccacaagaaggccgtgttctgcctcgccgcggccggcgcgctactgctcagcggctccgccgacaacaccatcttcgtgtggcgccgcgactgcggggtgcactcgtgcctctcggtcctcacgggccacaccgagcccatcaggtgcatcgccgtcgtcgaggacaacggcgagaacagcagcgagtccaacgccggtgactccgctgccggaggggggtcgtcggcgtcgcggtggatcgtgtacaccggcagcctcgacaagtcgatcaaggtgtggcgcgtgaccgacgaggcgccggacccgctgttccacggctccggcgatgcgccccagatattcgaccggtatcccggcgacgccttcgggaccagtggctcgacgacgtcgttccgctaagacgatttgtctgatcgatcacatgcagcgaaattacacgtcgtctcacttcacaagaaaacgtcttgggaggactaaattatactctaaatacatatacatataccacgtccatatatacactgttggaaatggctgaaattgtaaggtataaaaatttatgatctatagcttgtgctgggcacaaccgcacgagctatgtagtttggttaccttttaaatttgtgagttgtgacagagatggcgaatttagttaggtatacgtttgctttttgcaactttgcattgctatatggcaaattttgaaacaaaaaaaaaaaaaaaa

SEQ ID NO: 4450 - protein, 489 aa, Zea mays
MKDSDDEGAGDGVNRPHPSNNLPLPAPHSDPNLQFSGGTDDESSNRDSSSSATGGASPGYYSDYPSSFSGECSPYNMSPWNQTMASPWSHHSEAAGLGGGPPTMAPGTSLISSLVREEGHIYSLAAKGDTLYTGSDSKNIRVWRKQKDSGGFKSSSGLVKAIVMSGERIFTGHQDGKIRVWKVSAKNGMHKRVGSLPRLRDFLRGSLNPSNYVEVRKNRSALWIRHSDAVSCLSPTDPAQGLLYSGSWYRTFKVWRISDSKCLESVVAHDDNVNSVVAAFDGLVFTGSADGTVKVWRREQQGKGTKHTAVQTLLKQHAVNALAVSAVAPVLYCGSSDGLVNFWEGDRHLVHGGVMRGHKKAVFCLAAAGALLLSGSADNTIFVWRRDCGVHSCLSVLTGHTEPIRCIAVVEDNGENSSESNAGDSAAGGGSSASRWIVYTGSLDKSIKVWRVTDEAPDPLFHGSGDAPQIFDRYPGDAFGTSGSTTSFR

SEQ ID NO: 4451 - DNA, 2001 bp, Zea mays
  misc_feature (1)..(2001): Ceres cDNA ID no. 21705352
  misc_feature (1)..(2001): Ceres CLONE  ID no. 1394919
  misc_feature (1)..(2001): Also known as  Ceres CDNA ID no. 24359603
gaaattttaacttgttgcttctctccctcttctgttctgtctcgtccccttcacgaatcacgacagtattgaagcaattcctgattgctgatcctccacaatttctcccgtggattggagcgatctgaattggagccgtttactgctgacatggcgggaactgatcgcctctaccctgaaattgggacgtatgacctggagcccccgcaggtcccagcctccgccgggggcagcggcgaggaggaggccggggtttgcgacgcactggtgatgtgggacgacgaatccgacgcgtgtccctcccatgaagcggcccccatcatatttgagaagggcactagggatcctcctcctaaagttttcaaggaagaaaggcttgatgttgtccattattcagagttcagcgatgagatggcgactgagaaggaattcggagaaaacaactatgacagtttcccttcttgtgaacaaacaggcatcatatgggtgcctccctctgttccacctatgccaaaacatgatcacgatgagtggcaaaagggctttggttacaatagtccgtgcttcccagaggaagaatataagtgggatattgacgaagaaaatttggagatgacaatgtgggatgtgctctctgagatggttgttgcaggaaaggataaaatattatccattgcatcatttgatttaggaatgtatggcacgtctatgatttcagatttttgccttgaagagactttgaaggataaggcccaaacacttaaagatgtcagtgctggttctgaacatgctctccttgagacagaactaacaaagtggttgcctgatagtgcttcaacttcctgtatgctttgtggagcacgttttcatccaataatttgtgctcgccatcattgccgattttgtggtgggatattttgtggtggctgttcaaagggtagaagcttgatgcccccaaagttcatgaactcagatcctcaaagggtctgtgatgtttgtggagtgcgtcttgagtgtatacaaccttatttgatgaatcgattcagtcgtgcttgtcaacttccaactcaagacttgactgacctaagcaccttgaggtcatggataaacaccccatgggcagtcagaatggagtatgagatctacaaagcggcaaattccatacatggctattgtaaggtgggagagctgaaacctgagaagtcgatccctgattcaattctcagacaagcaaaagggcttgcaatcatcactgaggtaaaggttggagtgatgcttacatacaaaatcggtactggattggttgttgctcggagaggtgatggttcttggtcccctccttcagccatctctacttgtggtcttggatatggagttcaggctggaggtgagttggctgactacatcattgttcttaggaacaaagatgccatcaaaacttttagtggaaatgcacatatgtcaattggggctggtgttagtgcttctgctggtcattttggacgagtggcagaggctgatttccgtgctggtgatggtggttatgctgcctgttacacatacagttgtagcaaaggtgcctttgtgggctgtgcgctcaatggaagtgtggtgtccactcgagactcggtaaatgcccggttttacggtggtccgattaaggcctcagaaatccttcttgggtcgctgccaaaaccgcctgttgccgcaactctatacaaggctttatctatattatttgataagatcgagaagtgaatctcctgatccttctctttagtttgcgacacgcagggtagcatggtgaattgaattatttatgggtcattggttcgctctatttaccttatcctagttggtgatgatgcaagtgtacacctgacgatccactgttttccatcaaactgaggtatttggaaccacaaaccactctgtaaattttgtagacaattctcgttagaaatgaaaaggaaaccattttttccaaaaaaaaaaaaaaaa

SEQ ID NO: 4452 - protein, 535 aa, Zea mays
  misc_feature: PFam Name: FYVE; PFam Description: FYVE zinc finger
  misc_feature: GI Number: 53792650; NR Description: LAs17 Binding
  misc_feature: GI Number: 50251785; NR Description: LAs17 Binding protein;
  misc_feature: GI Number: 30690908; NR Description: zinc finger (FYVE type)
  misc_feature: GI Number: 21536658; NR Description: unknown [Arabidopsis thaliana]
  misc_feature: GI Number: 50935745; NR Description: LAs17 Binding protein-like [Oryza sativa (japonica cultivar-group)] >gi|34394538|dbj|BAC83843.1| LAs17 Binding protein-like [Oryza
MAGTDRLYPEIGTYDLEPPQVPASAGGSGEEEAGVCDALVMWDDESDACPSHEAAPIIFEKGTRDPPPKVFKEERLDVVHYSEFSDEMATEKEFGENNYDSFPSCEQTGIIWVPPSVPPMPKHDHDEWQKGFGYNSPCFPEEEYKWDIDEENLEMTMWDVLSEMVVAGKDKILSIASFDLGMYGTSMISDFCLEETLKDKAQTLKDVSAGSEHALLETELTKWLPDSASTSCMLCGARFHPIICARHHCRFCGGIFCGGCSKGRSLMPPKFMNSDPQRVCDVCGVRLECIQPYLMNRFSRACQLPTQDLTDLSTLRSWINTPWAVRMEYEIYKAANSIHGYCKVGELKPEKSIPDSILRQAKGLAIITEVKVGVMLTYKIGTGLVVARRGDGSWSPPSAISTCGLGYGVQAGGELADYIIVLRNKDAIKTFSGNAHMSIGAGVSASAGHFGRVAEADFRAGDGGYAACYTYSCSKGAFVGCALNGSVVSTRDSVNARFYGGPIKASEILLGSLPKPPVAATLYKALSILFDKIEK

SEQ ID NO: 4453 - DNA, 1793 bp, Zea mays
  misc_feature (1)..(1793): Ceres cDNA ID no. 21705353
  misc_feature (1)..(1793): Ceres CLONE  ID no. 1400223
  misc_feature (1)..(1793): Also known as  Ceres CDNA ID no. 24372181
atcaccgccgcggcctctatttctcccccatcccccctcgcatgccccgctcgccgccgctacctcctcccgcccctaggtgacggtgactcactgactccctacttccgtcgcccaaatttctatctcactatctccgccgcgagatctccggctgcccgcccatggtcgccgcctccggcctcgcgctgccgcgggtatccgcaccatgcccggtgcgcacgcgtggtggcctccgccccgccttcctccgagtcgcgcagcccgtgacgctgccaccgccccagctccggtgctgcgcgtccaccgtcgacgatggcgtggtgtccgctgcggcttccaagccccgcctccccagggtggttggtatgggttcaaagctcgttggatgtggatcagccatcccaacacttagcgtttcaaatgatgacctttcgaagatagttgaaacatcagatgaatggattgcggctcgaactgggattcgtaacaggcgagttctttcaggagatgaaacattgcggggactctcgatacaagcagctcaaagggcacttgagatggccggagtaaaagctgaagatgtcgacctcgttcttctttgtacatctactccagatgatctgtttggaggtgctgctcaggtgctgtccgaagtggggtgcacaaaagcttttggatttgatattacagctgcttgtagtgggtttttagtcggcttaatcacagctactcgctttatcaaaggcggaggttttcagaatgtcttagtaattggtgcagatgctctttcaaaatacgtggattggacagacagaggtacatgcattctttttggtgatgctgctggtgctgtgttggtacaggcatgcagtgctgatgaagatggcatgcttggtttttgtgttcaaagtgatggcaatggacaaaagcacctaagtgccatagcggctaatgacgagtctatcttgtccaataccaatggtgttccaggatttccgccaaagaaggcaacctactcatgcattcaaatgaacggaaaggaagtttttcgctttgctgtccgatgcgtgccacagtccattgagaaggcactccaagaagctggtttgcctgcctccagtatcgactggttgttgttacatcaagctaatcagcgtattattgatgctgctgccagtagattagatatcccatccgacaaggttatttcaaatcttgctaattacggcaataccagtgcggcatccatcccattagcattggatgaggctgttcgcagtggcaaggtgaagactggtgatattattgccgcatcaggttttggcgctggacttacctggggttcagctattgtcaaatggggctaattattctacgtgagccataacaacatcaatgagatcttcataggccttggggacctacatctatttggtctctccccccttccacccattttctgtgcaacatttttctatcgcatgtgtcggtcttccttgcacatgaaaatctagtgccattttaccgtattcctttggctcattacacaactgagagtagattggtggatgaaaatggttgaattttgcatcgaggatgattgtggtggtactaaagatgagattacactgtaaagttaatgagcctttttgtcagggaattttactgaataagcatgtacaaggagaggtgggccgtggacatatgctgtaggacaattcttagtaattttgttctgcttttattatacacctattgttagtatattttgttcaaaaaaaaaaaaaaaa

SEQ ID NO: 4454 - protein, 401 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: HMG_CoA_synt; PFam Description:
  misc_feature: PFam Name: ketoacyl-synt; PFam Description: Beta-ketoacyl
  misc_feature: GI Number: 1143069; NR Description: 3-ketoacyl carrier protein synthase III >gi|7433764|pir||JC5647 3-ketoacyl-acyl
  misc_feature: GI Number: 10120315; NR Description: beta-ketoacyl-acyl
  misc_feature: GI Number: 7862174; NR Description: beta-ketoacyl-acyl
  misc_feature: GI Number: 311686; NR Description: 3-ketoacyl-acyl carrier protein synthase III (KAS III) [Spinacia oleracea] >gi|1345946|sp|Q07510|FABH_SPIOL 3-oxoacyl-[acyl-carrier-protein] synthase III, chloroplast precursor (Beta-ketoacyl-ACP synthase
  misc_feature: GI Number: 20258997; NR Description: putative 3-ketoacyl-acyl carrier protein synthase III (KAS III) [Arabidopsis thaliana] >gi|17380660|gb|AAL36160.1| putative 3-ketoacyl-acyl carrier protein synthase III (KAS III) [Arabidopsis protein synthase III
MVAASGLALPRVSAPCPVRTRGGLRPAFLRVAQPVTLPPPQLRCCASTVDDGVVSAAASKPRLPRVVGMGSKLVGCGSAIPTLSVSNDDLSKIVETSDEWIAARTGIRNRRVLSGDETLRGLSIQAAQRALEMAGVKAEDVDLVLLCTSTPDDLFGGAAQVLSEVGCTKAFGFDITAACSGFLVGLITATRFIKGGGFQNVLVIGADALSKYVDWTDRGTCILFGDAAGAVLVQACSADEDGMLGFCVQSDGNGQKHLSAIAANDESILSNTNGVPGFPPKKATYSCIQMNGKEVFRFAVRCVPQSIEKALQEAGLPASSIDWLLLHQANQRIIDAAASRLDIPSDKVISNLANYGNTSAASIPLALDEAVRSGKVKTGDIIAASGFGAGLTWGSAIVKWG

SEQ ID NO: 4455 - DNA, 1602 bp, Zea mays
  misc_feature (1)..(1602): Ceres cDNA ID no. 21705355
  misc_feature (1)..(1602): Ceres CLONE  ID no. 1410631
  misc_feature (1)..(1602): Also known as  Ceres CDNA ID no. 24365190
atccccctctgctacgctttgttctgggctcttcctggctgcctcctcttcctcctcccctgtacagagagagagaacccagagagagggagcgggctctgagagaaccggagatggggaacatctgcggtggctccgggaaggatcgggtggccgaggatttcaggccgtctagcccagggacaacaatgacctccaagacgagcggcagcataaccaccagcctgagcaccacggggaagctctcctccgtgggcagcagcttcatggcgtccgccggcagccgcagcaccagcggcggattcgacgagggggccaagtactccgacggccagatcctcgaggcgcccaacctccgcaccttcacattcgtagagctcaagacggccaccaagaacttccggccggacagcgtccttggcgaaggagggttcgggagagtctacaaagggtgggtggatgagaagaccatggcgccgaccaggaacagcaccggcatggttgttgcggtcaagaagctcaactcggagagcatgcaggggtttgaggaatggcagtcggagataaattttctaggaaggctctcccatccgaacctagtgaagctcttgggctactgctgggaggacaaggaacttcttctcgtgtacgaattcatggccaaagggagcttggaaaaccacctattcaggagaggatgtgcccccctgtcctgggaactgaggctgaagatagccattggtgcagctcgagggctcgcgttcttgcatgcatcggaaaagcaagtaatctaccgtgatttcaaggcgtctaacatccttttagacgcgaactataacgcaaagctctccgatttcggccttgctaagctggggccaactggtagcaactcgcacatcacaaccagggtgatggggacatatgggtatgcagctccagagtacgtagccaccgggcatctgtacgtgaagagcgacgtgtacggcttcggcgtggtgatgctggagatgctgtcggggcagcgggcgctggacccgaaccggccgagcgggcagctgagcctggccgactgggcgaagccgtacctggcggaccgccggaggctggcgcggctcatggacccgcggttcgagggccagtacaactccaggcaggcgttccaggcggcgcagctgacgctcggctgcctggccggcgacccccgcagccggccctcgatgaaggaggtggtggagacgctggagcgggtggaggcggtgaagagccggacgcgcggcggcgggtccgggtctggccgcgccggtgccgcgccgcaccaccgctcgccgcgcgtcggtggcggctcccgtgccgcgtccaggcccgccgccaacggccacaacgccaggcccgcgcgatgacgctccggcagggtggtgagtggtgacgattctaaatgtaaatggcgtcttttttttttttttgttgcctggttcgcgtgctgttcatgcatggtggcggtggcggctgctgttgttgtaagttgtagccaatagtgtaatagttaaaaaatactagaagaaaggaataaccattcaatcaaaaaaaaaaaaaaaaaaaaaa

SEQ ID NO: 4456 - protein, 428 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 21555255; NR Description: serine/threonine-specific protein kinase NAK [Arabidopsis thaliana] >gi|7406425|emb|CAB85534.1| serine/threonine-specific protein kinase NAK [Arabidopsis thaliana]
  misc_feature: GI Number: 166809; NR Description: protein kinase
  misc_feature: GI Number: 42569425; NR Description: protein kinase (APK1b)
  misc_feature: GI Number: 53689728; NR Description: serine/threonine protein
  misc_feature: GI Number: 8778537; NR Description: F22G5.5 [Arabidopsis thaliana]
MGNICGGSGKDRVAEDFRPSSPGTTMTSKTSGSITTSLSTTGKLSSVGSSFMASAGSRSTSGGFDEGAKYSDGQILEAPNLRTFTFVELKTATKNFRPDSVLGEGGFGRVYKGWVDEKTMAPTRNSTGMVVAVKKLNSESMQGFEEWQSEINFLGRLSHPNLVKLLGYCWEDKELLLVYEFMAKGSLENHLFRRGCAPLSWELRLKIAIGAARGLAFLHASEKQVIYRDFKASNILLDANYNAKLSDFGLAKLGPTGSNSHITTRVMGTYGYAAPEYVATGHLYVKSDVYGFGVVMLEMLSGQRALDPNRPSGQLSLADWAKPYLADRRRLARLMDPRFEGQYNSRQAFQAAQLTLGCLAGDPRSRPSMKEVVETLERVEAVKSRTRGGGSGSGRAGAAPHHRSPRVGGGSRAASRPAANGHNARPAR

SEQ ID NO: 4457 - DNA, 1964 bp, Zea mays
  misc_feature (1)..(1964): Ceres cDNA ID no. 21705356
  misc_feature (1)..(1964): Ceres CLONE  ID no. 1414975
  misc_feature (1)..(1964): Also known as  Ceres CDNA ID no. 23852536
agcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctgcctgcgcgccggcggcggccgtccatctcggcacccagcacaagctgacggcgctcctcgtcgcgctcgcgctcctcctcgtcctccctcgccctcctctctcaggggtcccggtggtgtcgccccgcaggatggcgaggatccgcagccacgtggagaggatcaacaagacccccgtgcgctccattgagagccaggacggcgacaccatcgactgcgtggcggcgcacgagcagcacggcctggaccacccgctcctcagggcgcacgccgtccagacggagccgcccgaggcgccgaggggcggcggcgcgctctccttcccggctggctctgcgacgagcggcagcggcgcaggcaaggacgacagcaggcggggcgcgtggcagacgtggcaccacggcgggcactgtccccggggcacggtggccatccggcggacgagcgccgaggacgtgctgcgcgccggatccatctcccgcttcggccgcaagaggaggcaccggaaggtcgccgccgccgccgccgcgcgcgcggcctacgcgccggacgtcatcaccggcaacgggcacgagcacgcgatcgcgtacacggcgccgtcgcagcagccggtgtacggcgccaaggccaccatcaacgtgtgggatccggccatccaggagtccaacggcttcagcctctcccagctctgggtcctctccggctccttcaacggctccgacctcaacagcatcgaggcaggatggcaggtcagccctgagctgtacggggacagcaggccgaggctcttcacgtactggacaagcgacgcgtacgaggctactggttgctacaacgcgctgtgcccgggattcgtgcagacgagctcccgcatcgccatcggcgcgtccatctcgccggtgtcgtcggccggcggcgcgcagtacgacatgacgctgctggtgtggaaggacccgaagctgggcaactggtggctcagctacggggaccagctggtggggtactggccggcgcagctgttcacgcacctgtcggaccacgccaccatggtggagtggggcggcgaggtggtggacaccaggcccggcggggcgcacaccgccacgcagatgggctcgggccgcttcgccgccgagggcttcggccgcgccagctacttccgcaacctggagacggtggacgccgacaacagcctggccgaggtggcgctcgacgccatccagacgctggccgaggaccccgcctgctacgacatacgcaaggcctacgacgacgacgacgacgacggcggccagcactccgcccgcggaggctggggaacccacttctactacggtggcccgggacacaacccggcatgcccctgatggccggatctctgtcctctgatggagttgtgacgatgagcgcgcgcgcggcacctgaccggccgtacgtaccatggatggcatgcatttgatttaacttccgcctatatatgtgtacgttgccaaattttgacgtacgttcgcacgtgcctttgctagtatttcaagctttcgctaattctacctgtaaggacttgcaatatgtaattaacgaactgttgatttatctgttctttcaatcgatcccaaggatcgtcccaaatttcattttcctcgacaaaaaaaaaaaaaaaa

SEQ ID NO: 4458 - protein, 1964 aa, Zea mays
  misc_feature: PFam Name: Mucin; PFam Description: Mucin-like glycoprotein
  misc_feature: PFam Name: Glutenin_hmw; PFam Description: High molecular
  misc_feature: GI Number: 50948627; NR Description: carboxyl-terminal peptidase-like [Oryza sativa (japonica cultivar-group)] >gi|42409085|dbj|BAD10336.1| carboxyl-terminal peptidase-like
  misc_feature: GI Number: 50935081; NR Description: putative DD1A protein [Oryza sativa (japonica cultivar-group)] >gi|34393299|dbj|BAC83228.1| putative DD1A protein [Oryza sativa
  misc_feature: GI Number: 21593294; NR Description: putative
  misc_feature: GI Number: 21389708; NR Description: putative
  misc_feature: GI Number: 34913794; NR Description: OSJNBa0026J14.25 [Oryza sativa (japonica cultivar-group)] >gi|20146458|dbj|BAB89238.1|
AGCAGAGGGCCATCTTCTACTCTTCTCTCCCAGCCAACCCCCTTGTCCAACGGTTCAGCCTGCTCAATTTTAGTGACCAGTTACGGCAAATGCAGCCCTCGGCGGACAGCAGGAAGAAGAAGCGGCGGCGGCGGAGGAGGAGGAGGCTGGCGGCATGCTACTCATCGAGACCTGCTGCCGGCGCCGCTCAAGGCCAGTGTCAGTGCGGCTCCTCTAGCCCCGGTGGCGGCGGCGGAAGCGGCAGCCTCGTGGCAAGAACACCGCGCGCGTTCTCGAGCTGCTCCAGCTACGCCGCCTCGTCTGCCTGCGCGCCGGCGGCGGCCGTCCATCTCGGCACCCAGCACAAGCTGACGGCGCTCCTCGTCGCGCTCGCGCTCCTCCTCGTCCTCCCTCGCCCTCCTCTCTCAGGGGTCCCGGTGGTGTCGCCCCGCAGGATGGCGAGGATCCGCAGCCACGTGGAGAGGATCAACAAGACCCCCGTGCGCTCCATTGAGAGCCAGGACGGCGACACCATCGACTGCGTGGCGGCGCACGAGCAGCACGGCCTGGACCACCCGCTCCTCAGGGCGCACGCCGTCCAGACGGAGCCGCCCGAGGCGCCGAGGGGCGGCGGCGCGCTCTCCTTCCCGGCTGGCTCTGCGACGAGCGGCAGCGGCGCAGGCAAGGACGACAGCAGGCGGGGCGCGTGGCAGACGTGGCACCACGGCGGGCACTGTCCCCGGGGCACGGTGGCCATCCGGCGGACGAGCGCCGAGGACGTGCTGCGCGCCGGATCCATCTCCCGCTTCGGCCGCAAGAGGAGGCACCGGAAGGTCGCCGCCGCCGCCGCCGCGCGCGCGGCCTACGCGCCGGACGTCATCACCGGCAACGGGCACGAGCACGCGATCGCGTACACGGCGCCGTCGCAGCAGCCGGTGTACGGCGCCAAGGCCACCATCAACGTGTGGGATCCGGCCATCCAGGAGTCCAACGGCTTCAGCCTCTCCCAGCTCTGGGTCCTCTCCGGCTCCTTCAACGGCTCCGACCTCAACAGCATCGAGGCAGGATGGCAGGTCAGCCCTGAGCTGTACGGGGACAGCAGGCCGAGGCTCTTCACGTACTGGACAAGCGACGCGTACGAGGCTACTGGTTGCTACAACGCGCTGTGCCCGGGATTCGTGCAGACGAGCTCCCGCATCGCCATCGGCGCGTCCATCTCGCCGGTGTCGTCGGCCGGCGGCGCGCAGTACGACATGACGCTGCTGGTGTGGAAGGACCCGAAGCTGGGCAACTGGTGGCTCAGCTACGGGGACCAGCTGGTGGGGTACTGGCCGGCGCAGCTGTTCACGCACCTGTCGGACCACGCCACCATGGTGGAGTGGGGCGGCGAGGTGGTGGACACCAGGCCCGGCGGGGCGCACACCGCCACGCAGATGGGCTCGGGCCGCTTCGCCGCCGAGGGCTTCGGCCGCGCCAGCTACTTCCGCAACCTGGAGACGGTGGACGCCGACAACAGCCTGGCCGAGGTGGCGCTCGACGCCATCCAGACGCTGGCCGAGGACCCCGCCTGCTACGACATACGCAAGGCCTACGACGACGACGACGACGACGGCGGCCAGCACTCCGCCCGCGGAGGCTGGGGAACCCACTTCTACTACGGTGGCCCGGGACACAACCCGGCATGCCCCTGATGGCCGGATCTCTGTCCTCTGATGGAGTTGTGACGATGAGCGCGCGCGCGGCACCTGACCGGCCGTACGTACCATGGATGGCATGCATTTGATTTAACTTCCGCCTATATATGTGTACGTTGCCAAATTTTGACGTACGTTCGCACGTGCCTTTGCTAGTATTTCAAGCTTTCGCTAATTCTACCTGTAAGGACTTGCAATATGTAATTAACGAACTGTTGATTTATCTGTTCTTTCAATCGATCCCAAGGATCGTCCCAAATTTCATTTTCCTCGACAAAAAAAAAAAAAAAA

SEQ ID NO: 4459 - DNA, 1196 bp, Zea mays
  misc_feature (1)..(1196): Ceres cDNA ID no. 21705358
  misc_feature (1)..(1196): Ceres CLONE  ID no. 1420460
  misc_feature (1)..(1196): Also known as  Ceres CDNA ID no. 25088180
gccacattttacatcccaccaccagcctccttcccctttccgttccccgaagcgagagcgaagccagcgcccatcttcttcttcctcctccttgttgttggatcgcagctccttcgtcgtagcgtccgatacgccaggtttcctttcgcgagcaacaatctttggcaatggcgtccacgtcgagctcgacgccagcgccggttgaggtggacgagaggggccggaagcggaagcgtgcggccggggcggaccccgcggcgccggcgcagccgtccaagtggcggacgcggcgcgagcacgagatctactcgtccaagctcctggaggcgatccgcctcgtgcgcgcggggcccccctccgccgccgccgccggcacggcggcggccccgccgcgcagcagggccgtgcgcgaggcggccgaccgcgcgctcgccgtcgcggcgcgcgggcgcacgcactggagccgcgccatcctcgcgtcccgccgccgccgcctccaggccgcgcaccgcgcgcgcctccgcgcccccgcgtccccgcccgcgcgacacggtgccccctcggcctcggcggcgaagggcgccgccacgccgcctctggagaggaaggccaaggtgctgggccggctggtgcccggctgccggaagctgtcgttcccgacactgctcgccgagaccacggactacatcgcggcgctccagatgcaggtccgcgccatgacggccctcgccgaggcgctgtccgccgtctccgccacctcctcctccggcgccggctcctcctcgccgccgtgatcgaagccgaagcctcaacattcgtgcattcgttgtaaatttttccctctcttttctccccccacgaatttttcctcgggattagttaacctctagctttctctctctctcccctctagttttccttgtcgtcttgtttctcccagttcggtgagtggttagtgtgacgatgaagaagaagatgatgatggcgtcccagtgattaacccgtgcggtaatgtgatagaagaagtcgtaggctgtctccgctcctcccttcctccctagctcaggattcttttgtagcttgggtttattctcatctgcttcgatcgctcttcgatgaatgcatcttgaaatgttcattcagatcacaccatcatgtatgatgtatctttcatgtgcttaaaaaaaaaaaaaaaa

SEQ ID NO: 4460 - protein, 208 aa, Zea mays
  misc_feature: PFam Name: FH2; PFam Description: Formin Homology 2 Domain
  misc_feature: PFam Name: Pyr_redox_2; PFam Description: Pyridine
  misc_feature: PFam Name: Cation_efflux; PFam Description: Cation efflux family
  misc_feature: PFam Name: Extensin_2; PFam Description: Extensin-like region
  misc_feature: PFam Name: MCPVI; PFam Description: Minor capsid protein VI
  misc_feature: GI Number: 34898122; NR Description: bHLH protein-like [Oryza sativa (japonica cultivar-group)] >gi|24059889|dbj|BAC21355.1| bHLH
  misc_feature: GI Number: 27764992; NR Description: At1g09250 [Arabidopsis thaliana] >gi|3249098|gb|AAC24081.1| ESTs gb|T04610, gb|N38459, gb|T45174, gb|R30481 and gb|N64971 come from this gene.
  misc_feature: GI Number: 21618012; NR Description: unknown [Arabidopsis thaliana]
  misc_feature: GI Number: 34904544; NR Description: B1066G12.17 [Oryza sativa (japonica cultivar-group)] >gi|20160491|dbj|BAB89443.1| B1066G12.17 [Oryza sativa (japonica cultivar-group)] >gi|21104528|dbj|BAB93123.1| B1008C01.3 [Oryza sativa (japonica
  misc_feature: GI Number: 11095327; NR Description: unknown [Paracoccus
MASTSSSTPAPVEVDERGRKRKRAAGADPAAPAQPSKWRTRREHEIYSSKLLEAIRLVRAGPPSAAAAGTAAAPPRSRAVREAADRALAVAARGRTHWSRAILASRRRRLQAAHRARLRAPASPPARHGAPSASAAKGAATPPLERKAKVLGRLVPGCRKLSFPTLLAETTDYIAALQMQVRAMTALAEALSAVSATSSSGAGSSSPP

SEQ ID NO: 4461 - DNA, 1138 bp, Zea mays
  misc_feature (1)..(1138): Ceres cDNA ID no. 21705361
  misc_feature (1)..(1138): Ceres CLONE  ID no. 1434348
  misc_feature (1)..(1138): Also known as  Ceres CDNA ID no. 24365258
ataaaactcagagaaaaatgaagacttatctgcttctctttctcatcttctcacttctcttttcattttcctccggccagcaatgcggtcgtcaagcccaaggagcactctgccccaacggtctatgctgcagccagtacggatggtgcggcaccaccgaagcttactgtgggcgtggttgccaaagccagtgcactcccactcccactcctcctactcccaatcctcctagtcccacccctcctaggcccactccacctggtcccagcggggatctttcgggcatcatttcaagagatcagttctataaaatgcttaagcacatgaacgataatgcttgtcctgctagagggttcttcacttacgatgccttcatcaccgccgctaagtttttccctagttttgggaacaccggagaccttgccacaaggaagaaggagatcgcagccttcttcggccagacttcccacgaaaccactggtgggtgggcggatgcaccagacggagcaaatacatggggctactgtttcaaggacgaaattggcaaaagtaacccctactgtgatagcaacaacctcgagtggccatgcgcaccaggccaattttactacggaagaggaccaatgatgctgtcttggaactacaattatggacagtgcgggagagacctaggactcgacttactacgcaggccagctattgcgtccagcgacccagtgatagctttcgaaactgcaatttggttctggatgactcctcaggctcctaaaccgtcttgccacgatgtgatcaccgaccagtggcagccgtcggctgccgatatttcagcggggagattaccaggttatggagtgattaccaatatcattaacggtggattagagtgtgctggtcgcaatgtcgcacaggtccaagatcggatatcgttttatacaaggtattgtggcatgtttggtgttgatccgggaagtaatgttgactgtgacaaacaaaggccgtttagtgaaggtagtaacgttttcttggatgctgctatttaattaaggagtgttaataatgcagctttgttgtatccaagcaataagagaatatcaaactaaataaaactccttttatttacataaaaaaaaaaaaaaaa

SEQ ID NO: 4462 - protein, 1138 aa, Zea mays
  misc_feature: PFam Name: Glyco_hydro_19; PFam Description: Chitinase class I
  misc_feature: PFam Name: Chitin_bind_1; PFam Description: Chitin
  misc_feature: GI Number: 6048743; NR Description: chitinase [Brassica juncea]
  misc_feature: GI Number: 7798646; NR Description: class I chitinase [Arabis
  misc_feature: GI Number: 5689118; NR Description: basic endochitinase
  misc_feature: GI Number: 5689134; NR Description: basic endochitinase
ATAAAACTCAGAGAAAAATGAAGACTTATCTGCTTCTCTTTCTCATCTTCTCACTTCTCTTTTCATTTTCCTCCGGCCAGCAATGCGGTCGTCAAGCCCAAGGAGCACTCTGCCCCAACGGTCTATGCTGCAGCCAGTACGGATGGTGCGGCACCACCGAAGCTTACTGTGGGCGTGGTTGCCAAAGCCAGTGCACTCCCACTCCCACTCCTCCTACTCCCAATCCTCCTAGTCCCACCCCTCCTAGGCCCACTCCACCTGGTCCCAGCGGGGATCTTTCGGGCATCATTTCAAGAGATCAGTTCTATAAAATGCTTAAGCACATGAACGATAATGCTTGTCCTGCTAGAGGGTTCTTCACTTACGATGCCTTCATCACCGCCGCTAAGTTTTTCCCTAGTTTTGGGAACACCGGAGACCTTGCCACAAGGAAGAAGGAGATCGCAGCCTTCTTCGGCCAGACTTCCCACGAAACCACTGGTGGGTGGGCGGATGCACCAGACGGAGCAAATACATGGGGCTACTGTTTCAAGGACGAAATTGGCAAAAGTAACCCCTACTGTGATAGCAACAACCTCGAGTGGCCATGCGCACCAGGCCAATTTTACTACGGAAGAGGACCAATGATGCTGTCTTGGAACTACAATTATGGACAGTGCGGGAGAGACCTAGGACTCGACTTACTACGCAGGCCAGCTATTGCGTCCAGCGACCCAGTGATAGCTTTCGAAACTGCAATTTGGTTCTGGATGACTCCTCAGGCTCCTAAACCGTCTTGCCACGATGTGATCACCGACCAGTGGCAGCCGTCGGCTGCCGATATTTCAGCGGGGAGATTACCAGGTTATGGAGTGATTACCAATATCATTAACGGTGGATTAGAGTGTGCTGGTCGCAATGTCGCACAGGTCCAAGATCGGATATCGTTTTATACAAGGTATTGTGGCATGTTTGGTGTTGATCCGGGAAGTAATGTTGACTGTGACAAACAAAGGCCGTTTAGTGAAGGTAGTAACGTTTTCTTGGATGCTGCTATTTAATTAAGGAGTGTTAATAATGCAGCTTTGTTGTATCCAAGCAATAAGAGAATATCAAACTAAATAAAACTCCTTTTATTTACATAAAAAAAAAAAAAAAA

SEQ ID NO: 4463 - DNA, 1245 bp, Zea mays
  misc_feature (1)..(1245): Ceres cDNA ID no. 21705362
  misc_feature (1)..(1245): Ceres CLONE  ID no. 1439713
  misc_feature (1)..(1245): Also known as  Ceres CDNA ID no. 24371596
attaggcagagaagagaaaaatgggtaaggatttatccaaacgtgtcctcacttttctgatattgatctcgttactggcggtggcaatgaaccttctgtccacggtagaggcacagaacaagaagaagccgaggagagatgttcctctagtgaaaggtctctcatggagcttttaccagaaagcatgtccaaaagtggaaagcatcatcaggaaagagctcaagaaagtcttcaagagagacattggtttagccgcagccatccttcgaatacatttccatgactgcttcgttcagggatgtgaagcatcagtgctgctagatggatcagcgagtggaccaggagagcaatcatcgatcccgaatctgacactccgtcaagccgcctttgtcgtcatcaataaccttcgtgcactcgtccacaagcagtgtggtcaagtcgtctcttgctccgacatcctcgctctcgccgcccgtgactccgtcgtcctttcaggagggccagactatgctgtaccacttggccgacgcgactcactagcattcgcgagccagaacacaacgttaaacaacttgccgccaccattcgccaacgcgagccaactcatcgccgacttcgccaatagaaacctcaacatcaccgacttagttgcactctccggtggtcacaccatcggaatcgcgcattgcccgtctttcacagaccggctctacccgaaccaagacccaacaatgaacaagtccttcgcgaacaacctcaaacgcacttgccccaccgctaactcgagcaacacgcaagtgaatgacataaggagccctgacgtgttcgacaataagtactacgttgatctcatgaaccgacaagggctgttcacatcagaccaggacctgttcacggacaagaggacacgtggtatcgtggagagctttgcgatcgaccagaagctattttttgatcattttgtggtggggatgatcaagatgggccagatgagtgtcttgacggggtcacaaggagagattcgtgcaaactgttccgccagaaacactgaaagtttcatgtctgttttggaagaaggcatactcgaggaggctctttccatgatgtagatgaaaccatataaaatatcgcctcttattttcctttgactttgttttttttagttgacgcacttgtggtttgtggaatgctttaagactatctgataaataagagtgttgttttatcttaaaaaaaaaaaaaaaa

SEQ ID NO: 4464 - protein, 362 aa, Zea mays
  misc_feature: PFam Name: Pyr_redox_2; PFam Description: Pyridine
  misc_feature: PFam Name: Pyr_redox; PFam Description: Pyridine
  misc_feature: GI Number: 50912077; NR Description: putative NADPH-thioredoxin reductase [Oryza sativa (japonica cultivar-group)] gi|51964302|ref|XP_506936.1| PREDICTED OJ1479_B12.9 gene product [Oryza sativa (japonica cultivar-group)]
  misc_feature: GI Number: 17826833; NR Description: NADPH-thioredoxin
  misc_feature: GI Number: 50725984; NR Description: putative NADPH-thioredoxin reductase [Oryza sativa (japonica
  misc_feature: GI Number: 6320560; NR Description: Thioredoxin reductase; Trr1p [Saccharomyces cerevisiae] >gi|1717781|sp|P29509|TRB1_YEAST Thioredoxin reductase 1 >gi|2117554|pir||S61150 thioredoxin-disulfide reductase (EC 1.8.1.9) TRR1 [validated] -
  misc_feature: GI Number: 520501; NR Description: thioredoxin reductase
MGKDLSKRVLTFLILISLLAVAMNLLSTVEAQNKKKPRRDVPLVKGLSWSFYQKACPKVESIIRKELKKVFKRDIGLAAAILRIHFHDCFVQGCEASVLLDGSASGPGEQSSIPNLTLRQAAFVVINNLRALVHKQCGQVVSCSDILALAARDSVVLSGGPDYAVPLGRRDSLAFASQNTTLNNLPPPFANASQLIADFANRNLNITDLVALSGGHTIGIAHCPSFTDRLYPNQDPTMNKSFANNLKRTCPTANSSNTQVNDIRSPDVFDNKYYVDLMNRQGLFTSDQDLFTDKRTRGIVESFAIDQKLFFDHFVVGMIKMGQMSVLTGSQGEIRANCSARNTESFMSVLEEGILEEALSMM

SEQ ID NO: 4465 - DNA, 905 bp, Zea mays
  misc_feature (1)..(905): Ceres cDNA ID no. 21705364
  misc_feature (1)..(905): Ceres CLONE  ID no. 1444098
  misc_feature (1)..(905): Also known as  Ceres CDNA ID no. 24362764
aataaaccccccttgtcgtcgcttcggttcaagcgaggaagagagagagagcgagagttgttagttgtacaaggggcgccggcggccgcattgtagagtacgttgagcttgttcactgccgtcgcggcctcaaagcaagccacatcatcgatggcggacgcagctcacctcttcctgctggtagcggtggccgccgcgctcgccggccgctcagacggcgcgtggtgcgtgtgccgcccggagctggcggacagcgcgctgcagaaggcgctggactacgcgtgcggcgccggcgccgactgcaagcccatcctgcagagcggcgcctgcttcgccccggacaccgtcaaggcccactgctcctacgccgtcaacagcttctaccagcgcaacagccagaacccgcaggcctgcgtcttctccggcaccgccacgctcagcaacagcgacccgagcggcaatggctgcacgtaccctgcgaccccaagtgctgctgcgacgacaagcaatagttcgcccggcgtgtacagccctcccacgatgggtccgacagccctcaacgacaacagcgctgctgccagcgtcctcccggtggctggactcaccaccgtgcggctgctgatcctggcctcctgctcgctcgtcgctctctgcatcggcgcgtgactcatgaggacgagacgcccctcggctgctgctgttttgggtgtgtcttgtttgttccttgccccttttcttctagtggcaggcagatggaaccttccggtggtggagcgcgagaaccccgaggcctcacaaatgccattctcgttgctgcgacttccgttcactttctcttatgtctgggcatgaggctatccgcaaccgttatccctaaatttttctccccaaaaaaaaaaaaaaaa

SEQ ID NO: 4466 - protein, 171 aa, Zea mays
  misc_feature: PFam Name: X8; PFam Description: X8 domain
  misc_feature: GI Number: 57899559; NR Description: glycosyl hydrolase
  misc_feature: GI Number: 34909796; NR Description: P0403C05.4 [Oryza sativa (japonica cultivar-group)] >gi|15289889|dbj|BAB63584.1| P0403C05.4
  misc_feature: GI Number: 21592859; NR Description: unknown [Arabidopsis thaliana]
  misc_feature: GI Number: 50939031; NR Description: glycosyl hydrolase family 17-like protein [Oryza sativa (japonica cultivar-group)] >gi|22775658|dbj|BAC15512.1| glycosyl hydrolase family 17-like protein [Oryza sativa (japonica cultivar-group)]
  misc_feature: GI Number: 34912962; NR Description: beta-1,3 glucanase-like protein [Oryza sativa (japonica cultivar-group)] >gi|20161490|dbj|BAB90413.1| beta-1,3 glucanase-like protein [Oryza
MADAAHLFLLVAVAAALAGRSDGAWCVCRPELADSALQKALDYACGAGADCKPILQSGACFAPDTVKAHCSYAVNSFYQRNSQNPQACVFSGTATLSNSDPSGNGCTYPATPSAAATTSNSSPGVYSPPTMGPTALNDNSAAASVLPVAGLTTVRLLILASCSLVALCIGA

SEQ ID NO: 4467 - DNA, 1156 bp, Zea mays
  misc_feature (1)..(1156): Ceres cDNA ID no. 21705365
  misc_feature (1)..(1156): Ceres CLONE  ID no. 1444772
  misc_feature (1)..(1156): Also known as  Ceres CDNA ID no. 23833010
acgattcactaggaattcttccagatccagcccttggctcgcagtacaccacaccacgcccagatctcaacgtgccccttctctcagatctcaattcccaaatgccctcgccgtcgtagctgcaccccgaccccgcgcgctcgctcggatccatgggcggggtcagggcagcatcgccatcaggcgcaggatccggagccgtcgcgggggcgggatccgatcacggggcgccgcgactggctatggcgtgtgtgctagcgtcagaggccgccacggtgctcgctgtcatgcgccgcaacgtccgctgggctggcgtccgctacggcggcggcgacggtggcgcgggcgacgacgagcaccttgaccacccgctcgttgcggggctcaaggttctccgccgccgcgctgccgcttggggccagggtagttgggcgggcgttgagccgctcctctacctccgacccttcctcgatatcgtctgctccgacgagactggggcgcccatcacgggtgctgcgctctcgtcgttgcacaagatcctcacccttgatgtcgtcgggcccggcgcaccaggcgccgccggggccatggccgccgtcgtcgacgccgtcacggcttgccgctttgaagtcaccgacccggcgtccgaggaggccgtcctggcaagggtcctgcaagtgctgctagcctgcgtgcgcagccgtgcagcaccggcgcttgccaaccgccacgtctgcacgatcgtcaacacatgtttccgcgtcgtgcagcaggctggaaccaagggggagctactgcagcgtgtctcccgccagacaatgcaggaggttatacgaactgtctttgcccgcctgccggacatcaatgtcaccttgttgtccgacgagcaggtatggtgcattgttatactcagtattttactttgctgtgctgatgaacatggaaattgttgcaataccattcctccctcagcttaataactcaacttactcctactatgctcatgtgcattggtctgaagtgtaaacaagtgaaatgttctagtttttttgtcctttttatctttaacattttttgtcatttgagcaatacgaccacattgcaaatactcacattctgacactaagatcagcttttgttaaaaaaaaaaaaaaaa

SEQ ID NO: 4468 - protein, 274 aa, Zea mays
  misc_feature: GI Number: 50907605; NR Description: putative pattern formation protein GNOM [Oryza sativa (japonica cultivar-group)] >gi|46390266|dbj|BAD15695.1| putative pattern formation protein GNOM [Oryza sativa (japonica cultivar-group)] GNOM [Oryza sativa
  misc_feature: GI Number: 5080774; NR Description: EMB30/GNOM gene product [Arabidopsis thaliana] >gi|8778395|gb|AAF79403.1| F16A14.20 [Arabidopsis thaliana] >gi|2498329|sp|Q42510|EM30_ARATH Pattern formation protein EMB30 >gi|2129665|pir||S65571 pattern formation
  misc_feature: GI Number: 1209631; NR Description: GNOM gene product
  misc_feature: GI Number: 10177699; NR Description: pattern formation protein [Arabidopsis thaliana] >gi|15241777|ref|NP_198766.1|
  misc_feature: GI Number: 15241142; NR Description: Sec7 domain-containing
MGGVRAASPSGAGSGAVAGAGSDHGAPRLAMACVLASEAATVLAVMRRNVRWAGVRYGGGDGGAGDDEHLDHPLVAGLKVLRRRAAAWGQGSWAGVEPLLYLRPFLDIVCSDETGAPITGAALSSLHKILTLDVVGPGAPGAAGAMAAVVDAVTACRFEVTDPASEEAVLARVLQVLLACVRSRAAPALANRHVCTIVNTCFRVVQQAGTKGELLQRVSRQTMQEVIRTVFARLPDINVTLLSDEQVWCIVILSILLCCADEHGNCCNTIPPSA

SEQ ID NO: 4469 - DNA, 1171 bp, Zea mays
  misc_feature (1)..(1171): Ceres cDNA ID no. 21705367
  misc_feature (1)..(1171): Ceres CLONE  ID no. 1448208
  misc_feature (1)..(1171): Also known as  Ceres CDNA ID no. 24372316
tctccctctgaccctctccacccttttttgttcctcgctcctcctcggcggccgcctccccgcagcccctccccccacgccgccgccgccgccatggccatgaagggacccggcctcttcaccgacatcggcaagaaggccaaggatctgctcaccagggactacacctacgaccagaagctctccgtctccaccgtcagctcctccggagtggccgtcacttccacagctgtgaagaaaggagggctttattctcttgatgtagcatcagcttacaagtataagaataatcttgttgatgttaaagtggatacagaatcaaatatctctactaccttgactgtcttggatgtcctgccatccacaaagcttgtgacatctgtcaagtttcctgattacaatgctggaaaggtggaggtgcaatacttccacgaccatgcaacttttgctgccgctgttggcatgaagccctctcctgtggtcgatttttctttggtagtaggccctaaaggacttgccttcggtggggaagctgggtttgacacttcttcaggaaagtttaccaagtacactggtggtttcagtgtaaccaagcctgacttccatgcttcagctattctggccgacaaaggtgacaccatcaaagtgtcaggtgtgtatcaccttgatgagaagcagaaggcttcagccgtggctgaatttacccggaagctctcaacaaacgaaaacacgctgacagttggtggcctgtacacggtcgaccctcagacagctgtgaaggcaaggctcaacaacactggaaagcttgctgccctcctccagcacgaggttaaaccaaagtcactcttgacgatatctggtgagttcgacaccaaggccttggacagggcacccaagtttgggctgtcactcgcactcaagccttgaccagatcatacgtggatgatggcgattgaacatcggattctttggttattttttgtgaagctatggccaataatttgttccgcagacatgttctgttaaatctctggaggtttaggtgctctgtgggcaggatccgataggccttcacctggatttttgtccaggagtttacttttgatgatcgaagtacttcctcattgatagatgaatgcagcttgttttttctgcaaaaaaaaaaaaaaaa

SEQ ID NO: 4470 - protein, 277 aa, Zea mays
  misc_feature: PFam Name: Porin_3; PFam Description: Eukaryotic porin
  misc_feature: GI Number: 29367429; NR Description: porin-like protein
  misc_feature: GI Number: 31249532; NR Description: PgPOR29 [Pennisetum glaucum]
  misc_feature: GI Number: 60279272; NR Description: pom30 [Solanum tuberosum]
  misc_feature: GI Number: 36957216; NR Description: VDAC2.1 [Lotus
  misc_feature: GI Number: 21537313; NR Description: porin-like protein [Arabidopsis thaliana] >gi|9757871|dbj|BAB08458.1| porin-like protein [Arabidopsis thaliana] >gi|15240765|ref|NP_201551.1| porin,
MAMKGPGLFTDIGKKAKDLLTRDYTYDQKLSVSTVSSSGVAVTSTAVKKGGLYSLDVASAYKYKNNLVDVKVDTESNISTTLTVLDVLPSTKLVTSVKFPDYNAGKVEVQYFHDHATFAAAVGMKPSPVVDFSLVVGPKGLAFGGEAGFDTSSGKFTKYTGGFSVTKPDFHASAILADKGDTIKVSGVYHLDEKQKASAVAEFTRKLSTNENTLTVGGLYTVDPQTAVKARLNNTGKLAALLQHEVKPKSLLTISGEFDTKALDRAPKFGLSLALKP

SEQ ID NO: 4471 - DNA, 1029 bp, Zea mays
  misc_feature (1)..(1029): Ceres cDNA ID no. 21705370
  misc_feature (1)..(1029): Ceres CLONE  ID no. 1456398
  misc_feature (1)..(1029): Also known as  Ceres CDNA ID no. 24361780
ggtggcgacggcatccaagcaaggaaaagaaataaagcggaaaactttaaacgggtacgcaggagatccagcgaaatggcggcgccgccgccgtcatatccagcggccttgaagccggagatcggccctgacggcctcgctcgagattctcccgtaatcgcctacaccgagaaggtcattttggaggagcagctgcagctgaagaaatacattcaggagaactattccaaaattcgtgatgtagaaaaggagttagagagtcttactttagaaatgaaactgacagctggaccaaagaaagcagcactagagcatctgaggaagaagattgaaatatcaacagagaaaatacgtttagctaaggtgaaagaggaacatgcaaaaaagacttgggaagttgctgcacaagttgttaaagacgaagaggatgctaagcagaaattatgtgatgacctaaaccatctagtccaggagagtgctgcttcccaatatgcaagattggaggagctgaagaaacgtttagaatctctaaatcccataagggattctgttaatgtgtcaggtgtttatactgcacagcatgctactctgaattcagtacctcagcaaccaactgcacaaaatcctgcagatgtaactggccgtcagaatattgccacaaagcctgcttctatgcaacagcagcctatacctgcggaggcagaaaagaagagaagaccctcgaattcggcaagagggaggggtggtgtcatgatccttccgaagggaagagagggttctgggtcaggatggacaggtgctgggtttgatgtagatagccgtacatgacgcccggtatttcaagttattcgtaccattgaaaccatgctctccaaaattcacaagaattagattggtcaccaaaaaaaaaaaaattcagagccattccagaattctaatgtgaggaaggtgtacgtttgatcatttgttcatccattgtatatgaatcatgcactaaattaatcaaagttttaacaaaaaaaaaaaaaa

SEQ ID NO: 4472 - protein, 250 aa, Zea mays
  misc_feature: GI Number: 21593113; NR Description: unknown [Arabidopsis thaliana]
  misc_feature: GI Number: 48209904; NR Description: expressed protein
MAAPPPSYPAALKPEIGPDGLARDSPVIAYTEKVILEEQLQLKKYIQENYSKIRDVEKELESLTLEMKLTAGPKKAALEHLRKKIEISTEKIRLAKVKEEHAKKTWEVAAQVVKDEEDAKQKLCDDLNHLVQESAASQYARLEELKKRLESLNPIRDSVNVSGVYTAQHATLNSVPQQPTAQNPADVTGRQNIATKPASMQQQPIPAEAEKKRRPSNSARGRGGVMILPKGREGSGSGWTGAGFDVDSRT

SEQ ID NO: 4473 - DNA, 900 bp, Zea mays
  misc_feature (1)..(900): Ceres cDNA ID no. 21705371
  misc_feature (1)..(900): Ceres CLONE  ID no. 1458489
  misc_feature (1)..(900): Also known as  Ceres CDNA ID no. 24364408
gaagccaacgctcgatcgcaaacgcacacgctactctctttttttttttgttgttggtggtgaggggctggctctggctggatctggatggcgcacgggcggatgatgatgatgggctgcgtgttcctggcgtgcctgctggtggcggcgtctgtgccgtccaccgcgtccgcgttcgtgttcaaggcgggcggcacgggcgagtggcgcgtgccagccgcggccgctagcggcaacgtcagcgcgtacaacgcgtgggcgcaacgcaaccgtttccgcgtgggtgacgccatcgctttcacgtaccagcccggcaaagactcggtgctcgtcgtcgacgagaggtcctacgacgcctgcgacacgagctcgccgaccgacaccttcgccgacggcagcaccgtcttcaccttcaaccgctccggccccttctacttcatcagcggcagcaaaggcaactgcgaccgcggcgagaagctggtcgtcgtcgtcatggccgagcgcgcggccatcggcacgggcggcacggggctggcgccgtcgccgtcgtcgtcgtcgtcccccaacggcccattctccgccttctctccgccgccgccaccctttggcatcgacatctcgccgagtcccacggccgcgtatccgccaccaagtgccgcgccgcccaagatggcaggacttgccggcgcggcggcgtttgccattattggagccttgttctacgcgcttgtttgatgatacgtacgcgtgttttgtttatccactcagatcatatgcatatacatagcgaccatatatgccattgagtgaatttatttttaatgtatagtgtatcaaatgctggtgtgatgcatgtattgttgattaattaattcagtgctgatggaaaaaaaaaaaaaa

SEQ ID NO: 4474 - protein, 215 aa, Zea mays
  misc_feature: PFam Name: Cu_bind_like; PFam Description: Plastocyanin-like
  misc_feature: PFam Name: Mucin; PFam Description: Mucin-like glycoprotein
  misc_feature: GI Number: 34908784; NR Description: P0415A04.29 [Oryza sativa (japonica cultivar-group)] >gi|20161188|dbj|BAB90115.1| phytocyanin protein-like [Oryza sativa (japonica cultivar-group)] >gi|20160824|dbj|BAB89764.1| P0557A01.2 [Oryza sativa (japonica
  misc_feature: GI Number: 21618177; NR Description: unknown [Arabidopsis thaliana]
  misc_feature: GI Number: 52076874; NR Description: putative phytocyanin
  misc_feature: GI Number: 50905419; NR Description: phytocyanin protein-like [Oryza sativa (japonica cultivar-group)] >gi|49389255|dbj|BAD25217.1| phytocyanin protein-like [Oryza sativa
  misc_feature: GI Number: 34146796; NR Description: At2g25060 [Arabidopsis thaliana] >gi|4559346|gb|AAD23007.1| similar to early nodulins [Arabidopsis thaliana] >gi|34395732|sp|Q9SK27|ENL1_ARATH Early nodulin-like protein 1 precursor (Phytocyanin-like protein)
MAHGRMMMMGCVFLACLLVAASVPSTASAFVFKAGGTGEWRVPAAAASGNVSAYNAWAQRNRFRVGDAIAFTYQPGKDSVLVVDERSYDACDTSSPTDTFADGSTVFTFNRSGPFYFISGSKGNCDRGEKLVVVVMAERAAIGTGGTGLAPSPSSSSSPNGPFSAFSPPPPPFGIDISPSPTAAYPPPSAAPPKMAGLAGAAAFAIIGALFYALV

SEQ ID NO: 4475 - DNA, 2342 bp, Zea mays
  misc_feature (1)..(2342): Ceres cDNA ID no. 21705375
  misc_feature (1)..(2342): Ceres CLONE  ID no. 1468510
  misc_feature (1)..(2342): Also known as  Ceres CDNA ID no. 24371254
agcacggccggctctccgctccgccagacccggaccggcaccacgccacggctccggccatcacgcgccgcgcacaccatgaccacggttgcgcaccatcaccacctcgccgctgctaccgtgctcttcttcgtcgcattcaccatggcgcctctcgccgccggggaccccgtgggccagctctgcggtaccagcggcaactacacgctcaacagcacctaccagggcaacatccgccgcctcgccgccacgctgccgaagaacacctccacctcggcgacgctcttcgccacggacaccttcggcgccgtcccggacatcgtctacgcgctcgcgctctgccgcggcgacaccaacgcctccgcctgcagcggctgcgtcgccgccgcgttcctggacgcgcagcagctgtgcgcctacaacaaggacgccaccatgttctacgacccctgcctcctccgctactccaaccagaacttcctcgccgaccccagcagcgatggccgcgggaccgcgctcatcctcatgaacacgcagaacgtcaccgcgcggttcaaggtgttcgacgccgccgtcgccgcgctcctcaacgccaccgccgcctacgcggccgccaattcgtccaaaaggttcggcaccggggtcgaggcgttccagaacttcgacagcaaccgcccgaggatctacgggctggcgcagtgcacgccggacatgacgccggccgactgccagagctgcctctcgggtattatccagacggggcccaagtatttcagcgggaagcagggtggcaggattcttagtgtgcggtgcaactacaggtatgagcagtacccgttctttacaagcaccccactgcttcagctggcggagcctaccgtgggggccccggcgcccgcgcccgcggtggtcaacggaactccaacgccaccgacgaccggaggagcacgaggaacaacaggaaataaaactggtagagttttagccattacactgcctatagttgctgcagtgctagctactatagtactttgttcatgcctctggaggaagaggaaaacaccagggaagtcggcactaccagatacaactaaccctgaggacatacaaagtatcgattctctcattattgacgtgtcaactctacgagctgcaacagaaaactttgctgaagccaataagctcggtgaaggaggttttggttcagtatataagggaatcctccctgatgaccaggaaatagcagtgaaaaggctctcgcagacttctagacaagggatggaggagctgaaaaacgagctcgtgttggttgctaaactgcaacacaagaatttagtgaggcttgtcggggtttgcttggaggaccatgaaaaattgcttgtctatgaatacatgcccaacaaaagcctcgacaccattctatttaatcacgagagatgtggagagctggattgggggaagaggtttaagatagttaacgggatcgcccgtggcttgcagtaccttcatgaagattctcaggtgaagataatccacagggatcttaaagcgagcaatgttctgttagacaatgacttcaaccctaagatctcggattttggcttagcaaggctattcggaagtgagcaatcacgagatgtcaccaaccgcgtcgtcggaacctatggatacatggcccctgagtacgccatgcgtgggcactactctgtcaagtccgacgtgttcagcttcggcgttttaatcctagaaatcgtcaccggaaggcgaaatggtggctcctatagctctgaagaatcggccgatctccttagtctggtgtgggagcactggacgacggggacattggtggagatcatggatccatccttgagcagccttgctccgcgagacctgatgttgaagtgcatccacatcggcctcctctgcgttcaagatgaccatgaggacaggccgatgatgtcgacagtgaatgtcatgcttagtagcagcacggtgaccctccaagctccatcgaggccggcgttttgcttcccgaagagtggcttcaactcagagatcaactcagaagtgtacccgccaggagcttatcagtccgcgagcaggtcgcccatgtcgctcaacgacgtctcaatcactgagctcgagcccagatgatgcatgcatgcatggcgatgaattgatgattgtcttcttcgaaggagtttctgttgagtgtttgtgttttaccgcctgggccgagcacgtaagtgtgagtgtgacccgtagtatacgaaactagtagactaccaatatatatggcgaaatataacgcctattagttgtccaaaaaaaaaaaaaaaaaa

SEQ ID NO: 4476 - protein, 691 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50939397; NR Description: putative receptor-like protein kinase 4 [Oryza sativa (japonica cultivar-group)] >gi|33146545|dbj|BAC79722.1| putative receptor-like protein kinase 4 [Oryza sativa (japonica cultivar-group)]
  misc_feature: GI Number: 50938137; NR Description: putative serine/threonine kinase protein [Oryza sativa (japonica
  misc_feature: GI Number: 50938119; NR Description: putative serine/threonine kinase protein [Oryza sativa (japonica cultivar-group)] >gi|28812096|dbj|BAC65048.1| putative serine/threonine kinase protein [Oryza sativa (japonica
  misc_feature: GI Number: 50938121; NR Description: putative serine/threonine kinase protein [Oryza sativa (japonica cultivar-group)] >gi|28812097|dbj|BAC65049.1| putative serine/threonine kinase protein [Oryza sativa (japonica
  misc_feature: GI Number: 50938125; NR Description: putative serine/threonine kinase protein [Oryza sativa (japonica cultivar-group)] >gi|28812099|dbj|BAC65051.1| putative serine/threonine kinase protein [Oryza sativa (japonica
MTTVAHHHHLAAATVLFFVAFTMAPLAAGDPVGQLCGTSGNYTLNSTYQGNIRRLAATLPKNTSTSATLFATDTFGAVPDIVYALALCRGDTNASACSGCVAAAFLDAQQLCAYNKDATMFYDPCLLRYSNQNFLADPSSDGRGTALILMNTQNVTARFKVFDAAVAALLNATAAYAAANSSKRFGTGVEAFQNFDSNRPRIYGLAQCTPDMTPADCQSCLSGIIQTGPKYFSGKQGGRILSVRCNYRYEQYPFFTSTPLLQLAEPTVGAPAPAPAVVNGTPTPPTTGGARGTTGNKTGRVLAITLPIVAAVLATIVLCSCLWRKRKTPGKSALPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFCFPKSGFNSEINSEVYPPGAYQSASRSPMSLNDVSITELEPR

SEQ ID NO: 4477 - DNA, 1921 bp, Zea mays
  misc_feature (1)..(1921): Ceres cDNA ID no. 21705380
  misc_feature (1)..(1921): Ceres CLONE  ID no. 1471217
  misc_feature (1)..(1921): Also known as  Ceres CDNA ID no. 24362411
aaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaggaacagatagccactgccctagccagcatccacagcgctggattattcaatagctcaagcctacacgaggctgcccttcggtttcgcttgcttaggcagcaggggttttgggttcctgcagatgaacttgtcaagttcatcaagaacgaagacgggagctttatcgatggtataaccaatgacccaaagggcctgttgagcttatacaacgcagctcaccttgttactcacgacgaggggacgacgacacttgaagatgccatcgcatttgcaaggcagcatctggaagctgctagaagatgtagtctcaagtcccctctagctgaacaagtcggccgtgcccttggtatcccactgccaaggaccttaaagagggaggaagcaatagcttttatcccggagtatagctcatcacaacaagatcaacaagtgtacagccccgtgatactagagcttgccaagctagacttcaacctccttcagcgtctccatcaagaagaactcaaggagatttctcaatggtggaaagacctctctggagaaatcggattaggctacgtcagggaccgcatcgtcgagtgttacttttggtcgtatactgtgcactacgagcgagggcaagcgcgtgcacggatgatacttgccaaggtattcatgttaacgtctttgttagatgacacttacgatgtgcatgcaactttggaggaggccagggagctcaacaaggctattcaaagatgggatgagagtgatgtttctcttctacccgagtacctaaagaaattctttgtcaaggtgataagtaacttcagggagtttgaggatgagttggagtcacatgaaaagtatcgtaatgtttacaatattaaagggttccaaacattatccaaacattatctccaagaagcagaatggtttcatcatggctgcactccaagcttcaaagatcaagtgaatgtttctgtcataacggggggcgctcaggtactaagcattggtttgcttgttggcatgggtcatgaggcaaccagagaggcattcgagtgggccatcggtgacactgatgctatatgggcttgtggagaggtgtcacgtttcatggatgacatgtcagcgttcaagaatggtaggaacaaaatggatgtcgccagttctgtggagtgctacatcaaggagcacaatgtccctagcgaggtcgccctggcaaggataaattccttggttcaagatgcatggaagaccataaatcaagcaccatttaagtaccctgctctattcccggttgtgcaacgagttacgagcctggcaaagagcatgacactgctgttcctcgataagagggatgcgtacacatacagcaaggactttcaaacgacactggagacccatttcgtaagacatattccgctctagtactaggctgtttatagaggggagttttaaataaaatgtgagctgccaggatagccttagaaagcaaaattcatggtgtgtgtttcagtcagacatctaataatctttttgttttcgtctaccatatgtattattttttttcataaggtatccggaatctgtgttatgtctgatgttagaaacatatttatataacgcttttcagagcccaaaaaaaaaaaaaaaaa

SEQ ID NO: 4478 - protein, 549 aa, Zea mays
  misc_feature: PFam Name: Terpene_synth_C; PFam Description: Terpene
  misc_feature: PFam Name: Terpene_synth; PFam Description: Terpene
  misc_feature: GI Number: 34900222; NR Description: putative sesquiterpene synthase [Oryza sativa (japonica cultivar-group)] >gi|23495894|dbj|BAC20102.1| putative sesquiterpene synthase [Oryza
  misc_feature: GI Number: 45478055; NR Description: terpenoid synthetase
  misc_feature: GI Number: 61354279; NR Description: (+)-delta-cadinene
  misc_feature: GI Number: 9864189; NR Description: terpene synthase [Citrus junos]
  misc_feature: GI Number: 61191782; NR Description: (E)-beta-farnesene
MATTGTTSMPAPVFHPTVWGDYFIKFVPEPLQVSDETMAERIRHLREEVSGMFQACKNVVDKTNLVDVVQRLGIDHHFEEQIATALASIHSAGLFNSSSLHEAALRFRLLRQQGFWVPADELVKFIKNEDGSFIDGITNDPKGLLSLYNAAHLVTHDEGTTTLEDAIAFARQHLEAARRCSLKSPLAEQVGRALGIPLPRTLKREEAIAFIPEYSSSQQDQQVYSPVILELAKLDFNLLQRLHQEELKEISQWWKDLSGEIGLGYVRDRIVECYFWSYTVHYERGQARARMILAKVFMLTSLLDDTYDVHATLEEARELNKAIQRWDESDVSLLPEYLKKFFVKVISNFREFEDELESHEKYRNVYNIKGFQTLSKHYLQEAEWFHHGCTPSFKDQVNVSVITGGAQVLSIGLLVGMGHEATREAFEWAIGDTDAIWACGEVSRFMDDMSAFKNGRNKMDVASSVECYIKEHNVPSEVALARINSLVQDAWKTINQAPFKYPALFPVVQRVTSLAKSMTLLFLDKRDAYTYSKDFQTTLETHFVRHIPL

SEQ ID NO: 4479 - DNA, 1166 bp, Zea mays
  misc_feature (1)..(1166): Ceres cDNA ID no. 21705381
  misc_feature (1)..(1166): Ceres CLONE  ID no. 1471233
  misc_feature (1)..(1166): Also known as  Ceres CDNA ID no. 24362502
aaactcctctaccagccggcgcacgccgacgccgacgccgacgggcacagtactagcgaccgagctgcgagcgacgccagggcatgggtgacactggcgcgaacatggcccactggggcgggctctacggccggggcggcggcggcggggttgtcgcgccggcgacgacggagacggtgacgacggcaggaggcggcgggtcggtgtcgagcccgacgtcgggcgggtcgggcggcagcccgagccgcgcgcagctgcagcccggggtcggggtggagggcgggcgcgtgggcaagcccgcgcggcggcggtcgcgcgcgtcccgccgcgcgcccgtcacgctgctcaacaccgacacctccaacttccgcgccatggtgcagcagttcaccggcgtcccgcccgggccctacggccccggccccggcggcggcggggggcccgtcatcagcttcggcgccgagtacggcggcgcgcagctggtgcgcccgtcgccgacgtccgccgtcatgtcgttcgacccccagcaccaccaccaccggccgacggcggcgtcgtcgctgcagagccagctgttcaggccgcagcagcagcagcagtacggtgccgacgtcggcggctacggcgtgcacggcatggccatggcggcgccgtcctccttcctgcacggcgggttcgaggcctcgtcggaggaccggctgctgctgcagagcatgatgcaggcctcgacgatgcccaccggccacccgccccccactaacaacggcaatggataccacttcggctagctgatcgatccaccggtttgatccccaccgcacaaccgaggtaattaatataataagcggggagctagatcagggatccatggaacgaagaagccgtcgtcgatgaccacgagctgatgatgacgcgtgttctagcttgttgctgctgcttaagcagctaagcattttttttgttatgttttttttgctggcctcgcagaaggctagctaattacgagtaagtaactaagtatagttagtagtggtagtgttatcttgctgctttaactagaaaaggagttaagctaggtcgatgtaaatagttcccttcctttttttctttttctttttgaaaaaatatcaatcaagaagtttaattttggggcaaaaaaaaaaaaa

SEQ ID NO: 4480 - protein, 234 aa, Zea mays
  misc_feature: PFam Name: VQ; PFam Description: VQ motif
  misc_feature: GI Number: 34912428; NR Description: P0681B11.18 [Oryza
MGDTGANMAHWGGLYGRGGGGGVVAPATTETVTTAGGGGSVSSPTSGGSGGSPSRAQLQPGVGVEGGRVGKPARRRSRASRRAPVTLLNTDTSNFRAMVQQFTGVPPGPYGPGPGGGGGPVISFGAEYGGAQLVRPSPTSAVMSFDPQHHHHRPTAASSLQSQLFRPQQQQQYGADVGGYGVHGMAMAAPSSFLHGGFEASSEDRLLLQSMMQASTMPTGHPPPTNNGNGYHFG

SEQ ID NO: 4481 - DNA, 1631 bp, Zea mays
  misc_feature (1)..(1631): Ceres cDNA ID no. 21705382
  misc_feature (1)..(1631): Ceres CLONE  ID no. 1475494
  misc_feature (1)..(1631): Also known as  Ceres CDNA ID no. 24371375
agtgcttgctatatccatctcttcaatctcccatacatactacatgttcttgcttcgtagtagttgtcagttaccttaacaatcatcattcaggtttgcagtggtatcatctaacgatgagcaatatgtgtccatcaccaggggctagggctagggaagcccatggaggagatgctcatggctggaaacgcaaatctaaaccagaatccaaacccaccgccggctgcgccctcggctcccggcgcccagagggcaggcgctcccgccgcggttgcggcagcgccgcctagcgctggcgcgaccggaggagcggggccggagcggcgggcgcggccgcagaaggagaaggcgctcaactgcccgcggtgcaactccaccaataccaagttctgctattacaacaactatagcctccagcagccgcgctacttctgcaagacgtgccgtcgctactggaccgagggcggctcgctccgcaacgttccggtgggcggcggctccaggaagaacaagcgctcgtcctcggccgtgtcgtcggcggctgcggccgccgccgcctccacctccgcggctatgtctggcacggtccccgtggggctcgcggccaagaaccccaagttgatgcacgagggcgcgcacgacctcaacctggcgttccctcaccacaacggccgcgctctgcagccaccggagttcccggcgttcccgagcctggagagcagcagcgtgtgcaaccccggagctgccatgctgggcaacggcgccgccggcaggggcatgggcgcgctctcgggtttggagctgctgaggagcacgggctgctacgtcccactgcagcactttcagctagggatgcccgcggagtacgcagccgcgggattctcgctgggcgagttccgcgttccgccgccgccgcagtctcagagtgtgttcgggttctcgctggacacgcacggcacggggggagttggcggcgccgggggttacagtgccgggctgcaggagagcgcggctggcaggatgctcttccccttcgaggacttgaagccggcagtgagcgctgctggcggcggcgcgagcaacggagctgatcatcatcactacgagcacagcaaagatcaagcagcaggcgacggcggcggagccagcggcgtcaccggcggccacgaggctccagcaggattctggagcaatagcatgatcgggaatggcagcagcaatggtggcggaggctcttggtaaatggtaaggcggcgcgccatgcatggctcatgcacgcgccgttgtcagcatgcggagataggggtagagacaaggatcggagttaataagagggtggaggtgattagtgttcacatatggcgtttgatctctctggttgtttgccttgtcttttttattttcggttcttggtgttcgtgtgtgtcaatcgacttgggggctaacacagcaggatatacagattgttaaggcggtgaaccggttatttacagcttctcttagccaatccatctctcgttttctgattctgtaatgtaatccaaggagcaagctgtcaatcacgttgtgcattgcatgcgcattatgtagagtatgtattaattgagcagctctaaaaaaaaaaaaaaaaa

SEQ ID NO: 4482 - protein, 359 aa, Zea mays
  misc_feature: PFam Name: zf-Dof; PFam Description: Dof domain, zinc finger
  misc_feature: GI Number: 4996642; NR Description: Dof zinc finger protein
  misc_feature: GI Number: 50253202; NR Description: putative Dof zinc finger
  misc_feature: GI Number: 20372847; NR Description: dof zinc finger protein
  misc_feature: GI Number: 20372895; NR Description: dof zinc finger protein
  misc_feature: GI Number: 4996640; NR Description: Dof zinc finger protein
MEEMLMAGNANLNQNPNPPPAAPSAPGAQRAGAPAAVAAAPPSAGATGGAGPERRARPQKEKALNCPRCNSTNTKFCYYNNYSLQQPRYFCKTCRRYWTEGGSLRNVPVGGGSRKNKRSSSAVSSAAAAAAASTSAAMSGTVPVGLAAKNPKLMHEGAHDLNLAFPHHNGRALQPPEFPAFPSLESSSVCNPGAAMLGNGAAGRGMGALSGLELLRSTGCYVPLQHFQLGMPAEYAAAGFSLGEFRVPPPPQSQSVFGFSLDTHGTGGVGGAGGYSAGLQESAAGRMLFPFEDLKPAVSAAGGGASNGADHHHYEHSKDQAAGDGGGASGVTGGHEAPAGFWSNSMIGNGSSNGGGGSW

SEQ ID NO: 4483 - DNA, 2082 bp, Zea mays
  misc_feature (1)..(2082): Ceres cDNA ID no. 21705383
  misc_feature (1)..(2082): Ceres CLONE  ID no. 1475533
  misc_feature (1)..(2082): Also known as  Ceres CDNA ID no. 24371379
aagtgcatttacacagaatttggaccaaatccccagagtgcgactgggctgtggttggcaccgagctcagtggggtagtgccgtagtggtcacggcggacggattgggcctttatcgctggtgaccgcgttgctccgctccggatgaggtgccccagggtcctctgctcatgtccacgtccatgtccgctccggctccgacccccgtcccgctgacctccttcgccgtgctgcggcaacaccactcgcagctcatccgtctcggcgtcgcctcccacgccgcccacgcgcgccgccttctctccttccttgcccgggaccccgactcccacttcccgtacgcgagccgcctcctggcgcaccacccggacccgcacccggcgctcttcaacccgctcttctccgcgctcccgacgcgccacgccgcgcggctcctggccctcatgctgtccctgcccctgcgcccggaccacttcaccttcccgcaaatcctcccgagcgcccagccgctccacctggtcgcccagctccacgcgctgctcctcaagctcggcttccacgcccacacgcagtcgctcaacgcgctgctcgccgcctacctcgccaacgcgagacccgacctcgcctcccgcgtcttccgcggcggcggcggagctctcgacgtcgtgtcgtggaccacgatggtcggcgggctcctcaagctggggctgttcgacgacgcgcgggtgctgttcgacgggatgcctgagcgaaacctggtgtcgtggaacgcgatgatgtccgggtacgtcaaggcctgcaggttcctggacgcgcttgaggtgttcgacgagatgcgggcgcgcggggtggacggcaacgtcttcgtcgcggctaccgcggtggtggcgtgcacgggcgccggcgcgctggcgcgcgggagggaggtgcaccggtgggtggagcagagcgggatccagatggacgagaagctggccaccgcggtggtggacatgtactgcaagtgcggctgcgtcgaggaggcgtggcgtgtgttcgaggccctcccgctcgctgccaaggggctcacgacgtggaactgcatgatcggcgggttcgcggtgcacgggcgggggcaggacgctctgaagctgttcggacggatggagagggagggcgtggcgccggacgacgtcacgctggtgaatgtgctcactgcttgcgcgcacgcggggatgctcagcgagggccgccactacttcaactacgttcctcagagatacggcattgagcccaagatggagcactacggctgcatggtcgacttgtatggaagagcagggcggctggaggaagccaagaaggttatccaggacatgcctatggagccagacgtcggcgtcctcggtgcgctcttcggcgcgtccaagatacacggcgacgtcgacctgggcgaggcgatcgggtggcgcgtcattgagctggatccccagaacagcgggcgctatgtgctgctggcgaacctcctcgccacggccggccggtgggaggacgtggccagggtccggcggctgatggacgagcggaacgtgagcaaggaagcagggcggtcagtgatcgaggtccaaggtgaggtctgcgagttccagtgcggcggcctgtgccacccccgggcggaggaggtgtacgcaatggccagtgacatgatgaggaagatcagggcagagggctacgtgcccgatacccgggacgtgctgcacgccattgcagaggaggagaaggagacgccactgctttaccatagtgagaagctggccatcgccttcgggctcctgcacaccagacccggcgacacgatgcggatcaccaagaatttgagagtctgtagagattgccatgaagcgaccaagttcgtgtctcgcgtctttgagcgccagattgtggtcagggacaggaaccggttccaccattttaaggacgggcagtgctcgtgtaaagattattggtaaaagtccattataatgttattatactcaaagactgagctaggaatgttcggaaatgttgatttagttccgaaaaaaaaaaaaaaaaaaaaaaaaaa

SEQ ID NO: 4484 - protein, 605 aa, Zea mays
  misc_feature: PFam Name: PPR; PFam Description: PPR repeat
  misc_feature: PFam Name: CITED; PFam Description: CITED
  misc_feature: PFam Name: Pyr_redox_2; PFam Description: Pyridine
  misc_feature: PFam Name: 7tm_1; PFam Description: 7 transmembrane receptor
  misc_feature: PFam Name: FH2; PFam Description: Formin Homology 2 Domain
  misc_feature: GI Number: 51535413; NR Description: pentatricopeptide (PPR) repeat-containing protein-like [Oryza sativa (japonica
  misc_feature: GI Number: 8778839; NR Description: T6D22.15 [Arabidopsis thaliana] >gi|15223099|ref|NP_172286.1| pentatricopeptide (PPR)
  misc_feature: GI Number: 50909363; NR Description: putative pentatricopeptide (PPR) repeat-containing protein [Oryza sativa (japonica cultivar-group)] >gi|46389885|dbj|BAD15486.1| putative pentatricopeptide (PPR) repeat-containing protein [Oryza sativa
  misc_feature: GI Number: 34910594; NR Description: putative selenium-binding protein [Oryza sativa (japonica cultivar-group)] >gi|20160880|dbj|BAB89818.1| putative selenium-binding protein [Oryza sativa (japonica cultivar-group)]
  misc_feature: GI Number: 10177533; NR Description: selenium-binding protein-like [Arabidopsis thaliana] >gi|15239979|ref|NP_201453.1| pentatricopeptide (PPR) repeat-containing protein [Arabidopsis
MSTSMSAPAPTPVPLTSFAVLRQHHSQLIRLGVASHAAHARRLLSFLARDPDSHFPYASRLLAHHPDPHPALFNPLFSALPTRHAARLLALMLSLPLRPDHFTFPQILPSAQPLHLVAQLHALLLKLGFHAHTQSLNALLAAYLANARPDLASRVFRGGGGALDVVSWTTMVGGLLKLGLFDDARVLFDGMPERNLVSWNAMMSGYVKACRFLDALEVFDEMRARGVDGNVFVAATAVVACTGAGALARGREVHRWVEQSGIQMDEKLATAVVDMYCKCGCVEEAWRVFEALPLAAKGLTTWNCMIGGFAVHGRGQDALKLFGRMEREGVAPDDVTLVNVLTACAHAGMLSEGRHYFNYVPQRYGIEPKMEHYGCMVDLYGRAGRLEEAKKVIQDMPMEPDVGVLGALFGASKIHGDVDLGEAIGWRVIELDPQNSGRYVLLANLLATAGRWEDVARVRRLMDERNVSKEAGRSVIEVQGEVCEFQCGGLCHPRAEEVYAMASDMMRKIRAEGYVPDTRDVLHAIAEEEKETPLLYHSEKLAIAFGLLHTRPGDTMRITKNLRVCRDCHEATKFVSRVFERQIVVRDRNRFHHFKDGQCSCKDYW

SEQ ID NO: 4485 - DNA, 668 bp, Zea mays
  misc_feature (1)..(668): Ceres cDNA ID no. 21705384
  misc_feature (1)..(668): Ceres CLONE  ID no. 1476689
  misc_feature (1)..(668): Also known as  Ceres CDNA ID no. 24363919
agctcgctcgcacttgcccgcaccccacccgacccacaccctgcacgcagcagcaacgagtctccctgggaggagcgagcgagagagcggtatggccggtggcagcatggtgttcgagccccacgcgggcacggtggcgggcggcgacgtcgtgttctgcgcggccatcgtgtgcctgtcgctcctgtccatgatcatcttcgcggcttccggctcctctggcgctggggacggggaggaaggggtgaagccgcggcggcgcggacgatccaacgggcctgtgttcgtgggcggcaggggctgcggctgcggcggctgcggcgcgggggccggcgtctgcggcacctacctctcctgaccggccactgcgtcggggcagagcacgcacgacgcgaccgccgatggactctccgcatcggcggcgtgcacgctggctgtacatactcgcatatatactagtacgctgcacggcagagcatgtcgtaataatcagaattaagctcgatttcagtgtccatggtcatggctgctgcgcttaatttccctttgatgttctcttcattcccctgctactactaataaacatgatgatgcaattattaccatgtaagtagttatctaaagaagagacggctcgcttttaattttctcaaaaaaaaaaaaaaaaa

SEQ ID NO: 4486 - protein, 88 aa, Zea mays
MAGGSMVFEPHAGTVAGGDVVFCAAIVCLSLLSMIIFAASGSSGAGDGEEGVKPRRRGRSNGPVFVGGRGCGCGGCGAGAGVCGTYLS

SEQ ID NO: 4487 - DNA, 515 bp, Zea mays
  misc_feature (1)..(515): Ceres cDNA ID no. 21705385
  misc_feature (1)..(515): Ceres CLONE  ID no. 1477049
  misc_feature (1)..(515): Also known as  Ceres CDNA ID no. 24362514
aaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaaggtaccgagcagcgagcgcggattgacggtcccggcggtcgcgccgtgccgtgccgtgatcccccggggtcttggcgttctagccttctaggaggcgcttgctattgtcaattgtcatgttggctgtgttgctgccggaacatgctgtgcgaattgtcaatttgtagcaatcatgattgatgaccaaaaaaaaaaaaaaaaa

SEQ ID NO: 4488 - protein, 103 aa, Zea mays
  misc_feature: GI Number: 50251779; NR Description: putative Citrate synthase, glyoxysomal precursor (GCS) [Oryza sativa (japonica
  misc_feature: GI Number: 21700853; NR Description: At2g42790/F7D19.21 [Arabidopsis thaliana] >gi|4512675|gb|AAD21729.1| putative citrate synthase [Arabidopsis thaliana] >gi|15081644|gb|AAK82477.1| At2g42790/F7D19.21 [Arabidopsis
  misc_feature: GI Number: 1345933; NR Description: CITRATE SYNTHASE, GLYOXYSOMAL PRECURSOR (GCS) >gi|1084323|pir||S53007 citrate synthase - cucurbit >gi|975633|dbj|BAA07328.1| glyoxysomal citrate
MDRADPARGRLAVLSSHLRGAGAEEAAGLERSPVSAPAPGPRAGALAVVDGRTGKRHEVKVSEDGTVRATDFKKVPSSERGLTVPAVAPCRAVIPRGLGVLAF

SEQ ID NO: 4489 - DNA, 1850 bp, Zea mays
  misc_feature (1)..(1850): Ceres cDNA ID no. 21705386
  misc_feature (1)..(1850): Ceres CLONE  ID no. 1477922
  misc_feature (1)..(1850): Also known as  Ceres CDNA ID no. 25088188
aatccactccaaacccccaccccaccgagccacgcgacgagccgcgccgccatgtggccactctcctacctgccgccggcaccggcgcagcagttgcgagcgcaccccggtcccggctccggccgcgggcccaggccgcagccgtgcgggctgccgttccccgacaccctccgcgcggctgcggctgcggccgccgtctccctttctctcatctatggcaacggcgtgggcgcggccttcgcggcatcagcggcgcaaccaatggaggtgtgccggaacgggggcgcggagatggtagaggaggtgagggccgaggcggtgactaacgagcagctcgtggaggaggcgtgggaggtggtcaacgagagcttcctccccgacgccgccagccgtccgtggtcgccagagatgtggatgcaaaggaagcaggatgttctccaaggcacaattaaatctcgtgctagagcccatgatatcattcgcaagatgctagcgagcctcggtgacccttacactcggtttctatctccctccgaattctcaaagatgtcaaaatatgacatgacgggaattggattaaatctgcgggagattcctgatgaaaatggttcttttaagttgatggtattagggctgttgttagatgggcctgcttactctgctggtgttagacagggtgatgagcttttatcagtcaacggcattgatgtaaagggtaaatctgcatttgatgcttcatccatgctgcaaggtccaaaggagacgttcgttacgattaaggttaagcatggcgactgtggtcctgttgagtcaatgaaggtgcagaggcaactggttactcgaactccagttttctatcgtttggagaaaagagaaaacaatgattcatctgttgggtatattcacattacagagttcaatgcagtggccaaaaaagatttggttagtgcgctaaaacgtctacagaaatcaggcgcctcctattttgttctggatttgagggacaatcttggtggactagtgcaagctggaatcgagacagcaaagctctttctgaataaaggagacacggtcatttatactgctggccgggatcgcctagtccaaaaggcaattgttgctgaaagtggacctatgattgctactcccctcatgttgctggtgaataataggacagcaagcgccagtgaaatagttgcttcagcacttcatgacaattgcaaagctgttcttgttggcgaaaggacttttggcaagggcttaatccaatctgtatttgaacttcatgatggttctggtattgtcgtcacagttggcaaatacgtgacaccaaaccacaaggatatcaatgggaatggaatagaaccggattacaatcgtcttcctgatttcaatgaagccagagatttcctttcacgatgcggaattaaagaattaagctgacagacgtctgtggcagatttcaatgaagcattatattctgaaggttctctcacgggtcagacgacctaatatgatagaattgatatggaacagagctgatgctcctcctgactactacatgaccctctatgtcgcgcgccactgataccataagcagcgtatcggcgagcgtcgacacagcctctacagtacagggcgaacatgttgctggtggcctctgctgcatggtgcaagaaatagagtacacgtggcgctcatctaaggcatcgcaaatgattgattcctaatccaacacaatatgtgaatagcttgtgatctgttcaaggcgcttagtcaaaatatacttctgactaaatcctttttaattgtcggtttcacgtcctgtcaaaaaaaaaaaaaaaaaaaaa

SEQ ID NO: 4490 - protein, 463 aa, Zea mays
  misc_feature: PFam Name: Peptidase_S41; PFam Description: Peptidase family S41
  misc_feature: PFam Name: PDZ; PFam Description: PDZ domain (Also known as
  misc_feature: GI Number: 1296805; NR Description: C-terminal peptidase of the D1 protein [Hordeum vulgare subsp. vulgare] >gi|7489416|pir||T05975 probable carboxy-terminal proteinase (EC
  misc_feature: GI Number: 19774137; NR Description: D1 protease-like protein
  misc_feature: GI Number: 19774135; NR Description: D1 protease-like protein
  misc_feature: GI Number: 10177720; NR Description: carboxy-terminal
  misc_feature: GI Number: 42573594; NR Description: peptidase S41 family
MWPLSYLPPAPAQQLRAHPGPGSGRGPRPQPCGLPFPDTLRAAAAAAAVSLSLIYGNGVGAAFAASAAQPMEVCRNGGAEMVEEVRAEAVTNEQLVEEAWEVVNESFLPDAASRPWSPEMWMQRKQDVLQGTIKSRARAHDIIRKMLASLGDPYTRFLSPSEFSKMSKYDMTGIGLNLREIPDENGSFKLMVLGLLLDGPAYSAGVRQGDELLSVNGIDVKGKSAFDASSMLQGPKETFVTIKVKHGDCGPVESMKVQRQLVTRTPVFYRLEKRENNDSSVGYIHITEFNAVAKKDLVSALKRLQKSGASYFVLDLRDNLGGLVQAGIETAKLFLNKGDTVIYTAGRDRLVQKAIVAESGPMIATPLMLLVNNRTASASEIVASALHDNCKAVLVGERTFGKGLIQSVFELHDGSGIVVTVGKYVTPNHKDINGNGIEPDYNRLPDFNEARDFLSRCGIKELS

SEQ ID NO: 4491 - DNA, 439 bp, Zea mays
  misc_feature (1)..(439): Ceres cDNA ID no. 21705388
  misc_feature (1)..(439): Ceres CLONE  ID no. 1479565
  misc_feature (1)..(439): Also known as  Ceres CDNA ID no. 24726891
acacgctccaagttgtagcacccaactcgcgtttggtatggatgtttgcttgagaggatcatcgtcacagtaccacgaatggtcaacagtgtgagattccctgctggtcttgccacgcccttttcggtttggcttcgcgtctggaatgtgtatacaggattactggtcagaattctgagaataacgagaagattctctgctgggatagtgggattccctgcatatttatgtgaaaccagctgtcggtctttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaaatatcatacgtactttagggttgggtgaaaaaaaaaaaaaaaaa

SEQ ID NO: 4492 - protein, 439 aa, Zea mays
ACACGCTCCAAGTTGTAGCACCCAACTCGCGTTTGGTATGGATGTTTGCTTGAGAGGATCATCGTCACAGTACCACGAATGGTCAACAGTGTGAGATTCCCTGCTGGTCTTGCCACGCCCTTTTCGGTTTGGCTTCGCGTCTGGAATGTGTATACAGGATTACTGGTCAGAATTCTGAGAATAACGAGAAGATTCTCTGCTGGGATAGTGGGATTCCCTGCATATTTATGTGAAACCAGCTGTCGGTCTTTATGCACAGATGCAACAGCAACACAAATCTGGTAGGAACACTGGTGGGTTTCTGTCGATAATTTGAGTGTATATGTAATATTATGTAATCTATTCCAGGGAAACATAGTTAAACCGAGGTTGTGAAAGCCAAAGAGATTGAGAAAATATCATACGTACTTTAGGGTTGGGTGAAAAAAAAAAAAAAAAA

SEQ ID NO: 4493 - DNA, 1178 bp, Glycine max
  misc_feature (1)..(1178): Ceres cDNA ID no. 21705389
  misc_feature (1)..(1178): Ceres CLONE  ID no. 1493914
  misc_feature (1)..(1178): Also known as  Ceres CDNA ID no. 0
attttctcataaaaaaacaatcttctctttaaaacgatggagtgtaggccgttggatctgacgatcatatccgcagaggacctcaaggacatccagctgatcggcaagcaagacttgtacgccgtcgtttccctcaacaacgacgcaaggaccaagcaaaagacgaaggtggacaaagactgcgggacgaaacctaaatggaatcatcagatcaagctcaccgtcgacgacacagcagcgcgtgagaaccatctcacacttgtcatccagatcatcgctgatcgtcccatcgccggtgataaaccagtcggagaggttagcgttcctctgaaggagcttttggatcagaacaacaaggagggtgacgtggaggaggagaaaacggtgacgtatgctgtgaagctgcctaacgggaagaccaaaggatctctcaagttctctttcaagttcggtgagaagtacactttcgggtcttcgagtgatcctcacgcgcctggctcatcgagtgttgaccacaagtctacggatcagcccgtcgcagcttacccgcccggacaaggcgccccgggtgcatacccgcctcctccaggccatgatgataaacacggcggtgtttacggttaccctcaggccggtggatatccgccacctggtggtcccggtggttatcctccagctgggccgggtgggtatccgcctcccggtgcatacccgcaacaaggtggatatccacctcaaggaggctacccgggttatccaccacagggtccaggctatgggtatccaccacagggtccaggttatgggtatccgccacagggtccgtacggttacccgcaacagcaaggttacggtggtcaaccgcagaaaccgaagaagcatggaggagctggaatgggactagggcttggacttggagctgggttgttgggtgggttgcttgtaggtgaagcaattgatgacatggctgatatgggtggcgactgtgatttctgattgtgctatcttatatggtcttaaattttcaatttcttagttaactgctgttttgttttgctctttggtggatcttgtgagagatcaacaagttctatcttcttgtctttagtttctggctttctcattatacaaaaaatgaagttgatatatgctgctttgtgtgaaaaaaaaaaaaaaaa

SEQ ID NO: 4494 - protein, 319 aa, Glycine max
MECRPLDLTIISAEDLKDIQLIGKQDLYAVVSLNNDARTKQKTKVDKDCGTKPKWNHQIKLTVDDTAARENHLTLVIQIIADRPIAGDKPVGEVSVPLKELLDQNNKEGDVEEEKTVTYAVKLPNGKTKGSLKFSFKFGEKYTFGSSSDPHAPGSSSVDHKSTDQPVAAYPPGQGAPGAYPPPPGHDDKHGGVYGYPQAGGYPPPGGPGGYPPAGPGGYPPPGAYPQQGGYPPQGGYPGYPPQGPGYGYPPQGPGYGYPPQGPYGYPQQQGYGGQPQKPKKHGGAGMGLGLGLGAGLLGGLLVGEAIDDMADMGGDCDF

SEQ ID NO: 4495 - DNA, 821 bp, Zea mays
  misc_feature (1)..(821): Ceres cDNA ID no. 21705391
  misc_feature (1)..(821): Ceres CLONE  ID no. 1494672
  misc_feature (1)..(821): Also known as  Ceres CDNA ID no. 24371425
ctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaaggtgcattccctgctctttctgctgtaatctgctggtgtaaagaaagttttcaaatctatatacatccttgtagagtcaatgcattcttttgaactttggaacctgaaaaatgctgtcttatcttgtcacgatgaatagaggaaagttcacggaaagtgtaatgtagcttttaaggcttgcaacaagatgcttattattttgaaacttaaaaaaaaaaaaaaaa

SEQ ID NO: 4496 - protein, 142 aa, Zea mays
MHSSENKLGWNETSMGLVPVPKRPARPDASHQCKSDSFMKRSPRKVRNATLAKSIKSKYHYSPLKQRKGSDSVPGKIVTGLTARKKKKRKIQITDEATRLERRARYFLIKIKLEQNLLDAYSGDGWNGQRCIPCSFCCNLLV

SEQ ID NO: 4497 - DNA, 531 bp, Zea mays
  misc_feature (1)..(531): Ceres cDNA ID no. 21705396
  misc_feature (1)..(531): Ceres CLONE  ID no. 1520294
  misc_feature (1)..(531): Also known as  Ceres CDNA ID no. 24362419
aaaaaaaaaaaaaaaaaaaaaaaaaaggtttcctccctgctcacgaattctgtccaaagataactgaagggtgttgtggcgcatgtgttcctgctagtattaatcttctccccagtccctagatcgatttgcttaagctggtatgtgccaccccctgtgctggtgaccacgcgtgcagttctcccacctcgccatggctcggacgtccttaggagttgctggcccgtatgaagcttgttctgtaatcatctcagagctcccaaaataaagagcgaagattcaagatgaagtggttgctaaagaggactctactccaatgcctgctcatcaagtggatggagccatctaactggggtttaatagagggatttagacctccgtctccgcaacaaaggcaagccccgatgtatttaccccttcattgtatttttaaaaagacttttatacacttaagtctagtcaaatgtgcattaagtttataggaattgcttggaaactatttgatgcattgactaaaaaaaaaaaaaaaaa

SEQ ID NO: 4498 - protein, 65 aa, Zea mays
MKWLLKRTLLQCLLIKWMEPSNWGLIEGFRPPSPQQRQAPMYLPLHCIFKKTFIHLSLVKCALSL

SEQ ID NO: 4499 - DNA, 689 bp, Zea mays
  misc_feature (1)..(689): Ceres cDNA ID no. 21705397
  misc_feature (1)..(689): Ceres CLONE  ID no. 1521100
  misc_feature (1)..(689): Also known as  Ceres CDNA ID no. 24362426
attgcaaggatgatcgtagagactgcaaccaagtctagcatagactggctggaccggccacctgcaagccttgtcgtcgagggccagctgaggcctgcctttgctgaggagagcaccatggttgccaagcatatatcaagtgacgcgccaaagaaagatacaaaggagagtggtgccacctttttcaaggtcgaggtcctcagcatcgagttgatcactgcgtatggaactgagccaaaggtaaagattgaagaataccagaaggctaagccggacatcatcgcgcattctgcaccgaacgtaatatcgcgcctgagagctggtggagacaaggtcacacaggctctgaaatctctctgttggaggagcaaggccattcaagtagaggaggcagcggtgatcggagtggactgtcttggttttgacctgagagtgtgctcaggaactcaagtgcagacattgagatttgctttccctacaaaggccacttcagagttctctgcagagaagcaaatacatgagcttctgtttcctaggaatacacatcaagaagggcaatcaccacaggcccgacagaagtcctgatgtaattcgatccatcgatgtggtaacttcattcagatggtaggaaattaatttagagaaataaataataaattcttggtcatgtccaaaaaaaaaaaaaaaaa

SEQ ID NO: 4500 - protein, 689 aa, Zea mays
ATTGCAAGGATGATCGTAGAGACTGCAACCAAGTCTAGCATAGACTGGCTGGACCGGCCACCTGCAAGCCTTGTCGTCGAGGGCCAGCTGAGGCCTGCCTTTGCTGAGGAGAGCACCATGGTTGCCAAGCATATATCAAGTGACGCGCCAAAGAAAGATACAAAGGAGAGTGGTGCCACCTTTTTCAAGGTCGAGGTCCTCAGCATCGAGTTGATCACTGCGTATGGAACTGAGCCAAAGGTAAAGATTGAAGAATACCAGAAGGCTAAGCCGGACATCATCGCGCATTCTGCACCGAACGTAATATCGCGCCTGAGAGCTGGTGGAGACAAGGTCACACAGGCTCTGAAATCTCTCTGTTGGAGGAGCAAGGCCATTCAAGTAGAGGAGGCAGCGGTGATCGGAGTGGACTGTCTTGGTTTTGACCTGAGAGTGTGCTCAGGAACTCAAGTGCAGACATTGAGATTTGCTTTCCCTACAAAGGCCACTTCAGAGTTCTCTGCAGAGAAGCAAATACATGAGCTTCTGTTTCCTAGGAATACACATCAAGAAGGGCAATCACCACAGGCCCGACAGAAGTCCTGATGTAATTCGATCCATCGATGTGGTAACTTCATTCAGATGGTAGGAAATTAATTTAGAGAAATAAATAATAAATTCTTGGTCATGTCCAAAAAAAAAAAAAAAAA

SEQ ID NO: 4501 - DNA, 1111 bp, Zea mays
  misc_feature (1)..(1111): Ceres cDNA ID no. 21705408
  misc_feature (1)..(1111): Ceres CLONE  ID no. 1532133
  misc_feature (1)..(1111): Also known as  Ceres CDNA ID no. 25088194
aatctcactctccgccactgcacccagcttcctcaaacttgcggtttactttcagagccccttgaacctgtacgtgtttcacgacctagcacctttgaatttgtcatggctgtttcctcacctagccctccctcttccatgtgtaggggagtgggttagatgagacaactatccgtgagatgttcaacaaatgggaagcacaaagatggtgggctgaaaactatgacaaagttatggaactttacaatgtgcagaagtttaatcaaactgtccctctcccagctaccccaaaatctgaagatgagagctccaaggaggacagcccggtgacaccaccactggacaaggaaaggctaccccgcactttccacagacaaggtggtggagcgatgggctcctcttcatcagattctctcgagcatcactcaaaccactactgtactggccgccaccaccaccaccaccaccatggacaccaatgctgtgattcaatgggcctggcatcaacgccaaagctgtcaagtatcagtggagccaaaacagaaacctcatcgatggacgcgtcaatgaggacaagctcgtcacctgaggagatcgacaggtctggtgagctctcggtgtccgtcagcaatgcgagcgaccaggagagggagtgggtcgaagaagacgagccaggcgtatatatcacaatccgggctttacctggtgggatcagagagcttcgccgcgttcggttcagccgggagaagttcagcgagatgcatgccaggctgtggtgggaagagaaccgagcgaggatacacgaacaatacctctgagaagagacgcccgacaccatcagcagcacgagcacatgaatagagctggcactaacacatccacatgcatttccagcttcatacgatgttttgctaacctaagaggtccggtttccggtattttacatttcgttcagtctcacgtgtggtggtggtggggtgggaggatagtgtacgtatttcacagtttcactactgaatctgtaggtctcgtttttcatcaataatgtatatctacctgttgtttcccataagacaaattagcatgcttgtgttaaaaaaaaaaaaaaaaa

SEQ ID NO: 4502 - protein, 212 aa, Zea mays
  misc_feature: GI Number: 51964952; NR Description: PREDICTED B1111C03.19 gene product [Oryza sativa (japonica cultivar-group)] >gi|50946569|ref|XP_482812.1| major intrinsic protein-like [Oryza sativa (japonica cultivar-group)] >gi|42409368|dbj|BAD10682.1|
  misc_feature: GI Number: 51536140; NR Description: major intrinsic
  misc_feature: GI Number: 15221753; NR Description: zinc finger
  misc_feature: GI Number: 21593118; NR Description: major intrinsic protein,
  misc_feature: GI Number: 50911833; NR Description: putative major intrinsic protein [Oryza sativa (japonica cultivar-group)] >gi|41052675|dbj|BAD07522.1| putative major intrinsic protein
MFNKWEAQRWWAENYDKVMELYNVQKFNQTVPLPATPKSEDESSKEDSPVTPPLDKERLPRTFHRQGGGAMGSSSSDSLEHHSNHYCTGRHHHHHHHGHQCCDSMGLASTPKLSSISGAKTETSSMDASMRTSSSPEEIDRSGELSVSVSNASDQEREWVEEDEPGVYITIRALPGGIRELRRVRFSREKFSEMHARLWWEENRARIHEQYL

SEQ ID NO: 4503 - DNA, 486 bp, Zea mays
  misc_feature (1)..(486): Ceres cDNA ID no. 21705410
  misc_feature (1)..(486): Ceres CLONE  ID no. 1540973
  misc_feature (1)..(486): Also known as  Ceres CDNA ID no. 24362209
aacactcaactttcatttcatcagcatcttctttgctccattcccttgcttaactcgtctctataacaatgtttggctacttctatttctttcggccacaacgtaaggaggtttcgtatgcaaaggcatatgtccttgaggatccttaatgggattcaacaagttgacgactacttcacgcaacatgttgacgccactaggttgcccaggttgggtcccttacaaaaaatatgtgttgttgtctgtatccaagcgtatggtttaccttcggacgttgttgatgattacatcataataggagaatccacggctaggggatgcgtcattaggttctatcgcgctgtcataagtgcattcagtgcatggtacattaggacgttgttgtctgtatcctatgtttgttaaatccatctgccaccccttcgaggagaagaaagttcatttcactcatatgcatgaataatgtcgtaaaaaaaaaaaaaaaaa

SEQ ID NO: 4504 - protein, 95 aa, Zea mays
  misc_feature: GI Number: 50937407; NR Description: ribosomal protein-like [Oryza sativa (japonica cultivar-group)] >gi|50509426|dbj|BAD31045.1| ribosomal protein-like [Oryza sativa
  misc_feature: GI Number: 9743357; NR Description: F21J9.3 [Arabidopsis thaliana]
  misc_feature: GI Number: 62734663; NR Description: transposon protein, putative, ping/pong/SNOOPY sub-class [Oryza sativa (japonica
  misc_feature: GI Number: 62734556; NR Description: transposon protein, putative, ping/pong/SNOOPY sub-class [Oryza sativa (japonica
  misc_feature: GI Number: 51535903; NR Description: ribosomal protein-like
MQRHMSLRILNGIQQVDDYFTQHVDATRLPRLGPLQKICVVVCIQAYGLPSDVVDDYIIIGESTARGCVIRFYRAVISAFSAWYIRTLLSVSYVC

SEQ ID NO: 4505 - DNA, 1863 bp, Zea mays
  misc_feature (1)..(1863): Ceres cDNA ID no. 21705415
  misc_feature (1)..(1863): Ceres CLONE  ID no. 1553397
  misc_feature (1)..(1863): Also known as  Ceres CDNA ID no. 24364225
aacgactcccgccaaaccatagccacgagttccctgctcccccggcccccgctaccccgccaatcctgtcccgggtttctgccgccggccgccatcacgcgatggatcccctctccctcctgcagctccctcgcgcctcgcgcccaccgatgcccctggccgcggccgccgcgccattggtctccgcgaggctaagcgtaagcggcggcgcgcgctccgttcggaggcggcgacggcgccgcgccgctgggctgtcggtgttcgccgtggcgaccgagacgccgcggaccgaggagcagcagccgtcgccgtccggggaggagcggttcgactggctggaccagtggtacccgctggcgcccgtgtgcgacctcgacccgcgcgcgccgcacggcaagacggtgctggggctcagcgtcgtggcctggtacgaccgcggcgccggcgagtggcgcgtcttcgacgacgcctgcccgcaccgcctcgcgccgctctccgagggccggatcgacgacagggggcgcctccagtgcgtgtaccacggctggtgcttcgacggcgccggcgcctgcaagttcatcccccaggcacccgccctcggcccgccggtgcacacgagcagcagggcgtgcgtggcgtcgtacccctgcgtggtgcagaacaacatcctgtggttctacccgagggctgaccccgagcatagcgacgtgctgcagaggaagcgcccgccgctcatccctgagattgacgacccggacttcgtcaccgtctatggcatcagagacctcccttacgggtatgatattttggttgagaacctcatggaccctgctcatgtcccgtatgcacacaaggggatcatgcgtggcattcgcaagaaggaagatcctggaagagtcgactacgataaagagggcggcggtccagtcaagatgaagatcgagcaggcaaacatagaagggtttgtgtcaccgcaagagcggggctacttccagttcgtcgcgccctgcacgttcttcggcacgccgtttgtgcaggagggccagaagaagaaggcgcctcgggtcatgctggtgttcttctgcatcccggtcggtcctggcaggagcagggtgatctgggcgttcccgaggaacgtcggggtctggctccaccatatcacgccacggtggctgtaccacgtcggccagaaccttatattggattcagacattttcctcctccacgttgaggagcgtaaatttgctgcggcagggctggataactggcagagagcttgttacgtgccgacgtcgtcggacgccatggtggtcgccttcaggaactggttcagaaaattctgcaagaaccaggtcggctgggcaaccttacaagtcgaccagctgccaccaacgcgtaccaaggaccagctcatggagaggtactggtcgcacgtggtgcagtgcaggagctgcaacgcggcgctcaaggccatgaaggcgctcgaggctgccctgcaggtggcctcggtcgccgtcgtcgggttccttgccgtcgctaagggaacggtcctcacgtcaactgttcagagggccgcagtcgtgtcggcgaccgtgctgtgcttcgctgcctcccgttggcttgccaacttcatccagaagaacttctactttcaagactacatccacgcctacaagtgacacgctcatgaatacgtttttaaaggtttttgttgctaggagattgttgtttttactgtgaatgcatattattaggagaattgggtgggtagaaagcagtatctatactgcattaacttgtatataataatgcatataatcgataataaaacggaagacacgcggctaaaaaaaaaaaaaaaaa

SEQ ID NO: 4506 - protein, 525 aa, Zea mays
  misc_feature: PFam Name: Rieske; PFam Description: Rieske [2Fe-2S] domain
  misc_feature: PFam Name: Cornifin; PFam Description: Cornifin (SPRR) family
  misc_feature: PFam Name: Cupin_1; PFam Description: Cupin
  misc_feature: GI Number: 50919231; NR Description: putative iron-sulfur cluster-binding protein [Oryza sativa (japonica cultivar-group)] >gi|41469406|gb|AAS07229.1| putative iron-sulfur cluster-binding
  misc_feature: GI Number: 50919233; NR Description: putative iron-sulfur cluster-binding protein [Oryza sativa (japonica cultivar-group)] >gi|41469408|gb|AAS07231.1| putative iron-sulfur cluster-binding
  misc_feature: GI Number: 50919235; NR Description: putative iron-sulfur cluster-binding protein [Oryza sativa (japonica cultivar-group)] >gi|41469410|gb|AAS07233.1| putative iron-sulfur cluster-binding
  misc_feature: GI Number: 50919237; NR Description: putative iron-sulfur cluster-binding protein [Oryza sativa (japonica cultivar-group)] >gi|41469411|gb|AAS07234.1| putative iron-sulfur cluster-binding
  misc_feature: GI Number: 1935914; NR Description: lethal leaf-spot 1
MDPLSLLQLPRASRPPMPLAAAAAPLVSARLSVSGGARSVRRRRRRRAAGLSVFAVATETPRTEEQQPSPSGEERFDWLDQWYPLAPVCDLDPRAPHGKTVLGLSVVAWYDRGAGEWRVFDDACPHRLAPLSEGRIDDRGRLQCVYHGWCFDGAGACKFIPQAPALGPPVHTSSRACVASYPCVVQNNILWFYPRADPEHSDVLQRKRPPLIPEIDDPDFVTVYGIRDLPYGYDILVENLMDPAHVPYAHKGIMRGIRKKEDPGRVDYDKEGGGPVKMKIEQANIEGFVSPQERGYFQFVAPCTFFGTPFVQEGQKKKAPRVMLVFFCIPVGPGRSRVIWAFPRNVGVWLHHITPRWLYHVGQNLILDSDIFLLHVEERKFAAAGLDNWQRACYVPTSSDAMVVAFRNWFRKFCKNQVGWATLQVDQLPPTRTKDQLMERYWSHVVQCRSCNAALKAMKALEAALQVASVAVVGFLAVAKGTVLTSTVQRAAVVSATVLCFAASRWLANFIQKNFYFQDYIHAYK

SEQ ID NO: 4507 - DNA, 1022 bp, Zea mays
  misc_feature (1)..(1022): Ceres cDNA ID no. 21705422
  misc_feature (1)..(1022): Ceres CLONE  ID no. 1559180
  misc_feature (1)..(1022): Also known as  Ceres CDNA ID no. 24362116
agtggcccgtgggggacggcagtacggcacgcaaccgcacgcagccactcaccggtgagcggcgaggcgactgacgcggccgcgcaccgcagtcacgcacgcaggcgctcaatggctgcgtcactctgctccccgcctccgctcccttccgccttccgccgatcccgcgccgtcgtccgcgcctcctcctcctcctcctcctcctcgtcatccgccgtctcgtcgtcgtcgtccgcccccaaagcgcggttcgtcgcccgccgctccgagtccgtccccgtccagcagctggtccgcccgctcgcggagtacatgagcttgccagccagccagtactcggtgctggacgccgagcgcatcgaacgcgtcgacgactccaccttccggtgctacgtgtaccgcttccgtttcttcgcgcttgaggtctgccccgtcctcctggtccgcgtcgatgaggaacccaacggctgttgtattcacctcctctcctgcaagctggagggatcaccgctcgtggaggcgcagaatgataaattctcagcttccatggcgaatagggttttctgcagcagcaagtcgcaagattcgacccttcaacaacttacatcagatactacaatagaggttgcaattgatataccttttccatttcgagcaataccggttgaagccattgaatcaagtggcaggcaagtgcttgaacagttactcagagtcatgcttccaagatttctgaagcagcttgttaaagactaccaagcttgggcttctggcgatgcttctaggaaaccacttggcactggtgaaatctgaagctgcccagtgtctccattacgcatgatagtttgatcgtagaattcagttattgccccgttgtgttgtatagcaatcctgccaaaacaatgggcatgcttgtttcagtttttttgctgattttggctgccaaaagctgttgtatgctaaacgctcagtttttgattccacttttatgagaatcattttggtgaaaaaaaaaaaaaaaa

SEQ ID NO: 4508 - protein, 233 aa, Zea mays
  misc_feature: PFam Name: Pkinase; PFam Description: Protein kinase domain
  misc_feature: PFam Name: Extensin_2; PFam Description: Extensin-like region
  misc_feature: PFam Name: FH2; PFam Description: Formin Homology 2 Domain
  misc_feature: PFam Name: Pyr_redox_2; PFam Description: Pyridine
  misc_feature: PFam Name: Vitellogenin_N; PFam Description: Lipoprotein
MAASLCSPPPLPSAFRRSRAVVRASSSSSSSSSSAVSSSSSAPKARFVARRSESVPVQQLVRPLAEYMSLPASQYSVLDAERIERVDDSTFRCYVYRFRFFALEVCPVLLVRVDEEPNGCCIHLLSCKLEGSPLVEAQNDKFSASMANRVFCSSKSQDSTLQQLTSDTTIEVAIDIPFPFRAIPVEAIESSGRQVLEQLLRVMLPRFLKQLVKDYQAWASGDASRKPLGTGEI

SEQ ID NO: 4509 - DNA, 1558 bp, Zea mays
  misc_feature (1)..(1558): Ceres cDNA ID no. 21705424
  misc_feature (1)..(1558): Ceres CLONE  ID no. 1559853
  misc_feature (1)..(1558): Also known as  Ceres CDNA ID no. 24370970
aaccttctccttcctctcgcctagcctgcctcgctcctccgttcaggctttcagctaccgccgcgcggccgcgaccggcggcctcctttagcggctacgacgacgtatataccgggcaggcgggcaccggccacggccaacgctagctgctgccaggttgctggaaagagcagtaaagagagataattcaggagtgggatcgagacgacatgagggacatgggagagaagaggagacacgggcatggacatggacatggacatcttgttgggtttggagctggaggggttgttggacatgccgcagagcatgaggagaagcgcatggagcagaagaagctggacatgagcagcatgtccatggacaccctgccacatctcaccacgcctcttggcaacatcactaccctggatctctccaacaacaacctacagagcattccggagtccataatcgcgaggctcctgaacgtggtggtgctggacgtgcgctccaaccagctcaagtcgctgcccaactccatcggctgcctctcaaagctcaaggtcctcaacgtctccggcaacctgctccaagaactgccggccaccatcgaggaatgccgtgcgctggaggagctgaacgccaacttcaaccagctgacgaggctgccggacacgctgggcttcgagctccacggcctccggcggctgtccgtcaactccaacaagctcgcgtacctgccgtcgtccacctcccacatgacggcgctgcggtcgctggacgcgcgcctcaactgcctccgcgcgctgcccgacgggctggagaacctcggcggcctcgaggcgctcaacgtgagccagaacttccagtacctgcgggagctgccctacggcatcggcctcctcgtctcgctccgggagctggacgtcagctacaactccatcgccgcgctcccggactccatgggctgcctcaccaagctcgccaggttcagcgccgcgggcaacccgctggtgtgcccgcccatggacgtcgtcgagcagagcctcgacgccatgcgcgcctacctcagcgcgcggatgaacggcaccgccaaggccaagaagaagagctgggtgcccaagctggtcaagtacagcaccttctcggcggggatgatgacgcccggccgcaccaaggtgcacgggaacaacaccgacggcctccacatgtcggattaccggtcgctcgacggcggcggcgttgcgtcgtcggcgtttctcagcatgctgtcgccccggcgtctcttctcgccgcggagaaattcgaccaaacactagtagcttagcagtggccactggttcggcaggctatacatgtgtgctacctccttattgctggctgtttgcttgctgcttcgatgttcatatgacatgctcgtactgtagcgcaagctgaagctaatgatcttgctactacagttgtatatgctttgaagagaggtatatatgaagtgtgtatagtagcacgtagtgcaatagggcattgatgtacataggaattaagggtgtctttctttccaaaaaaaaaaaaaaaa

SEQ ID NO: 4510 - protein, 363 aa, Zea mays
  misc_feature: PFam Name: LRR_1; PFam Description: Leucine Rich Repeat
  misc_feature: GI Number: 30725612; NR Description: At4g26050 [Arabidopsis thaliana] >gi|20260486|gb|AAM13141.1| putative leucine-rich-repeat protein [Arabidopsis thaliana] >gi|22328943|ref|NP_194335.2|
  misc_feature: GI Number: 3135263; NR Description: putative leucine-rich-repeat protein [Arabidopsis thaliana] >gi|7486236|pir||T01281 probable leucine-rich-repeat protein At2g19330 [imported] - Arabidopsis thaliana
  misc_feature: GI Number: 57868156; NR Description: plant intracellular
  misc_feature: GI Number: 21700931; NR Description: At1g12970/F13K23_18 [Arabidopsis thaliana] >gi|17063165|gb|AAL32979.1| At1g12970/F13K23_18 [Arabidopsis thaliana] >gi|18391461|ref|NP_563921.1| leucine-rich repeat family protein
  misc_feature: GI Number: 50910025; NR Description: putative leucine-rich protein [Oryza sativa (japonica cultivar-group)] >gi|46805022|dbj|BAD16887.1| putative leucine-rich protein [Oryza sativa (japonica cultivar-group)] >gi|50726485|dbj|BAD34094.1|
MRDMGEKRRHGHGHGHGHLVGFGAGGVVGHAAEHEEKRMEQKKLDMSSMSMDTLPHLTTPLGNITTLDLSNNNLQSIPESIIARLLNVVVLDVRSNQLKSLPNSIGCLSKLKVLNVSGNLLQELPATIEECRALEELNANFNQLTRLPDTLGFELHGLRRLSVNSNKLAYLPSSTSHMTALRSLDARLNCLRALPDGLENLGGLEALNVSQNFQYLRELPYGIGLLVSLRELDVSYNSIAALPDSMGCLTKLARFSAAGNPLVCPPMDVVEQSLDAMRAYLSARMNGTAKAKKKSWVPKLVKYSTFSAGMMTPGRTKVHGNNTDGLHMSDYRSLDGGGVASSAFLSMLSPRRLFSPRRNSTKH

SEQ ID NO: 4511 - DNA, 1737 bp, Zea mays
  misc_feature (1)..(1737): Ceres cDNA ID no. 21705428
  misc_feature (1)..(1737): Ceres CLONE  ID no. 1560705
  misc_feature (1)..(1737): Also known as  Ceres CDNA ID no. 24371203
actcctccacaggaccaccgccgcctcctcctcctcctctctgctgcggccgctgtaccgtcggtcgcctggacgggtgcggcggccacgtcttcgtcttcatcgtgacccacgacggagaggacacacacacacacagagagagagagaggcctggcgtcagggaggaagacgtctcgcctcgtctcgtcgtcttctgcggcgtccgttcttcaagccctcccccgtcgcccaccagtagcccgcccgcccgctccccaaggaggacgcagcggtttgccatgagaagacagctttggttgtgccaaagccaaacacgaacaccagcctaggaattccagcatgggttcagggaatctggtaacgaagaaggtggtaaggaggcccagctccatcgaccaggacataaagttcgatcaaagctgggtggaggatgtcgcgtgcccaatctgtctcgattccccccacaatgcagtgttgctcaggtgcgcctcgtatgagaagggctgtaggcctttcatatgcgacaccgaccagactcgctccaactgtctcgagaggttcagaggcgctcatggactgccactgccagtgccagccaacgccagagcctcctcccgtaccgtggctcctctcaacagcatccataccattaccatctcttcgtcgaatgcaaacaacaaccgcccggcttgcccgctgtgtagaggcgatgtgatggggtggttcgtcatcggcgaggctcgctcgcaccttaaccagaagagaagatgctgcgaagagagccgctgctcgtacgtcggcagcttccacgagctccagaggcacacccagcaaaagcatccggactcgcgcccttccgcgatcgaccctgctcgccgggccgattgggagaacctgcagcggtcttccgacgtggtagatgtcctgagcacaatacacgcgcaggttccaaacggtgtggttcttggagactatgtcatcgagtacggggacggtgacgaagctggagacgacgactacgaggtttaccacggggttagagcaagctggtggacgtcctgtatcttctgcaaagcgttctgtaggtcttcccccccaggaggagtccggagaaggacgagaacaggggaaaggagaagcagtggtggaagtggaacaaggagcagcagcaacaggtctagctctagtcaagaaaggttcactcttgatgaagttgacgatggatatgtagttgcaggggccatggccagggctgccgtgtcagggacaatggatgctcgttacaggtctgtttggtaactgtgctgttgtttcctgctttctgttattcatcagagatcatatggttaaatgccatgcacacatacagaatcgaagatatcatgagaaatgactttgttttatttaagttctccatttgtacgcattttttttttgtttcgtcgatgtaaaagtgtgtccaattttagtaccctgtctctgatatatatgaactatttcatccattcatcaattcagggatccaacacttggacaccgacgttcgcattcctaggaacattaaccggggaggaaaataaggaaagctgtgctggtgtaggatgcaacaaaaaatcagatccgttctacctctgctcatttttattcttttttttctcttgggagcttcatgtacatatatatataaatatataaagattgtagggaacttttttttaaaaaaaaaaaaaaaaa

SEQ ID NO: 4512 - protein, 319 aa, Zea mays
  misc_feature: GI Number: 5103842; NR Description: F9L1.39 [Arabidopsis thaliana]
MGSGNLVTKKVVRRPSSIDQDIKFDQSWVEDVACPICLDSPHNAVLLRCASYEKGCRPFICDTDQTRSNCLERFRGAHGLPLPVPANARASSRTVAPLNSIHTITISSSNANNNRPACPLCRGDVMGWFVIGEARSHLNQKRRCCEESRCSYVGSFHELQRHTQQKHPDSRPSAIDPARRADWENLQRSSDVVDVLSTIHAQVPNGVVLGDYVIEYGDGDEAGDDDYEVYHGVRASWWTSCIFCKAFCRSSPPGGVRRRTRTGERRSSGGSGTRSSSNRSSSSQERFTLDEVDDGYVVAGAMARAAVSGTMDARYRSVW

SEQ ID NO: 4513 - DNA, 1158 bp, Zea mays
  misc_feature (1)..(1158): Ceres cDNA ID no. 21705432
  misc_feature (1)..(1158): Ceres CLONE  ID no. 1562032
  misc_feature (1)..(1158): Also known as  Ceres CDNA ID no. 24362541
acccgttgccacacatacggatccaacaaaatctcccgcaaagacaacggcgagccaaccaccaccagcgtcccgcgctagctgcggcaccgcatggctgccgtgaccagcaccgcctccatctgcccggccgcagccggcgccctctcttcgctgccgtccttcatcacgcgcaagcccaccagcggcagcaggaggttgcagcaggcagcagcgacgacagtctgccactgccgctctgctcgggtagaggaggggctgctgggccggagggacgccttattgctcggcatcgtcttctccgccgcgacgccgccgctgctcgcccctgccggcgctctggcggacgaggccaccgccgagtcgcaggagggcttcactacgtacgaggatgaggccaacaagttcagcattcaagttccgcaaggctggctggtcggcgccggcgaggccagcggcatcaagtctgtcacggcgttctaccccgagcaggccgccaccgactccaatgtcagcgtcgccatcaccgggatcgggccggacttcaccagcctcaagtccttcggcgacgtcgatgccttcgccgagggtctggtgaacggcctggacaggagctggcagaggccgccggggctcgccgccaagctcatcgactccagggcggcaaacggcctgtactacctggagtacacgctgcagaaccccggcgagcgacggcgccacatcgtctcggccatcgggatggccttcaacggctggtacaaccgcctctacactgtgacgggccagtacatcgacgacgatgactcggagaagtacaggcctcagatagagaaggctgttggatcgttcaggctgacatgaaagatgcgatgtcatccagcaccagcagcagcagccgcccacggtacataaaccctaaatatgtatgcggagaggtccagcaacatgttgtgcccgaaaattgacaccttgccatttcgatgagacaagacaaggcatgtgcctattgccctattccaattcttgagcactgtaacactgccaatatgcagagtatatgttttctgcctgttgaggtggatacaaatgcatgcttttttttttattaataactcatgtgtaacactgctgccttttttaaaaaaaaaaaaaaaa

SEQ ID NO: 4514 - protein, 256 aa, Zea mays
  misc_feature: GI Number: 50947575; NR Description: thylakoid lumen protein, chloroplast precursor-like [Oryza sativa (japonica cultivar-group)] >gi|42408803|dbj|BAD10064.1| thylakoid lumen protein, chloroplast
  misc_feature: GI Number: 21537211; NR Description: thylakoid lumen protein,
  misc_feature: GI Number: 32815945; NR Description: At1g76450 [Arabidopsis thaliana] >gi|18203439|sp|Q9S720|THL1_ARATH Unknown thylakoid lumen protein, chloroplast precursor >gi|18411110|ref|NP_565131.1|
  misc_feature: GI Number: 61826057; NR Description: PREDICTED: similar to serine\/arginine repetitive matrix 1, partial [Bos taurus] gi|61818041|ref|XP_593433.1| PREDICTED: similar to serine\/arginine
  misc_feature: GI Number: 7949115; NR Description: Ser/Arg-related nuclear matrix protein; plenty-of-prolines-101; serine/arginine repetitive matrix protein 1 [Mus musculus] >gi|3153821|gb|AAC17422.1|
MAAVTSTASICPAAAGALSSLPSFITRKPTSGSRRLQQAAATTVCHCRSARVEEGLLGRRDALLLGIVFSAATPPLLAPAGALADEATAESQEGFTTYEDEANKFSIQVPQGWLVGAGEASGIKSVTAFYPEQAATDSNVSVAITGIGPDFTSLKSFGDVDAFAEGLVNGLDRSWQRPPGLAAKLIDSRAANGLYYLEYTLQNPGERRRHIVSAIGMAFNGWYNRLYTVTGQYIDDDDSEKYRPQIEKAVGSFRLT

SEQ ID NO: 4515 - DNA, 1075 bp, Zea mays
  misc_feature (1)..(1075): Ceres cDNA ID no. 21705436
  misc_feature (1)..(1075): Ceres CLONE  ID no. 1564312
  misc_feature (1)..(1075): Also known as  Ceres CDNA ID no. 24362163
accgatcccctcaaagctaggagtgggggaccaggggagctgggaatctgcggcttcagctgctgctgcgagcctgcgacctccgaggcggagctcaatggagttatccactcccgttgggagctcccttgctagaacagcgaccatggccctcgttagccccagcttcaagataaccaatcaaatgcgtggcaggggtatgccacttgaatgccaatttcctcataggctaccatctgtagcttgttcaatgttgttaaacacacaaccttcacaacgaaccaaccataaagattgtggtttgcttcaggtgcaatgtacagaaaacctgatgcagtcgccagtatctttcagtgacttctctgtttcagtgtgtactcaagaggatggtctgataaagctacaggtaaatgtatctggcacaatgacagattctatcttcgagaaagttttcacaaagaatgttgccgccgctcaaccccttcccggctttcgacgaatgaaaggagggaaaactccagacataccgaaagaagttgctctacacttaatcgggccatcaaaagtgaagaaagaaacaatcaagaaaattataaatagcacggttgctgagtacgttcaaaaggagggcctgactgtatcgaagaatatgaaagttcagcagagctatgaagagcttgaggcagcatttgaaccagggaaagaattttgctttgacgcaacagttcatttacaataagctgatgacgcataagtggtgccactaggattgataaccagccttctccagcattatgccctcattagtagttgttaagaaatgttttcaggtgaaacagaattaggcaaaatatcatggtaatcttcggtagggccatgggcgtaatgtattttttgtatggcagtaattcataaacatggtgatgttctcgttgatacaaggatcaaattaagtgagcgctgcaagaaaaaaaatctttaacaattatattttacaatggagtatgtaattgtaatatccaaatgctcgatcaatcatgaaaaaaaatctgttatgcaaaaaaaaaaaaaaaaa

SEQ ID NO: 4516 - protein, 213 aa, Zea mays
MELSTPVGSSLARTATMALVSPSFKITNQMRGRGMPLECQFPHRLPSVACSMLLNTQPSQRTNHKDCGLLQVQCTENLMQSPVSFSDFSVSVCTQEDGLIKLQVNVSGTMTDSIFEKVFTKNVAAAQPLPGFRRMKGGKTPDIPKEVALHLIGPSKVKKETIKKIINSTVAEYVQKEGLTVSKNMKVQQSYEELEAAFEPGKEFCFDATVHLQ

SEQ ID NO: 4517 - DNA, 1487 bp, Zea mays
  misc_feature (1)..(1487): Ceres cDNA ID no. 21705438
  misc_feature (1)..(1487): Ceres CLONE  ID no. 1565945
  misc_feature (1)..(1487): Also known as  Ceres CDNA ID no. 25891794
aatcaactgtgtcgaagcatctagcctagtggtggcgcgacgcgataatggactctgagagcgaggagcagggctcgtcgccggagacagagtcggatcccccgccgtcgccgtcgcagctgccgctgctgctgaacccggcgtacgcgcggtgcaagtcggtcgtccacgacgagctgcgcagcttccgcgtgttcctgcagtggtgcgcgctggaccacagcacctgcgcggggcgcgccgcgtcgtacgcggtgttcgtggcgctggcgctgctggtgcccgccgcggtgtcgctgtcgctgcgcgccgacacggcgctgtcgcgggcctccgcgtccgccatcgccttcaaccgcgtggcgcaggcccccgccacggggctcgccgtcgtgtccttcgccacgctggccgccttcttccgccgcttcggcggcctgcggcagctgctgttcctcgacggcgcgctccgcgacgacaccgccttcgtgcggcgcggctacgcgcgggagctggaccgcgcgttccgcaccctggccgcgctcctgctgccctcgctctgcgtggaggccgcgcacaaggccgtcttcttcttctgcaccgttagggtggagccgcccgccgccgtgctcctccccttcgccacgccgccgctggtgctgccgtggcgcgcggtggcgctggtcgccacggtggcgtcgtgggtgtaccgcacgggggtgttcctgctggtgtgcgtgctgttccgcctcacctgcgagctccagatcctgcgcttcgagggcatctaccgcatgttcgacgtcgaggcgcgccccaccgccgctgagatcttcgcggagcaccgccgcatccgcacgcagctgctcgccaccagccaccggtacagggtgttcatcctctgctgcctcgtcaccatcaccatcagccagctcggcgcgctcatcgtggtcctctcgtcaagggacgccaagagcttctccaacaccggcgacctcgtggtcggctcggcggtgcagctgagcggcttcttcatgtgcctgctgggcgcggccaggatcacgcacagggcgcagaggatcgtgtccatcgccagccagtggcacatgagcttggagtcgtcgtccacgcacaactgcaaatcgtcgtcagcgagcgacgccgtcgacgcgtcgtcccacgtctccggctcgtcgacggccgccgtctcccagctggcggagcccagtgcgccgtgctcgtacagcagcagacaagcactcgtgacttacctacggcacaacggcggcgggatcaccctgttcggcttcacgctggacaggggcctcctccacaccatcttcgtcttcgagatgaccctggtgctctggatcctcagcaaagtcgtggtcttctaacaggaagaggagtgtcgtcgcatagtaacgttgcctattgattaacgactgattattctcccttttctttctgaaaaaaaaaaaaaaaaa

SEQ ID NO: 4518 - protein, 449 aa, Zea mays
MDSESEEQGSSPETESDPPPSPSQLPLLLNPAYARCKSVVHDELRSFRVFLQWCALDHSTCAGRAASYAVFVALALLVPAAVSLSLRADTALSRASASAIAFNRVAQAPATGLAVVSFATLAAFFRRFGGLRQLLFLDGALRDDTAFVRRGYARELDRAFRTLAALLLPSLCVEAAHKAVFFFCTVRVEPPAAVLLPFATPPLVLPWRAVALVATVASWVYRTGVFLLVCVLFRLTCELQILRFEGIYRMFDVEARPTAAEIFAEHRRIRTQLLATSHRYRVFILCCLVTITISQLGALIVVLSSRDAKSFSNTGDLVVGSAVQLSGFFMCLLGAARITHRAQRIVSIASQWHMSLESSSTHNCKSSSASDAVDASSHVSGSSTAAVSQLAEPSAPCSYSSRQALVTYLRHNGGGITLFGFTLDRGLLHTIFVFEMTLVLWILSKVVVF

SEQ ID NO: 4519 - DNA, 1167 bp, Zea mays
  misc_feature (1)..(1167): Ceres cDNA ID no. 21995773
  misc_feature (1)..(1167): Ceres CLONE  ID no. 229062
  misc_feature (1)..(1167): Also known as  Ceres CDNA ID no. 24395825
gctttgccttgcttgcccccacacgccctctctctcctctctctctctcaaaccgaaaagaaaagaggaaagtgggatagctcaatctcttcttccttcgtcattcctctcccgtaggttctctctccctccctccctccctccctcagcacacataaactcgagatacatatatatcagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgagcagcacctgctgcaggaacaaacacttaacaacaatgctcgtcctccggagaagaggcagcgggttccgtcggcgtataacagattcatcaaggaagagatacgcaggatcaaagcgaacaaccccgacattaaccacagggaagccttcagcacggcagccaagaattgggcacattatccaaacatccatttcggtttagacgactccgggcgagagggcaagaagaagctcgtggatcatgaggcggcggcgtctgtcgtcgcagtcgcagcagcaccgactgctgctaaaaagatccagggtttctactgatggtagcagatagatgtgtagattgattgatacatcatcgaccgggtggaagaattgataccacaaaaactgctttatatatatgtactgtgagtaaacagttaaaattaaacttgtgagatgtaccgtacaaaaaaaaaaaaaaaaaaaaaaaaaaaaaa

SEQ ID NO: 4520 - protein, 215 aa, Zea mays
  misc_feature: PFam Name: YABBY; PFam Description: YABBY protein
  misc_feature: GI Number: 55771074; NR Description: YABBY5 like protein
  misc_feature: GI Number: 57157494; NR Description: filamentous flower like
  misc_feature: GI Number: 32330681; NR Description: yabby10 protein [Zea mays]
  misc_feature: GI Number: 32330675; NR Description: yabby14 protein [Zea mays]
  misc_feature: GI Number: 55771078; NR Description: filamentous flower like
MSSAQIAPADHVCYVHCSFCNTVLAVSVPGNSMLNIVTVRCGHCANLLSVNLRALTHSLPEQDHQLQENIKVHGINGTLHDDHQCGHLDQLGSSSSSRFRRLPVMCSPQNEQHLLQEQTLNNNARPPEKRQRVPSAYNRFIKEEIRRIKANNPDINHREAFSTAAKNWAHYPNIHFGLDDSGREGKKKLVDHEAAASVVAVAAAPTAAKKIQGFY

SEQ ID NO: 4521 - DNA, 684 bp, Zea mays
  misc_feature (1)..(684): Ceres cDNA ID no. 21995774
  misc_feature (1)..(684): Ceres CLONE  ID no. 278694
  misc_feature (1)..(684): Also known as  Ceres CDNA ID no. 24373591
gcgccgtcccgtgctccctccgctagttctcccaattccttccccacctcctcggtcgtcgcctcccccagagagcaggagccgcctcgtccctgccggtcccgacccccatcccgtccgcgtccaacgccatgaatcccgagtacgggctcgggttcaggaggtacgacgacgccagcagcggcagcggcaggctgaggtgctttgggcactccgggatgggcggctcgaccgggttctgcgacgtggagaacggcttcgccatcgcggtgacggtgaacaagctgtctctgggcagcgtcacgcgcggcgtcgtccggctcgtcctcgaggagctgggcctgcccgtgccggacgagtactcggccaccggggagaaggggcctgacatgatgctcaacctgacgacaacgacgacgactacgccgccgcaactgagatgacggcgaaactgagattaccaggttgggttcgtaataatctgtggaacaagatatatagcgagcagaaggaaggtggggtacagggatttggtggacagtatatatacgcgtgccattttgattttgacgtggcatgtaaaactcggcaaattctggtatattacgaagctgggtgctgggaatagtggccagcagtacaagaaatggacatgctagtttgttgcaaaaaaaaaaaaaaaaa

SEQ ID NO: 4522 - protein, 103 aa, Zea mays
  misc_feature: PFam Name: Beta-lactamase; PFam Description: Beta-lactamase
MNPEYGLGFRRYDDASSGSGRLRCFGHSGMGGSTGFCDVENGFAIAVTVNKLSLGSVTRGVVRLVLEELGLPVPDEYSATGEKGPDMMLNLTTTTTTTPPQLR

SEQ ID NO: 4523 - DNA, 1425 bp, Zea mays
  misc_feature (1)..(1425): Ceres cDNA ID no. 21995775
  misc_feature (1)..(1425): Ceres CLONE  ID no. 294719
  misc_feature (1)..(1425): Also known as  Ceres CDNA ID no. 23766580
actcacacagtctctctgctccacgctcgccgctttttcgctccacccctcctctctttctccctccctctctttctctctcctgccccaaccaaccaatggaggctctcgcgggcgccgcatcctcctccgttctccccgcgcgccacccgccctcccgcgtggccgcgcagtccctcgcgctccgccctagccgctgcggtcccctccgcgcggttggcgccggcggtgtcagtggcaaggacgacgcccaggccgcccacgccgccaacgggtctcccgtcctcaagctgaatagcgattccagtctaaatggagtcctaccgattgcagctgacaagtcacagaaggcttcatcaactaacgttagtactgactctagtggatctagagctggcctgtttagaacacccatatcaggtggtgtgcagagtgcaactttcgcccacggtctacccccgccggctttggctgttcgcaatttgatggaacaggcgcggtttgcccacctgtgctctgtcatgtctggcatgcaccaccgccgtactggatatccgtttggttcacttgtcgactttgctaacgattcaatgggccacccaattttttcgctgtcacccttggcaatccatacgaggaacttactcgctgacccaagatgcacgcttgttgtccaggtgcctggatggagtggactgtcgaacgcgcgagtcaccatatttggtgatgtttaccctttgccagctgaacaacaggaatgggcacataagcaatatgtagcaaaacatcagcagtgggcatcacagcagtggggaaacttttactattacaggatgcacaacataagtgacatatatttcatcgggggcttcggaactgtcgcatggatagatgttaaggagtatgaaacgattcaacctgacaagatagcagttgatggtggtgacttgcaaagtttaaaggagttgaacgctattttctctaaaccacttcgggaggtcctatcatcagaaggggaggttgatgatgctgcgcttatatcagtagatagcaaagggatagatatacgggttcgacagggtgcacagttcaatattcagaggctagcatttgatgtccctcataaggttgagactctggaggaagccaagaaagcactccacaagataatcaaagacaagcagcaaataaagtgaagttgcaggagctggctctacccatttttctggtggtgtaaggtttcattgcaaccggaccaaggattacgtaatggtagcaggtagcatgatacaagtgaaaacgatggctgtttttttttaaaataatgagagtctcgctctccagctgtggtgaagattgtatatatgctcgtgttgccatattaataattattattgtgcggttgcttcaaaaaaaaaaaaaaaa

SEQ ID NO: 4524 - protein, 365 aa, Zea mays
  misc_feature: PFam Name: Pyridox_oxidase; PFam Description: Pyridoxamine
  misc_feature: GI Number: 51979000; NR Description: PREDICTED OJ1699_E05.22-1 gene product [Oryza sativa (japonica cultivar-group)] >gi|51963494|ref|XP_506422.1| PREDICTED OJ1699_E05.22-1 gene product [Oryza sativa (japonica
  misc_feature: GI Number: 46310951; NR Description: COG0748: Putative heme
  misc_feature: GI Number: 48784174; NR Description: COG0748: Putative heme
  misc_feature: GI Number: 7381225; NR Description: root border cell-specific
  misc_feature: GI Number: 46322727; NR Description: COG0748: Putative heme
MEALAGAASSSVLPARHPPSRVAAQSLALRPSRCGPLRAVGAGGVSGKDDAQAAHAANGSPVLKLNSDSSLNGVLPIAADKSQKASSTNVSTDSSGSRAGLFRTPISGGVQSATFAHGLPPPALAVRNLMEQARFAHLCSVMSGMHHRRTGYPFGSLVDFANDSMGHPIFSLSPLAIHTRNLLADPRCTLVVQVPGWSGLSNARVTIFGDVYPLPAEQQEWAHKQYVAKHQQWASQQWGNFYYYRMHNISDIYFIGGFGTVAWIDVKEYETIQPDKIAVDGGDLQSLKELNAIFSKPLREVLSSEGEVDDAALISVDSKGIDIRVRQGAQFNIQRLAFDVPHKVETLEEAKKALHKIIKDKQQIK

SEQ ID NO: 4525 - DNA, 1193 bp, Zea mays
  misc_feature (1)..(1193): Ceres cDNA ID no. 21995777
  misc_feature (1)..(1193): Ceres CLONE  ID no. 313474
  misc_feature (1)..(1193): Also known as  Ceres CDNA ID no. 25088197
gtttcgctctcagttggcggttagctagcttgcatactagcatcaggtgccccttgccgagccgtacgtgtgtcgtcgtcgacgacgatggtggcggcgcccagcaagtgccggccgtcggcggcagcgctggtggtggcaccgccgggggcccctcggcgccggctgcggtgccggtgctgcgaggacacgctgggcgtcccgcgccgccggctgcagccgcagctgcacctgaagcagcaggcacctgcggcgacgaccgcccccgccgcggcgccgccgccgaggccccggcggatcgtgctggtgcggcacggcgagagcgagggcaacgtggacgaggctgcatacacgcgcgtcccggaccccaggatcgggctcaccgccaagggctggcgcgaggccgacgactgcggccgccgcctgcgcgacctcttctcctctggatcccgcgaccaggacgactggaaggtctacttctacgcgtcgccgtaccgccgcagcctggagaccctgcgcggcatcggccacgccttcgagccccaccgcatcgccggcgtccgcgaggagccccgcctccgcgagcaggacttcggcaacttccaggaccgggagcagatgcgggtggagaaggagatccggcaacgctacggccgcttcttctaccgcttccccaacggcgagtcggcggcggacgtgtacgaccgcatcaccggcttccgggagaccctgctctccgacatcgtcctcggccgcttccagcccccgggccaccgcagcaccagcggagacatgaacatcgtgctcgtctcccacggcctcaccctccgcgtcttcctcatgcgctggtacaagtggaccgtccgccagttcgagggcctcgagaacctcgccaacggcggcgagctcgtcatgcagactggagaaggcggcaggtacagcctcctagtgcaccacacgcccgacgagctcagggcgttcggcctcaccgacgagatgctgcaggaccagatgtggcagaagacggccaggcccggcgagctcaaccaccgcttcatgacaaacggacagtccttctttgatccatttactgtaatctactagttcttgacgaccgaccacatgttatgtatgtgataagtgattaaatgtttttttttatggctgtaaaaaaaaaaaaaaaaaaaaaaaaa

SEQ ID NO: 4526 - protein, 338 aa, Zea mays
  misc_feature: PFam Name: PGAM; PFam Description: Phosphoglycerate mutase family
  misc_feature: PFam Name: Prog_receptor; PFam Description: Progesterone receptor
  misc_feature: PFam Name: SerH; PFam Description: Cell surface
  misc_feature: PFam Name: Drf_FH1; PFam Description: Formin Homology Region 1
  misc_feature: PFam Name: Mucin; PFam Description: Mucin-like glycoprotein
  misc_feature: GI Number: 34897810; NR Description: P0514G12.25 [Oryza sativa (japonica cultivar-group)] >gi|6069661|dbj|BAA85437.1| P0514G12.25 [Oryza sativa (japonica cultivar-group)] >gi|25553532|dbj|BAC24808.1| OSJNBa0004I20.3 [Oryza sativa
  misc_feature: GI Number: 29469213; NR Description: unknown [Streptomyces
  misc_feature: GI Number: 11359723; NR Description: proteophosphoglycan, membrane-associated [imported] - Leishmania major (fragment)
  misc_feature: GI Number: 13592175; NR Description: ppg3 [Leishmania major]
  misc_feature: GI Number: 5420387; NR Description: proteophosphoglycan
MVAAPSKCRPSAAALVVAPPGAPRRRLRCRCCEDTLGVPRRRLQPQLHLKQQAPAATTAPAAAPPPRPRRIVLVRHGESEGNVDEAAYTRVPDPRIGLTAKGWREADDCGRRLRDLFSSGSRDQDDWKVYFYASPYRRSLETLRGIGHAFEPHRIAGVREEPRLREQDFGNFQDREQMRVEKEIRQRYGRFFYRFPNGESAADVYDRITGFRETLLSDIVLGRFQPPGHRSTSGDMNIVLVSHGLTLRVFLMRWYKWTVRQFEGLENLANGGELVMQTGEGGRYSLLVHHTPDELRAFGLTDEMLQDQMWQKTARPGELNHRFMTNGQSFFDPFTVIY

SEQ ID NO: 4527 - DNA, 1326 bp, Zea mays
  misc_feature (1)..(1326): Ceres cDNA ID no. 21995778
  misc_feature (1)..(1326): Ceres CLONE  ID no. 313604
  misc_feature (1)..(1326): Also known as  Ceres CDNA ID no. 23839240
atttcatttcgttcggcgtccccacacggccacaccggaaaaaagaccccggcaagaacctcgctctccggcgtctccggccaatacccatggaggccaccgcagtgccgagggctctgttcctattcgggacatcgccggcgccgtatcgtatgcgtatgaactgcttgcgcgtagctattggaggaaatgtgaggcggcagggggccgtggcagtgtgggcgaagaagaagagggggagggggcgggatagcgagacggaggaacgggtggacacgcacagcttcacccccaagccgggcgaggctgccgggctgttccccgaggccgtcctgcttagaaagaaaatggtgagagaggatggtcaagtgtcaccagaatttgctgatgcagacgaagaaaagctgtatgattttcttaatattgagctagaaagtgatttaaatctgaaaagaatgcggcactatgaagtagtttatctaattcatgaggaccgtgttgaagaagttgaaaatgttgtatcaaaagtacaagattttatcagggagaagaaaggaaggatatggaggcttaacaattgggggctgcgcaggcttgcttacaaaataaagaaagcaacacatgccaattacattttaatgaactttgagatagagtcaagatacatcaatgacttcaagaccctgctagacaaggatgagaggatcatcagacatctggttatgaaacgggatgagacaattactgaagattgccctcccccaccagtatttcacactctgcgagctcaacaatattttgatgatgaatatgaagatgagggggaagaggaagaggatgaggatgctaggagtgagccaaagtctgccaattatgatgaggatgatgttgaagctgatgatgagcctgaaattatttatgtcgatgaagctgatgaggataattacgaagacactagaagaaggaacacaaagctaaaggtgaagaagtatacatcagagaaggtattgaggcagcattagtgtatggttttccacttagtttaagtctttttagctcttatagaaaggactatctgtgtctgtatgatgaggaagtttcacttaggtgtttttttctgatgccaaggaccactgcatgataatgagataggtatatgtgctatggttggtacagcccttgtaaatgctttctttagtgcacctttgtttttgtgcaactttattttccaaggaaaccaaaagcttaaatactatattattagtttgaatacagccttctcggactgcaaataaggtatgagtaaaaaaaaaaaaaaaaaaaaaa

SEQ ID NO: 4528 - protein, 310 aa, Zea mays
  misc_feature: PFam Name: Ribosomal_S6; PFam Description: Ribosomal protein S6
  misc_feature: GI Number: 21553777; NR Description: unknown [Arabidopsis thaliana]
  misc_feature: GI Number: 29654191; NR Description: ribosomal protein S6 [Coxiella burnetii RSA 493] >gi|29541457|gb|AAO90397.1| ribosomal
  misc_feature: GI Number: 15677189; NR Description: 30S ribosomal protein S6 [Neisseria meningitidis MC58] >gi|13959510|sp|Q9JZ29|RS6_NEIMB 30S ribosomal protein S6 >gi|11276542|pir||B81097 30S ribosomal protein S6 NMB1323 [imported] - Neisseria meningitidis (strain
  misc_feature: GI Number: 15600128; NR Description: 30S ribosomal protein S6 [Pseudomonas aeruginosa PA01] >gi|9951214|gb|AAG08320.1| 30S ribosomal protein S6 [Pseudomonas aeruginosa PAO1] >gi|13959534|sp|Q9HUM9|RS6_PSEAE 30S ribosomal protein S6
  misc_feature: GI Number: 49076654; NR Description: PA4935 [synthetic construct]
MEATAVPRALFLFGTSPAPYRMRMNCLRVAIGGNVRRQGAVAVWAKKKRGRGRDSETEERVDTHSFTPKPGEAAGLFPEAVLLRKKMVREDGQVSPEFADADEEKLYDFLNIELESDLNLKRMRHYEVVYLIHEDRVEEVENVVSKVQDFIREKKGRIWRLNNWGLRRLAYKIKKATHANYILMNFEIESRYINDFKTLLDKDERIIRHLVMKRDETITEDCPPPPVFHTLRAQQYFDDEYEDEGEEEEDEDARSEPKSANYDEDDVEADDEPEIIYVDEADEDNYEDTRRRNTKLKVKKYTSEKVLRQH

SEQ ID NO: 4529 - DNA, 1607 bp, Zea mays
  misc_feature (1)..(1607): Ceres cDNA ID no. 21995779
  misc_feature (1)..(1607): Ceres CLONE  ID no. 330406
  misc_feature (1)..(1607): Also known as  Ceres CDNA ID no. 23763860
actcgctctcgctaatccacatccaccctcgagtgctcgctcactcgaacagtggcggcgagatgcggagacagatccctcccgtctcctgcctcgtacccatcgcggtggcgttcgcgctgctcgctgcggcatctgcagcttcgccggcgccggtcaacgtcacggccgtgctctcggcgttcccggacctcaacgacttcacgcggctgctggcgtccagccccgtgctggcggagctcgcagggcggtcgtcgctgacgcttctcgccgtgccgaacggcaacctcccgcagtcgccgtcggcgttcgcggccgcgtcgggcgccgacctcgccgacgttctccgctaccacgtcctcctggagtacctcgcccccgccgacctccgccgcttgcccgcctccgggaagctcgtgaccacgctgttccagaccaccggccgcgcccccgcggacctcggcgccgtgaacgtcaccgcagcgggcgcctccctcgccgtggtccgctcgccggcaccgttcccgggctcgaacgccaccgtcctcggcgccattaccgcggtgccgtacaacctgagcgtgctggcggtgaacggcctcatcgtcccgtccgggttcgacctcgcggcgtccgagtcccgcccgcccgcggccgtcaacatcacccgcgtcctcgccgacgcgcgcgccttcaacgtggcggcgtccatgctcgaggcctcgggcgtcgcggccgagttcgaggacgacgagcgcggggcggggattacggtgttcgcccccaccgacgacgccttcgcgggcctcccggcgggcgaccgcctccagtccctccccgccgaccgcaaggccgtggtgctccgcttccacgtgctccactcctactacccgctgggatcgctcgagtcgatcgtgaaccccgtccagcccacactggccaccgagttcagcaatgccggccgcttcaccctcaatatcacccgcgccaacggttcggtcgccatcgacaccggcgtcgtgcaggcgaccatcacgcggaccgtcttcgaccagaatcccgtcgccgtgttcgccgtctccaaggtcctcctgcccaaggagatgttcacccgcacaggcggcggcggcgacgacgactcctccatcgtggtcgccgccgccgccgcgtcctccccccccgccagccgcaacagccccggaggcctccgagagcgcgcagacgccgccgacaaagctctcctccccgcctgcactccgcggcggcgagcacgactacgacacggcgtcggcgcaagggatcggaatcggatggtggtgtatagcattggtgtatctacttccacatctcgtgtgagatccgggactcggtcagcccattgtcattccgcttgtgctcaatttttgccttttctttttgttttctcttgtcttttctttacttgtttgggttggctatgtacactgggaggtgagggaggtgaagtagaagattgagctgcgaaaacaaaggaaatgcagcaacctgtttttagtaagaagaaacaagattggttattggccatcatcagatggggaataacagtacagcctaaaaaaaaaaaaaaa

SEQ ID NO: 4530 - protein, 1607 aa, Zea mays
  misc_feature: PFam Name: Fasciclin; PFam Description: Fasciclin domain
  misc_feature: PFam Name: Cation_efflux; PFam Description: Cation efflux family
  misc_feature: GI Number: 34908162; NR Description: P0408C03.24 [Oryza sativa (japonica cultivar-group)] >gi|21104633|dbj|BAB93225.1|
  misc_feature: GI Number: 56784671; NR Description: endosperm specific
  misc_feature: GI Number: 51536400; NR Description: endosperm specific
  misc_feature: GI Number: 50912323; NR Description: putative fasciclin-like arabinogalactan-protein [Oryza sativa (japonica cultivar-group)] gi|51964328|ref|XP_506949.1| PREDICTED OJ1124_G07.29 gene product
  misc_feature: GI Number: 34902266; NR Description: Putative endosperm specific protein [Oryza sativa (japonica cultivar-group)] >gi|20330756|gb|AAM19119.1| Putative endosperm specific protein
ACTCGCTCTCGCTAATCCACATCCACCCTCGAGTGCTCGCTCACTCGAACAGTGGCGGCGAGATGCGGAGACAGATCCCTCCCGTCTCCTGCCTCGTACCCATCGCGGTGGCGTTCGCGCTGCTCGCTGCGGCATCTGCAGCTTCGCCGGCGCCGGTCAACGTCACGGCCGTGCTCTCGGCGTTCCCGGACCTCAACGACTTCACGCGGCTGCTGGCGTCCAGCCCCGTGCTGGCGGAGCTCGCAGGGCGGTCGTCGCTGACGCTTCTCGCCGTGCCGAACGGCAACCTCCCGCAGTCGCCGTCGGCGTTCGCGGCCGCGTCGGGCGCCGACCTCGCCGACGTTCTCCGCTACCACGTCCTCCTGGAGTACCTCGCCCCCGCCGACCTCCGCCGCTTGCCCGCCTCCGGGAAGCTCGTGACCACGCTGTTCCAGACCACCGGCCGCGCCCCCGCGGACCTCGGCGCCGTGAACGTCACCGCAGCGGGCGCCTCCCTCGCCGTGGTCCGCTCGCCGGCACCGTTCCCGGGCTCGAACGCCACCGTCCTCGGCGCCATTACCGCGGTGCCGTACAACCTGAGCGTGCTGGCGGTGAACGGCCTCATCGTCCCGTCCGGGTTCGACCTCGCGGCGTCCGAGTCCCGCCCGCCCGCGGCCGTCAACATCACCCGCGTCCTCGCCGACGCGCGCGCCTTCAACGTGGCGGCGTCCATGCTCGAGGCCTCGGGCGTCGCGGCCGAGTTCGAGGACGACGAGCGCGGGGCGGGGATTACGGTGTTCGCCCCCACCGACGACGCCTTCGCGGGCCTCCCGGCGGGCGACCGCCTCCAGTCCCTCCCCGCCGACCGCAAGGCCGTGGTGCTCCGCTTCCACGTGCTCCACTCCTACTACCCGCTGGGATCGCTCGAGTCGATCGTGAACCCCGTCCAGCCCACACTGGCCACCGAGTTCAGCAATGCCGGCCGCTTCACCCTCAATATCACCCGCGCCAACGGTTCGGTCGCCATCGACACCGGCGTCGTGCAGGCGACCATCACGCGGACCGTCTTCGACCAGAATCCCGTCGCCGTGTTCGCCGTCTCCAAGGTCCTCCTGCCCAAGGAGATGTTCACCCGCACAGGCGGCGGCGGCGACGACGACTCCTCCATCGTGGTCGCCGCCGCCGCCGCGTCCTCCCCCCCCGCCAGCCGCAACAGCCCCGGAGGCCTCCGAGAGCGCGCAGACGCCGCCGACAAAGCTCTCCTCCCCGCCTGCACTCCGCGGCGGCGAGCACGACTACGACACGGCGTCGGCGCAAGGGATCGGAATCGGATGGTGGTGTATAGCATTGGTGTATCTACTTCCACATCTCGTGTGAGATCCGGGACTCGGTCAGCCCATTGTCATTCCGCTTGTGCTCAATTTTTGCCTTTTCTTTTTGTTTTCTCTTGTCTTTTCTTTACTTGTTTGGGTTGGCTATGTACACTGGGAGGTGAGGGAGGTGAAGTAGAAGATTGAGCTGCGAAAACAAAGGAAATGCAGCAACCTGTTTTTAGTAAGAAGAAACAAGATTGGTTATTGGCCATCATCAGATGGGGAATAACAGTACAGCCTAAAAAAAAAAAAAAA

SEQ ID NO: 4531 - DNA, 1114 bp, Zea mays
  misc_feature (1)..(1114): Ceres cDNA ID no. 21995780
  misc_feature (1)..(1114): Ceres CLONE  ID no. 346115
  misc_feature (1)..(1114): Also known as  Ceres CDNA ID no. 24396400
aaccgccgccgaggagcagcgctgcgtctcaagagctccccggcgagatcgtccatcaccatcaaaaaggccgcaccacactgatcacaagcatcaaacttcctaaagcgctctggtcgcagcctcgcagtggccgcagctgcagcgtcccctcccctttcgccatcgagcatcacctgtgctgaccgccggcgcgtaactgcaccagggtcactgcttacgaggaagaggaggcgcaacgcaacagtgttgttgggttgtctcgtcgtgcggtgccggtgcccatgggcgtgcacgccagggcgatgagctggtacacgagcccgccggggtcgccggcgccggggagcgccgccgaggcgcagcacgcgctgagcagcagcccccggggcggcgacaccagcttcgacaccaacatggtcgtcgtccttgccgcgctgctgttcgcgctcctcttcgcgctgggcatcaactcgctcgcgcgctgcctcatccgctgggcgcgccgcgcgccggcagcggagggcggcggcggcgggttcgagaagcgcgtgctccggagcatgcccgtcgaggtgtacggcgccgcggccgtcaccgtcgccgacgtctgcgccatctgcctcggcgagttcgcggacggcgagaaggtgcgcgtgctgccgcgctgcacccacggcttccatgtccgctgcgtcgacacctggctcctgtcgcacgactcctgccccacgtgccgggcctccgtgctcgacggcgcaaaggccgccactcccgccggtgggggcagccggtggcagggcagcgaggctgctgccatcgccgttgtcattcgatgacgtggacaggaagggcccgcgtgcccattggtggtggagccacacggcaggtatgcaggagcttcgttccgtagtcgggagatatttttctgtgagagaccgaccagtgggcccagaccctttgtagcttcctcggtcgcaggcaagtcaaggttgcagctggccatgttggttgccaccatggaccgtccactgtcctgtggcaggcatgtcgaaaccgatatgattccatcaatcatgtggtctgatcttgacacaaaaaaaaaaaaaaaaaa

SEQ ID NO: 4532 - protein, 184 aa, Zea mays
  misc_feature: PFam Name: zf-C3HC4; PFam Description: Zinc finger, C3HC4
  misc_feature: GI Number: 34907826; NR Description: P0485B12.26 [Oryza sativa (japonica cultivar-group)] >gi|19571069|dbj|BAB86495.1|
  misc_feature: GI Number: 10176740; NR Description: RING zinc finger protein-like [Arabidopsis thaliana] >gi|15239062|ref|NP_196147.1| zinc finger (C3HC4-type RING finger) family protein [Arabidopsis
  misc_feature: GI Number: 6630539; NR Description: putative RING zinc finger protein [Arabidopsis thaliana] >gi|28466857|gb|AAO44037.1| At3g10910 [Arabidopsis thaliana] >gi|15228395|ref|NP_187702.1| zinc finger (C3HC4-type RING finger) family protein [Arabidopsis
  misc_feature: GI Number: 50252215; NR Description: putative RING-H2 zinc finger protein [Oryza sativa (japonica cultivar-group)] >gi|50251291|dbj|BAD28071.1| putative RING-H2 zinc finger protein
  misc_feature: GI Number: 52076527; NR Description: RING zinc finger
MGVHARAMSWYTSPPGSPAPGSAAEAQHALSSSPRGGDTSFDTNMVVVLAALLFALLFALGINSLARCLIRWARRAPAAEGGGGGFEKRVLRSMPVEVYGAAAVTVADVCAICLGEFADGEKVRVLPRCTHGFHVRCVDTWLLSHDSCPTCRASVLDGAKAATPAGGGSRWQGSEAAAIAVVIR

SEQ ID NO: 4533 - DNA, 1241 bp, Zea mays
  misc_feature (1)..(1241): Ceres cDNA ID no. 21995781
  misc_feature (1)..(1241): Ceres CLONE  ID no. 361837
  misc_feature (1)..(1241): Also known as  Ceres CDNA ID no. 24373564
atctctctctctcgctcgctctcagccttccttccctggcggcaacgcctgggcggacgagcgccgtcgccctgccagttcttcgtcggtcccttcgcctgtgattggcgccgcgtcttctttggatttcggccctttcgcgctggggactagcgcccaccaggagcaagattgaagccttgaagggctatatagggttgggcacggttgacctgatcgactgaaactgaaatggcattggtggtgaagcggtaccgatgtacgcactccgtgagctgtgcttgcctcaagggccatgtcagggaggatgcaatgtatctcgtgtttaaacacatgaactggaacccgaagatgattgctatcttatcaagtgtatgtaagtggttcgatgaatttgccaagagggtgctctggaaggaattctgccatgccagggcaccaaagatgatgaaggatttgcactctgacggaagtcatatcgttgatggcaactggaaggccctagggaagcttcttatctattgcgcagggtgccctagtggagacctgttcagtaatatccatgacccagtcccggggcactttgtctacagaacccgtttttctaggacattggggaagagcttactggcgccacagtgcaggtctgatgcgttgtatgtctcagagtcctgtgaacatcttgaccagggcgaggaaggtgacttgggcctcttccggggtatcttcaagtcgtttgctgcgtcgaagatgaagaaaatgttgattgagaggcaggcaaacttccatttgaataagatgtgtccttattgtaagacaaagctatgggacttgatgcaaccaaatatgataccaagtagtgccgccgtgagattgggtgcggaagatggttctgttgagtactatgtatgccttaatgggcacatccttggttcatgcactctgatacccatctctgattctgagggcacaaaggaagagtgatcaagacttgatttaggttgctgtgtgaaatcccgtgcttgttgactagggcgtgagcagcgataaggacgagccctgtcgccgccgttgtacttaactgtaattgtagtgccagtgttcttctagctgcctttctttgagggtgtgggttgacggattctcgtagttgcttgtagcagtagaaaaagaagaggttgctgtatcgtggctgccttttatttatgaatacctcattacaggtaaaaaaaaaaaaaaaa

SEQ ID NO: 4534 - protein, 250 aa, Zea mays
  misc_feature: GI Number: 14210079; NR Description: circadian clock coupling
  misc_feature: GI Number: 34908976; NR Description: putative circadian clock coupling factor ZGT [Oryza sativa (japonica cultivar-group)] >gi|19571004|dbj|BAB86431.1| putative circadian clock coupling
  misc_feature: GI Number: 52353476; NR Description: putative circadian clock
  misc_feature: GI Number: 21553661; NR Description: unknown [Arabidopsis thaliana]
MALVVKRYRCTHSVSCACLKGHVREDAMYLVFKHMNWNPKMIAILSSVCKWFDEFAKRVLWKEFCHARAPKMMKDLHSDGSHIVDGNWKALGKLLIYCAGCPSGDLFSNIHDPVPGHFVYRTRFSRTLGKSLLAPQCRSDALYVSESCEHLDQGEEGDLGLFRGIFKSFAASKMKKMLIERQANFHLNKMCPYCKTKLWDLMQPNMIPSSAAVRLGAEDGSVEYYVCLNGHILGSCTLIPISDSEGTKEE

SEQ ID NO: 4535 - DNA, 553 bp, Zea mays
  misc_feature (1)..(553): Ceres cDNA ID no. 21995782
  misc_feature (1)..(553): Ceres CLONE  ID no. 368705
  misc_feature (1)..(553): Also known as  Ceres CDNA ID no. 24396205
aacttgttcttccgctgcaagacagcagtcccgagctgtatgcctaggggagccgcgagggggcggagatgccgacgctgacgaagctgtacagcatggaggaggctgccctccacaacacgcccgacgactgctgggtcatcgtcgacggcaagatttatgatgtgaccaagtatttggaagaccatcctgggggtccgatgttctgctcgaagcaaccggtaaggatgctacgagcagcacttcggcctcttccagccggacatgagcgaggtctaccacgtcgacttcacggcgggatccccctagggaggctcacccgcttctgtgtttactttatttatgtagtaggaatgatcattcttcattcagagactgatcgacttcatcggagctgctcgatactcgagcggcgcggataggcttactgcgtactggtagtattgttggagacttggagtagcattactatcgacgtgattcattacagtgcatgtcgttacacggcgccatggatttatcttctctgttcagcataaaaaaaaaaaaaaaa

SEQ ID NO: 4536 - protein, 117 aa, Zea mays
  misc_feature: PFam Name: Cyt-b5; PFam Description: Cytochrome b5-like
  misc_feature: GI Number: 30090027; NR Description: cytochrome b5 [Sorghum
  misc_feature: GI Number: 30090033; NR Description: cytochrome B5 [Triticum
  misc_feature: GI Number: 12083238; NR Description: putative cytochrome b5 protein [Arabidopsis thaliana] >gi|26450007|dbj|BAC42124.1| putative cytochrome b5 [Arabidopsis thaliana] >gi|21536989|gb|AAM61330.1| cytochrome b5 [Arabidopsis from this
  misc_feature: GI Number: 52353573; NR Description: cytochrome b5 [Oryza sativa (japonica cultivar-group)] >gi|14719320|gb|AAK73138.1|
  misc_feature: GI Number: 414705; NR Description: cytochrome b5 [Oryza sativa] >gi|1345881|sp|P49100|CYB5_ORYSA Cytochrome b5
MPTLTKLYSMEEAALHNTPDDCWVIVDGKIYDVTKYLEDHPGGPMFCSKQPVRMLRAALRPLPAGHERGLPRRLHGGIPLGRLTRFCVYFIYVVGMIILHSETDRLHRSCSILERRG

SEQ ID NO: 4537 - DNA, 603 bp, Zea mays
  misc_feature (1)..(603): Ceres cDNA ID no. 21995785
  misc_feature (1)..(603): Ceres CLONE  ID no. 385082
  misc_feature (1)..(603): Also known as  Ceres CDNA ID no. 23803206
aaccgagacaccgcgtgcgaaccaagcagaccacagcaagaagcgtagtcgtcgccggaaggaaaggcgcggagcaagatgtcgtggcaggcgtacgtcgatgagcacctgatgtgcgagatcgaaggacaacatctcagcgccgccgccatcgtcggtcacgacggcagcgcttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaccagttggtgcaagagtaccaggttcgtgaatgtccgttctgtacgcgtcttgtctcgtgtgtgttgtcgtttgcagcgaatttgcaagtaataataataaaaagagtatgtcgtcgtggaaaactgtaatatgagatagaaaatttgacggtctgtaggaaataggactggcttctgaacagtatcgacctcgaatccatgatcatggatgcactatcacttctcaataaacgctcttcataaaaaaaaaaaaaaaaaaaaaaaa

SEQ ID NO: 4538 - protein, 116 aa, Zea mays
  misc_feature: PFam Name: FH2; PFam Description: Formin Homology 2 Domain
  misc_feature: GI Number: 50938941; NR Description: putative diaphanous homologue [Oryza sativa (japonica cultivar-group)] >gi|27817931|dbj|BAC55695.1| putative diaphanous homologue [Oryza
  misc_feature: GI Number: 42569297; NR Description: formin homology 2 domain-containing protein / FH2 domain-containing protein
  misc_feature: GI Number: 50943435; NR Description: putative diaphanous 1 [Oryza sativa (japonica cultivar-group)] >gi|37805990|dbj|BAC99403.1| putative diaphanous 1 [Oryza sativa
  misc_feature: GI Number: 50915568; NR Description: diaphanous homologue-like [Oryza sativa (japonica cultivar-group)] >gi|47497221|dbj|BAD19266.1| diaphanous homologue-like [Oryza
  misc_feature: GI Number: 42565351; NR Description: formin homology 2 domain-containing protein / FH2 domain-containing protein
MSWQAYVDEHLMCEIEGQHLSAAAIVGHDGSAWAQSESFPELKPEEVAGIIKDFDEPGTLAPTGLFVGGTKYMVIQGEPGVVIRGKTSWCKSTRFVNVRSVRVLSRVCCRLQRICK

SEQ ID NO: 4539 - DNA, 787 bp, Zea mays
  misc_feature (1)..(787): Ceres cDNA ID no. 21995787
  misc_feature (1)..(787): Ceres CLONE  ID no. 390531
  misc_feature (1)..(787): Also known as  Ceres CDNA ID no. 24372286
aactcgcagtcgcagcgaccgtccgctcgcttccgcctttcgtttgccccgccgcctctatcctttcctcgactcccccgcacccaccacctgttcttcgacccagcaccggagcccccagtccacccacccaatggcgaccgccaccgcggccgtagcgccgccgtccacctccacctccacggtcctcctgcgccgccgcctcccttccccggcgcccgcgtccgccgccttcccccggctccccggcccgcccccgccgcgcctccccctcctccaggtcgcgctcaccagcgaggtggcctcggacgacgtggcggccgaggaggccgcggccgcgcccaagatcggcaggcgggtgcgcgtcacggcgccgatccgcgtccaccacgtcatcaaggcgcccgacctggacgtccagggcatggagggcgtcgtcaagcagtacgtcggcgtgtggaagggcaagcgcgtcaccgccaacctgcccttcaaggtcgaggtccagctcgccgtcgagggccagcccaagcccgtccggttcttcgtccacctccgtgaggacgagttcgagttcgtcgatgaggagtgatgtgacgggcgtcagtcagagcgcgtccgagttagccgttcttatagattatagaataatcattgttccggcggggtagtaagcttgggagtggcaaatgtttcagctgttgggaattgttcggatgttgacgatcatcagtagttataatagtgatcattttgccgctgtttgtcgacaaaaaaaaaaaaaaaa

SEQ ID NO: 4540 - protein, 152 aa, Zea mays
  misc_feature: PFam Name: FeThRed_A; PFam Description: Ferredoxin
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: Vitellogenin_N; PFam Description: Lipoprotein
  misc_feature: GI Number: 50911048; NR Description: putative ferredoxin-thioredoxin reductase [Oryza sativa (japonica cultivar-group)] >gi|49388220|dbj|BAD25340.1| putative ferredoxin-thioredoxin reductase [Oryza sativa (japonica
  misc_feature: GI Number: 1362192; NR Description: ferredoxin-thioredoxin
  misc_feature: GI Number: 2498397; NR Description: FERREDOXIN-THIOREDOXIN REDUCTASE, VARIABLE CHAIN (FTR-V) (FERREDOXIN-THIOREDOXIN REDUCTASE
  misc_feature: GI Number: 21592688; NR Description: unknown [Arabidopsis thaliana] >gi|26449733|dbj|BAC41990.1| putative lipoic acid synthase [Arabidopsis thaliana] >gi|28372908|gb|AAO39936.1| At5g08410 [Arabidopsis thaliana] >gi|18415805|ref|NP_568195.1|
  misc_feature: GI Number: 10178283; NR Description: lipoic acid
MATATAAVAPPSTSTSTVLLRRRLPSPAPASAAFPRLPGPPPPRLPLLQVALTSEVASDDVAAEEAAAAPKIGRRVRVTAPIRVHHVIKAPDLDVQGMEGVVKQYVGVWKGKRVTANLPFKVEVQLAVEGQPKPVRFFVHLREDEFEFVDEE

SEQ ID NO: 4541 - DNA, 1300 bp, Zea mays
  misc_feature (1)..(1300): Ceres cDNA ID no. 21995788
  misc_feature (1)..(1300): Ceres CLONE  ID no. 391454
  misc_feature (1)..(1300): Also known as  Ceres CDNA ID no. 24371682
atcggcatgcagtagcataccagacgatctgcaagctaagcgtagttccagtacagaagccagccatctctgttcattggttgaggaaatggccggacgtaaggcggcgatggtggtggagaagaacaagaaggtggtgctaaggaggcacgtcaccgggttccccacggaagaagacatggagatcacggtggacactatcgagctgggtgtgccagcggggctgacggccgtgctgatcaagaacctctacctgtcctgcgacccctggatgcgcggtcgcatgagcaagcatgaagacggcgccaccgtgccagcctcggactttgtcatcggagaggccatggtgaatttcggtgtgggcaaggtggtcggctcgacgcaccctgagttcaccgccggtgatcttgtctgggggctgagtgggtgggaggagtacaccctcgtcacccagccggaatcgctgcacaagatcaaacacaccgagctgccgctctcctactacacgggagttcttggcatgccagggctcactgcgtacggtgggttcacccatgtcgccaggcccaagaaaggcgacttcgtgtacgtctcggcggcgtcgggcgccgtcggccagatcgtcgggcagctagcaaagatcgccggttgctacgtggtcggcagcgccggctccgacgagaaggtcagcctcctcaagaccaagttcggcttcgacgatgccttcaactacaagtcggagagcgacctcggcgccgcgctgaagcgctgcctccccgatggaatcgatatctacttcgacaacgtgggtggcgcgacgctcgacgccgcgctactgcacatgcgccatggcggcagggtcgccgcctgcgggatgatctcccagtataacctggaggaacgggacggccatggcctacgcaatctgttctacatcatctcaaacgccatcagggtggaggggttcaccgcccttgactggttccacctgtacgcaaggtttgaggaggagatggccaggtacatcaaggaggggaaggtggtggtcgtggaggatgtggctgaggggatcgagagcgcgccggcggctctaatcgggttgttctcggggaaaaatgtaggcaagcagctggttgccattgcgagggcatgaggtgaagcaggaactatcaatgcaaagcgaaatagcagcactaatagtaacagactagtgcattgcgcgcgtgttagaccatttttttacgagcatgttttatttcaaataaagtttacatgaatacgtaaaaaaaaaaaaaaaaaa

SEQ ID NO: 4542 - protein, 354 aa, Zea mays
  misc_feature: PFam Name: ADH_zinc_N; PFam Description: Zinc-binding
  misc_feature: GI Number: 62732671; NR Description: oxidoreductase, zinc-binding dehydrogenase family [Oryza sativa (japonica
  misc_feature: GI Number: 6714428; NR Description: putative NADP-dependent oxidoreductase [Arabidopsis thaliana] >gi|15228456|ref|NP_186958.1|
  misc_feature: GI Number: 20259087; NR Description: putative quinone oxidoreductase [Arabidopsis thaliana] >gi|17529038|gb|AAL38729.1| putative quinone oxidoreductase [Arabidopsis thaliana] >gi|9755700|emb|CAC01712.1| quinone oxidoreductase-like protein
  misc_feature: GI Number: 886428; NR Description: zeta-crystallin homologue [Arabidopsis thaliana] >gi|9755698|emb|CAC01710.1| quinone oxidoreductase-like protein [Arabidopsis thaliana] >gi|2498731|sp|Q39172|P1_ARATH Probable NADP-dependent
  misc_feature: GI Number: 21554121; NR Description: quinone
MAGRKAAMVVEKNKKVVLRRHVTGFPTEEDMEITVDTIELGVPAGLTAVLIKNLYLSCDPWMRGRMSKHEDGATVPASDFVIGEAMVNFGVGKVVGSTHPEFTAGDLVWGLSGWEEYTLVTQPESLHKIKHTELPLSYYTGVLGMPGLTAYGGFTHVARPKKGDFVYVSAASGAVGQIVGQLAKIAGCYVVGSAGSDEKVSLLKTKFGFDDAFNYKSESDLGAALKRCLPDGIDIYFDNVGGATLDAALLHMRHGGRVAACGMISQYNLEERDGHGLRNLFYIISNAIRVEGFTALDWFHLYARFEEEMARYIKEGKVVVVEDVAEGIESAPAALIGLFSGKNVGKQLVAIARA

SEQ ID NO: 4543 - DNA, 1467 bp, Zea mays
  misc_feature (1)..(1467): Ceres cDNA ID no. 21995789
  misc_feature (1)..(1467): Ceres CLONE  ID no. 396775
  misc_feature (1)..(1467): Also known as  Ceres CDNA ID no. 24373577
attctcttctcacgaacgtttacacgccgggtgcgcgcgctctgctctccctccttcccttgcccaactctcactctctcgcccgcgcggcgcggccttgctttctggtggcaccgactggccggctgccaccgtctcctcctcgctggtgcccaggtcttcgtcggtcccttggtgtctgccccttatcctggtctttgtcaggccctcgcctttcgcccgcgacgagcaccacctgcaggaacaaaatgaagtgcaatgcttgctggcgggatttggaagggcaagctgtatcaaccacctgtggtcatcttttatgtgcagatgatgctaggaaaatactcaataatgatggtacatgtccaatttgtgatcaggtgctctcaaaaagccatatgaaacctatggatataaatccaggtgatgattggacaaatatggcaatggttggaatatccccacaaatacttatgaagagtgcatacagaagcgtaatgttctacattggacaaaaggaactggagatgcagtacaagatgaacagaattgttggtcaatgtaggcaaaaatgtgaacttatgcaggcgaaatttactgagaaactggaagaagtacataccgcataccagaagatggcgaaaagatgtcagttgttggagcaagagaatgaaaacttgaacagagataagcacgagctgcaagaaaaatttgctgagaaatccaggcagaagaggaagcttgatgagatgtatgaccaactgaggaatgaatatgagtcggtgaagcgttctgcccttcaacctgcaaataactacttagcaagacctcagccagacttatttgcaggcatgcccaacgtgatggatggtggcgaccatctgagacaagggcagagagatgagggctggggtccaccgccaaggcaacgtcactgcacctctggtccctttgatctgtccaccgggtctcctgcccatgccgtggctcccccggctgatatcaggcccagacagcagacacggtcagtcttcggagctacactgaacaatccatcaagcaccctgcgaaacctcataatctcacctgtcaagcgtccccagacgtcccgtaatcgccaacacatattcacgttgtagagagttggaatagctgacgctgacggggtgctccgcattggaaatcaaatggagatatggttgattatacgcagacttcgtccatttctacagttacatgtacagcaggaagtttcatctatacccctaatcttagccttggtagtatgacaactgtggttaacatttttctaactcatccgcatctgaacagaccaagtaatcctgtgtgctgattgaggacctaaacgagttgtttaagtgcaagtgatttggaactggaattacttggatgttatcctaaataaactccaagtggagtttgcctcctgtctcaaaaaaaaaaaaaaaa

SEQ ID NO: 4544 - protein, 295 aa, Zea mays
  misc_feature: GI Number: 50251774; NR Description: putative bZIP protein
  misc_feature: GI Number: 8671877; NR Description: T3F20.19 [Arabidopsis thaliana] >gi|15220804|ref|NP_175754.1| bZIP protein [Arabidopsis
MKCNACWRDLEGQAVSTTCGHLLCADDARKILNNDGTCPICDQVLSKSHMKPMDINPGDDWTNMAMVGISPQILMKSAYRSVMFYIGQKELEMQYKMNRIVGQCRQKCELMQAKFTEKLEEVHTAYQKMAKRCQLLEQENENLNRDKHELQEKFAEKSRQKRKLDEMYDQLRNEYESVKRSALQPANNYLARPQPDLFAGMPNVMDGGDHLRQGQRDEGWGPPPRQRHCTSGPFDLSTGSPAHAVAPPADIRPRQQTRSVFGATLNNPSSTLRNLIISPVKRPQTSRNRQHIFTL

SEQ ID NO: 4545 - DNA, 505 bp, Zea mays
  misc_feature (1)..(505): Ceres cDNA ID no. 21995791
  misc_feature (1)..(505): Ceres CLONE  ID no. 446288
  misc_feature (1)..(505): Also known as  Ceres CDNA ID no. 24371742
atcaagaaacaaacgaagccagccagccagccgggtcctcccgcgtagctagcgtaggcgtaggcgtagccgtagcagcgtgtgcgagaggggaagaaatgctggaggggagggcgcgggtggaggacacggacatgccggcgcggatgcaggacgcggcgacctccgcggcctcgcgcgcgctcgacctcttcgacgtcgccgactgccgcgccatcgccggccacatcaagacggagttcgacaagcggtacggcgtcgggtggcagtgcgtggtgggcgccaacttcgggtgcttcttcacccacagcagcggcaccttcatctacttctccatggagcgcctctccttcctcctcttcaaggccgccgtcgtcgcagccgccgccgccgctgccgtcgcctcctaatcaaccaagtctccgtccatcacaccgtgcactttgtactgctagctagtatctatatatatctatatatgccatttggaaaaaaaaaaaaaaaa

SEQ ID NO: 4546 - protein, 103 aa, Zea mays
  misc_feature: PFam Name: Dynein_light; PFam Description: Dynein light
  misc_feature: PFam Name: MCPVI; PFam Description: Minor capsid protein VI
  misc_feature: GI Number: 50251496; NR Description: dynein light chain type
  misc_feature: GI Number: 50901996; NR Description: putative dynein light chain [Oryza sativa (japonica cultivar-group)] >gi|14587295|dbj|BAB61206.1| putative dynein light chain [Oryza sativa (japonica cultivar-group)] >gi|20804663|dbj|BAB92351.1|
  misc_feature: GI Number: 60701888; NR Description: unknown [Schistosoma
  misc_feature: GI Number: 45752676; NR Description: At5g20110 [Arabidopsis thaliana] >gi|15241269|ref|NP_197511.1| dynein light chain, putative [Arabidopsis thaliana] >gi|40822853|gb|AAR92244.1|
  misc_feature: GI Number: 2208914; NR Description: outer arm dynein LC6 [Anthocidaris crassispina] >gi|2811014|sp|O02414|DYL1_ANTCR DYNEIN
MLEGRARVEDTDMPARMQDAATSAASRALDLFDVADCRAIAGHIKTEFDKRYGVGWQCVVGANFGCFFTHSSGTFIYFSMERLSFLLFKAAVVAAAAAAAVAS

SEQ ID NO: 4547 - DNA, 1468 bp, Zea mays
  misc_feature (1)..(1468): Ceres cDNA ID no. 21995792
  misc_feature (1)..(1468): Ceres CLONE  ID no. 446343
  misc_feature (1)..(1468): Also known as  Ceres CDNA ID no. 24373595
acgactccccagtccccatccagacaagggaagggaatacaggcctgctccgccctgcctcccctctcctcttcttctctccccgcgcccaacaccacgccggcctcgatccaggctgccgcagcccgcaggtgtcctggacgccgcccttcccgtccgccggcggttgattccttctctccttcctcaggttcctggcctgatcacaaagcaggcggcgacggcgcggatggagctcccggtggcggagcccggcacggagcgaggcgagggcccgctgatccagtgcccgtactgcgactcggaggcgatgcacaagctagcgcagatcctgctaccggggctcgccgccgtgtgcgtggacggcacgacgggggacccgttccacagcccgtcggtggtggccgtggacctgcgcagggagatggtggactacatcacgcagcggagcgagagcttcatcgcggacgcgctgatcgagtcggaggccaatcaggaggggcccgacgcggcggtccccgacgacccgttcgaggccgtgtccgtgttcatggacgacttcggcagcacgaagcgcaacatcatcggccacgtctccgggtggctgctgagcgacagccgcgacgacaagatcgacgacttggtgcaggagatggaggcgacccggttctggccgctggagcggcgggaggccgtcgccgagacgctgctcaagaacgtggacctcaggacccggttccactgccccgagaagtacgagagcgaggcgcgcctggcggaccacaagcagcagtgcagcttccgccccgtcgcctgccccaacgacggatgccgcgccagggtctccgtccgctgcgcgcgggaccacgacgccgcctgcccgtacaagccgctccagtgcgagcagggctgcgagaagcggctgctcaggcgcgacatggacaggcactgcgtcaccgtctgccccatgaggcccatgaagtgccccttcggatgcgactcctccttccccgaccgtgacctcgagaagcactgcgcccagttccttcggccgcatttgatcaaggtgctcaaggcgattcataagaaggcgcgttcggaagatgagctcaaggacctcgctctgaagctggaaaagtacgatggagatggtaaactggctaaagctctggatgcaaggcctctcactaacgctgtcaaggacctcgaggccaagatgaaagctgaacactcgagtcgaagggctgttttacactgacagactttacagaatggataatgccattgtttagtatgaagggatgacgcagcttgtatacagagaagaatataagttttgttttcgtttttttttttgcttcactttctcctccctcacgatcaaatcaactgtcagtatgaatattccactattgctctgtacgagtatattgtttgttttagcgtaaaaagaaaaaaaaaaaaaaaa

SEQ ID NO: 4548 - protein, 342 aa, Zea mays
  misc_feature: PFam Name: zf-TRAF; PFam Description: TRAF-type zinc finger
  misc_feature: PFam Name: Cupin_1; PFam Description: Cupin
  misc_feature: GI Number: 30681973; NR Description: UbiA prenyltransferase
  misc_feature: GI Number: 50910267; NR Description: UbiA prenyltransferase-like protein [Oryza sativa (japonica cultivar-group)] >gi|47497283|dbj|BAD19326.1| UbiA prenyltransferase-like protein [Oryza sativa (japonica
  misc_feature: GI Number: 66777231; NR Description: Ferric-uptake regulator [Anaeromyxobacter dehalogenans 2CP-C] >gi|66857054|ref|ZP_00401112.1| Ferric-uptake regulator
  misc_feature: GI Number: 13592175; NR Description: ppg3 [Leishmania major]
  misc_feature: GI Number: 56283929; NR Description: CG3047-PA [Drosophila melanogaster] gi|55380421|gb|AAF50957.4| CG3047-PA [Drosophila
MELPVAEPGTERGEGPLIQCPYCDSEAMHKLAQILLPGLAAVCVDGTTGDPFHSPSVVAVDLRREMVDYITQRSESFIADALIESEANQEGPDAAVPDDPFEAVSVFMDDFGSTKRNIIGHVSGWLLSDSRDDKIDDLVQEMEATRFWPLERREAVAETLLKNVDLRTRFHCPEKYESEARLADHKQQCSFRPVACPNDGCRARVSVRCARDHDAACPYKPLQCEQGCEKRLLRRDMDRHCVTVCPMRPMKCPFGCDSSFPDRDLEKHCAQFLRPHLIKVLKAIHKKARSEDELKDLALKLEKYDGDGKLAKALDARPLTNAVKDLEAKMKAEHSSRRAVLH

SEQ ID NO: 4549 - DNA, 460 bp, Zea mays
  misc_feature (1)..(460): Ceres cDNA ID no. 21995794
  misc_feature (1)..(460): Ceres CLONE  ID no. 447621
  misc_feature (1)..(460): Also known as  Ceres CDNA ID no. 24373224
acaaagagggacttgctcgagggtttagctagcttggaagccctccgcaaactcccatggcgtgcctcctcgtgctcgtcatcgctgccacagtactaacgggtccaccgggaaaactgacgcacgccgctcggacgtcgccggcggaggccttctggcatgcggccctccccggcgctcccatgcccgaggccatccgcgagctcttgcgcccagctggtgctgccgggaccaggaacagcatgtcatcctggttcgctgaggaacgagccattcattcaccttggtgtccatacattccattcatccgtcgtacgcgtacaaggttgtaagatgtaccactccatttttttgttcaggcctttacaagcctaaaaaaagcttatatgtaccaccacttcatttgtaaaccctcaaaatttgttgctgagaagatcgacatatcaaaaaaaaaaaaaaa

SEQ ID NO: 4550 - protein, 91 aa, Zea mays
  misc_feature: GI Number: 4091010; NR Description: anther-specific protein
MACLLVLVIAATVLTGPPGKLTHAARTSPAEAFWHAALPGAPMPEAIRELLRPAGAAGTRNSMSSWFAEERAIHSPWCPYIPFIRRTRTRL

SEQ ID NO: 4551 - DNA, 1704 bp, Zea mays
  misc_feature (1)..(1704): Ceres cDNA ID no. 21995795
  misc_feature (1)..(1704): Ceres CLONE  ID no. 459678
  misc_feature (1)..(1704): Also known as  Ceres CDNA ID no. 24195347
agatgcagatgctaatgatacagtccgtccagaccccacccgccgccgcccacctccgcgctgctgcgcccgccagcacgccaccgctcctcgcgcgtaggctggccggttctcgtccagctcccgcctccgccggaacaatcagatgcagccgatgctaacgctacagtccgtccagcccccacccgccgctgcccacctccgcgccgctgcgtccgccaagacgccactgctcctcccgcgcagagcggccggtcctcctccagcttccgcctccgcctccgcctcggctgagttcccaggatccgttccagacagcgctcagatggcgccccgacggcggcggcgccggagcgtggccggcatcgaccaggacgaactcctcgatcccgaggccctcgcggaccccgacagcggcttctacgagatcaacggcgtgaggctgcaccacaaggtctgcagccacgaggatgaggactcgtccagcgaccagtccaccggtagtaccattgcctcagactcagacgctgtcctgaaaagccagattggcctgcccatactgctgctgcacggcttcggcgcgtcagtcttctcctggagcagtgtgatgcggcctctcgcccgcattgtccgtgccaaggttcttgcgttcgaccggccggcgtttgggctgacatcccgggccagtcgctctgccgatgacgccaagcctctcaatccttactccatggcgttctcggtcttggccacgttggcgttcatcgactaccttggcgctgagaaggccatacttgttgggcactcagctggttgccttgtagcagtggatgcatactttgaggcaccggaacgggtggctgctctcgtgctagttgcgccggctatatttgcaccaaggaaggcggtgaaagagggccagtcaggggaagaagaaggagggcagcaagcacagagggttcccaacgatgaaaattcgcctccaaatttgttcgctaggatttcgggaggatttcttgagctatggaagcacgttgcggggcttgttctcaagatgatcacagcgatacgagatgtggtccgatctttgtgtcttaaagctgtcgttgcttttcttcggtcatcgttgggtgtggtgctggtaagatgggtgatggataaatttggtatactgggcgtccggaatgcatggtatgacccgagcaaagtaactgatcatgtcatacaaggctacacaaagcctctaaaatccaagggttgggagacagctctgctggaacacaccgtatccatgatcatagattctgtgtctgcatcaagagtaccagtttcaaagaggctttctgagatctcatgcccagtgctagtggtgacaggtgacaccgatcgcattgttcctgcttggaatgccgagcgtgtggcacgcgctatacctggagcaacttttgaggcgatcaagagttgtggtcacttgccccacgaagaaaggcctgaggaattcctgtccgtcgttgaaaattttctacggacaacgtttgcaaatccaaatgaacaagtatttcaagcagctgtatcatgaattatgtgttgagtacgatctatttgctttataataaatcttaaagacccactcgtgtacaatgagagtggaatttggagtttaagcacatgagaagtaaaagaagttgaacaaaaaaaaaaaaaaaa

SEQ ID NO: 4552 - protein, 476 aa, Zea mays
  misc_feature: PFam Name: Abhydrolase_1; PFam Description: alpha/beta
  misc_feature: GI Number: 42563999; NR Description: hydrolase, alpha/beta
  misc_feature: GI Number: 6630546; NR Description: putative alpha/beta
  misc_feature: GI Number: 26450364; NR Description: putative alpha/beta
  misc_feature: GI Number: 34911750; NR Description: P0038D11.18 [Oryza sativa (japonica cultivar-group)] >gi|21328020|dbj|BAC00606.1| OJ1316_H05.1 [Oryza sativa (japonica cultivar-group)] >gi|21901991|dbj|BAC05542.1| P0038D11.18 [Oryza sativa (japonica
  misc_feature: GI Number: 55296870; NR Description: alpha/beta hydrolase-like [Oryza sativa (japonica cultivar-group)] gi|55296846|dbj|BAD68190.1| alpha/beta hydrolase-like [Oryza sativa
MQPMLTLQSVQPPPAAAHLRAAASAKTPLLLPRRAAGPPPASASASASAEFPGSVPDSAQMAPRRRRRRSVAGIDQDELLDPEALADPDSGFYEINGVRLHHKVCSHEDEDSSSDQSTGSTIASDSDAVLKSQIGLPILLLHGFGASVFSWSSVMRPLARIVRAKVLAFDRPAFGLTSRASRSADDAKPLNPYSMAFSVLATLAFIDYLGAEKAILVGHSAGCLVAVDAYFEAPERVAALVLVAPAIFAPRKAVKEGQSGEEEGGQQAQRVPNDENSPPNLFARISGGFLELWKHVAGLVLKMITAIRDVVRSLCLKAVVAFLRSSLGVVLVRWVMDKFGILGVRNAWYDPSKVTDHVIQGYTKPLKSKGWETALLEHTVSMIIDSVSASRVPVSKRLSEISCPVLVVTGDTDRIVPAWNAERVARAIPGATFEAIKSCGHLPHEERPEEFLSVVENFLRTTFANPNEQVFQAAVS

SEQ ID NO: 4553 - DNA, 2202 bp, Zea mays
  misc_feature (1)..(2202): Ceres cDNA ID no. 21995797
  misc_feature (1)..(2202): Ceres CLONE  ID no. 461712
  misc_feature (1)..(2202): Also known as  Ceres CDNA ID no. 24396174
tacccacgccctcgccgccgcccccgctcgcgctacacttcgcttccccagtctcccctcccccgctcactatggcgtccacaccgcggctcgctcgcctcgccgccgccgtcgcggcgtggatgctagtcgctgctgcttctgctggcgtggaggccggggatccgccgctttcgcccaaggggctcaactacgaagtggcggcgctcatggcggttaagagccggctgcgggacgagaggggggtcatggccctctgggacatcaactccgtcgacccctgcacctggtccatggtcgcctgctccccggacaagttcgtcgtctcgctccagatggccaacaacggcttgtccgggacgctgtcgccgagcatcgggagcctcagccacctccagacaatgtcactacagaataacagaatatcaggtgaaattcctccagagatagggaagctgatcaatctgaatgctcttgacctttccagtaatgagttcattggtgatatcccaagttcattggggcacctgactcgactaaattatctacgccttgataggaataacttgtctgggccgatcccaacagatgttgctaggcttccaggtctcacattccttgacttgtcattcaacaatttaagtggcccagttccaaaaatctatgcacatgattacagtcttgcgggaaatcgattcctttgcaattcctcagttatacatggttgttcagatgtgacagcaatgactaatgggacaatgtcgagacaggtccaaaaggccaagaaccaccatcaattagctttggcaatttctctaagtgtcacctgttccacaatattagttttgttgttcgtgtattggctaagttattgcagatggcgcttgccttttgcttcagctgatcaagatctagaattcgaattgggccatgtgaagcattttgcttttcacgatctgcaaagtgcaacggacaattttaattccaagaatatattaggtcaaggaggttttggtattgtgtataaaggctgtttgagaaatggaactttagtggcagtgaagagattaaaagatcctgatgttaccggtgaagtccagtttcagacagaagttgagttgattggccttgctgtgcacaggaatctcttgcgtttgtatggattttgcatgacctctaaagaacggttgcttgtatatccatatatgccaaatggcagtgttgctgaccgtttgagagattatcgcaatggaaaaccatctcttgattggagtaaacgcatgcggattgctcttggtgctgccagggggttactctaccttcatgaacaatgcaatcctaagatcatccacagggacgtcaaagctgcaaacatattgctcgatggaaatttcgaagcaatcgtcggggattttggattggcgaaacttcttgaccgtcatgaatcgcatgttactactgcagttcggggcactattgggcatattgctcccgagtatctctcaactggacagtcctcggaaaagactgatgtttatgggtttggcattctcctgttggaactgattactggtcctaaaaccttgagcaatggacatggccagtctcagaaaggcatgattctagactgggttagagagctaaaggaggacaagagaccggataagctggtcgacagggatctcagagattcatttgatattcttgagctggagtgttcagttgacgtgatcatccaatgcacgcagacgaaccctatgctgcggcctaagatgtccgaaattctgcacgctcttgaagccaatgtcacgctggcggaaaccagcgtcgagttgaacagggaacctcttccttatggtgtgcctcgcagtttctctgtgaggcatgaggacccccacgattcgtcgtccttcataatagagccaattgagctatctggtcccagatgacagctgttgtcagtgtggttgaggcgaaaagaaaagaaagcatggaaacaatacaattgtacaaaacatgtatatcgtggatgtagttcaacttagcaagagtttgctgggcgtgttgccataccttacataatattttgaacgtggagctggagcgaaccttgttggctatttttgttgcttacgttttcatctgccatccatgaggcactgaggcggtcaaaaaaaaaaaaaaaaaaaaaaaaaaaaaaaa

SEQ ID NO: 4554 - protein, 625 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 47076396; NR Description: leucine-rich repeat
  misc_feature: GI Number: 42568341; NR Description: leucine-rich repeat
  misc_feature: GI Number: 50251689; NR Description: putative SERK1 protein
  misc_feature: GI Number: 23297726; NR Description: putative receptor kinase [Arabidopsis thaliana] >gi|15810511|gb|AAL07143.1| putative receptor kinase [Arabidopsis thaliana] >gi|15219817|ref|NP_176279.1| leucine-rich repeat family protein
  misc_feature: GI Number: 20465457; NR Description: putative receptor kinase-like protein [Arabidopsis thaliana] >gi|17979065|gb|AAL49800.1| putative receptor kinase homolog [Arabidopsis thaliana] >gi|22329033|ref|NP_194781.2| leucine-rich
MASTPRLARLAAAVAAWMLVAAASAGVEAGDPPLSPKGLNYEVAALMAVKSRLRDERGVMALWDINSVDPCTWSMVACSPDKFVVSLQMANNGLSGTLSPSIGSLSHLQTMSLQNNRISGEIPPEIGKLINLNALDLSSNEFIGDIPSSLGHLTRLNYLRLDRNNLSGPIPTDVARLPGLTFLDLSFNNLSGPVPKIYAHDYSLAGNRFLCNSSVIHGCSDVTAMTNGTMSRQVQKAKNHHQLALAISLSVTCSTILVLLFVYWLSYCRWRLPFASADQDLEFELGHVKHFAFHDLQSATDNFNSKNILGQGGFGIVYKGCLRNGTLVAVKRLKDPDVTGEVQFQTEVELIGLAVHRNLLRLYGFCMTSKERLLVYPYMPNGSVADRLRDYRNGKPSLDWSKRMRIALGAARGLLYLHEQCNPKIIHRDVKAANILLDGNFEAIVGDFGLAKLLDRHESHVTTAVRGTIGHIAPEYLSTGQSSEKTDVYGFGILLLELITGPKTLSNGHGQSQKGMILDWVRELKEDKRPDKLVDRDLRDSFDILELECSVDVIIQCTQTNPMLRPKMSEILHALEANVTLAETSVELNREPLPYGVPRSFSVRHEDPHDSSSFIIEPIELSGPR

SEQ ID NO: 4555 - DNA, 1344 bp, Glycine max
  misc_feature (1)..(1344): Ceres cDNA ID no. 21995798
  misc_feature (1)..(1344): Ceres CLONE  ID no. 464388
  misc_feature (1)..(1344): Also known as  Ceres CDNA ID no. 24366989
tttatacttctgatcatttctaattttgaattcttaattcatgcatgtactcacatgctttgaaagatctttttgttattaagaatacatcagagtcaatatttttatccttgactggtttcaattgatgtttacatgcaactgtttttgtttgcttgcttttatagcatttacataacggttttaattgatgtttacatgcaactgtttatgtttgcttatatagtatttacaacagttccttgcatttaacttcccaggttaatgccttcagggaaaggagagcacttgctttgacattgaatgataccaaaacggcagtgaacaaacttcatcgaatgctcaattttatagttggaattattatactggttatttggctcttgatattggaacttgccaccaccaaatttcttctctttgtgagctcacaggttgtcgtggttgcatttatatttggaaacacctgcaagaccatatttgaagcaattattttcttatttgtcatgcacccatttgatgtgggagatagatgtgaaattgatggggttcagatggttgtagaagaaatgaacatattgacaaccatatttctgagatttgataatcaaaaggtcatcatccctaacaatgtccttgctaccaaggccatatataactattaccggagtcctgacatgggagatgctatcgaattctgtgtacatatatctaccccagttgaaaagatttcactcattaaacacagaatacaaagttacattgataacaagaaggagcactggtatccttcacctttgattgtatacagggattatgaccaattaaacatggtgaggttggctatctggccaactcatagaatgaacttccaagacatgggagaaaggtttgtgaggagatcccttttgcttgaagagatgatcaagattttcagggagcttgacattaattaccggctcttgcccatggacattaatgtgagagccactcctaccacttctgatcggcttccacctagttggacatcagttccaactccaagttgagtagaagaaggaaattcataacctcatgtcatcttgtgtgtgtggaaaacccgcggcattaactgctaggaaatgctatattttagctggatagcatattgtaaagagagggtcttttgtttttagattagcttgatatgtactgaggttagtttgtagtagctatgaagccatgcctaggtttcccatgtagtagttttgttcaaatgattagagggttaatcgctacgtcttttatactataaccatattcagtataagatttctatatgtctagaaaaaaaaaaaaaaaaaa

SEQ ID NO: 4556 - protein, 236 aa, Glycine max
  misc_feature: PFam Name: MS_channel; PFam Description: Mechanosensitive
  misc_feature: GI Number: 50252134; NR Description: mechanosensitive ion channel domain-containing protein-like [Oryza sativa (japonica
  misc_feature: GI Number: 42569089; NR Description: mechanosensitive ion channel domain-containing protein / MS ion channel
  misc_feature: GI Number: 15231928; NR Description: mechanosensitive ion channel domain-containing protein / MS ion channel
  misc_feature: GI Number: 51091457; NR Description: mechanosensitive ion channel domain-containing protein-like [Oryza sativa (japonica
  misc_feature: GI Number: 46981887; NR Description: unknown [Zea mays]
MLNFIVGIIILVIWLLILELATTKFLLFVSSQVVVVAFIFGNTCKTIFEAIIFLFVMHPFDVGDRCEIDGVQMVVEEMNILTTIFLRFDNQKVIIPNNVLATKAIYNYYRSPDMGDAIEFCVHISTPVEKISLIKHRIQSYIDNKKEHWYPSPLIVYRDYDQLNMVRLAIWPTHRMNFQDMGERFVRRSLLLEEMIKIFRELDINYRLLPMDINVRATPTTSDRLPPSWTSVPTPS

SEQ ID NO: 4557 - DNA, 1230 bp, Glycine max
  misc_feature (1)..(1230): Ceres cDNA ID no. 21995799
  misc_feature (1)..(1230): Ceres CLONE  ID no. 464783
  misc_feature (1)..(1230): Also known as  Ceres CDNA ID no. 23671390
ttgttctttcacaaatggtagccccaaaagtgaggtcatggagcctgagattaagaacaaagatgtctttaagaaaagaaagaccatgtcaacgtgcacagaacaagtgaaggtgtgcttgggaacggcgcatgaaggatctctggatgatggctatagttggagaaaatatggacagaaggatattctcggagctaagtttccaagaggatattacagatgcacatatagaaatgtacaaggatgtctggccacaaagcaggtgcaaaagtcagatgaagacccaatgatatgtgaaataacctacaaaggaagacacacatgcacccaagcaagtcacttaaacaaaacagtgatacccccatcaaagacaaaggtgaacttgttgggagaaaataagcaccaaacccatcaaattaagaatcaaccacggcaagagaaaatagaacaacaaccaccagagacatttttcacatttggatcatcatcaggtcttgaagttaaaatagaggacatcgaccacaaggagggcatattcccatcattttgcttttcttctccatcaatagtagggtcagaaaatggggacgacaacaacagcagcatattctcatacaccatgattgagaacaacttaatggaaagcttctctcctgccttcatatctccaacaacttcagatatagaatcaaacactttctgccactgggggagcactggactaggccaaagtgtgcaaagctcagggtctgatatcactgatatagtttcagcaccaacttcagtcaccaattcaccaataatggaccttgatttctttttcgataagatcgatttcgacacagatttccctttgagcaccatggaactttgcacttaataaattgtccccacttctaagtttacagcatatgtgatttctatgcggattaactgtgagttttgtagatcctgactagcaccataaccgagggaaggaagtctataataatcaccatagatcatgtccataaatgaagacaatgaaaaacttccctcttgtgctaattaagagagttttcatgtacctaggctgcaatgtgaaaataatttgtaggttgtagcttaatttggtgcatgtttggtttgcaatggaaattgttgtaatgcgcgttccaatgtagatcttatggataaaagtaaaatgaaatcaaaagagttctaatcttttagaaaaaaaaaaaaaaaaaa

SEQ ID NO: 4558 - protein, 280 aa, Glycine max
  misc_feature: PFam Name: WRKY; PFam Description: WRKY DNA -binding domain
  misc_feature: GI Number: 40846374; NR Description: putative WRKY
  misc_feature: GI Number: 30681651; NR Description: WRKY family transcription factor [Arabidopsis thaliana] >gi|24762209|gb|AAN64171.1| putative WRKY family transcription
  misc_feature: GI Number: 21436293; NR Description: putative WRKY-type DNA binding protein [Arabidopsis thaliana] >gi|19423942|gb|AAL87292.1| putative WRKY-type DNA binding protein [Arabidopsis thaliana] >gi|4559382|gb|AAD23042.1|
  misc_feature: GI Number: 46394402; NR Description: TPA: WRKY transcription
  misc_feature: GI Number: 50843966; NR Description: transcription factor WRKY31 [Oryza sativa (indica cultivar-group)] >gi|50252562|dbj|BAD28735.1| WRKY family transcription factor-like [Oryza sativa (japonica cultivar-group)]
MEPEIKNKDVFKKRKTMSTCTEQVKVCLGTAHEGSLDDGYSWRKYGQKDILGAKFPRGYYRCTYRNVQGCLATKQVQKSDEDPMICEITYKGRHTCTQASHLNKTVIPPSKTKVNLLGENKHQTHQIKNQPRQEKIEQQPPETFFTFGSSSGLEVKIEDIDHKEGIFPSFCFSSPSIVGSENGDDNNSSIFSYTMIENNLMESFSPAFISPTTSDIESNTFCHWGSTGLGQSVQSSGSDITDIVSAPTSVTNSPIMDLDFFFDKIDFDTDFPLSTMELCT

SEQ ID NO: 4559 - DNA, 1368 bp, Glycine max
  misc_feature (1)..(1368): Ceres cDNA ID no. 21995801
  misc_feature (1)..(1368): Ceres CLONE  ID no. 466966
  misc_feature (1)..(1368): Also known as  Ceres CDNA ID no. 25088204
gagcagtagtgatgaattccacagaagaagagtgtcgtggctgcgagattatggagaaagatgctcatgtcaggtttctcgagttaatgtactatatgctcccatctccgtacgagtcccaagagatcaaccatctcaccctcgcttactttgtcatctctggacttgacattctcaactcactccacaaagtcgcgaaggatgctgttatcagttgggttttgtctttccaagctcaccctggtgccaaggctgatctcaatgatggacaattctatggctttcatgggtccaaaacttcgcagtttcctccagatgagaatggggttttgattcacaacaacagtcacttggcaagtacttattgcgccatttccatattgaaaattgttggttatgaattgtccaatcttgattctgaaacaattgtgacttctatgaggaaccttcaacagcctgatggaagtttcatttctattcatactggaggcgaaacagatcttaggtttgtgtattgtgcagctaccatctgtttcatgttggataactggagtggcatggacaaggagaaaaccaaggattacatattacgttgccagtcttacgatggtggctttggattagttcctggtgcagaatctcatggaggtgcaacttattgtgctattgcatctctccgattaatgggattcattggagataatattctctcaagttgtgcttcatcttctttgatagatgcaccattgctgctggactggatcttgcagaggcagggaactgatgggggttttcaaggtagaccaaataaatccagtgatacatgttatgcattttggattggagccgttttaaggattctagggggctgcaaatttgttgacagtaaggctctacgtggatttttgctttcttgtcaatataagtatggtggtttcggaaaattccctggagagtatccagacctgtaccactcctactatggagttaccgctttcagcttgttggaagaatctgctttgaaatcactttgttctgaactgggaattcactgaaaatgctgcactggcactctagcatagattcagaaatggatgcacctttatacctgacatttcttgcatattatatgaagctctcagcactaatccactcttaatggacttttcttttttattctttcacaaatttagatggattgtaaattttcaatttcatttgattgtatttgtgattttgtgtgcatcaattcaggttatcgggcctcttctgtttagatcaagctttttttcattgctttcttttttgttttatttacatttccatgaagtttattaaatatgttaattcaaaaaaaaaaaaaaaaaa

SEQ ID NO: 4560 - protein, 1368 aa, Glycine max
  misc_feature: PFam Name: Prenyltrans; PFam Description: Prenyltransferase
  misc_feature: GI Number: 30725602; NR Description: At2g39550 [Arabidopsis thaliana] >gi|3355484|gb|AAC27846.1| putative geranylgeranyl transferase type I beta subunit [Arabidopsis thaliana] >gi|27311719|gb|AAO00825.1| putative geranylgeranyl transferase
  misc_feature: GI Number: 37787343; NR Description:
  misc_feature: GI Number: 11878247; NR Description:
  misc_feature: GI Number: 34895850; NR Description: putative geranylgeranyl-diphosphate geranylgeranyltransferase I beta chain
  misc_feature: GI Number: 13592025; NR Description: protein geranylgeranyltransferase type I, beta subunit [Rattus norvegicus] >gi|51247341|pdb|1S64|L Chain L, Rat Protein Geranylgeranyltransferase Type-I Complexed With L-778,123 And A
GAGCAGTAGTGATGAATTCCACAGAAGAAGAGTGTCGTGGCTGCGAGATTATGGAGAAAGATGCTCATGTCAGGTTTCTCGAGTTAATGTACTATATGCTCCCATCTCCGTACGAGTCCCAAGAGATCAACCATCTCACCCTCGCTTACTTTGTCATCTCTGGACTTGACATTCTCAACTCACTCCACAAAGTCGCGAAGGATGCTGTTATCAGTTGGGTTTTGTCTTTCCAAGCTCACCCTGGTGCCAAGGCTGATCTCAATGATGGACAATTCTATGGCTTTCATGGGTCCAAAACTTCGCAGTTTCCTCCAGATGAGAATGGGGTTTTGATTCACAACAACAGTCACTTGGCAAGTACTTATTGCGCCATTTCCATATTGAAAATTGTTGGTTATGAATTGTCCAATCTTGATTCTGAAACAATTGTGACTTCTATGAGGAACCTTCAACAGCCTGATGGAAGTTTCATTTCTATTCATACTGGAGGCGAAACAGATCTTAGGTTTGTGTATTGTGCAGCTACCATCTGTTTCATGTTGGATAACTGGAGTGGCATGGACAAGGAGAAAACCAAGGATTACATATTACGTTGCCAGTCTTACGATGGTGGCTTTGGATTAGTTCCTGGTGCAGAATCTCATGGAGGTGCAACTTATTGTGCTATTGCATCTCTCCGATTAATGGGATTCATTGGAGATAATATTCTCTCAAGTTGTGCTTCATCTTCTTTGATAGATGCACCATTGCTGCTGGACTGGATCTTGCAGAGGCAGGGAACTGATGGGGGTTTTCAAGGTAGACCAAATAAATCCAGTGATACATGTTATGCATTTTGGATTGGAGCCGTTTTAAGGATTCTAGGGGGCTGCAAATTTGTTGACAGTAAGGCTCTACGTGGATTTTTGCTTTCTTGTCAATATAAGTATGGTGGTTTCGGAAAATTCCCTGGAGAGTATCCAGACCTGTACCACTCCTACTATGGAGTTACCGCTTTCAGCTTGTTGGAAGAATCTGCTTTGAAATCACTTTGTTCTGAACTGGGAATTCACTGAAAATGCTGCACTGGCACTCTAGCATAGATTCAGAAATGGATGCACCTTTATACCTGACATTTCTTGCATATTATATGAAGCTCTCAGCACTAATCCACTCTTAATGGACTTTTCTTTTTTATTCTTTCACAAATTTAGATGGATTGTAAATTTTCAATTTCATTTGATTGTATTTGTGATTTTGTGTGCATCAATTCAGGTTATCGGGCCTCTTCTGTTTAGATCAAGCTTTTTTTCATTGCTTTCTTTTTTGTTTTATTTACATTTCCATGAAGTTTATTAAATATGTTAATTCAAAAAAAAAAAAAAAAAA

SEQ ID NO: 4561 - DNA, 1595 bp, Glycine max
  misc_feature (1)..(1595): Ceres cDNA ID no. 21995803
  misc_feature (1)..(1595): Ceres CLONE  ID no. 467870
  misc_feature (1)..(1595): Also known as  Ceres CDNA ID no. 25088205
accaatgcactcgtttcctcttctgctgttggaaatgagccttctgactacaaaaggcataacaacaaactcatgacctttttgaaaaaaaccatgtgggagtatgctttcgcatgtgttggtgttgttccttgtggcggcaataacgaccttaacggtcaaaggaaggcaactttgaagcacaataaggcgtggttgctggcggattctggagcagaattggcgagtgctgaccctcgatcggttcactcgtctttcaggttcagcttctgctctcaggttgaggttgagtccttcaacatgagctattctgcttctgctgctgctgcaacctttttgatggtgaatttggactatgagtctcaagtgaaggagttaaaatggaggagaatacagtcaccggagaaaagcttgtctcccgtggccaacactttgatcaggttcagctatgatgaaattctgtctgctactcacaatttctccaaagagagagtgttggggagaggtgccttgagctgtgtttttagaggaagagttgggatttggaggacttctgttgctattaaaaggttggataaggaagacaaggagtgtgtcaaggcgttttgcagagaattgatgattgctagttctctgcataacacaaatgttgttcctcttgtggggttttgtattgactcagaggagggtttgtttttggtgtacaagtatgtgtcagggggaagcttagagcatcacttacatgggaggaagaagggtagttcaccacttccatggtctgtgaggtacaaagttgcaattgggattgcagaagcagtggcttatctgcatcatggaacagaaagatgtgttgttcatagagacattaagccctcaaacattctgctttcctctaagaagattcccaagttatgtgattttggactagcttcatggacttctgcaccttcagttcctttcctttgcaaaactgtgaaaggaacatttggttatttggctcctgagtatttccaacatggaaaagtttcagataagactgatgtttacgctttgggagttgttctattggagctcttaactggccgcaagccaattgaagcaaaaagaacccctggagaggaaaacttggtagtatgggctaaacctttgctgagaaaagggaaaggagccattgaagagttgcttgattctcaagtcaaatacaatttgagttacacagatcaaatggctcgcatgattgatgccgcagctgcctgtgttacaagtgaagaatctaggaggccaagcataggtgagattgttgcaatattgaaaggagaagtagagcctgtactctctagaagaaggaaatctggttattttggtaatggatatgtgattgattattaccctcaattacaagaaacaaataatgagatgaaaagtcacttggctttggcaatgctaggagtttcagagtgtgaggatgatgattttctctatggtcattgagaatcattgttgccatgattctcaccattgtgcagggattagatgtgaatgttttcaagttgttagtagaaataaaaattcaaaggaaaaaaaaaaaaaaaaaa

SEQ ID NO: 4562 - protein, 1595 aa, Glycine max
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 12322261; NR Description: protein kinase, putative [Arabidopsis thaliana] >gi|25404623|pir||B96690 probable protein kinase F28G11.10 [imported] - Arabidopsis thaliana >gi|15219657|ref|NP_176819.1| protein kinase family protein
  misc_feature: GI Number: 21536612; NR Description: protein kinase-like protein [Arabidopsis thaliana] >gi|15240345|ref|NP_198595.1|
  misc_feature: GI Number: 10177167; NR Description: Ser/Thr protein
  misc_feature: GI Number: 42563282; NR Description: protein kinase family
  misc_feature: GI Number: 22655342; NR Description: At1g21590/F24J8_9 [Arabidopsis thaliana] >gi|18086338|gb|AAL57632.1| At1g21590/F24J8_9 [Arabidopsis thaliana] >gi|22329713|ref|NP_173578.2| protein kinase family protein
ACCAATGCACTCGTTTCCTCTTCTGCTGTTGGAAATGAGCCTTCTGACTACAAAAGGCATAACAACAAACTCATGACCTTTTTGAAAAAAACCATGTGGGAGTATGCTTTCGCATGTGTTGGTGTTGTTCCTTGTGGCGGCAATAACGACCTTAACGGTCAAAGGAAGGCAACTTTGAAGCACAATAAGGCGTGGTTGCTGGCGGATTCTGGAGCAGAATTGGCGAGTGCTGACCCTCGATCGGTTCACTCGTCTTTCAGGTTCAGCTTCTGCTCTCAGGTTGAGGTTGAGTCCTTCAACATGAGCTATTCTGCTTCTGCTGCTGCTGCAACCTTTTTGATGGTGAATTTGGACTATGAGTCTCAAGTGAAGGAGTTAAAATGGAGGAGAATACAGTCACCGGAGAAAAGCTTGTCTCCCGTGGCCAACACTTTGATCAGGTTCAGCTATGATGAAATTCTGTCTGCTACTCACAATTTCTCCAAAGAGAGAGTGTTGGGGAGAGGTGCCTTGAGCTGTGTTTTTAGAGGAAGAGTTGGGATTTGGAGGACTTCTGTTGCTATTAAAAGGTTGGATAAGGAAGACAAGGAGTGTGTCAAGGCGTTTTGCAGAGAATTGATGATTGCTAGTTCTCTGCATAACACAAATGTTGTTCCTCTTGTGGGGTTTTGTATTGACTCAGAGGAGGGTTTGTTTTTGGTGTACAAGTATGTGTCAGGGGGAAGCTTAGAGCATCACTTACATGGGAGGAAGAAGGGTAGTTCACCACTTCCATGGTCTGTGAGGTACAAAGTTGCAATTGGGATTGCAGAAGCAGTGGCTTATCTGCATCATGGAACAGAAAGATGTGTTGTTCATAGAGACATTAAGCCCTCAAACATTCTGCTTTCCTCTAAGAAGATTCCCAAGTTATGTGATTTTGGACTAGCTTCATGGACTTCTGCACCTTCAGTTCCTTTCCTTTGCAAAACTGTGAAAGGAACATTTGGTTATTTGGCTCCTGAGTATTTCCAACATGGAAAAGTTTCAGATAAGACTGATGTTTACGCTTTGGGAGTTGTTCTATTGGAGCTCTTAACTGGCCGCAAGCCAATTGAAGCAAAAAGAACCCCTGGAGAGGAAAACTTGGTAGTATGGGCTAAACCTTTGCTGAGAAAAGGGAAAGGAGCCATTGAAGAGTTGCTTGATTCTCAAGTCAAATACAATTTGAGTTACACAGATCAAATGGCTCGCATGATTGATGCCGCAGCTGCCTGTGTTACAAGTGAAGAATCTAGGAGGCCAAGCATAGGTGAGATTGTTGCAATATTGAAAGGAGAAGTAGAGCCTGTACTCTCTAGAAGAAGGAAATCTGGTTATTTTGGTAATGGATATGTGATTGATTATTACCCTCAATTACAAGAAACAAATAATGAGATGAAAAGTCACTTGGCTTTGGCAATGCTAGGAGTTTCAGAGTGTGAGGATGATGATTTTCTCTATGGTCATTGAGAATCATTGTTGCCATGATTCTCACCATTGTGCAGGGATTAGATGTGAATGTTTTCAAGTTGTTAGTAGAAATAAAAATTCAAAGGAAAAAAAAAAAAAAAAAA

SEQ ID NO: 4563 - DNA, 1528 bp, Glycine max
  misc_feature (1)..(1528): Ceres cDNA ID no. 21995804
  misc_feature (1)..(1528): Ceres CLONE  ID no. 471537
  misc_feature (1)..(1528): Also known as  Ceres CDNA ID no. 23672334
tgacagcctcagggaacggaactaatctagattcccattatttactagatgcttatgacaatggtatggtgtatggaatgacacaatacaatggagttcaacatcaacataatcttgatatgggtgttccagctgcggccaacttatattattctagcatgaatccttcatctggtgcggctgtatctctaaatgctgaagttatgagaggaaattatcaatatttcaatgcctcggctagttcttcagttgctccccctaatgcaagacacactgaaaatggcatcccctcgctaccacattgcacttcatggagcagatcaggcgagtctatgatggtgcgtgaccctaaccgtataactcgagtaaattatttaagtcaacactttcaaccagcagctcctcctccctggctggaccagcagttgaatagcaataataatgatggtcatgctttgccttggcatcagtctcttctaatgccatatgtacaagctcccagtgctaatggaagttcattagagaatgcaagaatgggcccccagagatatcatgatacagctggcagcagaagtggccacagatttccccatcctccccttgtcaacccacactaccatagctttcatcatcaaacacagcctgtccaagagatgagaggtcactccatcaactttcaccctcctcctccagtaactgcaccttcatatagagttccaacaaatccatcacgcagttcttcaatcttcatacaagattctattgagatgggtgctaggcatgttggtgctgcaccatttgcaggttcacatatataccgaccccatagaggcagcacacatgagactactcttagacatcgaaatcttcctcccgtgacttttctccaagttgatgatgttactttactggttgaccatcataatgatatgcgcttggacattgaggatatgtcttatgaggagcttcttgcattaggggagcggattggcaaagtaaacacaggtttgtcagaggaaatgattacaagtcaaatgaagacaaaaacttatttattactacctactaatgctattaacttggaggaggcagcttctgaggaacaggaaaatgattcttgcataatatgccaggatgaatataaaagccaagaaaagattggaattcttcaatgtgggcacgaatatcacgcagattgtttaaagaaatggttacttgtgaaaaatgtctgccccatatgcaaatcagaagcattgactcctggagagaagtgtgtataaaaaacaatgagatttacatgtctctttgttcctacatgcacacttctaagctactacatttttctaacgaattcatattttgttgtgtatatgaacactcgtacatatagacagtcgcattgtccaactcatttatttgttggcatcaaaacattgtatgtatcaagttgtacagacttctgttgatatattaactttaggcaattacattgttgctattttttatttttaaaaaaaaaaaaaaaaaa

SEQ ID NO: 4564 - protein, 1528 aa, Glycine max
  misc_feature: PFam Name: zf-C3HC4; PFam Description: Zinc finger, C3HC4
  misc_feature: GI Number: 22330219; NR Description: zinc finger (C3HC4-type
  misc_feature: GI Number: 23506055; NR Description: At3g15070/K15M2_22 [Arabidopsis thaliana] >gi|14326493|gb|AAK60292.1| AT3g15070/K15M2_22 [Arabidopsis thaliana] >gi|18400621|ref|NP_566498.1| zinc finger (C3HC4-type RING
  misc_feature: GI Number: 8777490; NR Description: RING-finger protein
  misc_feature: GI Number: 34910942; NR Description: putative U2 snRNP auxiliary factor [Oryza sativa (japonica cultivar-group)] >gi|20161586|dbj|BAB90507.1| putative U2 snRNP auxiliary factor
  misc_feature: GI Number: 558543; NR Description: C-terminal zinc-finger [Glycine max] >gi|1076498|pir||S49445 RING finger protein Pzf -
TGACAGCCTCAGGGAACGGAACTAATCTAGATTCCCATTATTTACTAGATGCTTATGACAATGGTATGGTGTATGGAATGACACAATACAATGGAGTTCAACATCAACATAATCTTGATATGGGTGTTCCAGCTGCGGCCAACTTATATTATTCTAGCATGAATCCTTCATCTGGTGCGGCTGTATCTCTAAATGCTGAAGTTATGAGAGGAAATTATCAATATTTCAATGCCTCGGCTAGTTCTTCAGTTGCTCCCCCTAATGCAAGACACACTGAAAATGGCATCCCCTCGCTACCACATTGCACTTCATGGAGCAGATCAGGCGAGTCTATGATGGTGCGTGACCCTAACCGTATAACTCGAGTAAATTATTTAAGTCAACACTTTCAACCAGCAGCTCCTCCTCCCTGGCTGGACCAGCAGTTGAATAGCAATAATAATGATGGTCATGCTTTGCCTTGGCATCAGTCTCTTCTAATGCCATATGTACAAGCTCCCAGTGCTAATGGAAGTTCATTAGAGAATGCAAGAATGGGCCCCCAGAGATATCATGATACAGCTGGCAGCAGAAGTGGCCACAGATTTCCCCATCCTCCCCTTGTCAACCCACACTACCATAGCTTTCATCATCAAACACAGCCTGTCCAAGAGATGAGAGGTCACTCCATCAACTTTCACCCTCCTCCTCCAGTAACTGCACCTTCATATAGAGTTCCAACAAATCCATCACGCAGTTCTTCAATCTTCATACAAGATTCTATTGAGATGGGTGCTAGGCATGTTGGTGCTGCACCATTTGCAGGTTCACATATATACCGACCCCATAGAGGCAGCACACATGAGACTACTCTTAGACATCGAAATCTTCCTCCCGTGACTTTTCTCCAAGTTGATGATGTTACTTTACTGGTTGACCATCATAATGATATGCGCTTGGACATTGAGGATATGTCTTATGAGGAGCTTCTTGCATTAGGGGAGCGGATTGGCAAAGTAAACACAGGTTTGTCAGAGGAAATGATTACAAGTCAAATGAAGACAAAAACTTATTTATTACTACCTACTAATGCTATTAACTTGGAGGAGGCAGCTTCTGAGGAACAGGAAAATGATTCTTGCATAATATGCCAGGATGAATATAAAAGCCAAGAAAAGATTGGAATTCTTCAATGTGGGCACGAATATCACGCAGATTGTTTAAAGAAATGGTTACTTGTGAAAAATGTCTGCCCCATATGCAAATCAGAAGCATTGACTCCTGGAGAGAAGTGTGTATAAAAAACAATGAGATTTACATGTCTCTTTGTTCCTACATGCACACTTCTAAGCTACTACATTTTTCTAACGAATTCATATTTTGTTGTGTATATGAACACTCGTACATATAGACAGTCGCATTGTCCAACTCATTTATTTGTTGGCATCAAAACATTGTATGTATCAAGTTGTACAGACTTCTGTTGATATATTAACTTTAGGCAATTACATTGTTGCTATTTTTTATTTTTAAAAAAAAAAAAAAAAAA

SEQ ID NO: 4565 - DNA, 827 bp, Glycine max
  misc_feature (1)..(827): Ceres cDNA ID no. 21995805
  misc_feature (1)..(827): Ceres CLONE  ID no. 471857
  misc_feature (1)..(827): Also known as  Ceres CDNA ID no. 24367618
gttgttctctcaaactttaataatctcataaattagcagaacgaagaggaacaaaaacaagaagaagaattggattcgaaaatcgtagcgtagcgttggtgcgattgaacgatacgatgggaagaggaaaattcaagagcaagcccactggtcgccgccagttctccaccccggaagatatgcttgctggaacctctaaccgtcctcgaacttttagacagaaagaagctgagcatgaagaggaagaacccgaggaagtatctggagatgaatctggagaagaatctgaagaagaaacttctaagaaaaaaggaacacaaggggttattgagattgaaaatcccaacttagtaaagccaaagaccttgaaagctagagatgttgatgttggaaaaacaacagaactttcaaggcgtgaaagggaggagatagagaaacagagagcccatgagcgctatatgaggctgcaagagcaaggaaaaacagaacaagcaaagaaggatttagaacgtttagctcttatacgtcagcaaagggaagatgctgctaaaaagcgagaagaagagaaagctgcgaaagagcagaagaaggctgaagcgcgcaagtgaatttcctggaaaatgtcatgttgccaaatttactccatattagtaggaggatatgtactcttactacacttcaacattatgtccatttagctttatattatggtattgctataccaagctggtaacatgtaatgcaattattttcatattctgtggtttaaaatcgtgattatatataaacgtttttaaaaattaaaaaaaaaaaaaaaaaaaaaaaaa

SEQ ID NO: 4566 - protein, 163 aa, Glycine max
  misc_feature: GI Number: 57899606; NR Description: putative 28 kDa heat- and acid-stable phosphoprotein [Oryza sativa (japonica
  misc_feature: GI Number: 34909600; NR Description: P0435B05.20 [Oryza sativa (japonica cultivar-group)] >gi|20160594|dbj|BAB89541.1|
  misc_feature: GI Number: 49257358; NR Description: MGC83035 protein
  misc_feature: GI Number: 28828808; NR Description: similar to Homo sapiens (Human). 28 kDa heat- and acid-stable phosphoprotein
  misc_feature: GI Number: 31212553; NR Description: ENSANGP00000022311 [Anopheles gambiae] >gi|21298505|gb|EAA10650.1| ENSANGP00000022311
MGRGKFKSKPTGRRQFSTPEDMLAGTSNRPRTFRQKEAEHEEEEPEEVSGDESGEESEEETSKKKGTQGVIEIENPNLVKPKTLKARDVDVGKTTELSRREREEIEKQRAHERYMRLQEQGKTEQAKKDLERLALIRQQREDAAKKREEEKAAKEQKKAEARK

SEQ ID NO: 4567 - DNA, 1439 bp, Glycine max
  misc_feature (1)..(1439): Ceres cDNA ID no. 21995806
  misc_feature (1)..(1439): Ceres CLONE  ID no. 472079
  misc_feature (1)..(1439): Also known as  Ceres CDNA ID no. 25087993
atagaaagcctctaaatatggcagccacaagcacggataagttggaggcaggaacagtttcaagttatgacaggaaaagtgaaatcaaggcatttgatgattcaaagactggtgtccaaggactggtagaaaatggtgtaacaaaagttccacttatgttctatagtgaaaactctaatctcaatgatggcgtaaccggtgcatcatattcaaagatcagcatccccataattgacctcacaggcatccatgatgatcctattttgagagatcatgttgtgggaaaagttagatatgcatgtgagaagtggggcttctttcaggttataaatcatggaattccaactcatgttttggatgagatgatcaaaggaacttgcaggtttcaccaacaagatgcaaaggtgaggaaagagtactacactcgcgaagtaagccgaaaagttgcttatctttccaattatactctttttgaagacccttctgctgattggagggatacacttgcattttccttggcacctcatccacccgaagctgaagaatttcctgcagtttgtagagatattgtgaatgaatactcaaagaaaataatggctcttgcttatgctttgtttgagttactgtcagaggctcttggccttaatcgcttttaccttaaagaaatggattgtgctgaagggcaacttcttctctgtcactattacccagcatgtcctgagcctgaattaacaatgggaaataccaagcactcagatggtaacaccataacaatacttttgcaagaccagattggtggccttcaagttcttcatgacagtcaatggattgatgtacctcccatgcatggggctctagtagtgaacattggggatattatgcagctcatgactaatgacaagttcattagtgttcaacatagagttttagcaaaggatcaaggtcctagaatttcggttgcatcctttttcagaacaggtatatcaagagtctttggtccaatcaaagaattgttatctgaagaacatccaccagtatacagagacatttctttaaaagattacatggcgcatcgttatacaagtggcagtggaacttctgcactgttacacttcaagttgtgatcatgaaaattacaagcaatcttgatgttattttgaaattaagggaacttttgttatctgtagatattgaacacatgtatccggaaatttacaataactgtcacacactgctgagccaattaaggaatttggatctcattctagtgaactttagggtgtggcttctattacctgaaattaaaataaagtagatgcaatagcttgctgtagatggattcaatcactttcttttttcagaaatgagaaccgagtttttcagaccaaaaaaaaaaaaaaaaaaaaaaaaaaaaaaaaaaaaaaaaaaaaaaaaaaaaa

SEQ ID NO: 4568 - protein, 368 aa, Glycine max
  misc_feature: PFam Name: 2OG-FeII_Oxy; PFam Description: 2OG-Fe(II)
  misc_feature: GI Number: 30102640; NR Description: At1g06620 [Arabidopsis thaliana] >gi|30679748|ref|NP_172147.2| 2-oxoglutarate-dependent
  misc_feature: GI Number: 5031283; NR Description: unknown [Prunus armeniaca]
  misc_feature: GI Number: 66730858; NR Description: 2-oxoglutarate-dependent
  misc_feature: GI Number: 8885558; NR Description: leucoanthocyanidin dioxygenase-like protein [Arabidopsis thaliana] >gi|15983483|gb|AAL11609.1| AT5g59540/f2o15_200 [Arabidopsis thaliana] >gi|15238459|ref|NP_200762.1| oxidoreductase,
  misc_feature: GI Number: 3201612; NR Description: putative dioxygenase [Arabidopsis thaliana] >gi|15224576|ref|NP_180642.1| 2-oxoglutarate-dependent dioxygenase, putative [Arabidopsis thaliana] >gi|25285697|pir||D84713 probable dioxygenase
MAATSTDKLEAGTVSSYDRKSEIKAFDDSKTGVQGLVENGVTKVPLMFYSENSNLNDGVTGASYSKISIPIIDLTGIHDDPILRDHVVGKVRYACEKWGFFQVINHGIPTHVLDEMIKGTCRFHQQDAKVRKEYYTREVSRKVAYLSNYTLFEDPSADWRDTLAFSLAPHPPEAEEFPAVCRDIVNEYSKKIMALAYALFELLSEALGLNRFYLKEMDCAEGQLLLCHYYPACPEPELTMGNTKHSDGNTITILLQDQIGGLQVLHDSQWIDVPPMHGALVVNIGDIMQLMTNDKFISVQHRVLAKDQGPRISVASFFRTGISRVFGPIKELLSEEHPPVYRDISLKDYMAHRYTSGSGTSALLHFKL

SEQ ID NO: 4569 - DNA, 1657 bp, Zea mays
  misc_feature (1)..(1657): Ceres cDNA ID no. 21995807
  misc_feature (1)..(1657): Ceres CLONE  ID no. 469036
  misc_feature (1)..(1657): Also known as  Ceres CDNA ID no. 24373603
catttttcctccgttccattcttctcttctctcctcgcctcccctcttgaaccctccgccgctccgaggaaaatccgatttgaattgaaaatcatccggagacagagatcttttcttcctcgaagctatcttctctctcgactcgatccatagctgctcgcgtccctgttcctcgccggctggcaagtggcggcgacgggacgaggtcttcatcgcctcctcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggcgccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggtttcgaggggatggggagaggaggtgggcaacctgcgccgtggggtggtgtgcaggagtactatgccaagctggccccgattgggagggcacatggccggccgtgggagcaaggcatgccgaattcggcgggcttcaggcatggtggtggcctgccgatgcccacaaaagataaggttggtgggcatcatgggccaccgaaagtgtcgagggagcatgaccatggcatggacaagagaactgatgatgctggccatgatcaaaaggttggagccaaggagggtgtgccgctgaagcatgcacagtcagaggcggacaacaagcgtgctaaacagcaatatgctcagaggtctcgtgtccggaagctgcagtatattgcagagcttgagagtagagtccaggcattacagtcagaaggggtagaagtgtctgctgaaatggagttccttagccagcagaatatcatgctagacctggaaaacaaagccttgaagcaaagagtggagagtctagcacaggaacaacttattaagcgttttcaacaggagatgtttgagcgggaaattggtcgtctcagaacaatatatcagcaacagcagcaacaacaggctcctgctcttgttcgtagtaacagcagggaccttgatgtgcagttcgccaacttgtctctgaaacacaaagaccccaacacgggccgggatgctctctctgggcctcttcgtacttagttctttccatccttccgttcttgtgggttctatcagtggccaccactgtgtctgtcatctccaccaagaaaggagaagtgcacttggattgtgtgaaaaacaccggaaaaggctaatagctatggatctgatgtttattatttcgggatatgcacctggcggtcatcctcagctcgcgtccattggtgatgctcgaccagtcggcggtgtttagggtttttgttttagctagatgcttttcaagcatcattgtaccatttttcatgctagggttctaatctgttgctacccccgttttcctgaactgtgttcttcaagcatcttagccaaaaaaaaaaaaaaaa

SEQ ID NO: 4570 - protein, 349 aa, Zea mays
  misc_feature: PFam Name: bZIP_1; PFam Description: bZIP transcription factor
  misc_feature: PFam Name: bZIP_2; PFam Description: Basic region leucine zipper
  misc_feature: GI Number: 53828635; NR Description: At1g58110 [Arabidopsis thaliana] >gi|28393180|gb|AAO42021.1| putative bZIP family
  misc_feature: GI Number: 42562802; NR Description: bZIP family
  misc_feature: GI Number: 18399693; NR Description: bZIP family
  misc_feature: GI Number: 21592919; NR Description: unknown [Arabidopsis thaliana]
  misc_feature: GI Number: 18149198; NR Description: putative bZIP
MMMANAKLHKQALLPPRSPFPTAAPYADRGPIARPQVGATHHRHGHHQRTSSESFIEEQPPSWLDDLLNEPETPAARQSGRAGHRRSSSDSFALFDGGAAGAGAYANGFEGMGRGGGQPAPWGGVQEYYAKLAPIGRAHGRPWEQGMPNSAGFRHGGGLPMPTKDKVGGHHGPPKVSREHDHGMDKRTDDAGHDQKVGAKEGVPLKHAQSEADNKRAKQQYAQRSRVRKLQYIAELESRVQALQSEGVEVSAEMEFLSQQNIMLDLENKALKQRVESLAQEQLIKRFQQEMFEREIGRLRTIYQQQQQQQAPALVRSNSRDLDVQFANLSLKHKDPNTGRDALSGPLRT

SEQ ID NO: 4571 - DNA, 1646 bp, Zea mays
  misc_feature (1)..(1646): Ceres cDNA ID no. 21995808
  misc_feature (1)..(1646): Ceres CLONE  ID no. 469482
  misc_feature (1)..(1646): Also known as  Ceres CDNA ID no. 25088206
ctctaagatccgccggcgcgtcgtggcggctcctccgcgtcccgcctccgaggccgcgggcggcgtcaggctgatctgggtggcgcgcggcgccggggagcgccccatcgtattcgtgcctctcaagcctaggccatggagggggtatcatcagctccagaaatggacgaggctatctcaactgaccaatcaagcagatcaacaaaaagaagggctaaagtgtgggatcatgttgattcagagctaatagatgggaaagagaaggcggtttgcaaatactgtaaggcccacttatcttctgctgcgggtaaaggtacaactcatctaaataggcatatttctgtgtattgccatgcaattccaccagaagagagacaaaggttcttagcgacccaaaaaacaaagcctgatgttgctcatgttttcgacccagtagtctttcgtggtctaatagccaagtacttccttagcgcagagatttcatttcgaaagtgtgaagatccatcctggaaagaaatgataaattattgtcaaccatcttttcgattagtcggtcgacagactgtccgttcagattgtatgttgttgtatgaagaggagaagttgcagttaattgagcagtttacaaagttgaaatctcatgttagtttgactgctgatctttggtcctctaaccaaaaccttggatatcttggtgtaacagcacatttcattagtgaagattttgagttgcacaaaaagattattgcattcaagaagatttccttcccacatacatcttatgctgtgcaagatggtattacctcttgtttgctagagtggggattggttggtgatttgtttaccctgactttggataatgctagtgtaaacaatagagcaatgaaagatatgcgagatgctttgggcagccagatgtttttcagtggtgaacacctccatgtgaggtgttcttctcatgtgctcaacatcatggttcaagctggactaaaggtcgttccaaatgcagtcgggaaggtgagggacattatcaaggtcgtaatatctacaccatctcgtttacagatcttcaattctattgttcaaacgttgggtcttagaagtaaatcggggctgattcttgatgttccacatcgttggaatgcaacctatgatatgctaaatgaagccctaaaatataaggctgctctgaacagatatgcagtagagcaacaccatgaatgtcccactgaagaagattggtcgaaggcagaagctcttcatggttttctacaagagtttagtgatgcaaccaaagcattctcagcggataggcatcccacagctcatctttttctcaagatgttgctcgttatccgaggtgtgctgcttgatgagaattataactcaaatgaactccttaatgagatggcaaatgttatgtataccaagttccaaaaatattggataaatcctaatattgtgttgctcatagctgctgttctagatccatcaatgaaaactgtatagaaatactgaattttagcatggagcgtctttgtaaacattttagcatggagcagtttctcatcgatcatggctgtcaagttctatttctctacacagttgcactttgtggttgttttctatcaaaaaaaaaaaaaaaa

SEQ ID NO: 4572 - protein, 457 aa, Zea mays
  misc_feature: PFam Name: zf-BED; PFam Description: BED zinc finger
  misc_feature: PFam Name: PH; PFam Description: PH domain
  misc_feature: GI Number: 34908974; NR Description: P0003D09.25 [Oryza sativa (japonica cultivar-group)] >gi|19571003|dbj|BAB86430.1|
  misc_feature: GI Number: 50901008; NR Description: putative transposase [Oryza sativa (japonica cultivar-group)] >gi|14702012|gb|AAK72262.1| putative transposase [Oryza sativa
  misc_feature: GI Number: 8778836; NR Description: T6D22.19 [Arabidopsis thaliana]
  misc_feature: GI Number: 12321083; NR Description: transposase, putative [Arabidopsis thaliana] >gi|25405068|pir||B96493 probable
  misc_feature: GI Number: 32490366; NR Description: OSJNBa0049H08.1 [Oryza sativa (japonica cultivar-group)] >gi|38346748|emb|CAD40758.2| OSJNBa0081G05.11 [Oryza sativa (japonica cultivar-group)] >gi|50923507|ref|XP_472114.1| OSJNBa0081G05.11 [Oryza sativa
MEGVSSAPEMDEAISTDQSSRSTKRRAKVWDHVDSELIDGKEKAVCKYCKAHLSSAAGKGTTHLNRHISVYCHAIPPEERQRFLATQKTKPDVAHVFDPVVFRGLIAKYFLSAEISFRKCEDPSWKEMINYCQPSFRLVGRQTVRSDCMLLYEEEKLQLIEQFTKLKSHVSLTADLWSSNQNLGYLGVTAHFISEDFELHKKIIAFKKISFPHTSYAVQDGITSCLLEWGLVGDLFTLTLDNASVNNRAMKDMRDALGSQMFFSGEHLHVRCSSHVLNIMVQAGLKVVPNAVGKVRDIIKVVISTPSRLQIFNSIVQTLGLRSKSGLILDVPHRWNATYDMLNEALKYKAALNRYAVEQHHECPTEEDWSKAEALHGFLQEFSDATKAFSADRHPTAHLFLKMLLVIRGVLLDENYNSNELLNEMANVMYTKFQKYWINPNIVLLIAAVLDPSMKTV

SEQ ID NO: 4573 - DNA, 1049 bp, Glycine max
  misc_feature (1)..(1049): Ceres cDNA ID no. 21995809
  misc_feature (1)..(1049): Ceres CLONE  ID no. 473473
  misc_feature (1)..(1049): Also known as  Ceres CDNA ID no. 24367785
tatattaatatcattctgttatagtacctctggtactcattaatgaatatattatattttggctgataaaaaaaataaaaaaattctgttttcactttaggttggattagctatgtcaccacttagcaataattctcttttcttgaactataaacgcaatccattaccaatgtttttccagctaggtctaaatgtgtctctctctaccgatgatcctttgcaaattcatttgacaaaagagccactgctcgaagaatataatgttgcagcaaaggtatggaagctctctgcatgtgacctgtgtgagatagctagaaattctgtctaccaatctggattttcacaccaagcaaagtcacactggcttggggataaatatttgttgagaggttccgaaggaattgatattcacaagacaaatgttcccaatttgaggatttctttccgatatgaggtgaaaaaacttaagacaaatcatatataagtgcagtttaatttgtattgattctttcatgataaccattcttgcatttattctttcttacttacgattgttggtgtttatgctggtcaagctgtctttcctgaagatttagacccatgaagcaagtctagtgaaattcatcattcatcccatgataacgctaacgtcggtactgtggtcaattttcttttgtgcagcagcagctttgatagtaagaagttatcgtaaccttgaagtaaccctcggttgtttcttaacataatcacaaactctaaaatgacatgctatcttaacacacttggttactattagtatttgcccctatttgtaccatataataaattatgtacggaagcgctggcatttgtagttgtctttttaggtggtaggaagtagggacgcttatgctagcctagttatttattagaagtaaattagcagtttgtataataaaatttgctcttcatgaatatacagaatgaaagatcatcttgaaactactttatttaatttcgcgtgtctatttgatgctaaaaaaaaaaaaaaaaaaaaaaaaaaaaaaaaa

SEQ ID NO: 4574 - protein, 123 aa, Glycine max
  misc_feature: PFam Name: A_deaminase; PFam Description: Adenosine/AMP deaminase
  misc_feature: GI Number: 7484807; NR Description: AMP deaminase homolog
  misc_feature: GI Number: 22136884; NR Description: putative AMP deaminase [Arabidopsis thaliana] >gi|15810525|gb|AAL07150.1| putative AMP deaminase [Arabidopsis thaliana] >gi|20196986|gb|AAC27176.2| putative AMP deaminase [Arabidopsis thaliana]
  misc_feature: GI Number: 608499; NR Description: AMP deaminase
  misc_feature: GI Number: 22267966; NR Description: Ampd2 protein [Mus musculus]
  misc_feature: GI Number: 644509; NR Description: AMP deaminase isoform L
MSPLSNNSLFLNYKRNPLPMFFQLGLNVSLSTDDPLQIHLTKEPLLEEYNVAAKVWKLSACDLCEIARNSVYQSGFSHQAKSHWLGDKYLLRGSEGIDIHKTNVPNLRISFRYEVKKLKTNHI

SEQ ID NO: 4575 - DNA, 1832 bp, Glycine max
  misc_feature (1)..(1832): Ceres cDNA ID no. 21995810
  misc_feature (1)..(1832): Ceres CLONE  ID no. 475681
  misc_feature (1)..(1832): Also known as  Ceres CDNA ID no. 23673723
aagtcacatggccattcacaacaatctaccacccccggcaaggatcacgttgtggcgcattcgaagatggtgaaattggtgtgcagctccgcggactacaaggaaaaatgtgaagaccctcttaacaaggcaatggaggatgaccccaaactcacgcaaccaaaagaccttctcaaggcatatgtcaaatttgctgaggatgaggttagcaaggccttcaacaaaaccatctccatgaagtttgaaaatgagcaagagaaaggtgcatttgaagattgcaagaagctctttgaggatgccaaggacgacattgcaacctccatatccgaacttgaaaaaattgagatgaagaacctttctcaaaggactcctgatttcaacagctggctcagtgctgtcatctccttccaacagaattgtgttgatggctttcccgagggaaacacaaagactgaacttcagactctcttcaacgattccaaggaattcgttagcaactcccttgccattctgtctcaggttgcatcggctctttcaacaatccaaacactagcacgcggcagccgttcgttgctgtctgagaacagcaactccccagttgcttctctagacaaagctgatggccttccttcttggatgaaccatgaggaccgaagggtattgaaggctatggataacaaacctgcacctaatgtcaccgtggctaaagatggcagcggagacttcaaaaccatctctgaatgtttaaatgctgtccctcaaaattttgaaggacgttatgtgatttttgttaaagaaggagtatacgatgagactgtgaccataacaaagaaaatgcaaaatataaccatgtatggtgatggatcccaaaagagcatcatcactggcaacaaaaactttagggacggtgtcaggactttcctaactgcaagttttgtggtagagggagatggattcataggcctagcaatgggattcagaaacactgcaggccctgatggccaccaagcagtggctgcaagagtgcaggcggatcgtgcagtgtttgccaactgtcggttcgagggctaccaagacactctatacacccaagcccacagacaattctacaggagctgcatcgttacaggaacaatcgatttcatctttggcgacgcagctgtcgtgttccagaactgcatcatggtagttaggaagccattggaaaaccagcagaacatggtgactgctcaagggagagtcgacaagcaacaagtcactggaattgtgctgcagaaatgcacaatcaaggctgatgattcactggttccagagaaggacaagatcaggagctaccttgggaggccgtggaaggagttctcgagaacaattgtgatggaatcggaaataggtgacttcattcaccccgatggatggacagcttgggagggagactttgctctcaagacattgtactatgctgagtatggcaacacaggacctggtgccagcaccaatgctaggatcaagtggcctggttaccaagtcattaacaaggatgaggctagccagttcactgtgggatctttcttgagaggcacatggctccagaacacgggcgtgcctgccacgcaaggcttgtacaattaaacgcctttgcttcaaatttcataccacttgagttcttgcttcagcctttgagctgctgctgctacatgttaattaggcacaccggaaaataaacttgatggtcttgctcattttgatgaattgtatttttctttctttcttttaccgtaaattttttaaaaacatttaatcttgaattgtaaaaaaaaaaaaaaaaaaaaaaa

SEQ ID NO: 4576 - protein, 520 aa, Glycine max
  misc_feature: PFam Name: Pectinesterase; PFam Description: Pectinesterase
  misc_feature: PFam Name: PMEI; PFam Description: Plant invertase/pectin
  misc_feature: GI Number: 25313441; NR Description: pectinesterase (EC 3.1.1.11) [imported] - Salix gilgiana >gi|6714532|dbj|BAA89480.1|
  misc_feature: GI Number: 30683114; NR Description: pectinesterase family
  misc_feature: GI Number: 7270271; NR Description: pectinesterase-like protein [Arabidopsis thaliana] >gi|4455337|emb|CAB36797.1| pectinesterase-like protein [Arabidopsis thaliana] >gi|15234112|ref|NP_195049.1| pectinesterase family protein
  misc_feature: GI Number: 30794091; NR Description: putative pectin
  misc_feature: GI Number: 2739370; NR Description: putative pectinesterase [Arabidopsis thaliana] >gi|7447376|pir||T00978 probable pectinesterase (EC 3.1.1.11) At2g26450 [imported] - Arabidopsis
MVKLVCSSADYKEKCEDPLNKAMEDDPKLTQPKDLLKAYVKFAEDEVSKAFNKTISMKFENEQEKGAFEDCKKLFEDAKDDIATSISELEKIEMKNLSQRTPDFNSWLSAVISFQQNCVDGFPEGNTKTELQTLFNDSKEFVSNSLAILSQVASALSTIQTLARGSRSLLSENSNSPVASLDKADGLPSWMNHEDRRVLKAMDNKPAPNVTVAKDGSGDFKTISECLNAVPQNFEGRYVIFVKEGVYDETVTITKKMQNITMYGDGSQKSIITGNKNFRDGVRTFLTASFVVEGDGFIGLAMGFRNTAGPDGHQAVAARVQADRAVFANCRFEGYQDTLYTQAHRQFYRSCIVTGTIDFIFGDAAVVFQNCIMVVRKPLENQQNMVTAQGRVDKQQVTGIVLQKCTIKADDSLVPEKDKIRSYLGRPWKEFSRTIVMESEIGDFIHPDGWTAWEGDFALKTLYYAEYGNTGPGASTNARIKWPGYQVINKDEASQFTVGSFLRGTWLQNTGVPATQGLYN

SEQ ID NO: 4577 - DNA, 1094 bp, Glycine max
  misc_feature (1)..(1094): Ceres cDNA ID no. 21995811
  misc_feature (1)..(1094): Ceres CLONE  ID no. 476753
  misc_feature (1)..(1094): Also known as  Ceres CDNA ID no. 24366898
ttttttagttaaaattttcacttatttgatgataccaagttctttgtatatattattattcactcttgattcagaggaatggcaattgaggatccctgtgccccccacggccttcgccttgtgatagaggactacccttatgctgttgatggactagaaatatgggatgctattcagacatgggttaagaactatgtctccttgtattacccaacagatgatgcaattaagaaagactctgagctccaagcttggtggaaggaagctgttgagacgggtcacggtgacttgaaagacaagccatggtggcctaagttgaacactcctcaagatttggttcacatttgctccattatcatatggatagcttcagctctccatgcagcagtgaattttggacaatacccttatggaggtttgatcctaaaccgtccaactttaaccagaagatttctccctgaaccaggaagcaaagaatatgaggagctttcaaccaattatcaaaaggcttacctgagaacaattacaagaaagattgaggcccttgtggacctttcagtgatagagatattgtcaagacatgcttctgatgagatctaccttgggaagagggacagtgacgattggactgatgaccaaaaggcaattcaagcctttgaaaagtttggaaccaagctgaaggaaattgaggccaaaatcaattcgaggaacaaagattcaagccttagaaaccgtaatggaccggttcagatgccttatactgtgcttcttcctaccagtgaggaaggccttactttcagaggaattcccaacagcatctctatctaaggccagagtgcgtttatgtgtggttctctttccaaacctacgttacctttctcgttgacgagtaaatatgcaagcttatgcatgcatataataattgtcttatgcattcttaagtgttgtatgtggacgttatctagttttcgtatttaataagaatggtatcaccattactttgtttttactatcatgttcacccgtagtatgtaagattgatatcccaaactatgattatgaaatcaaatttctccaaaaaaaaaaaaaaaaaa

SEQ ID NO: 4578 - protein, 249 aa, Glycine max
  misc_feature: PFam Name: Lipoxygenase; PFam Description: Lipoxygenase
  misc_feature: GI Number: 21017; NR Description: lipoxygenase [Phaseolus vulgaris] >gi|126409|sp|P27480|LOXA_PHAVU Lipoxygenase 1
  misc_feature: GI Number: 4464185; NR Description: lipoxygenase [Phaseolus vulgaris] >gi|7433162|pir||T11852 lipoxygenase (EC 1.13.11.12) -
  misc_feature: GI Number: 7208773; NR Description: lipoxygenase [Cicer arietinum]
  misc_feature: GI Number: 18746; NR Description: lipoxygenase [Glycine max] >gi|126411|sp|P24095|LOXX_SOYBN Seed lipoxygenase
  misc_feature: GI Number: 242462; NR Description: lipoxygenase [Glycine max] >gi|99934|pir||S18612 lipoxygenase (EC 1.13.11.12) - soybean
MAIEDPCAPHGLRLVIEDYPYAVDGLEIWDAIQTWVKNYVSLYYPTDDAIKKDSELQAWWKEAVETGHGDLKDKPWWPKLNTPQDLVHICSIIIWIASALHAAVNFGQYPYGGLILNRPTLTRRFLPEPGSKEYEELSTNYQKAYLRTITRKIEALVDLSVIEILSRHASDEIYLGKRDSDDWTDDQKAIQAFEKFGTKLKEIEAKINSRNKDSSLRNRNGPVQMPYTVLLPTSEEGLTFRGIPNSISI

SEQ ID NO: 4579 - DNA, 2312 bp, Glycine max
  misc_feature (1)..(2312): Ceres cDNA ID no. 21995812
  misc_feature (1)..(2312): Ceres CLONE  ID no. 477055
  misc_feature (1)..(2312): Also known as  Ceres CDNA ID no. 24727118
atattaatcttactatatttaatatttctttctttttcttcaatttctgagtttttttgctccagcagcttcgtcttaagaagctggtgttggaagtttgctcgcgatcatgcagaactgcgtgctcgatccacaagatcagagggttacttcctgcatggaggattcctctgcaatgactattgaattcctgcgggcaaggttgctttctgaaagatccatctcaagaagtgctaaacagagagctgatgaactggcaaaaaaggtcatggaattggaggaacaacttaagacggtgattcttcagaggaagatggcagagaatgccactgctgatgttcttgccattttggagagtcaagggataagtgatgtatctgaagaatttgattcaggctcagaccttggaaatccttgtgattctagcgtgagtaacgagtgtgcaaaagaaagtggggaacctatgagctcaaaaggaagacaacatgggtcagatgaaatgtctggttccaatgtagattcttcaccagtatccagtaaaagtttgtcttggaaaggacgccgtgattcttcccattctcttaaaaagtataagacttctaattcgaggaggcaaagcagtttttcatctatcagttcttctccaaagcatcgccaaggaaagtcatgtcgcaagataagacatagacaaatcaggtcggtagtggaggagtctagaaataagtttgctaaccatgaaaatgaacttgcatcctcgtctgaaggatttccaaatttcttagatggtgggtctaacatgccgaaaatagaatctgaaattcaagaagagggtggatcagaggcaaacccacttaacaaaaatcatcatgtagatggatatgtaagagagaaggacatggaaaaggcacttgaacaccaggcccaacttattgaccaatatgaagcaatggagaaggctcaaagagactgggaggagaaatttagagagaataacagcacaacaccagattcgtgtgatccggggaatctctcagatatgactgaggataaagatgaaagcaaggttcacattccatatgctgctaaggtggtcacctcagatgctcaagagaataaaggaggaccaagaggtgttcacttatctgaagaaaaattcaaagctgaggccagagatattatgccaaaaactcatgatgatacaggaggttatagcaaacagaagaatacaacttttagcacttctgatctgcttggtcaacaaaactcgcattccccactgaagggaaacgaaaatgagagctcagtagacggccactttcagtcttctgatatgaaccgtcaagatccaggtaggcatggttaccatgattcaaagcctacttattcctttacaactgatatccatggtgttcagcaccaaaatgatgcctcaagaaacaaaaatgacctctatgcattagttactcatgaacaacctcacaagttcaatggtgtacttgaatcacttaaacaagctaggatatccctacaacaggaactcaagagattgccactagtagagggtgggcacactgctaaaccctctgcttctgttagtaaaagtgaggatagatttgaagttcctgttgggtgttctggtctctttagactaccaacagatttttctggagcaactgctagtttcaatgttcatgattcaactgctggatttggttcaaactttcatgttaatagagccatgtctagaacttctgatggtcactttttctccagtcttccttactctggcacaccattgagcttgcctgctgatgatcaatctcttgccatccaatacgtggaaaacgggtcaagatttgattctaacaaggcccttattgatcctttctcaaatggaggttcactctcttccagtaaatacacatatcccacgtttcccatcaatccatcctatcaaaatgcaacaccacaaatgccatttggtaatgaactttcaagaccctattcaagtagcacagccagggttcctcttgcaaatcgtttctcgtttaatggcgatcatttaagatgaaacatgtatatataatatcattaggttgctagcagctactcttgttgtaaaagtaatggtttttatttgtcatgtactttaaggttattctctctagttgtgttgggaagagatttttttatgacaaaatacactgaaagttcgtcctttcatctggactgtgtttactttaaatgtcgcactatcaatcttggtcatcaagattgcttctggactgtgtttgaaaaaaaaaaaaaaaaaa

SEQ ID NO: 4580 - protein, 653 aa, Glycine max
  misc_feature: GI Number: 34908436; NR Description: P0683F02.9 [Oryza sativa (japonica cultivar-group)] >gi|15290012|dbj|BAB63706.1| P0683F02.9
  misc_feature: GI Number: 5852181; NR Description: zhb0011.1 [Oryza sativa
MQNCVLDPQDQRVTSCMEDSSAMTIEFLRARLLSERSISRSAKQRADELAKKVMELEEQLKTVILQRKMAENATADVLAILESQGISDVSEEFDSGSDLGNPCDSSVSNECAKESGEPMSSKGRQHGSDEMSGSNVDSSPVSSKSLSWKGRRDSSHSLKKYKTSNSRRQSSFSSISSSPKHRQGKSCRKIRHRQIRSVVEESRNKFANHENELASSSEGFPNFLDGGSNMPKIESEIQEEGGSEANPLNKNHHVDGYVREKDMEKALEHQAQLIDQYEAMEKAQRDWEEKFRENNSTTPDSCDPGNLSDMTEDKDESKVHIPYAAKVVTSDAQENKGGPRGVHLSEEKFKAEARDIMPKTHDDTGGYSKQKNTTFSTSDLLGQQNSHSPLKGNENESSVDGHFQSSDMNRQDPGRHGYHDSKPTYSFTTDIHGVQHQNDASRNKNDLYALVTHEQPHKFNGVLESLKQARISLQQELKRLPLVEGGHTAKPSASVSKSEDRFEVPVGCSGLFRLPTDFSGATASFNVHDSTAGFGSNFHVNRAMSRTSDGHFFSSLPYSGTPLSLPADDQSLAIQYVENGSRFDSNKALIDPFSNGGSLSSSKYTYPTFPINPSYQNATPQMPFGNELSRPYSSSTARVPLANRFSFNGDHLR

SEQ ID NO: 4581 - DNA, 2661 bp, Zea mays
  misc_feature (1)..(2661): Ceres cDNA ID no. 21995815
  misc_feature (1)..(2661): Ceres CLONE  ID no. 506084
  misc_feature (1)..(2661): Also known as  Ceres CDNA ID no. 23746486
gtgttgtctagcactctagctgcttctctcggttctcgcgactcccaaacggcaaaacgccaaaaccctagccgcggccattccggaattggccatggaggcgagggcgtcgccgcgtccgtcggtctccatcggtggcggcggcggcttcggagctgggcggggtgacggcagcgccttctcgtttctctcaaaggggtggcgcgaggtgcgggattccgccaccgccgacctgcgcctcatgcgcgcgagggctgattccctccgcacgctcgcggaccgcgagctcgagcacctcctcgcgtccgcctccactgcgctgacctccgcgccgccgccgccgctcgccgcgggggcgcccatagccgagttcgagttcgtgcgcacacggatccagcccaagatctccgaactgcggcgccggtacgtgtcacaggagcgggagctcggccgcagggtgctcgaggggtgggcgccgcgcggggcggggaaacccgcgcgcgcacgtgtcgacctctctgggatcaccgccatccgcaacgccatcgtctctgaagtggatggcggggagcgctggaggcgcgtggtgtggaacggggaggcggaagaggggaaagaatgggaggtgctcaggatcatacgggacggcatcaaagagttcgagcgccggagccagaccaaggagatttttgagggattgcgcagtaccggcgagctcgtcgagaaattcaagtccagcctgaaatcattcaacatggagtctcaaggatccaaggaaatccaaccactggatctacctgaaatactggcaaatcttgtaaggcagtctgaaccatttttggatcaacttggtgtacggagagatcagtgtgacaaactagtggaggcattgtgtaggaaacaaaatcattccctttcagaaaacacatccttgcctgtaaatgataagtcatcagatgaacttgacttgagaatcgcaagcgtgcttcaaagttctggttatcatgctgatgatggtttctggagtgaacctacaaagtctgaggtctcagacgataaaagacatgtggctatagtcaccacagcaagtttaccatggatgacaggaacagcagttaatccattgttccgtgcagcatatctcgcaaaaggtactagacaagatgtgacactggtagtgccttggctttgcaaatcagaccaagaactggtatacccaaatagcatgacgttcagttcaccagaagagcaggaaacttatataaggagctggctggaggaaagactaggatttgaatcaaacttcaagatatccttttatcctggcaagttctcaaaagagcggcgtagcatcattccagctggtgatacgtctcagttcataccgtcaagagaagctgatatagcaatattggaagaaccagaacatctcaattggtatcatcatgggaaacgctggactgacaagttcaaccatgttgttggtgtagttcatacaaactacctggaatatatcaagagagagaagaatggagctcttcaggcctttctagttaaacacatcaacaattgggtgaccagagcatactgcgacaaggtcttacgtctttctgcagcaactcaagatttaccaaagtctattgtttgcaatgttcatggtgttaacccaaagttcctgaagattggagaagaaataactgccaatagggggagttgggagcctccattttccaagggagcatattttcttgggaagatggtttgggccaaaggttatagggaactcatagatttgatggctaaacataaaagcgatttagaaggattcaagttagatgtatacggaagtggtgaggactcgcaagaagttcaatccactgccaggaggttagatttgagtctcaattttttcaagggaagggatcatgctgataattcactccatgggtacaaggttttcataaatccgagcattagtgatgtcctgtgcacagcaacggcagaggctcttgcaatggggaaattcgtgatctgcgcagaacatccatcaaatgagtttttcatgtcatttccgaactgtttgacatacaagacttcagaggagtttgttgcgagagtgaaagaggcaatggatagagaaccccaaccgctaacccctgagcaaagatacaacctttcgtgggaggcagcgactgagagattcatggagtactcagaccttgacaaggttctgaacaatgaggctgctcagcctggacaaggtaggaaaagaaagaataaaagaacctcacagcctaatttgtccgacataatggatggcggtctagcgttggcccatcgatgcttaactggcaatgaggttctcaggctggcaaccggagccattcctggtacccgggactacgataagcagcactgtgtggatatgggtctcttgcctcctcaagtacagcaccctgtatatggctggtgatgactgatgagcacccaaagctaatcgtaggtatatatgtacataatacaccatgtcgctcttatgtcgactaatgtttggagtattgtaattgtagcatgcatgacgacctttgcccattgttttgtactctgtaataaggttctttctccttaaattggagttttatcgcaaaaaaaaaaaaaaaa

SEQ ID NO: 4582 - protein, 792 aa, Zea mays
  misc_feature: PFam Name: Glycos_transf_1; PFam Description: Glycosyl
  misc_feature: GI Number: 33589694; NR Description: At4g00550 [Arabidopsis thaliana] >gi|18141112|gb|AAL60504.1| digalactosyldiacylglycerol synthase [Arabidopsis thaliana] >gi|22328179|ref|NP_191964.2| UDP-galactose:MGDG galactosyltransferase 2 /
  misc_feature: GI Number: 30681840; NR Description: digalactosyldiacylglycerol synthase 1 (MGDG:MGDG galactosyltransferase) (galactolipid galactosyltransferase) (DGD1)
  misc_feature: GI Number: 49617329; NR Description:
  misc_feature: GI Number: 49617333; NR Description: digalactosyldiacylglycerol synthase 1 [Lotus corniculatus var.
  misc_feature: GI Number: 49617331; NR Description:
MEARASPRPSVSIGGGGGFGAGRGDGSAFSFLSKGWREVRDSATADLRLMRARADSLRTLADRELEHLLASASTALTSAPPPPLAAGAPIAEFEFVRTRIQPKISELRRRYVSQERELGRRVLEGWAPRGAGKPARARVDLSGITAIRNAIVSEVDGGERWRRVVWNGEAEEGKEWEVLRIIRDGIKEFERRSQTKEIFEGLRSTGELVEKFKSSLKSFNMESQGSKEIQPLDLPEILANLVRQSEPFLDQLGVRRDQCDKLVEALCRKQNHSLSENTSLPVNDKSSDELDLRIASVLQSSGYHADDGFWSEPTKSEVSDDKRHVAIVTTASLPWMTGTAVNPLFRAAYLAKGTRQDVTLVVPWLCKSDQELVYPNSMTFSSPEEQETYIRSWLEERLGFESNFKISFYPGKFSKERRSIIPAGDTSQFIPSREADIAILEEPEHLNWYHHGKRWTDKFNHVVGVVHTNYLEYIKREKNGALQAFLVKHINNWVTRAYCDKVLRLSAATQDLPKSIVCNVHGVNPKFLKIGEEITANRGSWEPPFSKGAYFLGKMVWAKGYRELIDLMAKHKSDLEGFKLDVYGSGEDSQEVQSTARRLDLSLNFFKGRDHADNSLHGYKVFINPSISDVLCTATAEALAMGKFVICAEHPSNEFFMSFPNCLTYKTSEEFVARVKEAMDREPQPLTPEQRYNLSWEAATERFMEYSDLDKVLNNEAAQPGQGRKRKNKRTSQPNLSDIMDGGLALAHRCLTGNEVLRLATGAIPGTRDYDKQHCVDMGLLPPQVQHPVYGW

SEQ ID NO: 4583 - DNA, 1251 bp, Glycine max
  misc_feature (1)..(1251): Ceres cDNA ID no. 21995816
  misc_feature (1)..(1251): Ceres CLONE  ID no. 511015
  misc_feature (1)..(1251): Also known as  Ceres CDNA ID no. 24766338
gatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaaagaaaaaaaaaaaaaaaaaa

SEQ ID NO: 4584 - protein, 255 aa, Glycine max
  misc_feature: PFam Name: Cyclase; PFam Description: Putative cyclase
  misc_feature: GI Number: 21537400; NR Description: unknown [Arabidopsis thaliana] >gi|18491127|gb|AAL69532.1| AT4g35220/F23E12_220 [Arabidopsis thaliana] >gi|13937204|gb|AAK50095.1| AT4g35220/F23E12_220 [Arabidopsis thaliana]
  misc_feature: GI Number: 21617901; NR Description: unknown [Arabidopsis thaliana] >gi|21928057|gb|AAM78057.1| AT4g34180/F28A23_60 [Arabidopsis thaliana] >gi|16226603|gb|AAL16211.1| AT4g34180/F28A23_60 [Arabidopsis thaliana]
  misc_feature: GI Number: 51535583; NR Description: metal-dependent
  misc_feature: GI Number: 50905785; NR Description: metal-dependent hydrolase-like protein [Oryza sativa (japonica cultivar-group)] >gi|46390045|dbj|BAD15421.1| metal-dependent hydrolase-like protein [Oryza sativa (japonica cultivar-group)] [Oryza sativa
  misc_feature: GI Number: 23016903; NR Description: COG1878: Predicted
MKRGALLSVLACAFAAVIWAANGDDNLVPPRREVYGNGRIFDISHRYQPEMPEWESNDGIGQFLWLPKSMKNGSLANNSEMKFPTHTGTHVDAPGHVFDHYFHAGFDVDTLDLDILNGPAMLVDVPRDSNITAQVMKSLNIPRGVIRVLFRTLNTDRRLMFQKEWDSSYVGFTADGAKWLVENTDIKLVGIDYLSVASYDYLIPSHLVFLKDREIILVEGLKLDDVPAGLYSVHCLPLRLAGAEGSPIRCILIKN

SEQ ID NO: 4585 - DNA, 1450 bp, Glycine max
  misc_feature (1)..(1450): Ceres cDNA ID no. 21995817
  misc_feature (1)..(1450): Ceres CLONE  ID no. 512422
  misc_feature (1)..(1450): Also known as  Ceres CDNA ID no. 24428306
aaaatgaccaggatgctattcccccaactgggtttccaagtgatttcaaccaaaaggatcttgcccgattcatgcaaaatatgaagcctggcacaaatcctttcgccttgatggaaaaataccaagatataaacaagcctcatattttctggagagagcaacctgtgcctaagattagtgatattccgggccaacaaccagaaggagagatcgacccagaccacgacctcgaaaaggttcctaaaacccccttcgccctcctttctcagttcgaatggagcgatattgatatcaccaaaccagaacaactggaggagttgtacaagttcttgtatgagaattacgttgaggatgaagatggtatgttcagattcgactactcaaaggatttccttcaatgggctctttctcctcctggatactatcctgaatggttgattggtgttcgcgttcaaaagagcaagaagctcgtcggcttcatctctggtattcccgtacacattgttgctaatggcaacaagattaagatggccgaaatcaacttcctctgtgttcacaagaaacttagagcaaaccgtcttgctccagttcttattaaggaagtcaccagaagagtccacgttagaaacatgtggcaagccgtctacactgctggtactctcattcctactccaattacccaggctaaatacttccacagaagtcttaaccctaagaagcttattgaggttaaattctcaagcttacccgcaaaatctaccatgtcaagaaccgtgaaacttttcaagcttcctgaagagccccaaatccccggtatcagactcatgaagaagaaggatgttgctggagttcacaagctcctcaacactcatctcgagaaatatgccgttcacatgaagttcagcgaggaggaagttaagcactggctcttgcctagagacggtgttatcacaacttacgttgttgagaaggataagcaaattaccgatttctgctcatactactctctcccatcttcaatccttcagagccccaagcacgacagacttaatgctgcttactcttactacaatgttgctaccactgtgcctttcaaggatttgatcagcgatgctctcattcttgctcttaaggatggattcgacgtattcaatgctttgaacatcatggaaaatgaggaagtattcaaggatcttaaattcagtcaaggagatggaaacttgcactactatctatataactggagactttctcgcgaattgaatcctgctgatattggtatcgttctcctgtaatcgctagggacaattatgaggatttcatgagtttcctaacacatattttgtcgcagttcacataaagttactatgtaatattttataacgaaaaggaaattgttctgaagtgatcaatcttgcgaaaaaaaaaaaaagaaaaaaaaaaaaaaaaa

SEQ ID NO: 4586 - protein, 1450 aa, Glycine max
  misc_feature: PFam Name: NMT_C; PFam Description: Myristoyl-CoA:protein
  misc_feature: PFam Name: NMT; PFam Description: Myristoyl-CoA:protein
  misc_feature: GI Number: 13924514; NR Description: N-myristoyltransferase-like protein [Arabidopsis thaliana] >gi|21593140|gb|AAM65089.1| N-myristoyl transferase [Arabidopsis thaliana] >gi|20259207|gb|AAM14319.1| putative N-myristoyl putative
  misc_feature: GI Number: 34910442; NR Description: putative N-myristoyl transferase [Oryza sativa (japonica cultivar-group)] >gi|20804654|dbj|BAB92343.1| putative N-myristoyl transferase
  misc_feature: GI Number: 45510867; NR Description: N-myristoyl transferase
  misc_feature: GI Number: 50760631; NR Description: PREDICTED: similar to
  misc_feature: GI Number: 23509348; NR Description: N-myristoyltransferase [Plasmodium falciparum 3D7] >gi|6581106|gb|AAF18461.1| N-myristoyltransferase [Plasmodium falciparum] >gi|23497192|gb|AAN36739.1| N-myristoyltransferase [Plasmodium
AAAATGACCAGGATGCTATTCCCCCAACTGGGTTTCCAAGTGATTTCAACCAAAAGGATCTTGCCCGATTCATGCAAAATATGAAGCCTGGCACAAATCCTTTCGCCTTGATGGAAAAATACCAAGATATAAACAAGCCTCATATTTTCTGGAGAGAGCAACCTGTGCCTAAGATTAGTGATATTCCGGGCCAACAACCAGAAGGAGAGATCGACCCAGACCACGACCTCGAAAAGGTTCCTAAAACCCCCTTCGCCCTCCTTTCTCAGTTCGAATGGAGCGATATTGATATCACCAAACCAGAACAACTGGAGGAGTTGTACAAGTTCTTGTATGAGAATTACGTTGAGGATGAAGATGGTATGTTCAGATTCGACTACTCAAAGGATTTCCTTCAATGGGCTCTTTCTCCTCCTGGATACTATCCTGAATGGTTGATTGGTGTTCGCGTTCAAAAGAGCAAGAAGCTCGTCGGCTTCATCTCTGGTATTCCCGTACACATTGTTGCTAATGGCAACAAGATTAAGATGGCCGAAATCAACTTCCTCTGTGTTCACAAGAAACTTAGAGCAAACCGTCTTGCTCCAGTTCTTATTAAGGAAGTCACCAGAAGAGTCCACGTTAGAAACATGTGGCAAGCCGTCTACACTGCTGGTACTCTCATTCCTACTCCAATTACCCAGGCTAAATACTTCCACAGAAGTCTTAACCCTAAGAAGCTTATTGAGGTTAAATTCTCAAGCTTACCCGCAAAATCTACCATGTCAAGAACCGTGAAACTTTTCAAGCTTCCTGAAGAGCCCCAAATCCCCGGTATCAGACTCATGAAGAAGAAGGATGTTGCTGGAGTTCACAAGCTCCTCAACACTCATCTCGAGAAATATGCCGTTCACATGAAGTTCAGCGAGGAGGAAGTTAAGCACTGGCTCTTGCCTAGAGACGGTGTTATCACAACTTACGTTGTTGAGAAGGATAAGCAAATTACCGATTTCTGCTCATACTACTCTCTCCCATCTTCAATCCTTCAGAGCCCCAAGCACGACAGACTTAATGCTGCTTACTCTTACTACAATGTTGCTACCACTGTGCCTTTCAAGGATTTGATCAGCGATGCTCTCATTCTTGCTCTTAAGGATGGATTCGACGTATTCAATGCTTTGAACATCATGGAAAATGAGGAAGTATTCAAGGATCTTAAATTCAGTCAAGGAGATGGAAACTTGCACTACTATCTATATAACTGGAGACTTTCTCGCGAATTGAATCCTGCTGATATTGGTATCGTTCTCCTGTAATCGCTAGGGACAATTATGAGGATTTCATGAGTTTCCTAACACATATTTTGTCGCAGTTCACATAAAGTTACTATGTAATATTTTATAACGAAAAGGAAATTGTTCTGAAGTGATCAATCTTGCGAAAAAAAAAAAAAGAAAAAAAAAAAAAAAAA

SEQ ID NO: 4587 - DNA, 1667 bp, Glycine max
  misc_feature (1)..(1667): Ceres cDNA ID no. 21995818
  misc_feature (1)..(1667): Ceres CLONE  ID no. 512958
  misc_feature (1)..(1667): Also known as  Ceres CDNA ID no. 23681478
gaacaaagaaatcttcaatttgaattccaatgggtgaagagcgatccgagatagtgttcttcgatgtggagaccagcgttccgacccgggcggggcagggttttgcgcttctggaattcggcgccattttggtttgccccaggacgctcacggagctccgcgattactccactctcgtccgcccagccaacctctccgtcatcacccccttgtccgagcgctgcaacggcatcaacgccgccgctgtctccgccgcccctaccttcgccgacattgctcacctcgtttacgacctcctccacgggaggatttgggcggggcataacatcataagattcgactgtgttcggattagagatgcgtttgctgagattaatcagccaccgcctgaacctaaggggaccattgactcgctggttttgttgactcaaaagtttggtagaagagctggtgacatgaagatggctactcttgctacttattttgggcttggacgccagacacataggagcttggatgatgttcggatgaatcttgaagtcctcaaatactgtgcaacagttctattcttggagtcaagtctcccagatatattcactgcaaatagttgggtttcaccaaatgctactacaagaagccgcagtaatgggaaatctccatcacagtggggcttattaaatattaataaagattctgtattatcatctcctgcaactgaatccaaagacaaaaatcgtccaataatttcttttgcattgagcagcccaaaagggaatgtctcgaatattgcagatcctaacatggatcaatcagatccttttaacttgagcactcttgaggctgaaataaaaagagaatccattaagtcagatgtcgccttggaggaaaaacccatgcaagagtcaactgatttggcttcctcatcttctgtatctcagccttgcagcagctctattgctgttttggaacctgatggaatatgtataccttctattgatgcatctcttgttccatcttttcgtggcagtcaaagaatagagttactgcatgaaggtttcctgtttcagcttcattgtactgatttgaaagtgcggtttggaataaactcaaagttttttgatagtgctggccggccacgattgagttttgtggttgatccatcaccaagtctatgtaatgttcttgatgcatgtgaccgtgtagcacagaagttaaccgtggattctggtagcagctctgattggaggcctgttgttattaggaaagaaggcttcttcaactatcctactgtcagattacacatacctactgcagtagtggcagacattgctatttatgccacggaaatatatcaaagagaatcatctggaacagtgcaaagacttctcttcagtaagtttgatgctgcagaacttggttccttgttcatgcctgggacatttgttgatgccgtcttctccttagatccgtatgattatcagcagaatgcagggattaaattagttgccaaaaaattgatcattcatagcaaatagaaggaaattgataattaagtataggttagttattacatgctaaggttgatagattaaatattggttatgctgtaaagttagttccatttcatgtttgtagttcaattgaggttcaaaaaaaaaaaaaaaaaa

SEQ ID NO: 4588 - protein, 501 aa, Glycine max
  misc_feature: PFam Name: Exonuc_X-T; PFam Description: Exonuclease
  misc_feature: GI Number: 42568689; NR Description: exonuclease family
  misc_feature: GI Number: 9757860; NR Description: exonuclease-like protein
  misc_feature: GI Number: 9759593; NR Description: exonuclease-like protein [Arabidopsis thaliana] >gi|15240840|ref|NP_196388.1| exonuclease
  misc_feature: GI Number: 23198160; NR Description: putative exonuclease [Arabidopsis thaliana] >gi|20466502|gb|AAM20568.1| putative exonuclease [Arabidopsis thaliana] >gi|25406343|pir||F96772 probable exonuclease F1M20.7 [imported] - Arabidopsis thaliana
  misc_feature: GI Number: 37534220; NR Description: putative exonuclease [Oryza sativa (japonica cultivar-group)] >gi|15451562|gb|AAK98686.1| Putative exonuclease [Oryza sativa] >gi|31432000|gb|AAP53699.1| putative exonuclease [Oryza sativa
MGEERSEIVFFDVETSVPTRAGQGFALLEFGAILVCPRTLTELRDYSTLVRPANLSVITPLSERCNGINAAAVSAAPTFADIAHLVYDLLHGRIWAGHNIIRFDCVRIRDAFAEINQPPPEPKGTIDSLVLLTQKFGRRAGDMKMATLATYFGLGRQTHRSLDDVRMNLEVLKYCATVLFLESSLPDIFTANSWVSPNATTRSRSNGKSPSQWGLLNINKDSVLSSPATESKDKNRPIISFALSSPKGNVSNIADPNMDQSDPFNLSTLEAEIKRESIKSDVALEEKPMQESTDLASSSSVSQPCSSSIAVLEPDGICIPSIDASLVPSFRGSQRIELLHEGFLFQLHCTDLKVRFGINSKFFDSAGRPRLSFVVDPSPSLCNVLDACDRVAQKLTVDSGSSSDWRPVVIRKEGFFNYPTVRLHIPTAVVADIAIYATEIYQRESSGTVQRLLFSKFDAAELGSLFMPGTFVDAVFSLDPYDYQQNAGIKLVAKKLIIHSK

SEQ ID NO: 4589 - DNA, 1432 bp, Glycine max
  misc_feature (1)..(1432): Ceres cDNA ID no. 21995819
  misc_feature (1)..(1432): Ceres CLONE  ID no. 513046
  misc_feature (1)..(1432): Also known as  Ceres CDNA ID no. 24428110
aaattaaagcgcaaaaaccattctccttcggtgctcttgaaaacatgggaaaacagagcacagaattctctgccctcaactgcatcgacctctccaaccctgacatcaaccaatccgtcaatttactcaaacaggcatgtttggattccggttttttctacgttgtcaatcatggaataagccaggaattcatggaagaggtttttgcacagagcaagaaattcttctctcttcctcacaaggagaagatgaagattctcaggaatgaaaaacacaggggatacacccctgttcttgatgagttgcttgatcctgaaaaccaagtgcatggagactacaaagaggggtattatattggagttgaaaaaggtgaagatgacccagaatcgaataaacctttttatggaccgaataactggcccgcaccaggtgttcttccagggtggagggagaccatggaaaagttccatagagagacattagaagtagggaaagcagttgcaaagataatagcccttgcacttgatttggatgctaatttttttgatcagccagaaatgcttggagagcccattgcaactctgcgtttgctgcactatgaaggtcaagtttcggatcccttgaaaggattatatggagctggagctcatactgactatggtttaattacactgttagcaacagatgatgtctcgggtcttcaaatatgcaaagatagggatgctaaacctcagaaatgggaggatgtagcaccattgaagggagcattcatagtgaatcttggtgacatgctggagcgctggagcaactgcgtttttaagtccacactgcacagagttctaggaaacggtcaaggaagatattctattgcatacttcttggagcccagtcatgattgtctagtggagtgcttgcctacctgcaaatcagacagtaatccgcccaaatttcctcccatcttatgccatgactacctaactcagcgctacaacgacactcatgctgacttgaatgtttataagaaacaacaagcttgagtagtcaacctttggaactgaacagcctggagatttctcacaaggacactcacctaagctgatttggatgtttacaataaacaacatgcttaagaagttagtcttttggagctgagcagctggggaattttggactgcattatgtgttagagttaacagcatcatattgcattggcgatgttatgtagaatttgtttgaatggcaaattagttttgttttgtggaaggggggattcagctgtatggtttggtacttaatgttaaacctaaaagaaaaacatgtatgaaattagcagatgtattttttttattcagcactaaagttgggaaatgggaatgataggaagatgaaaaatgaaaattagtattttgctttcaaaaaaaaaaaaaaaaaa

SEQ ID NO: 4590 - protein, 330 aa, Glycine max
  misc_feature: PFam Name: 2OG-FeII_Oxy; PFam Description: 2OG-Fe(II)
  misc_feature: GI Number: 55771340; NR Description: putative oxidoreductase [Oryza sativa (japonica cultivar-group)] gi|55771331|dbj|BAD72256.1| putative oxidoreductase [Oryza sativa
  misc_feature: GI Number: 12320957; NR Description: hyoscyamine 6-dioxygenase hydroxylase, putative [Arabidopsis thaliana] >gi|15219523|ref|NP_174753.1| oxidoreductase, 2OG-Fe(II) oxygenase family protein [Arabidopsis thaliana]
  misc_feature: GI Number: 42565662; NR Description: oxidoreductase,
  misc_feature: GI Number: 42565664; NR Description: oxidoreductase,
  misc_feature: GI Number: 37536200; NR Description: putative gibberellin 20-oxidase [Oryza sativa (japonica cultivar-group)] >gi|27311281|gb|AAO00707.1| putative gibberellin 20-oxidase [Oryza sativa (japonica cultivar-group)]
MGKQSTEFSALNCIDLSNPDINQSVNLLKQACLDSGFFYVVNHGISQEFMEEVFAQSKKFFSLPHKEKMKILRNEKHRGYTPVLDELLDPENQVHGDYKEGYYIGVEKGEDDPESNKPFYGPNNWPAPGVLPGWRETMEKFHRETLEVGKAVAKIIALALDLDANFFDQPEMLGEPIATLRLLHYEGQVSDPLKGLYGAGAHTDYGLITLLATDDVSGLQICKDRDAKPQKWEDVAPLKGAFIVNLGDMLERWSNCVFKSTLHRVLGNGQGRYSIAYFLEPSHDCLVECLPTCKSDSNPPKFPPILCHDYLTQRYNDTHADLNVYKKQQA

SEQ ID NO: 4591 - DNA, 1467 bp, Glycine max
  misc_feature (1)..(1467): Ceres cDNA ID no. 21995820
  misc_feature (1)..(1467): Ceres CLONE  ID no. 513694
  misc_feature (1)..(1467): Also known as  Ceres CDNA ID no. 23681611
gaccatgacggtcgccagcaccaagagactcttcaagatcacgctctctctcctccgcctcggcttcaactcctccaaatgcaaaacggcagccaagatggccgtggccaggatcaagctgctgaggaacaagcgagaggtggtcgtgaggcagatgcgtcgcgacattgctcttcttctccagtctggtcaagacgccaccgctcgcatcagggttgagcatgtcatgagagagcaaaatgttttggctgcaaatgagttcattgaactcttctgtgaattagtggtggccaggctcgcaatcatttcaaagcaaaaggaatgtccagcagatttgaaagaaggaattgctagcttgatatttgcagcccctaggtgctctgaaatcccagaacttgtggcacttaagaatatctttgagaagaaatatgggaaagattttgtatctgcagctgttgatctaagacctagctgcggtgtaaatcgccagttgatcgaaaagctctcagtacgaacaccacctggtgaagtaaaattgaaagtgttgaaggaaatagctaaggaacatcatattgattgggatactacagatagcgagaaagaacttctcaagcctccagaagagctaatagtagggccaagtgcttttgtcagtgccagcagcctaccagtgaagccttctacagttatgtcggtggattcaaataaacccgctactagattatcgaggggtggaaaacccgatgccgagcattacaaagattctaagtctgctgccgaagcagcagctgaggcagctaagcaagcaattgctgctgctgaagttgctgcttatatgactatgaaggactataataatgaagctcctcaaccatatgcttacaatgataagttgtataactcaggagtcaactctgggaccttccaatcaaacaatcctgcaaaatgcaccctgaacatgacacctaaatctttaactgaggagaaaatgtacaggtcacagagcttaccaagatctgatcatatgaacaatgaggaggatgcattgcctaaccaatatggtggaaatgattataggaggcacagctaccatccagcttccgcacattcagatattaagtttgatgaatcaagttgtgatgaagaaattgaagcagaagagcctcctccggttactatgccccctaatcggcttccaccaccggtaccctcatctctggctaaacaggaaagccacattcgtgttcatcccaaattgccagattatgatgaacttgctgcccgctttgatgcactaaaattcaagaagtcacaatcctgaacccactttagcaaccaaccgtttatgaatctattaaattaatttatacacaataaatacatataagaatagtatattttgttatatagagatactaagaatgtattggatgctaaactttgctatgcaaaaaaaaaaaaaaaaaa

SEQ ID NO: 4592 - protein, 1467 aa, Glycine max
  misc_feature: GI Number: 33589706; NR Description: At1g34220 [Arabidopsis
  misc_feature: GI Number: 21595428; NR Description: unknown [Arabidopsis thaliana]
  misc_feature: GI Number: 34910388; NR Description: P0692C11.15 [Oryza sativa (japonica cultivar-group)] >gi|19571094|dbj|BAB86519.1|
  misc_feature: GI Number: 56784921; NR Description: MAPK activating
  misc_feature: GI Number: 34222084; NR Description: At2g19710 [Arabidopsis
GACCATGACGGTCGCCAGCACCAAGAGACTCTTCAAGATCACGCTCTCTCTCCTCCGCCTCGGCTTCAACTCCTCCAAATGCAAAACGGCAGCCAAGATGGCCGTGGCCAGGATCAAGCTGCTGAGGAACAAGCGAGAGGTGGTCGTGAGGCAGATGCGTCGCGACATTGCTCTTCTTCTCCAGTCTGGTCAAGACGCCACCGCTCGCATCAGGGTTGAGCATGTCATGAGAGAGCAAAATGTTTTGGCTGCAAATGAGTTCATTGAACTCTTCTGTGAATTAGTGGTGGCCAGGCTCGCAATCATTTCAAAGCAAAAGGAATGTCCAGCAGATTTGAAAGAAGGAATTGCTAGCTTGATATTTGCAGCCCCTAGGTGCTCTGAAATCCCAGAACTTGTGGCACTTAAGAATATCTTTGAGAAGAAATATGGGAAAGATTTTGTATCTGCAGCTGTTGATCTAAGACCTAGCTGCGGTGTAAATCGCCAGTTGATCGAAAAGCTCTCAGTACGAACACCACCTGGTGAAGTAAAATTGAAAGTGTTGAAGGAAATAGCTAAGGAACATCATATTGATTGGGATACTACAGATAGCGAGAAAGAACTTCTCAAGCCTCCAGAAGAGCTAATAGTAGGGCCAAGTGCTTTTGTCAGTGCCAGCAGCCTACCAGTGAAGCCTTCTACAGTTATGTCGGTGGATTCAAATAAACCCGCTACTAGATTATCGAGGGGTGGAAAACCCGATGCCGAGCATTACAAAGATTCTAAGTCTGCTGCCGAAGCAGCAGCTGAGGCAGCTAAGCAAGCAATTGCTGCTGCTGAAGTTGCTGCTTATATGACTATGAAGGACTATAATAATGAAGCTCCTCAACCATATGCTTACAATGATAAGTTGTATAACTCAGGAGTCAACTCTGGGACCTTCCAATCAAACAATCCTGCAAAATGCACCCTGAACATGACACCTAAATCTTTAACTGAGGAGAAAATGTACAGGTCACAGAGCTTACCAAGATCTGATCATATGAACAATGAGGAGGATGCATTGCCTAACCAATATGGTGGAAATGATTATAGGAGGCACAGCTACCATCCAGCTTCCGCACATTCAGATATTAAGTTTGATGAATCAAGTTGTGATGAAGAAATTGAAGCAGAAGAGCCTCCTCCGGTTACTATGCCCCCTAATCGGCTTCCACCACCGGTACCCTCATCTCTGGCTAAACAGGAAAGCCACATTCGTGTTCATCCCAAATTGCCAGATTATGATGAACTTGCTGCCCGCTTTGATGCACTAAAATTCAAGAAGTCACAATCCTGAACCCACTTTAGCAACCAACCGTTTATGAATCTATTAAATTAATTTATACACAATAAATACATATAAGAATAGTATATTTTGTTATATAGAGATACTAAGAATGTATTGGATGCTAAACTTTGCTATGCAAAAAAAAAAAAAAAAAA

SEQ ID NO: 4593 - DNA, 1707 bp, Glycine max
  misc_feature (1)..(1707): Ceres cDNA ID no. 21995821
  misc_feature (1)..(1707): Ceres CLONE  ID no. 514055
  misc_feature (1)..(1707): Also known as  Ceres CDNA ID no. 24366364
gagcaaggcccatcatcacatcacaacttcccaacccaaccacccagaaaaaaacacacaaaagccaaattttgacgtttcctttcctctttctttcccttttcctcgtttccacgaccctctcgaattcttgagacgtttcccgaatcttcactacgcacgtttctgaaactatataatatctaaaatcccttcacttcccattcctaaaacctcttacaaaaaccgtacaacaaggttgtttttgttttgttttgtgttttctctctaatcattcgaatggccaaagaaggacctaactgggacgggttgctgaaatggagcattgctcactccgatgggactagccctactcgcaatttaagtgaggaggatcgaaaatggtttatggaagcgatgcaagcacagaccattgatgttgtaaaacgtatgaaagagatcacacttgtgatgcaaactccagaacaagtattgaaagaccaaggagttacccctgcagacattgaagatatgttggaagagttgcaagagcatgttgagtcgattgacatggccaatgatctccactcaattggtggtttggttcctcttcttggttacctaaagaattctcatgccaatattcgagcaatggctgctgatgttgtgaccacaatagtccagaataatcctcgaagtcagcaacttgttatggaagcaaatggctttgaacctcttatttctaattttagttcggatcctgacgtgactgttagaactaaagcactgggtgcaatatcttcactaattcggcacaacaaaccaggcattactgcatttcgtttggcaaatgggtatgcagctttgaaagatgctctagcctctgaaaatgtgagatttcaaaggaaagctctcaacttgatccattacctgttgcatgagaataattcagactgcaacatcgtgaacgagcttgggtttcctcgaatgttgatgcaccttgcctcaagtgaagattcagatgtgagagaagctgcccttcgtggccttctccagcttgctcacaatgcgaaagatggcaaggatggcaatgagaaagacagtgcgaaaataaagcaacttcttcaagaacgaataaacaacatcagtttaatgtcagctgaggaccttggtgtagtcagggaggagaggcaacttgtggactccctgtggagaacttgcttcaacgagccgtcttctcttcgagagaaaggtcttctagtgcttccgggggaggacgtgccccctccagatgttgctagcaaatattttgagcctcctcttagatcttcgactgcaaatccatcttcaaagaaagacccagaaaagaatgagatccctttgcttttagggtcaggaccttctcctacatacactaacaaccaaggttcaaataaaggagatgctagttcatagacagatgctaatatatcgaaagtttaaatgctttatgttctgttttttataccatgctttctttctatcttatcatacaatagtaatttctttctttcacttataggctatgtttttaaccctttcttctggcctcagattggttttccctagtatttctaggatgatgatctcatggtatgttacactgtgacactataactagccctccattgtagtttgttaatgtatgattgcagcggtgaatgccttcaagaaaaaaaaaaaaaaaaa

SEQ ID NO: 4594 - protein, 384 aa, Glycine max
  misc_feature: PFam Name: Arm; PFam Description:
  misc_feature: PFam Name: HEAT; PFam Description: HEAT repeat
  misc_feature: GI Number: 21553998; NR Description: unknown [Arabidopsis thaliana]
  misc_feature: GI Number: 34897412; NR Description: putative Hsp70 binding protein [Oryza sativa (japonica cultivar-group)] >gi|27545051|gb|AAO18457.1| putative Hsp70 binding protein [Oryza
  misc_feature: GI Number: 29436427; NR Description: Zgc:55259 protein [Danio
  misc_feature: GI Number: 48105781; NR Description: similar to
MAKEGPNWDGLLKWSIAHSDGTSPTRNLSEEDRKWFMEAMQAQTIDVVKRMKEITLVMQTPEQVLKDQGVTPADIEDMLEELQEHVESIDMANDLHSIGGLVPLLGYLKNSHANIRAMAADVVTTIVQNNPRSQQLVMEANGFEPLISNFSSDPDVTVRTKALGAISSLIRHNKPGITAFRLANGYAALKDALASENVRFQRKALNLIHYLLHENNSDCNIVNELGFPRMLMHLASSEDSDVREAALRGLLQLAHNAKDGKDGNEKDSAKIKQLLQERINNISLMSAEDLGVVREERQLVDSLWRTCFNEPSSLREKGLLVLPGEDVPPPDVASKYFEPPLRSSTANPSSKKDPEKNEIPLLLGSGPSPTYTNNQGSNKGDASS

SEQ ID NO: 4595 - DNA, 1833 bp, Glycine max
  misc_feature (1)..(1833): Ceres cDNA ID no. 21995822
  misc_feature (1)..(1833): Ceres CLONE  ID no. 514881
  misc_feature (1)..(1833): Also known as  Ceres CDNA ID no. 24727121
atttctctccctccctctcaacacattttctcgggtcgggtcgtgcattctcggagcatcgccggaatcctttccgaccgaaaaagaaaaataatgacgggatccctcgcggcaaggctcgtccttcgtcgttgccgatcgccggcaagtcaattcttcttccgcagggaagcctcctggccggcgacggagcgaacgacaaaggacgtcgttacgtcgccgccgaaggaattgccggcgttcgactactctccgccggcgtactccggtccctcccgcgacgagatcatcgcgaagcgccgggagtacctcagcccttcgatcttccacaactacaaatctccgctgaacgtggtggaggggaagaggcagtacctgttcgacgataagggaaggaggtatctcgacgcgttcggagggattgctacggtgtgctgcgggcactgccaccccgatgtggtggaggccatcgtggaacaaacgaagcggttgcagcactccacagttctgtacctgaaccatgccataacggattttgctgaggctttggctgctaagcttcccggtaatcttaaggtggcattttttacaaattctggaacggaagcaaacgaattggcaatactgatagcaaaattgtacactggctcccatgacataatatctctaaggaattcttaccatgggaatggtggtggaacgatggggaccacagctcaaagcatttggaaatataatgttgtgcagagtggtgttcatcatgcggtgaatccagacccttatcgaggccttttcggttctgatggagagaagtatgtaagagatgttcaagaaatcattaattttggaacttccggaaatgttgcagctttcatatctgaagcgatacagggagtagggggcatcgttgaactggctcctggttacttgcctgctgcctacgatattgttagaaaagctggaggtctttgcattgccgacgaggttcagacgggaattgctcgcaccggtagccatttctggggatttgaggcccatggtgttgtacctgacatagtaacaatagcaaagagcattggaaacggcattcctcttggtgctgttgtgacaactcctgagattgcgaaggcattgactcgccggagttacttcaacacctttggtgggaatcctgtttgcactgctgcaggattggctgttttgagagtgatagagaaagagaagcttcaagaaaatgcttttgtagtgggttcctatttgaaagagagactcaatgcactcaaggacaaatatgaattaattggtgatgttagaggaagaggcatgatgcttggagttgaacttgtcagtgatggcaaacttaaaacaccagcacaaagtgaaacactgcatgtgatggaccaaatgaaagaattaggagtgctgattggaaagggtggctattatggaaatgtattcagaattacaccacccctatgtttcaccaaagaagatgcagacttccttgtggatgcgatggactacacattttccagaatgtgaagcttaaaataagaactaagtgtaaataaatctctattttacataatcatgttaagtaaactgtattaggttgatgcttggtttcatgctggcgccacaaaagtcacattttttatgtagaaatctggaggctacaaagagttgtggtgagattgaatgtgaaaaaaataattgtatccctttcaccacaccgcaggaaccaaacacaccagtataccatctatttagattgtagcaagtcaagtttataaattttacatggaagcttagtccaaaaaaaaaaaaaaaaaa

SEQ ID NO: 4596 - protein, 482 aa, Glycine max
  misc_feature: PFam Name: Aminotran_3; PFam Description: Aminotransferase
  misc_feature: GI Number: 25141217; NR Description: At4g39660/T19P19_50 [Arabidopsis thaliana] >gi|15809992|gb|AAL06923.1| AT4g39660/T19P19_50 [Arabidopsis thaliana] >gi|18420498|ref|NP_568064.1| alanine--glyoxylate
  misc_feature: GI Number: 5731259; NR Description: alanine:glyoxylate
  misc_feature: GI Number: 6403506; NR Description: putative aminotransferase [Arabidopsis thaliana] >gi|20466700|gb|AAM20667.1| putative aminotransferase [Arabidopsis thaliana] >gi|15231974|ref|NP_187498.1| alanine--glyoxylate
  misc_feature: GI Number: 52353685; NR Description: putative aminotransferase [Oryza sativa (japonica cultivar-group)] >gi|52353616|gb|AAU44182.1| putative aminotransferase class-III
  misc_feature: GI Number: 15028237; NR Description: putative
MTGSLAARLVLRRCRSPASQFFFRREASWPATERTTKDVVTSPPKELPAFDYSPPAYSGPSRDEIIAKRREYLSPSIFHNYKSPLNVVEGKRQYLFDDKGRRYLDAFGGIATVCCGHCHPDVVEAIVEQTKRLQHSTVLYLNHAITDFAEALAAKLPGNLKVAFFTNSGTEANELAILIAKLYTGSHDIISLRNSYHGNGGGTMGTTAQSIWKYNVVQSGVHHAVNPDPYRGLFGSDGEKYVRDVQEIINFGTSGNVAAFISEAIQGVGGIVELAPGYLPAAYDIVRKAGGLCIADEVQTGIARTGSHFWGFEAHGVVPDIVTIAKSIGNGIPLGAVVTTPEIAKALTRRSYFNTFGGNPVCTAAGLAVLRVIEKEKLQENAFVVGSYLKERLNALKDKYELIGDVRGRGMMLGVELVSDGKLKTPAQSETLHVMDQMKELGVLIGKGGYYGNVFRITPPLCFTKEDADFLVDAMDYTFSRM

SEQ ID NO: 4597 - DNA, 979 bp, Glycine max
  misc_feature (1)..(979): Ceres cDNA ID no. 21995823
  misc_feature (1)..(979): Ceres CLONE  ID no. 514911
  misc_feature (1)..(979): Also known as  Ceres CDNA ID no. 24366700
gagaccgttatacaagtgtgagaaaaattccatgtcttagattatactctccagtgagagagttatggcaaatgctggaaatctgatatcatcaaggaactttaatccaataatattcaatccataccactatgcaactaagctcaaaaccttgaggttgctctctcggtttcactcttacaacaataatgccactgtcactgcttccaaaaaaaaggatgacttgcaatctccattgattgggaagaacacgagcagggctcctcgccgtctgatcacaatatcaccaggtgatggcaaatatcatggggattggacttgtgactatcgcgtctctttgcacgacctagagttacaggatttgattgaagatgataataactcacgtaaggatgctcaagttttcatcaatctctctatccaaaagcatgctagctttggtttatcggtggatggaagagtcaccacatccttcactagaaaatgtagcacctgttcttctccgtattgccgacagattgatgcaaaatttaacgtatgggttcttatagcacgtagagatgaccgcaagataccgctacctgatattggaggtgaccctaatgtgatttatgttagaccgggatacgaagttgatcttgattctcttgtacaagatgccatccgattaaactctgtagtaaaagatacttgctcagaattgtgcgagaaatctgagggtacaatacaatatataactggacaaggccaagcttctgttgataaaaggtggtcaagactattggaactaaagaaagaaaatttatgatctatagtacaatgtaagaagttttatatatagaataatagtcagtttgcaaatagattggataatttgtcttacttagttttgcatgtgtatacctctgcagacattggataatatattttacgaaacaattcagctttttagaccttcaagcaaaaaaaaaaaaaaaaa

SEQ ID NO: 4598 - protein, 247 aa, Glycine max
MANAGNLISSRNFNPIIFNPYHYATKLKTLRLLSRFHSYNNNATVTASKKKDDLQSPLIGKNTSRAPRRLITISPGDGKYHGDWTCDYRVSLHDLELQDLIEDDNNSRKDAQVFINLSIQKHASFGLSVDGRVTTSFTRKCSTCSSPYCRQIDAKFNVWVLIARRDDRKIPLPDIGGDPNVIYVRPGYEVDLDSLVQDAIRLNSVVKDTCSELCEKSEGTIQYITGQGQASVDKRWSRLLELKKENL

SEQ ID NO: 4599 - DNA, 1142 bp, Glycine max
  misc_feature (1)..(1142): Ceres cDNA ID no. 21995825
  misc_feature (1)..(1142): Ceres CLONE  ID no. 515346
  misc_feature (1)..(1142): Also known as  Ceres CDNA ID no. 25088214
aaacagattttatttgaacaaatgcaaaaagtcgccctttgtgctctcgtcggtgtagcctctgccacccaacaaaagatggacctcactcctctttgggaagcctggaaatacaaacacgctaaagtttactccgaagtcgaagaagccatcagattcgctattttctccgacaatcaccacaaaattactaaaatgaaccaagaaaacaacgatgtcaagtttgccatcaacaagtttgctgacctcactgccactgaattcaaggccacctatgctggatgtggtctccctgaattcaaccaggaatttgttgaagaaaacacttacgaaccctatacctatggtgatctccctgcttctgttgactggagaagcaaaggcgctgttaccccagttaagaatcaagcacaatgtggctcatgctggaccttctctactactggtgctttggaaggtctttatgaaatcgataatggtcaacttttgtctttctctgaacaacaaattgttgattgtgctactgatgccggacaaggttgcggaggtggctggccctatttggctatagaatatgccattaagtatggtcttgaaactgaagctgattatccttacactggtgctgatggacaatgccattatgatgctagcaaggctcataagattgcttccagctactcctttgttaccacaaagagcactaatgcccttaagactgctttggttaaccaacctgtgtcagttcttattgaagctgatcaatcttcattccaattctatagttctggtgttatctcaactggttgcggcgctcaacttgaccatgctgttttggctgttggttatgataagcaaggagttcttgaagctttcatcgtaaagaactcttggggagctgattggggtgagcaaggttacgtttacatttctactattcaaactttgaatagcggtgctggtgcttgcggtatcctcagtcaacctgttgttcccaataagtaaagggggctagcttaaatatgaaaagtaaagcttaatacaaatttaataagaaactttatatttaactttatgaagattgaagtgaagtataatagtattgctattgcataagataatttaaaaaaaaaaaaaaaaaa

SEQ ID NO: 4600 - protein, 327 aa, Glycine max
  misc_feature: PFam Name: Peptidase_C1; PFam Description: Papain family
  misc_feature: GI Number: 2511693; NR Description: cysteine proteinase precursor [Phaseolus vulgaris] >gi|7435791|pir||T12041 cysteine
  misc_feature: GI Number: 30141019; NR Description: cysteine protease-1
  misc_feature: GI Number: 19548039; NR Description: F2G19.31/F2G19.31 [Arabidopsis thaliana] >gi|14517542|gb|AAK62661.1|
  misc_feature: GI Number: 22136972; NR Description: putative cysteine proteinase RD21A [Arabidopsis thaliana] >gi|18175926|gb|AAL59952.1| putative cysteine proteinase RD21A [Arabidopsis thaliana] >gi|435619|dbj|BAA02374.1| thiol protease cysteine protease,
  misc_feature: GI Number: 62320725; NR Description: cysteine proteinase
MQKVALCALVGVASATQQKMDLTPLWEAWKYKHAKVYSEVEEAIRFAIFSDNHHKITKMNQENNDVKFAINKFADLTATEFKATYAGCGLPEFNQEFVEENTYEPYTYGDLPASVDWRSKGAVTPVKNQAQCGSCWTFSTTGALEGLYEIDNGQLLSFSEQQIVDCATDAGQGCGGGWPYLAIEYAIKYGLETEADYPYTGADGQCHYDASKAHKIASSYSFVTTKSTNALKTALVNQPVSVLIEADQSSFQFYSSGVISTGCGAQLDHAVLAVGYDKQGVLEAFIVKNSWGADWGEQGYVYISTIQTLNSGAGACGILSQPVVPNK

SEQ ID NO: 4601 - DNA, 1331 bp, Glycine max
  misc_feature (1)..(1331): Ceres cDNA ID no. 21995826
  misc_feature (1)..(1331): Ceres CLONE  ID no. 515416
  misc_feature (1)..(1331): Also known as  Ceres CDNA ID no. 0
aagttgtcttttaaaaccttgtgtgtcttgtattgttttctggctctcccaaccatggaaggctggaaagctggtgccgatgccacactggcctcccctgacatcgacgccgacacggacgccgacggtcctttcttcgacttagagcttgccgtacccgattccgaagaagacgacactaatgataataacaacagtgactcagcctcagagaaagagttcaagttaacgctttctccttcaacttcaagcaatgatttcatcttcaactcccaacctaataactccaagcctcagttcactgcttcgctgttcaaatccgccaccaagttacgcgtcttcatgttgggcctcaagaagctcaagcccaacgcccctgccgctccaaacctcaagaagaaaaaacttttcaccgtcaaattcaaggcggaagagtatcccattgtgtccttgttctccagagataacagctccagacccaaagcctctcagaatcaccacacagacgaatcacaatcatcactctcagagacactttcttctgcttccgaggagaaacgcttaatgcgaaagtatttgaaaatggtgaagcctctgtacgtgagggtttctagaaggtccgagaaggtcgacgtgagttctcctgagtccgctgaagcttctacggtggcggagaagattccgacggtagcagaagattctgaaagtgccaacttgaagggtccgaagcaggggaatgttgctctgcctgcggctctacgcaagcatttaggaaagggccgttcggcggcggtggcggctccggcaccgccgtcggtgtcttcgaaacggcgtgatgattcacttttgcagcaacatgattggattcagggtgctattttacactgcaaaaactccttcaatgcttctaccgaatgcgagacttctcagctgccacgatcagtgagcgacatatctcctgaactatctgaaaattctaaagaatgacaagtgcctttgagatataatataatcaagtttcattgtctcaaggaccgaaggaaaatgttactacgtcagacccattgtgatggtgcttttgggaggaagaaggaaaaaaaaaaacatgtgaaagtgacaatagttgtttggctagggtggctcgtttttccttagtaattttatgtgtatttatgtatgtatattgtaaagctcttctttctgagagagtgaaagaaagaagaatcggatcttttttatgtagtatggtaccacagacaccacttttgaaacaacagtgcaatagaagtgaaaaattaggtttcgccaattccaaaaaaaaaaaaaaaaaa

SEQ ID NO: 4602 - protein, 310 aa, Glycine max
MEGWKAGADATLASPDIDADTDADGPFFDLELAVPDSEEDDTNDNNNSDSASEKEFKLTLSPSTSSNDFIFNSQPNNSKPQFTASLFKSATKLRVFMLGLKKLKPNAPAAPNLKKKKLFTVKFKAEEYPIVSLFSRDNSSRPKASQNHHTDESQSSLSETLSSASEEKRLMRKYLKMVKPLYVRVSRRSEKVDVSSPESAEASTVAEKIPTVAEDSESANLKGPKQGNVALPAALRKHLGKGRSAAVAAPAPPSVSSKRRDDSLLQQHDWIQGAILHCKNSFNASTECETSQLPRSVSDISPELSENSKE

SEQ ID NO: 4603 - DNA, 1154 bp, Glycine max
  misc_feature (1)..(1154): Ceres cDNA ID no. 21995827
  misc_feature (1)..(1154): Ceres CLONE  ID no. 515568
  misc_feature (1)..(1154): Also known as  Ceres CDNA ID no. 23682542
aaaatttatttttaaatataattttacaataattttttttaaggtatattagtactaaaaaaaatttgggatcttttttttttgaacctaaagccgttgtttgggccttaagccagcctgtcgctgaacatataagctattaacgaatgtcacacaataataatagagatcaaaaataaaattttaactttttgcgggatgaaaattacaagtaaaattataaggaaaaaaaaatcaaaattactaattttatagaaattaaaaatatatttaagtcaaattataaagatacacccacttttattacaatctcaaagcttttttacctaagaatataatgtcaaagaagatgaattcataattaatttgtaaactacagattaagtcgtcaccgtgtacgtgttttggtaaaattagcatgtactttatcacatttgtatgtttctatttgttgtattgttttgcagtgttagaggaacgatcgataggtacaagaaagcatgtgctgcctccacaaatccagaatctgtctctgaagctaatacacagttttatcagcaggaagcgtccaaattaaaacgacaaatcagagacattcagaatctaaacaggcacatccttggtgaagctcttagctctctgagtctgaaggaattaaagaacctggagagtagactggagaaaggtttaagcagagttagatccagaaagcatgaaactttgtttgccgatatcgagttcatgcaaaagcgggaaatagagctgcaaaaccataataattttctgagagctaagatagctgaacacgagaaagcacaacaacggcaacaggatatgataccgggaaatgtgtgcgagtcaaccatacctccacaatcatatgaccgcaatttcttccctgttaatctcatagattccaataatcaatattcaaatcaagaccagactgctcttcaacttgtcctttcaagtggtgtgggatcccttacatcgtcctatgtttcgtgaaggagagtgcccttagaaactcctctgctaaagttcttacaacggagaacaagagaaaaactaatcagcatttgtaccaatacatcatttgatattgtttatgtatctttcaatatatatagtttctattaaaaaaaaaaaaaaaa

SEQ ID NO: 4604 - protein, 189 aa, Glycine max
  misc_feature: PFam Name: K-box; PFam Description: K-box region
  misc_feature: GI Number: 62132641; NR Description: MADS box protein M8
  misc_feature: GI Number: 60100356; NR Description: MADS box protein AGL1
  misc_feature: GI Number: 16973296; NR Description: C-type MADS box protein
  misc_feature: GI Number: 14279306; NR Description: MAD-box transcripion
  misc_feature: GI Number: 33308109; NR Description: AGAMOUS-like protein
MFLFVVLFCSVRGTIDRYKKACAASTNPESVSEANTQFYQQEASKLKRQIRDIQNLNRHILGEALSSLSLKELKNLESRLEKGLSRVRSRKHETLFADIEFMQKREIELQNHNNFLRAKIAEHEKAQQRQQDMIPGNVCESTIPPQSYDRNFFPVNLIDSNNQYSNQDQTALQLVLSSGVGSLTSSYVS

SEQ ID NO: 4605 - DNA, 1414 bp, Glycine max
  misc_feature (1)..(1414): Ceres cDNA ID no. 21995828
  misc_feature (1)..(1414): Ceres CLONE  ID no. 515665
  misc_feature (1)..(1414): Also known as  Ceres CDNA ID no. 25088215
gagtggatgtgattatctgaattcagtgatgagggtgttgtcgttgagcccctccactttggctttgggtcgccactttctctgcaaaaccacctcacactcccacccttccctttccctcccacgcgccgcttccatctccgccactctcacgcgcccacccattcctcccaattcagatccccgcaggttccccttctcctccctcacctcttccaccaacactcccaacaacaatccctttctctctcactcccaaggtgctggtgctggtgctggcacgttcctttggaaccccgcttccgacaccccttacgccgcgctccacggaggcaaagaccgcgtcgccacggtggtgctgttggggtggcttggagcgaggaccaagcacctcaagaggtacgtcgagtggtacaattcgcgcggcattaacgcactcaccttcgtcgtcgacatcaaggagctgcttcgatttgacctcggccacgtgctcgagacccgaatctctctcctcgccgaccacctcgtttcttgggtgtcccgcgaggaacacgatgggagggaacgctgcctggtttttcacactttcagcaacacgggttggtttgtttatggttacattcttgcccgaatgctgggaagtgaggagctcatggagaagattaaaggatgcattgtggattcgggaggaggagaacctttcaatcctcaggtctgggctgccggtttttctgctgctatattgaagaagcgcatctctttaggacccatagtcgaggtagaaggcaagcttaaatcggagacagaagtcagcttgccaaagattgaacaaaaggaatcttcgacaatcgaaactttggtcttgtcactattagagaagttcttctcatttgttttgcagttgccagatgtgaaccagaggttaacaaggattgtcaatgtgctcatgaaacaccaaccttgtcctcagctttacctgtatagtacagctgacaaagtagttccatatcaatccatagaaacgttaattgaggagcagaggaagatgggaaagagggtaaggtcctttaacttcggcttatctccccacgtggatcattataggacatttccggacctatacttatcacaggtttctgaatttttgaaccaatgttttgccacgagcaaaccgacaacttacaagtcttaagttgcccattgaagtgtaaagtttttgcatagcagtccgaatgaaatttgcttcctttagttttctgagcggaatagcgattcattataacaagtacaaggagagaaatgaacagtggcaacacattacatacaagccattgacataatatattgaattgccgacagtgtctgccaattacacattagaatgattcttttgacgaaaaaaaaaaaaaaaaaa

SEQ ID NO: 4606 - protein, 387 aa, Glycine max
  misc_feature: GI Number: 21536700; NR Description: unknown [Arabidopsis thaliana]
  misc_feature: GI Number: 54291557; NR Description: integral membrane protein-like [Oryza sativa (japonica cultivar-group)] >gi|54291356|dbj|BAD62122.1| integral membrane protein-like [Oryza
  misc_feature: GI Number: 25411844; NR Description: probable integral
  misc_feature: GI Number: 50540342; NR Description: zgc:92204 [Danio rerio]
  misc_feature: GI Number: 55235749; NR Description: ENSANGP00000020918
MRVLSLSPSTLALGRHFLCKTTSHSHPSLSLPRAASISATLTRPPIPPNSDPRRFPFSSLTSSTNTPNNNPFLSHSQGAGAGAGTFLWNPASDTPYAALHGGKDRVATVVLLGWLGARTKHLKRYVEWYNSRGINALTFVVDIKELLRFDLGHVLETRISLLADHLVSWVSREEHDGRERCLVFHTFSNTGWFVYGYILARMLGSEELMEKIKGCIVDSGGGEPFNPQVWAAGFSAAILKKRISLGPIVEVEGKLKSETEVSLPKIEQKESSTIETLVLSLLEKFFSFVLQLPDVNQRLTRIVNVLMKHQPCPQLYLYSTADKVVPYQSIETLIEEQRKMGKRVRSFNFGLSPHVDHYRTFPDLYLSQVSEFLNQCFATSKPTTYKS

SEQ ID NO: 4607 - DNA, 809 bp, Glycine max
  misc_feature (1)..(809): Ceres cDNA ID no. 21995829
  misc_feature (1)..(809): Ceres CLONE  ID no. 516066
  misc_feature (1)..(809): Also known as  Ceres CDNA ID no. 24366675
ttcgtttcgtttcgttcccatggcggtctccgtttccgcgtcctccgcgattgcttctttgaactccgaactctccacgcgcttgccaccctcactcgcctccgcatcttcttccgccaagcaatcctttctgcaattcccgtcgtgcacgcgccttcttcggattagcactccacgcgctcccgctccatcgcgacctcgattccttcctctggttcaagcgaagaaacaaacctataactcgtttgacgatttgcttgccaattctgagaaacctgtgttggttgacttctatgcaacctggtgtggtccttgtcaatttatggttcccatactcaatgaagtaagcactcggcttaaggataagatacaggtggtgaagattgatactgagaagtatcctagcattgctgacaaatacagaattgaggccttgccgactttcatcatgtttaaggatggagaaccttatgatcgctttgagggagcattgactgcagatcagctcattgaacgcatagaagccggcctcaaggttaagcaataaccctactataatgaagacacaaagaagcttgtctattggaatgttcgatcacatacatgatatgattgactggaatcacttgtttcaacatcattcagacatttttgaagtgattaatgtatctcaaaatgcaaagattcagccctaaaatatttagtttaattagcagtggcattttttaaaaaaagaaatcacgactaaacctggttgagtttgtgagttccttgaacgagctaattcttgtctcaaaaaaaaaaaaaaa

SEQ ID NO: 4608 - protein, 175 aa, Glycine max
  misc_feature: PFam Name: Thioredoxin; PFam Description: Thioredoxin
  misc_feature: GI Number: 38604000; NR Description: At1g76760 [Arabidopsis thaliana] >gi|38454080|gb|AAR20734.1| At1g76760 [Arabidopsis thaliana] >gi|42563272|ref|NP_177802.2| thioredoxin family protein
  misc_feature: GI Number: 22135797; NR Description: At1g43560/T10P12_4 [Arabidopsis thaliana] >gi|48310619|gb|AAT41854.1| At1g43560 [Arabidopsis thaliana] >gi|30693659|ref|NP_175021.2| thioredoxin
  misc_feature: GI Number: 25406467; NR Description: thioredoxin-like protein, 49720-48645 [imported] - Arabidopsis thaliana >gi|6143893|gb|AAF04439.1| thioredoxin-like protein; 49720-48645
  misc_feature: GI Number: 57899183; NR Description: thioredoxin M-like
  misc_feature: GI Number: 48894708; NR Description: COG0526: Thiol-disulfide
MAVSVSASSAIASLNSELSTRLPPSLASASSSAKQSFLQFPSCTRLLRISTPRAPAPSRPRFLPLVQAKKQTYNSFDDLLANSEKPVLVDFYATWCGPCQFMVPILNEVSTRLKDKIQVVKIDTEKYPSIADKYRIEALPTFIMFKDGEPYDRFEGALTADQLIERIEAGLKVKQ

SEQ ID NO: 4609 - DNA, 1767 bp, Glycine max
  misc_feature (1)..(1767): Ceres cDNA ID no. 21995831
  misc_feature (1)..(1767): Ceres CLONE  ID no. 518530
  misc_feature (1)..(1767): Also known as  Ceres CDNA ID no. 23671390
gattcacacctccacactgtctctatcaccaatcccttatatcccccctccacttagcataccataattcaccgtcaatttccccattgatgatccatttggcatttcatcatatttcaccacttgtcctactccacttggataatttcctaacgtatagttttcaaaaatccttgttcttcatgagcttatagtttatgagtcctacgatttttggcaattcagcaacactatagatatatcttaggctaagagaagccttagcagcaactcaaatccaaaagtgtaagcctttcttcttgttattagtccatcttcaccaatggaagagaatatgaagtgtgaactagttggtctcattgatgagttaatgcaagggaaggagctagcaaagcagctttgtgaccatctagtctcattatcatcatcatcttctcatgaaacaaatgaagtcctaattgagaaaatactttccacctatgagaaagcacttgccatgctgaattgcaaggctaatgtaggagaaagtaaggccaacattaatggcagcatgatggattccccttgttctttcacaaatggtagccccaaaagtgaggtcatggagcctgagattaagaacaaagatgtctttaagaaaagaaagaccatgtcaacgtgcacagaacaagtgaaggtgtgcttgggaacggcgcatgaaggatctctggatgatggctatagttggagaaaatatggacagaaggatattctcggagctaagtttccaagaggatattacagatgcacatatagaaatgtacaaggatgtctggccacaaagcaggtgcaaaagtcagatgaagacccaatgatatgtgaaataacctacaaaggaagacacacatgcacccaagcaagtcacttaaacaaaacagtgatacccccatcaaagacaaaggtgaacttgttgggagaaaataagcaccaaacccatcaaattaagaatcaaccacggcaagagaaaatagaacaacaaccaccagagacatttttcacatttggatcatcatcaggtcttgaagttaaaatagaggacatcgaccacaaggagggcatattcccatcattttgcttttcttctccatcaatagtagggtcagaaaatggggacgacaacaacagcagcatattctcatacaccatgattgagaacaacttaatggaaagcttctctcctgccttcatatctccaacaacttcagatatagaatcaaacactttctgccactgggggagcactggactaggccaaagtgtgcaaagctcagggtctgatatcactgatatagtttcagcaccaacttcagtcaccaattcaccaataatggaccttgatttctttttcgataagatcgatttcgacacagatttccctttgagcaccatggaactttgcacttaataaattgtccccacttctaagtttacagcatatgtgatttctatgcggattaactgtgagttttgtagatcctgactagcaccataaccgagggaaggaagtctataataatcaccatagatcatgtccataaatgaagacaatgaaaaacttccctcttgtgctaattaagagagttttcatgtacctaggctgcaatgtgaaaataatttgtaggttgtagcttaatttggtgcatgtttggtttgcaatggaaattgttgtaatgcgcgttccaatgtagatcttatggataaaagtaaaacaaaaaaaaaaaaaaaaaa

SEQ ID NO: 4610 - protein, 373 aa, Glycine max
  misc_feature: PFam Name: WRKY; PFam Description: WRKY DNA -binding domain
  misc_feature: GI Number: 40846374; NR Description: putative WRKY
  misc_feature: GI Number: 30681651; NR Description: WRKY family transcription factor [Arabidopsis thaliana] >gi|24762209|gb|AAN64171.1| putative WRKY family transcription
  misc_feature: GI Number: 21436293; NR Description: putative WRKY-type DNA binding protein [Arabidopsis thaliana] >gi|19423942|gb|AAL87292.1| putative WRKY-type DNA binding protein [Arabidopsis thaliana] >gi|4559382|gb|AAD23042.1|
  misc_feature: GI Number: 46394402; NR Description: TPA: WRKY transcription
  misc_feature: GI Number: 50843966; NR Description: transcription factor WRKY31 [Oryza sativa (indica cultivar-group)] >gi|50252562|dbj|BAD28735.1| WRKY family transcription factor-like [Oryza sativa (japonica cultivar-group)]
MEENMKCELVGLIDELMQGKELAKQLCDHLVSLSSSSSHETNEVLIEKILSTYEKALAMLNCKANVGESKANINGSMMDSPCSFTNGSPKSEVMEPEIKNKDVFKKRKTMSTCTEQVKVCLGTAHEGSLDDGYSWRKYGQKDILGAKFPRGYYRCTYRNVQGCLATKQVQKSDEDPMICEITYKGRHTCTQASHLNKTVIPPSKTKVNLLGENKHQTHQIKNQPRQEKIEQQPPETFFTFGSSSGLEVKIEDIDHKEGIFPSFCFSSPSIVGSENGDDNNSSIFSYTMIENNLMESFSPAFISPTTSDIESNTFCHWGSTGLGQSVQSSGSDITDIVSAPTSVTNSPIMDLDFFFDKIDFDTDFPLSTMELCT

SEQ ID NO: 4611 - DNA, 1438 bp, Glycine max
  misc_feature (1)..(1438): Ceres cDNA ID no. 21995832
  misc_feature (1)..(1438): Ceres CLONE  ID no. 518816
  misc_feature (1)..(1438): Also known as  Ceres CDNA ID no. 24402917
attatcctcactcactcacaaacacatactcttcttcttcttccaatggcgctcactgcttcgctcgctaacaacgcatttctgaaaatcccaacactccatcatggcgaatgctcactgtcttcgtcatccttcatcggttctcggctcacactctcgcgctcttctactcttcaagggaaccaattgctttcgagaaagcaattcgtggttttcgcgaggaagatttcggggttggaggaggccatgaatatcagaagagaacgtgaagttcgagttgtgccaaagtttaagaaaaggcctccattaaggcgtgggagagtatcaccacatctccctgttcctgaccacataccaaggcctccttatgtaggttcagatatacttccagaaattgcaagtgagcatcaaattcatgattctgaaggtatagctaaaatgagggctgcaggtgagcttgcagcgcgtgtcttaaactttgcaggaactatggttaggccttccataacaactaatgagattgataaagcagtgcaccagatgataattgatgctggtgcttatccctcaccccttggctatggtggatttccgaaaagcgtgtgcacatcagttaatgagtgcatgtgccatggaatacctgattctcggcagttacagaatggtgatattattaacattgatgtgacagtctacctggatggatatcacggagacacgtcaaagacatttttttgtggggaagtcagtgatgaactgaaaaatcttgttaaggtaactgaagaatgcctggagaagggaatagctgcgtgcaaggacggtgctctctttaggaaaattggaaagagaatcagtgagcatgctgaaaagtatggctatggtgtagtggagcgttttgttgggcatggtgtgggaacagtgtttcattctgaaccaattattatacacaatcgcaatgagaaggcaggccgcatggttgaaggtcaaacatttacaattgagccgattctttcaatgggaagcattgattccattacatggccagacaactggacaacactaacagctgatggtagtccggctgcacagtttgagcataccattttgataactaagactggagccgaaattttgactacatgttgacatggtaattctttgtttaatccacattgatcatgttatgaaatatgaatatagtttgtgtctatgttgtaaatatgtgcccttaaatcaatttgcttctggaatattatgctctggcaagtaaagattgccttcagaagctgtataccaaattctttagtgcatagaattttcatatatgatggcaccagatatagaagacatagattcagcagtacatgtttctatcagagaatacaaactgtcaaaatgaaagttgaattggtagtctaataaaaaaaaaaaaaaaaaa

SEQ ID NO: 4612 - protein, 366 aa, Glycine max
  misc_feature: PFam Name: Peptidase_M24; PFam Description: metallopeptidase
  misc_feature: GI Number: 23306398; NR Description: methionine aminopeptidase I (MAP1), putative [Arabidopsis thaliana] >gi|25402759|pir||C86267 probable methionine aminopeptidase [imported] - Arabidopsis thaliana >gi|15222218|ref|NP_172785.1|
  misc_feature: GI Number: 11320956; NR Description: methionine
  misc_feature: GI Number: 50937627; NR Description: putative methionine aminopeptidase I (MAP1) [Oryza sativa (japonica cultivar-group)] >gi|34394646|dbj|BAC83953.1| putative methionine aminopeptidase I
  misc_feature: GI Number: 7939560; NR Description: methionine
  misc_feature: GI Number: 15230872; NR Description: metallopeptidase M24
MALTASLANNAFLKIPTLHHGECSLSSSSFIGSRLTLSRSSTLQGNQLLSRKQFVVFARKISGLEEAMNIRREREVRVVPKFKKRPPLRRGRVSPHLPVPDHIPRPPYVGSDILPEIASEHQIHDSEGIAKMRAAGELAARVLNFAGTMVRPSITTNEIDKAVHQMIIDAGAYPSPLGYGGFPKSVCTSVNECMCHGIPDSRQLQNGDIINIDVTVYLDGYHGDTSKTFFCGEVSDELKNLVKVTEECLEKGIAACKDGALFRKIGKRISEHAEKYGYGVVERFVGHGVGTVFHSEPIIIHNRNEKAGRMVEGQTFTIEPILSMGSIDSITWPDNWTTLTADGSPAAQFEHTILITKTGAEILTTC

SEQ ID NO: 4613 - DNA, 2176 bp, Glycine max
  misc_feature (1)..(2176): Ceres cDNA ID no. 21995833
  misc_feature (1)..(2176): Ceres CLONE  ID no. 518926
  misc_feature (1)..(2176): Also known as  Ceres CDNA ID no. 24365745
aattgttagtattttagacgagggagagatgtgcatatccaaatcctcttcaacccacttgctgcttctatctctcttcaacttgctaacatctgcaagtcaagcagctcctacatacagcgcacatgcctgctcggatgaaggatcccattaccgacccaacacaacattcgaaaccaacctcaacatccttctctcatccctcgtctccaacgccaccctccaccacggtttctaccgcacaaacgtctcccttggaacctccgatgaggtcaagggactcttcctctgccgcggtgacgtcaccccctccctctgtctcgactgcgtcaccgccgcagcaaaaaacatcacaaacttctgcaccaaccagacacagtccataatctggtacgacgagtgtatgctgcgttactccaacagttccaccctcgacaacatagtcccaagtgtcggcatgaagaacgaacagagcgtctccgactcggactacgcgcggttcaacgatgttcttgcgtccacgttaaatgatttaaagcaggaggccttgaactcttcttcttcgggtaagaagtttgctacaaaagaagcgaatttcacgagctcaatgaagctctacaccctggcgcagtgcacgcccgatttgtccacttctgactgcaacacgtgcttctcaagctccatcggtggctttccgaactgctgtgacggcaaacgaggtgcacgggtcctgcttcctggctgtagtgtcagatatgaactgtatcccttttacaatgtttcctccgtgtctcaccttccctctccatcttcagggaaaagcagtatctctataattgtggcgattgttgtcccaattgtttttgtgattcttctattcattgttggcgtctacttcctatgtaaaagggcaagcaagaagtataatacttttgtccaggattcaattgcggatgatcttaccgatgtcggcgatgtggagtccttgcagttcgacttggctacagttgaagctgccacagacagattctcagatgagaacaagattggccaaggtggatttggggtggtttataagggtgtcttccctaacggacaggagatagctgtgaagaggttgtcagtaacctccttgcagggtgctgtagagttcaggaatgaagctgctcttgtggccaagcttcaacatagaaatttagtgagactattgggattttgcttggagggacaagagaagatccttatctatgaatacataccaaacaaaagccttgatcgctttttatttgaccctgtaaagcaaagagagttagattggtcaagacgctacaagattattgttggcattgctcgaggaattcagtatttacacgaagattcccagcttagaattatacaccgtgatctcaaagctagtaatgttctattagatgaaaatatgaacccgaagatttcagattttggcatggcaaaaattttccaggcagatcagactcaagtaaatacaggaaggatagttgggacttatggttacatgtctccagaatatgcaatgcgtggacagttctctgtgaaatcagatgtgttcagctttggtgtcttagttttggagattgtgagtggcaagaagaacactgagttttatcaatcgaatcatgctgatgaccttttaagccatgcttggaagaattggacagagaaaacacctttggagttgctggatccaacactgagaggttcttattctagaaatgaagtcaacagatgcatccatattggtttattgtgtgttcaggaaaatccatctgacaggccttcgatggccactattgcacttatgctgaacagttattcagttaccatgtcaatgccacgacaaccagcatctcttctgcgcgggagaggtcctaacaggttaaaccgagggatggactctgattcgtctacctccaatcagtctaccacttgttcaattgcatggtctgtgaatgaagtatccattactgatttataccctcgctaaaggattgtttttcatgtttccttcaatcaatccagtgtatgtccaaatcttttcaaactttgatgttactcttaaacatacctaaaggatatatgttctaaatattaatggctaaaagaattctgtccctacttcaaaaaaaaaaaaaaaaaa

SEQ ID NO: 4614 - protein, 664 aa, Glycine max
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 42567050; NR Description: protein kinase family
  misc_feature: GI Number: 42567054; NR Description: protein kinase family
  misc_feature: GI Number: 7269160; NR Description: protein kinase-like protein [Arabidopsis thaliana] gi|3021265|emb|CAA18460.1| protein kinase-like protein [Arabidopsis thaliana] gi|3292839|emb|CAA19829.1| protein kinase-like protein
  misc_feature: GI Number: 26452014; NR Description: putative receptor-like protein kinase 5 RLK5 [Arabidopsis thaliana] >gi|30686066|ref|NP_849426.1| receptor-like protein kinase 5 (RLK5)
  misc_feature: GI Number: 22136670; NR Description: putative serine/threonine kinase [Arabidopsis thaliana] >gi|30686073|ref|NP_194046.2| protein kinase family protein
MCISKSSSTHLLLLSLFNLLTSASQAAPTYSAHACSDEGSHYRPNTTFETNLNILLSSLVSNATLHHGFYRTNVSLGTSDEVKGLFLCRGDVTPSLCLDCVTAAAKNITNFCTNQTQSIIWYDECMLRYSNSSTLDNIVPSVGMKNEQSVSDSDYARFNDVLASTLNDLKQEALNSSSSGKKFATKEANFTSSMKLYTLAQCTPDLSTSDCNTCFSSSIGGFPNCCDGKRGARVLLPGCSVRYELYPFYNVSSVSHLPSPSSGKSSISIIVAIVVPIVFVILLFIVGVYFLCKRASKKYNTFVQDSIADDLTDVGDVESLQFDLATVEAATDRFSDENKIGQGGFGVVYKGVFPNGQEIAVKRLSVTSLQGAVEFRNEAALVAKLQHRNLVRLLGFCLEGQEKILIYEYIPNKSLDRFLFDPVKQRELDWSRRYKIIVGIARGIQYLHEDSQLRIIHRDLKASNVLLDENMNPKISDFGMAKIFQADQTQVNTGRIVGTYGYMSPEYAMRGQFSVKSDVFSFGVLVLEIVSGKKNTEFYQSNHADDLLSHAWKNWTEKTPLELLDPTLRGSYSRNEVNRCIHIGLLCVQENPSDRPSMATIALMLNSYSVTMSMPRQPASLLRGRGPNRLNRGMDSDSSTSNQSTTCSIAWSVNEVSITDLYPR

SEQ ID NO: 4615 - DNA, 1253 bp, Glycine max
  misc_feature (1)..(1253): Ceres cDNA ID no. 21995834
  misc_feature (1)..(1253): Ceres CLONE  ID no. 519743
  misc_feature (1)..(1253): Also known as  Ceres CDNA ID no. 23680808
actgagtgaaaaaccacaacctagaaagaaatgaagaaaatacagcactctgaacaaaaagcaacggaaccaaccaaaaaggattcaaagggcaacaaacaagaaggcacagactcagagtcagagcaataccaaaacgaagaaaatcaactccacacgctttcggaaccatcaccatccttctctctccgttcccgcaaatccccttcgccaccactccactccctctctgactcccccatctccgatgcccacctctcccctgcgccgcagaagccgccgcccgattcctcgccggactcctcgatctccgacggccacttcacgatcggtgaacagcgcctctccccggcgccgccgaccgtggtgacggctcatcggttgaaggtggagcccgcggtgttgaccagggtcgatcccggcgccgaagagggtttcgtgaaagacgtcgaacaagccaccggcagcgccggtagtcgacgcctcagaccggatatgaccggtttgttgaggtcgaaaaaaatcgccacgtggagcaagctcttgctgggtcttcgagtaaccgcttttgttttctgcttggcgtctttctcggtgttggccactgataagaaacagggctgggctatcgactctttctatttatacaaggaattcaggtatagtttgtcagtgaatgttattgggtttgtgcattccgcgttgcagatatgtgatcttgggcggtactttgcaacgggaaagcacttggtggagcaccagctaaggggttatttcactttcgcgctggatcagatcttgacataccttctaatgtcagcatcatcatcagctgccactagagcttatgattgggtttccaattggggtgaggacaagttcccctacatggcaaatgcatctgtggctttgtccttggttgcttttgtggcctttgccttagcctctcttgtctctggttctattgttgtaaggttcacataatttatacaagtactatgtgtgaggtgtgcaaactcttatctgagatactggattaagctttatcctttctcgattgaaaatcgtcccatattttcagaaggcagactgactcactttgtacagaagggaaactcactttatttctctgtcaactttaatttgtatagatgcaggtggatttacagcttgctgaactggcttgtatatgaacttttgcattattgagatggtattaagcttacttttttatcaaaaaaaaaaaaaaaaaa

SEQ ID NO: 4616 - protein, 317 aa, Glycine max
  misc_feature: GI Number: 2598569; NR Description: MtN24 [Medicago truncatula]
  misc_feature: GI Number: 15241975; NR Description: integral membrane
  misc_feature: GI Number: 34911616; NR Description: P0039G05.10 [Oryza sativa (japonica cultivar-group)] >gi|20805120|dbj|BAB92791.1|
MKKIQHSEQKATEPTKKDSKGNKQEGTDSESEQYQNEENQLHTLSEPSPSFSLRSRKSPSPPLHSLSDSPISDAHLSPAPQKPPPDSSPDSSISDGHFTIGEQRLSPAPPTVVTAHRLKVEPAVLTRVDPGAEEGFVKDVEQATGSAGSRRLRPDMTGLLRSKKIATWSKLLLGLRVTAFVFCLASFSVLATDKKQGWAIDSFYLYKEFRYSLSVNVIGFVHSALQICDLGRYFATGKHLVEHQLRGYFTFALDQILTYLLMSASSSAATRAYDWVSNWGEDKFPYMANASVALSLVAFVAFALASLVSGSIVVRFT

SEQ ID NO: 4617 - DNA, 2411 bp, Glycine max
  misc_feature (1)..(2411): Ceres cDNA ID no. 21995836
  misc_feature (1)..(2411): Ceres CLONE  ID no. 521134
  misc_feature (1)..(2411): Also known as  Ceres CDNA ID no. 23683295
atgggatcatccccaattttgaggaaggtcccagatcttccctgagtagtgaagatttgagtggtgagagtgaaactagtgaaattcattatatgaatgttcctttgatttcaaagaatgatacagatttgtcgtttgaatctgtcaatgatgtgaatgtgaatgttcctttggttctagagaatgacatttactacactgaaccatcatttgaaactgagcctgattatgataaccttgaccctacttttaagcttagccccacttccactcatcccgtttttaagcttagccccactgccactcctccggtttcattgaaagccaccgttgtggctcctctggatgcggatcccttgatgcccccttatgaccccaaaaccaactacctctcccccagaccacagtttcttcactacaaaccaaaatctcgaatggaactctgcagggaaagggaattagaggacagcttcatatctggaagcttttcagatacagaagtcactgaggattcccagtctgaagtctcacagaaggaatcggaggatgcttcttcggatgaaactgttaaggaagaagagggtgaaatttctgaactaagtcctgctaggaggactctcatgccagaggaatctgttgaagaaaaagaagttccaaaaccacgcttcacagtgagagcaaaggctgtttctcttaccttgcttcttgcagttgcttttgtatcaatctcagtcacagtcacagatttacctgtgattgatcgaactgtgtttgaagacttctacaaggtttatgaatcatcagagttttcaggggctaattttgatctattcaaccagtttgcaaaaacaaattttgatgagatagctcgaaacttacaaatttggtttaccaagttgttgtcttcaacttctgagttcatttcagatgttagaggagcacacaatttggccaagttgcaatattataacttgaccattcagcacgattactccatggtggatcagtaccctatatttggtcgtggtgaaaatgaaataggtgagactcacgtaccagtatgggacgctgatgagagtgatgctgcctcagatattgacagtgatgaggttgttgagggggatattctggaggagcattatgaagtgtatgaagaacaagttcagcaagatattgcaacaattactggagttgaaaatattatggatgctccagaatctgaggaagtactcaatatgatcgaatcagagcaactggctgaagcaggaaatttagaagcaacgattgcacaagaagctgaggctaacttaaatgttgaaaatcagccaagcttgaattcagaggttgctgaaatctgtgttgaagcgtatgagtcagatacaaagcaggcacaagaaaaggatgctaaactcaatgtcaatgagcaaagtgacataagtttagattcagatgttgctgccgtgaacgatgatgtagcaaaggaaaaatcagtaagcatagatgctgcaattaaagggaatgaagggcgattaggagcaattgacattcctccacatgtgatgctatgtttgctactcggtgcaggtactgttttaattgcagctgcagctttcaacttgtcaagaaagggtagcaaaagcatgagctccatggagaagcccctggagttacataatgactcctttccatctaagaacaagcagatttctccagagaagtcatctgggcccgtagaaatggacgtgcttgaagattcatcatgcccttcagaagcgagcagcattcagcaaagctcattctacagtgaaaaagaagtgaatgaaggtcacaggctaggccctgagaagaagcgcaagaataactaccggagagaatctttggcctcttctgcatcagactattccatgggttccccatcctatggaagcttaactgtgtatgagaaaattccaatcaagcagggacatggggaggaggagatcatcactcctgttaggcgttcaagtagaattagaaaccaagccacttctccttcataacctgattttgggattagtttgtgtttggtttttagttcgtgttccaaaggatgttcaaacttaaacccaatccgtgggtgtagtttcattgaactgaataacgtttgaatcttctgaatggaaaaccaaacatcccttagttttcaagtaggaatacctagccaaattttatccgttgtaatctgacctgacccagcataactgttaatgtaagcagaagtatcctatcttctgaatccccttgatcttctgtagcagaagaaatttattgttgagtgaatctgattggttattaagttgtattaatccaatgacctactgcattttccttcttattttgctctgtaagcttttaaaaaaaaaaaaaaaaaa

SEQ ID NO: 4618 - protein, 2411 aa, Glycine max
ATGGGATCATCCCCAATTTTGAGGAAGGTCCCAGATCTTCCCTGAGTAGTGAAGATTTGAGTGGTGAGAGTGAAACTAGTGAAATTCATTATATGAATGTTCCTTTGATTTCAAAGAATGATACAGATTTGTCGTTTGAATCTGTCAATGATGTGAATGTGAATGTTCCTTTGGTTCTAGAGAATGACATTTACTACACTGAACCATCATTTGAAACTGAGCCTGATTATGATAACCTTGACCCTACTTTTAAGCTTAGCCCCACTTCCACTCATCCCGTTTTTAAGCTTAGCCCCACTGCCACTCCTCCGGTTTCATTGAAAGCCACCGTTGTGGCTCCTCTGGATGCGGATCCCTTGATGCCCCCTTATGACCCCAAAACCAACTACCTCTCCCCCAGACCACAGTTTCTTCACTACAAACCAAAATCTCGAATGGAACTCTGCAGGGAAAGGGAATTAGAGGACAGCTTCATATCTGGAAGCTTTTCAGATACAGAAGTCACTGAGGATTCCCAGTCTGAAGTCTCACAGAAGGAATCGGAGGATGCTTCTTCGGATGAAACTGTTAAGGAAGAAGAGGGTGAAATTTCTGAACTAAGTCCTGCTAGGAGGACTCTCATGCCAGAGGAATCTGTTGAAGAAAAAGAAGTTCCAAAACCACGCTTCACAGTGAGAGCAAAGGCTGTTTCTCTTACCTTGCTTCTTGCAGTTGCTTTTGTATCAATCTCAGTCACAGTCACAGATTTACCTGTGATTGATCGAACTGTGTTTGAAGACTTCTACAAGGTTTATGAATCATCAGAGTTTTCAGGGGCTAATTTTGATCTATTCAACCAGTTTGCAAAAACAAATTTTGATGAGATAGCTCGAAACTTACAAATTTGGTTTACCAAGTTGTTGTCTTCAACTTCTGAGTTCATTTCAGATGTTAGAGGAGCACACAATTTGGCCAAGTTGCAATATTATAACTTGACCATTCAGCACGATTACTCCATGGTGGATCAGTACCCTATATTTGGTCGTGGTGAAAATGAAATAGGTGAGACTCACGTACCAGTATGGGACGCTGATGAGAGTGATGCTGCCTCAGATATTGACAGTGATGAGGTTGTTGAGGGGGATATTCTGGAGGAGCATTATGAAGTGTATGAAGAACAAGTTCAGCAAGATATTGCAACAATTACTGGAGTTGAAAATATTATGGATGCTCCAGAATCTGAGGAAGTACTCAATATGATCGAATCAGAGCAACTGGCTGAAGCAGGAAATTTAGAAGCAACGATTGCACAAGAAGCTGAGGCTAACTTAAATGTTGAAAATCAGCCAAGCTTGAATTCAGAGGTTGCTGAAATCTGTGTTGAAGCGTATGAGTCAGATACAAAGCAGGCACAAGAAAAGGATGCTAAACTCAATGTCAATGAGCAAAGTGACATAAGTTTAGATTCAGATGTTGCTGCCGTGAACGATGATGTAGCAAAGGAAAAATCAGTAAGCATAGATGCTGCAATTAAAGGGAATGAAGGGCGATTAGGAGCAATTGACATTCCTCCACATGTGATGCTATGTTTGCTACTCGGTGCAGGTACTGTTTTAATTGCAGCTGCAGCTTTCAACTTGTCAAGAAAGGGTAGCAAAAGCATGAGCTCCATGGAGAAGCCCCTGGAGTTACATAATGACTCCTTTCCATCTAAGAACAAGCAGATTTCTCCAGAGAAGTCATCTGGGCCCGTAGAAATGGACGTGCTTGAAGATTCATCATGCCCTTCAGAAGCGAGCAGCATTCAGCAAAGCTCATTCTACAGTGAAAAAGAAGTGAATGAAGGTCACAGGCTAGGCCCTGAGAAGAAGCGCAAGAATAACTACCGGAGAGAATCTTTGGCCTCTTCTGCATCAGACTATTCCATGGGTTCCCCATCCTATGGAAGCTTAACTGTGTATGAGAAAATTCCAATCAAGCAGGGACATGGGGAGGAGGAGATCATCACTCCTGTTAGGCGTTCAAGTAGAATTAGAAACCAAGCCACTTCTCCTTCATAACCTGATTTTGGGATTAGTTTGTGTTTGGTTTTTAGTTCGTGTTCCAAAGGATGTTCAAACTTAAACCCAATCCGTGGGTGTAGTTTCATTGAACTGAATAACGTTTGAATCTTCTGAATGGAAAACCAAACATCCCTTAGTTTTCAAGTAGGAATACCTAGCCAAATTTTATCCGTTGTAATCTGACCTGACCCAGCATAACTGTTAATGTAAGCAGAAGTATCCTATCTTCTGAATCCCCTTGATCTTCTGTAGCAGAAGAAATTTATTGTTGAGTGAATCTGATTGGTTATTAAGTTGTATTAATCCAATGACCTACTGCATTTTCCTTCTTATTTTGCTCTGTAAGCTTTTAAAAAAAAAAAAAAAAAA

SEQ ID NO: 4619 - DNA, 1444 bp, Glycine max
  misc_feature (1)..(1444): Ceres cDNA ID no. 21995838
  misc_feature (1)..(1444): Ceres CLONE  ID no. 523593
  misc_feature (1)..(1444): Also known as  Ceres CDNA ID no. 0
ctttgtaaacgttaacgagctcgggagcagcttccatggaggcatagacggagatgcagtcatgaacaggacaaagttcagattcttcttctgagcaaaattttggggcagcaactaactaaatcctcaaaacagtgcaatctagtgaagattgttgggtcagttatggcagcgttgatttccaaaaggatcctacgttgttcttctgggtccttgcattcactaggacgatgttactttgattcacctgggtttgcctctatttataaaccacgtgatgtatgcggcggtttatctggggagagaatgttttctgcagatcgttctttggtcgggtccatggtccggcagttttctacttctattttaactcccggagatgatgatagtgcatttccgtctgatttattgtccaaaaagattctggcaacatccgagcgtactattgggctttgccaggatcttttaattccagtaaccaactttcataatgaagacaagggctatatggttttacctggagatgtttttgatttgcctattcggaaggacattattcatcgtgttgttaggtggcagcttgcaaaacgacaacaggggactcactcaacaaaaactatcagtgaggtcagtggcactgggagaaaaccttggaatcaaaagggaactggtagagcaaggcatggttcattgcgtgggcctcagttcaggggtggtgccaccatgcatggccctaagccccgaagccatgctttcaaagtcaataagaaggttcgacgtctagggctgaagattgctttatcagctcgtgcagcagaaggaaagcttcttgtttttgaggatctggcggttcccacacataaaaccaagaatattgtgaattattacaatcaaatggaggataccaagaaactgctgcttgtagatggcgctatagatgaaaagttaaaattatctacacaaaatctacactatgttaacgtacttccctccattggcttgaatgtctacagcattttgctgcatgatacattggtgatgtcccgagctgctgtgagcaaaattgttgagcgcatgcatactccaataaatcgttgaggctgtaactttttattgtgcttcgcttcatttactcggaaataggaacatttctgtagcaacataaaaagatccaatgagaatatctttggtacgaggtgtctgttttaattacataagttaggcaagttatgccattttgcccatgttgaaggttggaacttaggaacttgatgatcgaaatttgacgttcatgtgattaggtttatcttgttttccggtggttgaatctcatttttcaattctttcacatgcataggatctgataaacctgtacatcattcatgacctagtgtccttcattcatgaatttaaccaatatagtttgaaaaaaaaaaaaaaaaaa

SEQ ID NO: 4620 - protein, 310 aa, Glycine max
MAALISKRILRCSSGSLHSLGRCYFDSPGFASIYKPRDVCGGLSGERMFSADRSLVGSMVRQFSTSILTPGDDDSAFPSDLLSKKILATSERTIGLCQDLLIPVTNFHNEDKGYMVLPGDVFDLPIRKDIIHRVVRWQLAKRQQGTHSTKTISEVSGTGRKPWNQKGTGRARHGSLRGPQFRGGATMHGPKPRSHAFKVNKKVRRLGLKIALSARAAEGKLLVFEDLAVPTHKTKNIVNYYNQMEDTKKLLLVDGAIDEKLKLSTQNLHYVNVLPSIGLNVYSILLHDTLVMSRAAVSKIVERMHTPINR

SEQ ID NO: 4621 - DNA, 1410 bp, Glycine max
  misc_feature (1)..(1410): Ceres cDNA ID no. 21995839
  misc_feature (1)..(1410): Ceres CLONE  ID no. 527800
  misc_feature (1)..(1410): Also known as  Ceres CDNA ID no. 25088227
aaacaatttggaactccatgttaatcttcactcaattagattcagaataactttctgtctctcctacatactagcacatctctcatatttgtatgttaactacattcagaaaccatgaaatgtagtttcctggaaggaaaaacaatggaaattttcttagattttgagttgcagacagaactggctgggattctaaaagattatgttggccgggagagtcctctttattttgctgaaaggttgacggagcattacaagaggcctaatggtgaaggacctcacatttatctgaagagggaagatctcaatcacactggggctcacaaaattaataatgctgttgctcaagctttgcttgctaagagattgggcaaaaaacgcattattgctgaaactggagcgggtcagcatggagttgccactgctactgtatgtgctcgatttggtttagaatgcattatttatatgggtgcgcaggatatggaaaggcaggctctcaatgttttcagaatgcgtcttctcggtgctgaggtgagaccagtccattctgggactgctacacttaaggatgcgacatcagaggctataagggactgggtgactaatgtggagacaactcattatattttggggtctgttgctgggccgcatccatatccaatgatggtaagagagtttcatgctgtgattggcaaggagaccagaaagcaagctttggagaagtggggagggaaaccagatgtcttgattgcatgtgttggtggaggttcaaatgccataggacttttcaatgaatttgttgatgacaaagatgtaaggctaattggtgtggaggctgctggatttggcctggacagcggcaagcatgctgcaaccttaacaaaaggagaagttggggttttgcatggagctatgagctatctgctgcaggatgatgatggacaaatagttgagcctcactctattagtgcaggcttggactaccctggtgtgggtccggaacatagctttttgaaagatttagggcgtgctgaatatcatagtatcacagatgaagaagcattggaagcttttaagagagtttcgcgacttgaaggcataattcctgcactggaaacatctcatgcattggcatatctagagaaagtgtgtccaacccttgctaatggagccaaggttgtggttaacttcagtggccggggtgataaggatgttcaaactgctatcaagtacttgaagctttgaaaggatcaaaacttgctgagtgagcttcattttcatacttagagacataattaatacaatttattattagaccaagttaaatagtcatgtatatttgcatcagagaactgttgctattcaatcctcaataaacttagtttatgttacaaaaaaaaaaaaaaaaaa

SEQ ID NO: 4622 - protein, 376 aa, Glycine max
  misc_feature: PFam Name: PALP; PFam Description: Pyridoxal-phosphate
  misc_feature: GI Number: 53765707; NR Description: COG0133: Tryptophan
  misc_feature: GI Number: 48890973; NR Description: COG0133: Tryptophan
  misc_feature: GI Number: 1174778; NR Description: Tryptophan synthase beta chain 1 (Orange pericarp 1) >gi|320136|pir||PQ0449 tryptophan synthase (EC 4.2.1.20) beta-1 chain - maize (fragment)
  misc_feature: GI Number: 1174780; NR Description: Tryptophan synthase beta chain 2, chloroplast precursor (Orange pericarp 2) >gi|320135|pir||PQ0450 tryptophan synthase (EC 4.2.1.20) beta-2 chain precursor - maize (fragment) >gi|168574|gb|AAA33491.1|
  misc_feature: GI Number: 3915165; NR Description: Tryptophan synthase beta chain 2, chloroplast precursor >gi|2792520|gb|AAB97087.1| tryptophan synthase beta subunit [Camptotheca acuminata] >gi|2801771|gb|AAB97526.1| tryptophan synthase beta [Camptotheca
MKCSFLEGKTMEIFLDFELQTELAGILKDYVGRESPLYFAERLTEHYKRPNGEGPHIYLKREDLNHTGAHKINNAVAQALLAKRLGKKRIIAETGAGQHGVATATVCARFGLECIIYMGAQDMERQALNVFRMRLLGAEVRPVHSGTATLKDATSEAIRDWVTNVETTHYILGSVAGPHPYPMMVREFHAVIGKETRKQALEKWGGKPDVLIACVGGGSNAIGLFNEFVDDKDVRLIGVEAAGFGLDSGKHAATLTKGEVGVLHGAMSYLLQDDDGQIVEPHSISAGLDYPGVGPEHSFLKDLGRAEYHSITDEEALEAFKRVSRLEGIIPALETSHALAYLEKVCPTLANGAKVVVNFSGRGDKDVQTAIKYLKL

SEQ ID NO: 4623 - DNA, 1851 bp, Glycine max
  misc_feature (1)..(1851): Ceres cDNA ID no. 21995840
  misc_feature (1)..(1851): Ceres CLONE  ID no. 527903
  misc_feature (1)..(1851): Also known as  Ceres CDNA ID no. 24727122
acacaggtagctttcgcacactcccttttttcgtgcgcaaactgttcccgttggtctctttccctctgcacttcacaatcctaccctctcactgtgctatctctcagcatcttcgcaatcacacccttcccagatggccttgcaaacagctactcctccaacaactcccagtgcccaagttgttggtaatgcatttgttgagcagtattaccatattcttcaccattcaccaggttcggtctatcggttttaccaggactctagtgtgataagccgtcctgattccagtggtgtgatgacatcagttacaaccatgaaaggcattaatgagaagattctttcactaaatttcaaggaatttaaagcagagataaagactgcagatgctcaaaaatcatacaaggaaggagtgactgtgttggtgactggatgcttgactggcaaggataacttgagaagaaaatttgcacagtcattctttcttgctccacaagacaatggctattttgttctgaatgatgtttttaggtatgtagaagaccatgaaccatcagaactgcctccagttactggagatggtgattcagctgctgttacagtaacaccagaactagaacccagtcatgttgctgattcttgtgcaccagagcccacaaattctcatgtgaacaaaggtcaaactgttgctgagaatgcttatgagctatctaataatcatgagagacagatacctgttgagaatgaaggcaatgtagaatcacattttcagtcaaatggtaatgatgattctcaggccacagaactggcttcatcagctcaagacgatgctccaaagaagtcttatgcatcaattgtgaaagtccaaaaagggagttcagttccaactaaagtctatgtgcctactaatacactaaagtctgggcctaacaaaactgagagcaaggtagttgagtcagtagaatctactgaagtgcctgaagcagctttggaaagtgttagcaaccctgaaagtagtgatgctcatgaggaagttgagggtcactccatatacattcgaaatttgcctttaaatgtgacggttgctcagttggaactggagtttaagaaatttgggcccatcaagccaggaggcatccaagtcagaaataataagcagcagggatactgttttggctttgttgagttcctatctctaaattccatgaatagtgcaattcaggcttcacctgttcctattggggggcgtcaagctgtagtcgagataaagagaaccactacccgagttggcagtggcattaatggtactggaagacctaggatcccatctggtaggggtgggttacgaaatgactctttcaggggtcgtgggaattatgttgggggtcggggatacggtcgaaatgattatgtaagccgtggcgggttttctggtaggggtcgtggtcatggagaaggttatcaccaagggagagggagaggcggccggtcaagtggacaaaaacaaaatgctgtttccaactgaaatactggatgatttttgggaggttgttctgagacccccctttttgggtcagttatgagcatggaattcaaccttctaaagtttctcatgtttctttcactgcaatttgcacagttgtagtatttctagttgttattgctatgattttagtgggttggtagtgatcactgatcaggaataggtatagtcttttcttttgaaaaattgaaacatgctatgactggaattagcagtaggttaaccatcagttctcttttatttgttgctatggtgcaacatttttatatctaagttgagattttaattttaagaaaaaaaaaaaaaaaaaa

SEQ ID NO: 4624 - protein, 462 aa, Glycine max
  misc_feature: PFam Name: NTF2; PFam Description: Nuclear transport factor
  misc_feature: PFam Name: RRM_1; PFam Description: RNA recognition motif.
  misc_feature: PFam Name: Dehydrin; PFam Description: Dehydrin
  misc_feature: GI Number: 30697452; NR Description: nuclear transport factor 2 (NTF2) family protein / RNA recognition motif (RRM)-containing
  misc_feature: GI Number: 21553535; NR Description: ras-GTPase-activating
  misc_feature: GI Number: 50908643; NR Description: putative Ras-GTPase-activating protein binding protein 1 [Oryza sativa (japonica cultivar-group)] >gi|48716424|dbj|BAD23032.1| putative Ras-GTPase-activating protein binding protein 1 [Oryza sativa
  misc_feature: GI Number: 21360395; NR Description: AT3g25150/MJL12_9 [Arabidopsis thaliana] >gi|17979475|gb|AAL50074.1| AT3g25150/MJL12_9 [Arabidopsis thaliana] >gi|30687772|ref|NP_189151.2| nuclear transport factor 2 (NTF2)
  misc_feature: GI Number: 9294171; NR Description: RNA-binding protein-like
MALQTATPPTTPSAQVVGNAFVEQYYHILHHSPGSVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDSAAVTVTPELEPSHVADSCAPEPTNSHVNKGQTVAENAYELSNNHERQIPVENEGNVESHFQSNGNDDSQATELASSAQDDAPKKSYASIVKVQKGSSVPTKVYVPTNTLKSGPNKTESKVVESVESTEVPEAALESVSNPESSDAHEEVEGHSIYIRNLPLNVTVAQLELEFKKFGPIKPGGIQVRNNKQQGYCFGFVEFLSLNSMNSAIQASPVPIGGRQAVVEIKRTTTRVGSGINGTGRPRIPSGRGGLRNDSFRGRGNYVGGRGYGRNDYVSRGGFSGRGRGHGEGYHQGRGRGGRSSGQKQNAVSN

SEQ ID NO: 4625 - DNA, 1635 bp, Glycine max
  misc_feature (1)..(1635): Ceres cDNA ID no. 21995841
  misc_feature (1)..(1635): Ceres CLONE  ID no. 528342
  misc_feature (1)..(1635): Also known as  Ceres CDNA ID no. 24404209
acaagaacaagtaccagaacaataggagcatcatggttaggctatggtgctcttctctctcaattacacttttattccaacagctcatcagattgtgcatttcttggagtgtgcaaaccccaacacccccattgccaatcctccctctcccaatatattcccagttgaaatggcaacaaagggagatcataatgtttttccattttggtgtgaacacattcagtgacagagaatggggcactggccaggaaaacccagcaatcttcaatccaacggggctcaacaccacccagtgggccactgtggcagcagatgcaggagtttcattgatgatattaactgcaaaacaccatgatggcttctgcctctggccttccaagtacactgaccattctgtcattagcagcccctggcaaggtggcaagggtgatgtggttcaagactttgtcaatgcagccactgcacaaggaattgatgtaggggtctacctttcaccttgggatagacatgaccctagatatggcaatgatttgctctacaaccaatactacttggctcaactacaagagttgctcaagaaatatccaaatgttagagagatttggttcgatggagcaaagggtgccaatgcaaaaaatatgacgtattacttttcagattggttttccatggtgaaggagctgcagagtttcatcaacatcttctctgatgcaggtcctgatgttaggtgggtgggagatgaaacaggttctgcagggtatacatgttggtctaccattaatcgaacctctctatccattggaagtccagacatcattcagtatataaacactggtgatccaaaagggacagattggctaccggcggaatgtgatgtatccattcgaaaaggatggttttggcacaaatcagaatcaccaaaaaagctaagcgagctacttgacatttattacaattcggttgggagaaattgtgtgttacttctcaatgtgcctcctaatacaagtggccttataactgaagttgatgccaatagattgaaagagtttagaagtgcaatcaagacaattttccatcagaatcttgctgaggattgttttgttaaagttagtagccaaagagggggtttcgggccagaaaagatgctagacagtgaccacttgtggtcatactgggccccaagggacgatgatgatgaaaaggaccattgggttgaaatttgggccaaggaagggagattgagattcaatgtggttagaatacaagaggcaattggtcttggtcaaaggatcaaacggcatgaaatctatgtggatggtaaattgatcatcaaagccacaacggttggttataagaggcttcataggcttgatgggggtgaagtgcacgctcgtggtgtgaggataagaattagaaaggcaagaggagtgcctcttatctcttctattggcttgcattatgatcctttctggcactcaaagtttactgtatcctgaagagttaagtaagtttaggtaaaggagcataactgcaataaattaagtagagccttaagaagaatattgaaatattgttctatcagtaaagaacaaaaaataaatttactttaaatttctacaaaaaaaaaaaaaaaaa

SEQ ID NO: 4626 - protein, 487 aa, Glycine max
  misc_feature: PFam Name: Alpha_L_fucos; PFam Description: Alpha-L-fucosidase
  misc_feature: PFam Name: F5_F8_type_C; PFam Description: F5/8 type C domain
  misc_feature: GI Number: 30683758; NR Description: glycosyl hydrolase
  misc_feature: GI Number: 42556000; NR Description: FucA [Streptococcus gordonii]
  misc_feature: GI Number: 60494104; NR Description: putative lipoprotein [Bacteroides fragilis NCTC 9343] gi|60682670|ref|YP_212814.1|
  misc_feature: GI Number: 53682312; NR Description: COG3669:
  misc_feature: GI Number: 48848369; NR Description: COG3669:
MVRLWCSSLSITLLFQQLIRLCISWSVQTPTPPLPILPLPIYSQLKWQQREIIMFFHFGVNTFSDREWGTGQENPAIFNPTGLNTTQWATVAADAGVSLMILTAKHHDGFCLWPSKYTDHSVISSPWQGGKGDVVQDFVNAATAQGIDVGVYLSPWDRHDPRYGNDLLYNQYYLAQLQELLKKYPNVREIWFDGAKGANAKNMTYYFSDWFSMVKELQSFINIFSDAGPDVRWVGDETGSAGYTCWSTINRTSLSIGSPDIIQYINTGDPKGTDWLPAECDVSIRKGWFWHKSESPKKLSELLDIYYNSVGRNCVLLLNVPPNTSGLITEVDANRLKEFRSAIKTIFHQNLAEDCFVKVSSQRGGFGPEKMLDSDHLWSYWAPRDDDDEKDHWVEIWAKEGRLRFNVVRIQEAIGLGQRIKRHEIYVDGKLIIKATTVGYKRLHRLDGGEVHARGVRIRIRKARGVPLISSIGLHYDPFWHSKFTVS

SEQ ID NO: 4627 - DNA, 1373 bp, Glycine max
  misc_feature (1)..(1373): Ceres cDNA ID no. 21995842
  misc_feature (1)..(1373): Ceres CLONE  ID no. 528645
  misc_feature (1)..(1373): Also known as  Ceres CDNA ID no. 24367556
aaaccacagcacagcaaagctagccaaccttaaacaaccttgttatctctctcacactcacttgtactcttatctctttttcataactttttttgtaccttctgatctaatggcagttccagtgattgatttttcaaagctcaatggtgaagaaagagccaaaactatggcacagattgctaatggatgtgaagagtggggattttttcagttgatcaaccatggcattcctgaggaacttcttgagagggtgaagaaggttgcttctgagttctataggctggaaagagaggagaatttcaagaactccaaatcagtgaagctactaagcgatttagtcgaaaagaagagcagcgaaaagctggagcatgcggattgggaggatgttatcactctccttgatgataacgaatggccagaaaaaacaccaggcttcagggaaaccatggcgaaatatcgggccgagctaaagaaattggcagagaaagtgatggaggtgatggatgagaatcttggcttaaccaaagggtacatcaagaaggcactgaatggtggagatggagacaatgccttctttggcaccaaggtgagccactaccctccatgtccccatccagggcttgtgaagggtctgcgagctcacaccgacgcaggaggcgtcatcctactcctccaagatgacaaggttggtggccttcagatgctgaaagatgggcaatggattgatgtgcagcctttgccaaatgccattgtcatcaacactggtgaccagattgaggtcctgagcaatggtagatacaagagttgctggcacagggttctggccacaccagatgggaacagaagatcaattgcctccttctataacccttcattcaaagccaccatatgtcctgcaccacaacttgtggagaaagaagaccaacaagtgaatcaaacttatcctaagtttgtttttggtgactacatgtctgtctatgctgagcagaagttccttcccaaggaaccaaggttccaagctgttagggccatgtgagaaaagcaacttgctttcttgtagaaaatgcttttgctcttccccccccccacactttttttatttttgaaaaaaaataacttcatctttaagggtcttgctactataagacatgcttgatagtagcaaaggatataccatttggttatcattctctgtatggatttctccagaatcgaaaacccccatgggtattagtcttcctttctttacaattttgctttatttttcagtgttatggggggagctagtgtgcatccatgcttgtattgtgcaatagttcttttaaatatattctactctaaagttgtccaccatgaaaaaaaaaaaaaaaaaa

SEQ ID NO: 4628 - protein, 308 aa, Glycine max
  misc_feature: PFam Name: 2OG-FeII_Oxy; PFam Description: 2OG-Fe(II)
  misc_feature: GI Number: 28949891; NR Description:
  misc_feature: GI Number: 27371996; NR Description: 1-aminocyclopropane-1-carboxylic acid oxidase [Populus tremula x
  misc_feature: GI Number: 37699070; NR Description:
  misc_feature: GI Number: 21555054; NR Description: 1-aminocyclopropane-1-carboxylate oxidase, putative [Arabidopsis
  misc_feature: GI Number: 12001828; NR Description: 1-aminocyclopropane-1-carboxylate oxidase; ACC oxidase [Musa
MAVPVIDFSKLNGEERAKTMAQIANGCEEWGFFQLINHGIPEELLERVKKVASEFYRLEREENFKNSKSVKLLSDLVEKKSSEKLEHADWEDVITLLDDNEWPEKTPGFRETMAKYRAELKKLAEKVMEVMDENLGLTKGYIKKALNGGDGDNAFFGTKVSHYPPCPHPGLVKGLRAHTDAGGVILLLQDDKVGGLQMLKDGQWIDVQPLPNAIVINTGDQIEVLSNGRYKSCWHRVLATPDGNRRSIASFYNPSFKATICPAPQLVEKEDQQVNQTYPKFVFGDYMSVYAEQKFLPKEPRFQAVRAM

SEQ ID NO: 4629 - DNA, 1782 bp, Glycine max
  misc_feature (1)..(1782): Ceres cDNA ID no. 21995843
  misc_feature (1)..(1782): Ceres CLONE  ID no. 528929
  misc_feature (1)..(1782): Also known as  Ceres CDNA ID no. 24402733
ttcttttctctctctctctctctgtgaaatggagccgtttgcttagagctgcttcttctgatctttgaatcttgatctagatatctagatacagaattggaaatggattcaaatgggagcctacgtgctaacacctgggcaaggtcgtcgtccttgacctctcctgcaagtggtttatcctcagatcctctttctttcccaggttttggtttgcagcataatcaacaaaaatgggatgttccctcaaattcagattttgggatcagggctgaagcacctttcaaagaattcaatcagccctctcaaacccagtctccgcttccttgcaactcaaacaatgagattgaaatccctggtcaagaaaactgtcatctgagtgaatcatcacaaaccaatacactccaagattgggaccccagtgtgatgttgaataacctatctttcttggaagaaaagattcatcagctccaggatctagtgcatttgattgctcgtcaaaaaggcattggacaacccaatgaacttgtaactcaggaacagcagctcgttacaactgatctcacatcaatcattattcaattgatctctaccgcaggtagtcttctcccttctgctaggcataaccttgtaaacactagttcattggttggacagattgaccagcttcgtgggacaaccattcctcctgggaccggtgcaagtaacggctgtattcaaccacagaataatggtggaaaaatattgtctgatcagtccatgcagactgatctacctaatagcggtgaaatggagcaaaagtacaatatggtagaacatgacttgaaagatgaagaagatgtagaggatggagaaaaccttgcccctggttcatatgagattctacaattagaaaaagaagaaatccttgctcctcatacccatttctgtacaatttgtgggaaggggttcaagagagatgcaaatcttcgaatgcacatgcgaggccatggtgacgagtacaaaaccccagcagcgcttgccaaaccgcacaaagaatctgcatcaccaaagcctatcaagaggtattcctgcccctatcctggctgcaagcgcaacaaggatcacaagaagttccagcctctgaagacgatcttatgtgtcaaaaaccattacaaaaggacgcattgtgacaagagttacacttgcagtaggtgcaacaccaagaagttctcagtcatggctgatctaaaaactcatgaaaaacactgtggtaaggataaatggctctgttcgtgtggcacaacattttctaggaaagacaagctttttgggcacattgctcttttccaagggcatgcaccagccattcctttggatgacactaaaggggcaggggtagctgaggcacccattcatgatagcaaagagaacaacagtaaggtgcagagcatgaacttcacttttggatcaaatccttcaaatgcaaatgaagttccaaatgccatggatgtaaaaggcgatagcgatgatcctatcaattatttctcatcattgaactttgaagccaactttggtgagtttaatgaattcaccagacctctatttgatgacccagaaggttcgttctcttttgtcacacctggatctttcaaatctggaggagaatctagttctgacaatcttttataacaatggtactaccattggttctgtaataacttaatatctatgtttctcttaattgtgaagatataactttcgggtttgtgttaaaaaaaaaaaaaaaaaaaaaaaaaaaaaaaa

SEQ ID NO: 4630 - protein, 521 aa, Glycine max
  misc_feature: PFam Name: zf-C2H2; PFam Description: Zinc finger, C2H2 type
  misc_feature: GI Number: 21593564; NR Description: zinc finger protein,
  misc_feature: GI Number: 34908682; NR Description: putative zinc finger protein [Oryza sativa (japonica cultivar-group)] >gi|15408708|dbj|BAB64114.1| putative zinc finger protein [Oryza sativa (japonica cultivar-group)] >gi|19571114|dbj|BAB86538.1|
  misc_feature: GI Number: 50920001; NR Description: putative zinc finger protein [Oryza sativa (japonica cultivar-group)] >gi|28376689|gb|AAO41119.1| putative zinc finger protein [Oryza
  misc_feature: GI Number: 30688719; NR Description: zinc finger (C2H2 type)
  misc_feature: GI Number: 50948539; NR Description: putative transparent testa 1 [Oryza sativa (japonica cultivar-group)] >gi|42408431|dbj|BAD09613.1| putative transparent testa 1 [Oryza sativa (japonica cultivar-group)] >gi|45736182|dbj|BAD13228.1|
MDSNGSLRANTWARSSSLTSPASGLSSDPLSFPGFGLQHNQQKWDVPSNSDFGIRAEAPFKEFNQPSQTQSPLPCNSNNEIEIPGQENCHLSESSQTNTLQDWDPSVMLNNLSFLEEKIHQLQDLVHLIARQKGIGQPNELVTQEQQLVTTDLTSIIIQLISTAGSLLPSARHNLVNTSSLVGQIDQLRGTTIPPGTGASNGCIQPQNNGGKILSDQSMQTDLPNSGEMEQKYNMVEHDLKDEEDVEDGENLAPGSYEILQLEKEEILAPHTHFCTICGKGFKRDANLRMHMRGHGDEYKTPAALAKPHKESASPKPIKRYSCPYPGCKRNKDHKKFQPLKTILCVKNHYKRTHCDKSYTCSRCNTKKFSVMADLKTHEKHCGKDKWLCSCGTTFSRKDKLFGHIALFQGHAPAIPLDDTKGAGVAEAPIHDSKENNSKVQSMNFTFGSNPSNANEVPNAMDVKGDSDDPINYFSSLNFEANFGEFNEFTRPLFDDPEGSFSFVTPGSFKSGGESSSDNLL

SEQ ID NO: 4631 - DNA, 1223 bp, Glycine max
  misc_feature (1)..(1223): Ceres cDNA ID no. 21995845
  misc_feature (1)..(1223): Ceres CLONE  ID no. 530801
  misc_feature (1)..(1223): Also known as  Ceres CDNA ID no. 24726550
attccattttcaagctaagccttataaataataagagcaaaaaaaaaaaaccaaaacaacgagagagagaacatgggttcaagttcagcatccgaaagtgtttgcgttacaggagcctctggtttcatcgggtcatggcttgtcatgagactcatcgagcgtggctacacggtccgagccactgtacgcgatccagctaacatgaagaaggtgaagcatttggtggagcttccaggtgcaaagaccaaattgtctctgtggaaggctgatcttgctcaagagggaagctttgatgaagccattaaaggctgcactggagttttccacgtggcaacccccatggattttgactccaaggaccctgagaatgaagtgataaagcctacaataaacggattgctagacatcatgaaagcatgcgtgaaggccaaaactgtccgaaggcttgtattcacttcctcagcgggaactgtggatgttacggaacacccaaaccctgtcatcgatgagaactgttggagcgatgttgacttctgcacaagggtcaaaatgactggttggatgtattttgtttcaaagaccctggcggagcaagaagcgtggaaatatgccaaagagcacaacatagactttatatcagtcattccaccccttgtcgttggcccctttcttatgccaacaatgccacctagcctaatcactgctctttcactaatcacaggaaatgagtcccattaccatatcataaagcagggccagttcgtacacttagatgacctttgtcttggccatatattcgtgttcgagaatccaaaagccgaagggaggtacatatgctgttcacacgaggcaaccattcatgacattgcaaaactgcttaaccaaaaataccctgagtataatgtccttactaagttcaagaatattccagatgaattggacattattaaattttcttcgaagaagatcacagacttgggcttcaaatttaagtacagcttagaggatatgtttactggagccgttgaaacctgcagagaaaaagggcttcttcctaaacctgaagaaactacagttaataatgagcttcttcctaaacctgcagaaactacagttaatgacactatgcagaaataaatatgctttcatatcagggataagtatgtatgttgaagatctcatctatcaagtgatgattatttcttaaaaaaaaaaaaaaaaaa

SEQ ID NO: 4632 - protein, 354 aa, Glycine max
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: GI Number: 31324464; NR Description: dihydroflavanol
  misc_feature: GI Number: 38683951; NR Description:
  misc_feature: GI Number: 38683953; NR Description:
  misc_feature: GI Number: 6009513; NR Description: dihydroflavonol 4-reductase [Camellia sinensis] >gi|6009511|dbj|BAA84939.1|
  misc_feature: GI Number: 28629480; NR Description: dihydroflavonol
MGSSSASESVCVTGASGFIGSWLVMRLIERGYTVRATVRDPANMKKVKHLVELPGAKTKLSLWKADLAQEGSFDEAIKGCTGVFHVATPMDFDSKDPENEVIKPTINGLLDIMKACVKAKTVRRLVFTSSAGTVDVTEHPNPVIDENCWSDVDFCTRVKMTGWMYFVSKTLAEQEAWKYAKEHNIDFISVIPPLVVGPFLMPTMPPSLITALSLITGNESHYHIIKQGQFVHLDDLCLGHIFVFENPKAEGRYICCSHEATIHDIAKLLNQKYPEYNVLTKFKNIPDELDIIKFSSKKITDLGFKFKYSLEDMFTGAVETCREKGLLPKPEETTVNNELLPKPAETTVNDTMQK

SEQ ID NO: 4633 - DNA, 1228 bp, Glycine max
  misc_feature (1)..(1228): Ceres cDNA ID no. 21995846
  misc_feature (1)..(1228): Ceres CLONE  ID no. 533498
  misc_feature (1)..(1228): Also known as  Ceres CDNA ID no. 24727252
ataggcataccatacctactaaaactcagcgacagatcatatcatatcatgtgataagctagcttatatatacacacaaacaagagggtagaagggaaaactcttgcagaaaatagcttgaaaaaaatatatattctataaacaattatgctttttccatctggtattctgaaaaagcaagtttaatttatttgtggaaagagatataaagcaagtattaaacacatgggtaggggaaaggtggagctgaagaggattgagaacaagataaaccgtcaagtgacatttgcaaagaggaggaatggtttgctcaagaaggcttatgaactctctgtcctctgtgatgctgaggttgccctcattatcttctccaaccgtggcaagctctatgagttctgcagtggccatagcacggccaagacacttgaacggtatcacagatgcagttatggagccttggaagtccagcaccaacctgaaatagagacacagaggcgctaccaagagtacctaaagctaaaatccagagttgaggcactacagcaaacacaaagaaacctccttggggaagaattggagcacttagacgttaacgaccttgagcagcttgaacgtcagctggactcttccttgaagcaaatcaggtctaacaagacacagcagatgcttgatcaactctctgatttgcatagaaaggaagagatgctactggaaactaacaatatcctgagaaacaagttggaggaaatcaatgtagccctacaaccaacatgggaagctagggagcaaaatgctccctacaattgccaccctccccaaacagagggatattatgagacagcaacagcacattgcagcagtacattgagaattggctatgattcttcaggattaaatgaagcaggaggagctgcaggagcctcagcccaaaatgctagtgaattcatgcatggatggatgaactaaatttatttccaatttagtacttaaattcatgatcatcagaaaaatgatgcttttgtagagatcttggcctacaagaacaggctctaataataggtgtcatgcagcataaaatatacttatgctattcttaatattccaataagacatgttttgaagaattttataattagcatcttcccaaactcaatccatcctcattgatccaaatggggttgtttgatacttaatgacatgtgtatgctccaaaaaaaaaaaaaaaaaa

SEQ ID NO: 4634 - protein, 246 aa, Glycine max
  misc_feature: PFam Name: K-box; PFam Description: K-box region
  misc_feature: PFam Name: SRF-TF; PFam Description: SRF-type transcription
  misc_feature: GI Number: 22091481; NR Description: MADS box transcription
  misc_feature: GI Number: 20385584; NR Description: MADS-box protein 2
  misc_feature: GI Number: 6683777; NR Description: CAGL2 [Cucumis sativus]
  misc_feature: GI Number: 60265518; NR Description: AGL2 [Amborella trichopoda]
  misc_feature: GI Number: 52548010; NR Description: SEPALLATA1 [Arabidopsis
MGRGKVELKRIENKINRQVTFAKRRNGLLKKAYELSVLCDAEVALIIFSNRGKLYEFCSGHSTAKTLERYHRCSYGALEVQHQPEIETQRRYQEYLKLKSRVEALQQTQRNLLGEELEHLDVNDLEQLERQLDSSLKQIRSNKTQQMLDQLSDLHRKEEMLLETNNILRNKLEEINVALQPTWEAREQNAPYNCHPPQTEGYYETATAHCSSTLRIGYDSSGLNEAGGAAGASAQNASEFMHGWMN

SEQ ID NO: 4635 - DNA, 1401 bp, Glycine max
  misc_feature (1)..(1401): Ceres cDNA ID no. 21995847
  misc_feature (1)..(1401): Ceres CLONE  ID no. 535199
  misc_feature (1)..(1401): Also known as  Ceres CDNA ID no. 23700031
atccaacttgttcttatatgatgaataccttgatgagtacatgtccacaatagctgtggaacatttaccacaaaataggccactatgggaacttcacattataaaatacccaacaagcaatgctaagggtaccttggtgttcaaactccaccatgcccttggggatggtttttctctcatgggtgcccttctttcatgcatgcaaagagctgacaacacctctcttcccttcacactcccatcaagccaaaggcccaaagcatcatcaatttccaacaccaaagggtttttcaagaaattgccctccattttcttccaaactatatccgaatttggatggagtttcttgaaaagtaagttgattgaagatgatcaaacaccaataaggtcttgtgcggaagacttcaagactcgccaaatgaccatctcagatgtcaccttctcattggatcttatcaaagacgtgaaatccaaacttggagtgagcataaatgatgtgcttgctggagtaattttttttggcattcggctatacatgcaagaaattaatctgaaatcaagccaaacccaatccacagcattggtgttgctgaacacaagaaacattgaaggttacaagtctgttaaggagatgattgagaagaccaatagtcgttctgcatgggggaatcaatatgcctttttgcatgtttcaattccagagcttagtgactccaaatatgcaaacccacttgagtttataagggaagcccataaggatatgaccaaaaagaaaaattctttggccactcctctcactggcatgcttctagatatgctcagaaaactcaggggtcctgaggctgcagctagctacttacgcagtactttgagaaactcaagcacaacaatctcaaacatcattggaccagtggagcaaatggctgtggctaatcatccaattaaagggttttacttcatggtagctggttcacctgagagtctcaccatgacgatcatgagctacatgggaaagataagaattgcatttggagtagagaagaacttcatcgacaagcaattattcaagtcgtgtttggagaattctcttgagatgataaaggaagcagcaaaaaagatttccgcataaaatcaaatatggaagatatgtactttttttgttgttgttgtggaagatatgtactaccactatattctatctatattcttgttaatatttaattattttatttaaatatatgtgatgtggtgattctgtaatagaaatttgtttctgagtggaatgtattttattgaactggaacagtatcattacggccgggcatggctgtttttagttgggaagtccctacattacatcaaaaagtagaattaaaaaaaaagaaaaaaaaaaaaaaaaaa

SEQ ID NO: 4636 - protein, 362 aa, Glycine max
  misc_feature: PFam Name: Condensation; PFam Description: Condensation domain
  misc_feature: PFam Name: UPF0089; PFam Description: Uncharacterised
  misc_feature: GI Number: 34909902; NR Description: P0665A11.11 [Oryza
MSTIAVEHLPQNRPLWELHIIKYPTSNAKGTLVFKLHHALGDGFSLMGALLSCMQRADNTSLPFTLPSSQRPKASSISNTKGFFKKLPSIFFQTISEFGWSFLKSKLIEDDQTPIRSCAEDFKTRQMTISDVTFSLDLIKDVKSKLGVSINDVLAGVIFFGIRLYMQEINLKSSQTQSTALVLLNTRNIEGYKSVKEMIEKTNSRSAWGNQYAFLHVSIPELSDSKYANPLEFIREAHKDMTKKKNSLATPLTGMLLDMLRKLRGPEAAASYLRSTLRNSSTTISNIIGPVEQMAVANHPIKGFYFMVAGSPESLTMTIMSYMGKIRIAFGVEKNFIDKQLFKSCLENSLEMIKEAAKKISA

SEQ ID NO: 4637 - DNA, 1142 bp, Glycine max
  misc_feature (1)..(1142): Ceres cDNA ID no. 21995848
  misc_feature (1)..(1142): Ceres CLONE  ID no. 537206
  misc_feature (1)..(1142): Also known as  Ceres CDNA ID no. 24367845
aattccccctcacttttgcctttgcacaacatacacgttctcctatcctagctacttactctctcttccttcaattcctcaactctctagctcttatggaaactcaacaccaacaacccaccatcaagtctaggttcagacgcatctgtgtctactgtggtagcagccctggcaaaaaccccagctaccagctcgctgctattcaactcggaaaacaactggtggagaggaacattgacttggtttatggaggaggaagcatagggttgatgggtctaatctcacaagttgtgtatgatggtggacgccacgtgttaggggtgattccagagacacttaatgcaagagagataactggagagagtgttggagaagtgagagctgtatcgggcatgcaccaacgcaaagccgaaatggcccgacaagccgatgcatttattgcactgccaggtggatatggcacccttgaagaactactggaaattatcacctgggctcaactaggcatccatgataaaccggtggggttgttgaacgtggatgggtactacaactcgctgctggcattcatggacaaagctgtggacgaaggtttcgtaacaccagctgcccgtcacattattgtttctgcccacactgcccaagaactcatgtgcaaacttgaggaatatgtccccgagcactgtggcgtggcccccaagctaagttgggagatggagcaacagttagttaacactgcaaagtcagatatttcccgttgactaataactaaataattaatcttctacaagctcactaatgcaccatcaaagaccctagatttagtgtataagtataaagtataatataacctcaaccccatgatgtagttgtaagctccacagaatagggcgaccacagtcgtttttagtttagctgtggatctaatcatttgtaatttctatggttcaagttcaagatattcaccatgtaatttctttaattttctttcttgattggctttcatggctgagactatgtattttaattatttcttagttaccaactaattgtgcattagaatttgacctggatgatcatcgaagatatatttatagtaatatatatactatgcattaattttcaaaaaaaaaaaaaaaaaa

SEQ ID NO: 4638 - protein, 221 aa, Glycine max
  misc_feature: PFam Name: Lysine_decarbox; PFam Description: Possible
  misc_feature: GI Number: 19548083; NR Description: T3B23.2/T3B23.2 [Arabidopsis thaliana] >gi|13605607|gb|AAK32797.1| T3B23.2/T3B23.2
  misc_feature: GI Number: 9758410; NR Description: lysine decarboxylase-like
  misc_feature: GI Number: 50916205; NR Description: Putative lysine decarboxylase-like protein [Oryza sativa (japonica cultivar-group)] >gi|24431606|gb|AAN61486.1| Putative lysine decarboxylase-like
  misc_feature: GI Number: 7573362; NR Description: lysine decarboxylase-like protein [Arabidopsis thaliana] gi|11358493|pir||T48554 lysine
  misc_feature: GI Number: 60594281; NR Description: Chain B, X-Ray Structure Of A Lysine Decarboxylase-Like Protein From Arabidopsis Thaliana Gene At5g11950 gi|60594280|pdb|1YDH|A Chain A, X-Ray Structure Of A Lysine Decarboxylase-Like Protein From Arabidopsis Thaliana
METQHQQPTIKSRFRRICVYCGSSPGKNPSYQLAAIQLGKQLVERNIDLVYGGGSIGLMGLISQVVYDGGRHVLGVIPETLNAREITGESVGEVRAVSGMHQRKAEMARQADAFIALPGGYGTLEELLEIITWAQLGIHDKPVGLLNVDGYYNSLLAFMDKAVDEGFVTPAARHIIVSAHTAQELMCKLEEYVPEHCGVAPKLSWEMEQQLVNTAKSDISR

SEQ ID NO: 4639 - DNA, 1552 bp, Glycine max
  misc_feature (1)..(1552): Ceres cDNA ID no. 21995851
  misc_feature (1)..(1552): Ceres CLONE  ID no. 540118
  misc_feature (1)..(1552): Also known as  Ceres CDNA ID no. 25088232
tattttttttatgggatggcggactaccaacatgtgattccagttcatgctgatgttgcccggaggaagaagcggaactggtcagagctagaagaactgcattttgataaaggtggtttcatggatctggatcacgaggatgttatgattatagtgcctccaattttcgctccaaaagatgtgccagaaaatttagtcttaagaccagctaccatgtcgagttcgaaaaagaaaccagaggaagttgtacaaccccattttgagatggacatggagccagttcttgcaattgattttgacattaaagagattcctaagaaagtgaattgggaggaatacataccccaaggctcagatcagtgggagttacagatggttgtatctagaatgtttgatgagcggcctatatggtccaaaaattcgcttaccgaactcttgcttgataagggcttaagcttttcgcacagcatgctcagaaggcttctatctagaatttcttactacttttctagtggaccatttctgaggttttggatcaagaaaggatatgatccacgcaaagatcctaattctcgaatttatcaaagaattgattatcgagtacctgttccattacgaagttactgtgatgctcattcagccaataaatcaaaacatagatggaaggatatatgtgcctttcgtgttttcccttacaagttccagacttctttacagtttttcgaccttgttgatgattatattcaatcagaaataaataagcctcctttccgaccaacttgcacttctggaactgggtggttctcacaacacatgatcaattgtattagacaacgtcttatggtgcgatatctatcagtattccccaagcctggtgctgagaatttactcagagctgccactttaaagtttgaaaaattgaagagggagtgctataggcatgccatgaagctcgatggagaagaatgccaacaagctaatttaggtttggaagagaatgaagaacttgataatggtgaagatgaagaggaggcagctgagggtaatgatagtgatgaagaatgggaagaagagcatgatttggctggagataatgaaatgcctctgccatctgattcctacatcaactttgagaatctttcaaggactcatttacaggatctttttgttaacttccctcctaatgaaattgattgtgacaatgtgcaagcaaatggcagcgaagaagaatatcaaatatacggggaagatagtgaggacaattactctgatgaatgatttctggcatttggagtcatcaaatacacaggaatgtcaatatttgtagaagttacataggagggtagatatcatcttttagatttgttgattaaatatcatcatagatcctagtattcactgttacgtataagaacaagtatctctaattacattagagaaacacgggagaaaaaaatagtagaagtagatgatggaaaatagaagagaaatggacatggttgattgaagaaaaccgtttttcattttattttcgaaaaaaaaaaaaaaaaaa

SEQ ID NO: 4640 - protein, 420 aa, Glycine max
  misc_feature: GI Number: 30693186; NR Description: transcription
  misc_feature: GI Number: 15238539; NR Description: transcription
  misc_feature: GI Number: 34913408; NR Description: B1074C08.27 [Oryza sativa (japonica cultivar-group)] >gi|20161197|dbj|BAB90124.1| B1129H01.6 [Oryza sativa (japonica cultivar-group)] >gi|21328151|dbj|BAC00730.1| B1074C08.27 [Oryza sativa (japonica
  misc_feature: GI Number: 38197503; NR Description: GTF3C5 protein [Homo sapiens]
  misc_feature: GI Number: 33879582; NR Description: GTF3C5 protein [Homo sapiens]
MADYQHVIPVHADVARRKKRNWSELEELHFDKGGFMDLDHEDVMIIVPPIFAPKDVPENLVLRPATMSSSKKKPEEVVQPHFEMDMEPVLAIDFDIKEIPKKVNWEEYIPQGSDQWELQMVVSRMFDERPIWSKNSLTELLLDKGLSFSHSMLRRLLSRISYYFSSGPFLRFWIKKGYDPRKDPNSRIYQRIDYRVPVPLRSYCDAHSANKSKHRWKDICAFRVFPYKFQTSLQFFDLVDDYIQSEINKPPFRPTCTSGTGWFSQHMINCIRQRLMVRYLSVFPKPGAENLLRAATLKFEKLKRECYRHAMKLDGEECQQANLGLEENEELDNGEDEEEAAEGNDSDEEWEEEHDLAGDNEMPLPSDSYINFENLSRTHLQDLFVNFPPNEIDCDNVQANGSEEEYQIYGEDSEDNYSDE

SEQ ID NO: 4641 - DNA, 1154 bp, Glycine max
  misc_feature (1)..(1154): Ceres cDNA ID no. 21995852
  misc_feature (1)..(1154): Ceres CLONE  ID no. 540439
  misc_feature (1)..(1154): Also known as  Ceres CDNA ID no. 24372715
gagggatcatgtaaacatgaacattctctttgaaaagcttctttctcaatttcctcaagtcattccttggtcttttgccatagttataatctctcttcatgttagttctgtgagtctaccaaactatgaaagtatcccagcagtgattgtgtttggggactctatagtggatacgggtaacaataactacatcaacaccatagcaaaatgcaattttctaccatatggtagagattttggtggaggaaatcaaccaactgggaggttcagcaatggtttagtcccatcagacatcatagctgcaaaatttggagtcaaggagcttttgccaccttatcttgatccaaaattgcaacctcaagatctcctcacagatcaactggacatgttcagggagtacaaaaacaagataatggaaatagttggagaaaacagaacggcaacaataatatcaaaaggcatttacatcctgtgcacaggaagtaatgacattaccaatacttacgtatttaggcgagtagaatatgacattcaagcatacacagacttaatggcgtcacaagccacaaacttcttgcaggaactttatggactaggagctagaaggattggagtagttggtttaccggttctagggtgtgtgccctcacagagaacaattgacggaggcatatccagagcatgttcagattttgaaaaccaggctgcagtgctcttcaacagcaagctctcatcccaaatggatgctcttaagaaacagtttcaagaggctagacttgtctatcttgacctttacaacccattactacatttgattcaaaacccagctaaatatggttttgaagtaatagacaaaggatgctgtggcacaggaaatttggaagtaagcttaatgtgcaaccatttcgtcttgcacatatgttcaaacacctcaaactacatattctgggacagtttccatcctacacaagcagcctataatgtagtttgctctctggtgcttgatcacaaaatcaaggacttcttctaatgccagtttcattgtaaaactctcaataataaataaacattataataattacatgcaatgctcacacaatatacttcaaaattataaaatggtttttcaaactgacaaaaaaaaaaaaaaaaaa

SEQ ID NO: 4642 - protein, 337 aa, Glycine max
  misc_feature: PFam Name: Lipase_GDSL; PFam Description: GDSL-like
  misc_feature: GI Number: 15054386; NR Description: family II lipase EXL3 [Arabidopsis thaliana] >gi|15222901|ref|NP_177718.1| family II
  misc_feature: GI Number: 26449364; NR Description: putative family II
  misc_feature: GI Number: 8778808; NR Description: T4O12.13 [Arabidopsis thaliana] >gi|25404994|pir||A96788 protein T4O12.13 [imported] -
  misc_feature: GI Number: 15054382; NR Description: family II lipase EXL1 [Arabidopsis thaliana] >gi|18410954|ref|NP_565120.1| family II
  misc_feature: GI Number: 28827430; NR Description: putative family II extracellular lipase 1 (EXL1) [Arabidopsis thaliana] >gi|28393626|gb|AAO42232.1| putative family II extracellular lipase 1 (EXL1) [Arabidopsis thaliana]
MNILFEKLLSQFPQVIPWSFAIVIISLHVSSVSLPNYESIPAVIVFGDSIVDTGNNNYINTIAKCNFLPYGRDFGGGNQPTGRFSNGLVPSDIIAAKFGVKELLPPYLDPKLQPQDLLTDQLDMFREYKNKIMEIVGENRTATIISKGIYILCTGSNDITNTYVFRRVEYDIQAYTDLMASQATNFLQELYGLGARRIGVVGLPVLGCVPSQRTIDGGISRACSDFENQAAVLFNSKLSSQMDALKKQFQEARLVYLDLYNPLLHLIQNPAKYGFEVIDKGCCGTGNLEVSLMCNHFVLHICSNTSNYIFWDSFHPTQAAYNVVCSLVLDHKIKDFF

SEQ ID NO: 4643 - DNA, 1062 bp, Glycine max
  misc_feature (1)..(1062): Ceres cDNA ID no. 21995853
  misc_feature (1)..(1062): Ceres CLONE  ID no. 540657
  misc_feature (1)..(1062): Also known as  Ceres CDNA ID no. 24727127
ttttattccatatttttggcatttaatttttcatgtcacttgttttctgccatctttatggtctctttactccagtatttaactttctttgaatttaaggtttcactattttctagaattgatgcttatctggattgctgtttaacttttgcagatgacaaacgcaagagaagctgaacaaatggatgatgaggatgattctattaggaagatgaaggctgctgaggaggctttggaagaaaaacagaagcaaaaaccttcatttgagctatctggaaagcttgcgggtgaaacaaatcgagttagaggtgttactttgttattcaatgaaccaccagaggctcgcaaaccagatattaaatggaggctttatgttttcaaggctggtgaagtgctaaatgagcccctttatatacatcgccaaagttgttatctttttggaagggaaagaagggttgctgatatccctacagatcatccctcttgcagcaagcaacatgctgttattcaattccggcaagttgaaaaggagcaacctgatggtacattattaaagcaagtaaggccttacgttatggaccttggaagcacaaacaaaactttcataaatgatagtcccattgaacctcaacgatattacgaacttaaggaaaaggacaccattaaatttggtaacagtagtcgagaatatgtattactacatgagaattctattgggcaatagacactaatgtctccaatttcgctctatctgctcatcagaactgattaaagcagcatttgacctgcagtttttggtaattaatgtccaacttctgtgtattccctcctttcagaagtttctagatcagtctgtctacaagtttcttgttattattatatatgcaagatacattagataatttattttgaagttgtataatacaatcttgagccgcccacttaaccaaagttaactcttgtaagctgataaatttgccctgtgaatttaacttgcttggttggaacatttgcatgttagtttcggacagggttcaacattttcaaaaaaaaaaaaaaaaa

SEQ ID NO: 4644 - protein, 189 aa, Glycine max
  misc_feature: PFam Name: FHA; PFam Description: FHA domain
  misc_feature: GI Number: 55237530; NR Description: ENSANGP00000010453
  misc_feature: GI Number: 31223455; NR Description: ENSANGP00000010453
  misc_feature: GI Number: 57096584; NR Description: PREDICTED: similar to
  misc_feature: GI Number: 62649625; NR Description: PREDICTED: similar to
  misc_feature: GI Number: 56541116; NR Description: Unknown (protein for
MTNAREAEQMDDEDDSIRKMKAAEEALEEKQKQKPSFELSGKLAGETNRVRGVTLLFNEPPEARKPDIKWRLYVFKAGEVLNEPLYIHRQSCYLFGRERRVADIPTDHPSCSKQHAVIQFRQVEKEQPDGTLLKQVRPYVMDLGSTNKTFINDSPIEPQRYYELKEKDTIKFGNSSREYVLLHENSIGQ

SEQ ID NO: 4645 - DNA, 1637 bp, Glycine max
  misc_feature (1)..(1637): Ceres cDNA ID no. 21995854
  misc_feature (1)..(1637): Ceres CLONE  ID no. 540940
  misc_feature (1)..(1637): Also known as  Ceres CDNA ID no. 25088234
agaatctgtgacacagtctgatgggattattggtatacaaagcactgagacagtcaatgcaagaatggaagagggatatcatcatgcatccacatctacacagaccagtccagatgaaaatgggatgaaaaatattcaaccagagcaactggaaatacaagaaatggggagaagagagagtgcattaggcaaagatatagagcaacaacctaccctcctagaggagtatcacttgaggaataaatcagaaagaagccctgcaacttatatatctagtcatgactttactgagaatagccattttcctgaaggaaaagaggcacttaatggtgctatggaggagttaaaagatggttacatttctgagaatgggaaactggttcttgatttcttgcaagccatccatgctgcagagaaaaggcaggctgacttagatgcacatgcttttaacgaagagaagaaagtgttaaaggaaaaatatgaaaagaagttgaaagatgcagctgccagagaacttatgctcgctgaggaggctgcaatgttggacagggagctaaaaagagagagagcaaaagcatcccttgctatcaagtcacttcaagaaaagatggaagagaaactgaagacagaactagaacaaaaggagattgaaactgatttgaagtttaaacaaactcaggaattagcaaaggcagagttaaatgcagccatagcaaatgagaaggcagctcaaattgaaaaaatggctgaagcaaatgttaatataaatgccttatgcatggcattttatgctcgatctgaagaagctcgtcaaagtcatgctacacaaaattttgctttgagagcacttgcattggaagatgcactatctaaaggacttccaattgagacagaaatagcatctttgcagtcttatcttggaagcacagataaagattcagttttggatttggtgctagcatcccttcctgaagaaacacgaagcaacggcacagacacacaactgcagttaaagcagaagtttgatgccttaaaaggtagtgtaagacacttcagcttcttcccaccgggagggggaggtatgttggcacattctttggcacatgtagcatcctggttgaaggttagggaagacaatcaatctggtgatgggatcgaatctgtgatcaataaagttgaagtttatttggcagaaggaaaacttgctgaagcagcagcttgtctagaagaaagtgtgagaggcacacaagctgcagaaattgttgcaggttgggtgaggcaagcaagaaacagggctatttctgagcaagcagtgctgcttcttcaatcctatgccaattcccttagctttacatgattctcaaattttgaatatttacaaaaccatgtgaattcaatacatggcagagattatctttggcggattattccaacgggaattattgacctatgaggaaaaaaaataacgtttttgtttcataggagcagaaattagttgattctgtgaattctatgcaactccagtggcattggagttttgaccgaagtgatatcaggctctgtataattttgccttttgttttacctgaataacagaaatgttgcattgcaacatattgaaaaaaaaaaaaaaaaaa

SEQ ID NO: 4646 - protein, 430 aa, Glycine max
  misc_feature: PFam Name: Myosin_tail_1; PFam Description: Myosin tail
  misc_feature: PFam Name: TolA; PFam Description: TolA protein
  misc_feature: GI Number: 32492176; NR Description: OSJNBb0034I13.6 [Oryza sativa (japonica cultivar-group)] >gi|50929023|ref|XP_474039.1|
MEEGYHHASTSTQTSPDENGMKNIQPEQLEIQEMGRRESALGKDIEQQPTLLEEYHLRNKSERSPATYISSHDFTENSHFPEGKEALNGAMEELKDGYISENGKLVLDFLQAIHAAEKRQADLDAHAFNEEKKVLKEKYEKKLKDAAARELMLAEEAAMLDRELKRERAKASLAIKSLQEKMEEKLKTELEQKEIETDLKFKQTQELAKAELNAAIANEKAAQIEKMAEANVNINALCMAFYARSEEARQSHATQNFALRALALEDALSKGLPIETEIASLQSYLGSTDKDSVLDLVLASLPEETRSNGTDTQLQLKQKFDALKGSVRHFSFFPPGGGGMLAHSLAHVASWLKVREDNQSGDGIESVINKVEVYLAEGKLAEAAACLEESVRGTQAAEIVAGWVRQARNRAISEQAVLLLQSYANSLSFT

SEQ ID NO: 4647 - DNA, 1132 bp, Glycine max
  misc_feature (1)..(1132): Ceres cDNA ID no. 21995855
  misc_feature (1)..(1132): Ceres CLONE  ID no. 541381
  misc_feature (1)..(1132): Also known as  Ceres CDNA ID no. 23617194
atttacacaaaatcatcaatggcaatggcctctcttgcatcctcaagtgttcttttgaacctcttgttcatcgtttctgcgctccatttgggagcagcagcagcaagaattctgagtgaaaaggaggaccaacaacagttgcagttccaataccacaaaggccctcttctcagcggcaatatctctgtcaatctcatatggtacggtagcttcaagccttcccagcgagccatcatctccgatttcatcacctccctttcctcttctccaaaatccacagcccaaccatccgtcgccacgtggtggaaaggcactgaaaaatactaccaactcatcaagtcggcaccaaaacccagcctcaccctcgctctcggtgcccaaatcctcgacgagaactactcccttggaaaatcactcaccaccgacaacatcgttagtttagcatccaagggtgctcccaatgacgccatcaacgttgttctaacattctcggacgtaaccgttgaggggttctgttccagtaggtgcgggactcacggctcctcggtgggtcatggcaagttggcttacgtgtgggtggggaactcggagacgcagtgcccgggccaatgcgcatggcccttccaccagcccatttacggcccacagagcccaccattggtagcgcccaacaacgacgtgggcctggatggaatggtcatcaacgtggccaccctattggccgggaccgttacaaacccttgggggaatggctacttccaaggacccaaagaggctcctctcgaagccgcttccgcttgcacagggctgtacggcaagggcgcttaccctggctacgctggggaactcttgctggaccccactaccgccgctagctacaatgctaacgccgtcaatcaccgcaaatatttgttgccggcactctttgaccctaccacttcagcttgttctactctgccgtaactctaaaactcgggtgcttagcttctatgttagggctacactatcaccccaagagattcttttatttgttgtttatctggatgaataaatatacaatgttcaatgtacaaagcaaaacatatagtatatatatatgaattgaattattggtaaaaaaaaaaaaaaaaaa

SEQ ID NO: 4648 - protein, 1132 aa, Glycine max
  misc_feature: PFam Name: Phi_1; PFam Description: Phosphate-induced
  misc_feature: GI Number: 31074969; NR Description: erg-1 [Solanum tuberosum]
  misc_feature: GI Number: 3759184; NR Description: phi-1 [Nicotiana tabacum]
  misc_feature: GI Number: 21537055; NR Description: phosphate-induced protein phi-1, putative [Arabidopsis thaliana] >gi|25371902|pir||H86471 probable phosphate-induced (phi-1) protein [imported] - Arabidopsis thaliana >gi|12320953|gb|AAG50598.1|
  misc_feature: GI Number: 21593043; NR Description: putative phi-1-like
  misc_feature: GI Number: 50912939; NR Description: putative phi-1 [Oryza sativa (japonica cultivar-group)] >gi|46805678|dbj|BAD17079.1| putative phi-1 [Oryza sativa (japonica cultivar-group)] >gi|46805967|dbj|BAD17261.1| putative phi-1 [Oryza sativa
ATTTACACAAAATCATCAATGGCAATGGCCTCTCTTGCATCCTCAAGTGTTCTTTTGAACCTCTTGTTCATCGTTTCTGCGCTCCATTTGGGAGCAGCAGCAGCAAGAATTCTGAGTGAAAAGGAGGACCAACAACAGTTGCAGTTCCAATACCACAAAGGCCCTCTTCTCAGCGGCAATATCTCTGTCAATCTCATATGGTACGGTAGCTTCAAGCCTTCCCAGCGAGCCATCATCTCCGATTTCATCACCTCCCTTTCCTCTTCTCCAAAATCCACAGCCCAACCATCCGTCGCCACGTGGTGGAAAGGCACTGAAAAATACTACCAACTCATCAAGTCGGCACCAAAACCCAGCCTCACCCTCGCTCTCGGTGCCCAAATCCTCGACGAGAACTACTCCCTTGGAAAATCACTCACCACCGACAACATCGTTAGTTTAGCATCCAAGGGTGCTCCCAATGACGCCATCAACGTTGTTCTAACATTCTCGGACGTAACCGTTGAGGGGTTCTGTTCCAGTAGGTGCGGGACTCACGGCTCCTCGGTGGGTCATGGCAAGTTGGCTTACGTGTGGGTGGGGAACTCGGAGACGCAGTGCCCGGGCCAATGCGCATGGCCCTTCCACCAGCCCATTTACGGCCCACAGAGCCCACCATTGGTAGCGCCCAACAACGACGTGGGCCTGGATGGAATGGTCATCAACGTGGCCACCCTATTGGCCGGGACCGTTACAAACCCTTGGGGGAATGGCTACTTCCAAGGACCCAAAGAGGCTCCTCTCGAAGCCGCTTCCGCTTGCACAGGGCTGTACGGCAAGGGCGCTTACCCTGGCTACGCTGGGGAACTCTTGCTGGACCCCACTACCGCCGCTAGCTACAATGCTAACGCCGTCAATCACCGCAAATATTTGTTGCCGGCACTCTTTGACCCTACCACTTCAGCTTGTTCTACTCTGCCGTAACTCTAAAACTCGGGTGCTTAGCTTCTATGTTAGGGCTACACTATCACCCCAAGAGATTCTTTTATTTGTTGTTTATCTGGATGAATAAATATACAATGTTCAATGTACAAAGCAAAACATATAGTATATATATATGAATTGAATTATTGGTAAAAAAAAAAAAAAAAAA

SEQ ID NO: 4649 - DNA, 1659 bp, Glycine max
  misc_feature (1)..(1659): Ceres cDNA ID no. 21995856
  misc_feature (1)..(1659): Ceres CLONE  ID no. 542397
  misc_feature (1)..(1659): Also known as  Ceres CDNA ID no. 24366500
gaatatcgaacgaaaataaaaaatactctattttttaatgtgtttctagtgacgatccttgttctgttgtgggatattgtgttgaatgttgtttgcagggcgaaacatacaaaggcgttgcctcgtgtaaactacagtggagaaaaaatgcgacacaagtttcagtacttcctctccatctggcgacgagtcaagagctagagttttgaaaaagttgagggagaaattgaatgttgaagatgtgatgttacaagaggaattgctgatacaagaaggcattctctttgatccttcatcagtagaagaggagtcagacatagaagacctcaccttacaggcgatatcctcactacaagccgccatggaaaagcttacagctactgttgatgagcttaaaggggagaatagcattctcaaggccaaagttgatgcctccatggaatctctgttctacaagggagcagagaatagatcgatttttcaaaatatggtttcagtggatgctatggacttgccattcctaaatgcctatctggattcgttgggtttgccaaattttaggaagggaagcaactttgccgcagcagctgcaactatacttccagccactgcatcatccctctgccccttctcctttggggttcaggtgtctcagttcctccgattcaaagctcgggcccttgaattgatcgctaaaggcaggaaatttgataagtacgtcccagatgaaaatatttttgagaagggattgtacatgtttgacattggccagaatgatctcgctggagcattttattcaaaaacattggaccaaatacttgcgtcaattcccacaattcttttagaacttgaaaagggaataaagaatctctatgaccagggggctagatatttctggatacacaatacaggtcctctcggatgcttgcctcagaatatagccaaatttggaactgattcatcaaagcttgacggactagggtgtgttagttcacacaaccaagctgctaaaacctttaacctacagctacgtgctctctgtactaaattgcagggccaatatccagattcaaatgtcacatacgttgatatcttcactataaaatcaagcctcattgcaaactattctagatacggatttgaacaacctattatggcttgttgtggatacggaggtccaccactaaactatgacagtcgagtttcctgtggggaaacaaagaccttcaacggaaccacaattacagcaaaagcttgtaatgatagcagtgagtacataagctgggatgggattcattacactgagactgcaaatcaatatgtagcatcacaaattctcactggaaagtactcggaccctcctttctcagacaaaatgccattcctacttaagctcaagttttaaataccccattatatttattgttattattatttgattctttacggtatcgtgaaagcaatagctgattgtaactttgaatgacagtcaagctcttactaatgaatatgttttaatgattggtcccattggcatggtaacatggtctgtgtgataatgttcaaggattggtaattgaacacattcagacttcatggttcatttgtatgcatatactatctaagagggccttttgggatacacaaaaaaaaaaaaaa

SEQ ID NO: 4650 - protein, 386 aa, Glycine max
  misc_feature: PFam Name: Lipase_GDSL; PFam Description: GDSL-like
  misc_feature: GI Number: 21537184; NR Description: early nodule-specific
  misc_feature: GI Number: 42571877; NR Description: GDSL-motif
  misc_feature: GI Number: 21553789; NR Description: putative nodulin
  misc_feature: GI Number: 23397291; NR Description: putative nodulin
  misc_feature: GI Number: 6729028; NR Description: putative nodulin [Arabidopsis thaliana] >gi|15810237|gb|AAL07236.1| putative nodulin protein [Arabidopsis thaliana] >gi|15229919|ref|NP_187169.1|
MLQEELLIQEGILFDPSSVEEESDIEDLTLQAISSLQAAMEKLTATVDELKGENSILKAKVDASMESLFYKGAENRSIFQNMVSVDAMDLPFLNAYLDSLGLPNFRKGSNFAAAAATILPATASSLCPFSFGVQVSQFLRFKARALELIAKGRKFDKYVPDENIFEKGLYMFDIGQNDLAGAFYSKTLDQILASIPTILLELEKGIKNLYDQGARYFWIHNTGPLGCLPQNIAKFGTDSSKLDGLGCVSSHNQAAKTFNLQLRALCTKLQGQYPDSNVTYVDIFTIKSSLIANYSRYGFEQPIMACCGYGGPPLNYDSRVSCGETKTFNGTTITAKACNDSSEYISWDGIHYTETANQYVASQILTGKYSDPPFSDKMPFLLKLKF

SEQ ID NO: 4651 - DNA, 1217 bp, Glycine max
  misc_feature (1)..(1217): Ceres cDNA ID no. 21995862
  misc_feature (1)..(1217): Ceres CLONE  ID no. 546837
  misc_feature (1)..(1217): Also known as  Ceres CDNA ID no. 24399407
gaaccattcttcctcgcaacttgttccatttttcttccttcctcattcctcacttccgtcccgaaaatggcttcaagtggcgttgcgggaacttccacacccgaattctaccagaacgtcgtcgtaatgcgtcacggcgatcgcatcgacaacttcgaacccatgtgggtgtccaccgctacccgaccctgggacccaccccttatccaacagggtcgggtccgagccttcgccacgggtcgcaagttccgcaacaacctccctttcactctccaccgcgtcttcgtctctcccttcctccgatgcatccaaaccgccgccgaagtcgtcgttgcactctctgccatcgccgccggcgacgaccccaacgtcatcgtcggcgatgacgtcccaatcgatccctccaaactcaaggtctctgttgaatatgggttatgtgaaatgatgagcagggacgctatcagacttgaggtggctcctaaagatggaaattggggctttgatgtatcagagcgtgaggccatgcttccggctgggacagtggataagaatgtggaacgggtctataaagagttgcccaagtgggaagaagatcccaatttgcacacaaggcctagatataagcaaatagttaaagaccttgcagacaaatatcatactgagaacttgctgcttgtcacacacggggaaggtgttggggtggctctttcttcattcaaaaaggatgttacagtgtacgaagttgattactgtggatacgtccaacttagacgcccaattttcaagaaagaccagtcatttactgcaggagaatttgaagttcttaatcacaatggtcaaactggcgtaaatttcatcccaaattaatggccatcttcatgtcttaggcctgattctcactactactctactctggctacttcatatttgagtcctccaaagtccaaatgactcctctattgtgaatgcttgattgagtaggaaaatttaaacaccattattcttcaatcataggatatttgattttccttgattaaatagtaaacataggaggaaaataaatagtactatagctttattcttctgcttaattcagaataagttaaaagatacattactctatgcatttactgaaattttggtatatgatagaactcaatggtgaagaatgatctgtgtaggcaattctacttatgagtaaaaaaaaaaaaaaaaaa

SEQ ID NO: 4652 - protein, 266 aa, Glycine max
  misc_feature: PFam Name: PGAM; PFam Description: Phosphoglycerate mutase family
  misc_feature: GI Number: 21553703; NR Description: pRIB5 protein
  misc_feature: GI Number: 21592687; NR Description: unknown [Arabidopsis thaliana]
  misc_feature: GI Number: 53736101; NR Description: COG0406:
  misc_feature: GI Number: 48892498; NR Description: COG0406:
MASSGVAGTSTPEFYQNVVVMRHGDRIDNFEPMWVSTATRPWDPPLIQQGRVRAFATGRKFRNNLPFTLHRVFVSPFLRCIQTAAEVVVALSAIAAGDDPNVIVGDDVPIDPSKLKVSVEYGLCEMMSRDAIRLEVAPKDGNWGFDVSEREAMLPAGTVDKNVERVYKELPKWEEDPNLHTRPRYKQIVKDLADKYHTENLLLVTHGEGVGVALSSFKKDVTVYEVDYCGYVQLRRPIFKKDQSFTAGEFEVLNHNGQTGVNFIPN

SEQ ID NO: 4653 - DNA, 1936 bp, Glycine max
  misc_feature (1)..(1936): Ceres cDNA ID no. 21995863
  misc_feature (1)..(1936): Ceres CLONE  ID no. 547307
  misc_feature (1)..(1936): Also known as  Ceres CDNA ID no. 24428161
ttcaaattccaacaacaccaaacaccatgaacaaagttcacatcctggcgttcccatacccagcacagggccacatcctcccactcctcgacctcatccaccacttagccctacgaggcctaaccgtcacaatcataatcacaccaaaaaacgttcctatcttaaaccctctcttatcctcgcatccaaacacggtccaaactttagttctcccatttcctccccaccctaacatccccgctggcgcagagaacgtccgtgaggtcggcaacagaggaaactaccccttcatcaacgccctctccaaactccaaccagaaattatccactggttcgcaacccacagtaaccctcctgtagcactcgtctccgatttcttcctcggttggactcagcaactcgcttcccaactcagtattcctaggatcacgttctactgctccggcgcgtccttaatcgccatcctccagcgctgctggaaaaatctacacttttacaattcacagggagataataatattattaattttcccgaaattccgggaacgccgtcgtttaagagggagcacctccccacgttgttcctccgctacaaggaatcggagccggagtctgagtttgttagagagagcatgcttcttaacgacgcgagctggggatgcgtgttcaacacgttccgcgcgttggagggttcttatttggatcacattaaagaagagttgggtcataagagtgtgttttcggtcgggccgttgggattgggtcgggctgagtccgacccaaatagaggatccgaggttttgcgttggcttgacgaggtggaggaagaagcgtcggtgttgtacgtttgctttgggagtcagaagttgatgagaaaggaacaaatggaagcattggcggtgggattagaaaaatccgaaacgagattcgtgtgggtggtgaagacggcttccacgaaggaagaaatggatgaagggttcgggttggtaccggaggggtttgcggatcgggtttcgggtcggggcttggttgtaaccgggtgggccccacaagtggcgatactgagtcaccgagctgtgggggggtttgtgagtcactgcggatggaactcggtgttggaggcgatgacgagtggggttgtgattgtggggtggcccatggaggcggatcagtttgtgaatgctaagatgttggtggaagatagagggctaggggtgcgggtttgtgaagggtcggattttgtgcccgacccggatgagtggggtcaggtcgtgaaagcggttatggttagagacagtgctgagaagagaagagcgaagttgatgagagaggaagctattggggctgtgagggaaggtggcgagtcttccatggatgtagagaagctcgtgaaatcgttgttggagcttggtgttaaacaaggataagtgagtgttcttccttaatctatttgttgtgttcttttatctaagtctaacctagagtttactagacatagtctaaaagcattcaactgcgactgaaagcattcgaatatcaatttgaaacatgcatacaagataaatgataggtcggttggtatacaaccatgaaggaccttgggatcatcctttgttagcatacaacaagtaaggatacaacaaatacataagtgtcaagcctctggtgctcaagcacaaaaaggtctgaatatattatcggaatccgtgtggtcaaaccttcctaatctgaagctgcacgatggctgcccactgattggaaagaacacataatcttctagccttggtggatgagcatgaagagagtctaagtcctaagtgagaatacaaattttatttgggaagaaacttcaaatgtgacttgtattttcaaagcaattaatgattatgaaattaaaagtgtaatttttttttttgacaaaaaaaaaaaaaaaaaa

SEQ ID NO: 4654 - protein, 466 aa, Glycine max
  misc_feature: PFam Name: UDPGT; PFam Description: UDP-glucoronosyl and
  misc_feature: PFam Name: Glyco_transf_28; PFam Description:
  misc_feature: GI Number: 19911191; NR Description: glucosyltransferase like
  misc_feature: GI Number: 58430500; NR Description: putative
  misc_feature: GI Number: 2232354; NR Description: UDPG glucosyltransferase
  misc_feature: GI Number: 7378633; NR Description: UDPG glucosyltransferase-like protein [Arabidopsis thaliana] >gi|15242769|ref|NP_195969.1| UDP-glucoronosyl/UDP-glucosyl transferase family protein [Arabidopsis thaliana]
  misc_feature: GI Number: 22330612; NR Description: UDP-glucoronosyl/UDP-glucosyl transferase family protein
MNKVHILAFPYPAQGHILPLLDLIHHLALRGLTVTIIITPKNVPILNPLLSSHPNTVQTLVLPFPPHPNIPAGAENVREVGNRGNYPFINALSKLQPEIIHWFATHSNPPVALVSDFFLGWTQQLASQLSIPRITFYCSGASLIAILQRCWKNLHFYNSQGDNNIINFPEIPGTPSFKREHLPTLFLRYKESEPESEFVRESMLLNDASWGCVFNTFRALEGSYLDHIKEELGHKSVFSVGPLGLGRAESDPNRGSEVLRWLDEVEEEASVLYVCFGSQKLMRKEQMEALAVGLEKSETRFVWVVKTASTKEEMDEGFGLVPEGFADRVSGRGLVVTGWAPQVAILSHRAVGGFVSHCGWNSVLEAMTSGVVIVGWPMEADQFVNAKMLVEDRGLGVRVCEGSDFVPDPDEWGQVVKAVMVRDSAEKRRAKLMREEAIGAVREGGESSMDVEKLVKSLLELGVKQG

SEQ ID NO: 4655 - DNA, 2047 bp, Glycine max
  misc_feature (1)..(2047): Ceres cDNA ID no. 21995864
  misc_feature (1)..(2047): Ceres CLONE  ID no. 547448
  misc_feature (1)..(2047): Also known as  Ceres CDNA ID no. 23689975
ggttttcaatttggggaaataaaaatagggggaaatattctggagagagtgtgtagaaaatatggttgtcgatgatatgacgctgtgcatcatcgtcggctatggaggttcctcttcttctcgtttctccgatgcttatcccaaaaggggtttgatggaggggagatatagtggggattgatatgatgaaggtgtttataaggttgttttgttgaattgtgtttttgggatggcaatattgtacgaaccagcaataaaactcatccaccagatgagctagcatgggcgattcttgtcttacttctatgtcaatggagaatcaccacccctccacgctcttgtcaatggactcaagtgcatcttctcacgaggaactggatttggagatgaatcgccaaatcatactcactcgtccgcccgatattaacctgcccctctccgccgagcgcagcccgccgccacagccgtggaattctgagccctgtgatattctggatgttggtcttggtactcaaggctacgagactgagagttttcttaatctgcccaaagctggtaggaagtgcgcgaagcgtgttgatagcatatggggtgcttggtttttcttcagtttttactttaaacctgctttgaacgataagtccaaggccaagattgtcagggacagcaatggtgtctcagggttcgataagtctgatctgaagctggatgttttcatggttcagcacgacatggaaaacatgtacatgtgggttttcaaggagaggccggagaacgcacttggtaagatgcagctgaggagttacatgaatgggcattctcgccaaggggagcgcccgtttccgttcagtgttgacaagggttttgctcggtcccacaggatgcagcgaaagcattatagaggactatcaaaccctcagtgcgtgcatggtgttgaggttgtttttgcacccagtctgatgaccctggatgaggatgatcgaaaaaggtggatagaactcactggccgggatttgaatttcacaatcccacctgaagcaagtgatttcagttcatggagaaatcttcccaacacggactttgagcttgagagaccacctcccccaatcaagagtggtcctaatgcacacccgaagaagctgcttaatggatccggacttaatggatctggacttcatctatctaaccacagtaatggtgatgggttggacctctctcctgtcagcagcaaaaaaaggaaggactttttccctcatggaaatgaagaagaatgttacttggctgttaatcctccatctgatcgtataccagatatagaaatgcacccaaccgagccacactggttgaatgacttcagcggggtgataaagagtgtttatggacctgttacagctgcaaaaactatttatgaggatgaacaaggttacttgattattatcagtctgccctttgtagatcttccaagtgtgaaagtttcatggaggaacactctgactcacggtatcataaaggtttcttgtatgagcacatctcggaagcctctcatcaagagacatgataggacattcaagcttacagatccatcgtcagagcactgcccccctggagagttcgtccgagaaatccctctttcaactcgaattcctgaagatgccaacatagaagcatactacgatgggccaggatcagtgcttgagatcctggtgccaaaacatcgcgtgggaccagaagagcatgaagtccgggtttgcctccgccctcatctgggagggaatgatctcaagttaacttgagataggcacttaaaaaaatttgttagggattccggtatggttcgtatgtcattgtttttctaactttgtaccatacagtgttatttgcaatagaattgtgtctcttatgtttgtctctagcaattttagctcactgactgccctggttcttttgttccggtgcatctgtattatgcttttgattgtaagcagtattgaacagctagttctcataatttataagaaattaccaaatcaaaaaaaaaaaaaaaaaa

SEQ ID NO: 4656 - protein, 503 aa, Glycine max
  misc_feature: GI Number: 34895866; NR Description: P0009G03.13 [Oryza sativa (japonica cultivar-group)] >gi|9663972|dbj|BAB03613.1|
  misc_feature: GI Number: 11611667; NR Description: SLT1 protein [Nicotiana
  misc_feature: GI Number: 34908142; NR Description: putative SLT1 protein (ion homeostasis related protein) [Oryza sativa (japonica cultivar-group)] >gi|15623836|dbj|BAB67895.1| putative SLT1 protein
MGDSCLTSMSMENHHPSTLLSMDSSASSHEELDLEMNRQIILTRPPDINLPLSAERSPPPQPWNSEPCDILDVGLGTQGYETESFLNLPKAGRKCAKRVDSIWGAWFFFSFYFKPALNDKSKAKIVRDSNGVSGFDKSDLKLDVFMVQHDMENMYMWVFKERPENALGKMQLRSYMNGHSRQGERPFPFSVDKGFARSHRMQRKHYRGLSNPQCVHGVEVVFAPSLMTLDEDDRKRWIELTGRDLNFTIPPEASDFSSWRNLPNTDFELERPPPPIKSGPNAHPKKLLNGSGLNGSGLHLSNHSNGDGLDLSPVSSKKRKDFFPHGNEEECYLAVNPPSDRIPDIEMHPTEPHWLNDFSGVIKSVYGPVTAAKTIYEDEQGYLIIISLPFVDLPSVKVSWRNTLTHGIIKVSCMSTSRKPLIKRHDRTFKLTDPSSEHCPPGEFVREIPLSTRIPEDANIEAYYDGPGSVLEILVPKHRVGPEEHEVRVCLRPHLGGNDLKLT

SEQ ID NO: 4657 - DNA, 1652 bp, Glycine max
  misc_feature (1)..(1652): Ceres cDNA ID no. 21995865
  misc_feature (1)..(1652): Ceres CLONE  ID no. 548186
  misc_feature (1)..(1652): Also known as  Ceres CDNA ID no. 24766371
gaataccttgtgcgttttgaatctctggaaattgagatggcgaacgagaacgaacccgcgaagctgctgttgccataccttcaacgcgccgatgaattgcaaaagcatgaaccactcgtcgcttattactgtcgattatatgcaatggaacgggggttgaagattccgcaaagtgagcgcacgaagaccactaatgctcttctggtttcgctcatgaagcagcttgaaaaggataaaaagtcaatccagttggggcctgaagacaatttatatctcgagggatttgctttgaatgtgtttggaaaagcagacaagcaagatcgtgctggaagagcagatttgactacagcaaaaacattttatgctgccagtatcttttttgagattcttaatcaatttggagcagttcagcctgatctggagcagaaacaaaaatatgctgtgtggaaagcagctgaaataagaaaagctttgaaagaaggaaggaagcccacagctggcccccctgatggtgatgaggatctgtcagttcctttgagttcttcaagtgatagatatgaccttgggactactgaaaatactgtttccagtcctggaccagaatctgattcatcaagaagttatcataaccctgctaactaccagaatcttccaagcattcatcctgctgctcctaaatttcatgatactgttaacgaccaacattctgctaatattccaccatctatgccatttcatgatagagtagataataacaagcattcttccgttgtttctccatcatctcactctttcacacctggagtttatccttcccaagactaccattctcctccaccttcccgagactatcattctcctccaccatcccaagactatcattctcctccatcgtcccaagattatcatcctcctccaccatcccaagattaccatcctccaccgtcccaagattaccatcctccacctgctagatctgaaggttcttattctgagctctacaatcatcagcaatactcaccagagaattcacagcatttaggtcctaactacccttctcatgaaacttcctcttattcttatccccattttcagtcttatccaagttttacagaaagcagccttccatcagtcccatcaaactatactcattatcaaggatcagatgtttcatattcttcccagtcggctccgctaactacaaaccattcatcaagtgctcaacacagtagcagaaatgaaactgtggaacctaagccaacaactactcaggcataccagtacgacagtaactaccagccagcacctgaaaaaatagcagaggcacacaaggctgcaagatttgccgttggggcactggcatttgatgatgtctcagttgcagtagacttcttgaagaaatcacttgagttgctgacaaatccatcagctggccagtaaaattttttgtaaatcgaaatgtggatttcggtggtgttttctaccttttatttgcatgtcttgttttgtatattaggtacatcatgcatttaaagtgtgaaaaaatttgggaagatgaacggaaattataaaatctgctgggatctgcaatctttcttgtttatctggtagttattgatattggcttgtttgttaaaaaaaaaaaaaaaaaa

SEQ ID NO: 4658 - protein, 467 aa, Glycine max
  misc_feature: PFam Name: Extensin_2; PFam Description: Extensin-like region
  misc_feature: PFam Name: GRASP55_65; PFam Description: GRASP55/65 family
  misc_feature: PFam Name: Atrophin-1; PFam Description: Atrophin-1 family
  misc_feature: GI Number: 54291496; NR Description: putative LYST-interacting protein LIP5 [Oryza sativa (japonica cultivar-group)] >gi|54290626|dbj|BAD62197.1| putative LYST-interacting protein LIP5 [Oryza sativa (japonica
  misc_feature: GI Number: 34852612; NR Description: similar to RIKEN cDNA
  misc_feature: GI Number: 31198779; NR Description: ENSANGP00000009396 [Anopheles gambiae] >gi|21292235|gb|EAA04380.1| ENSANGP00000009396
  misc_feature: GI Number: 50742667; NR Description: PREDICTED: similar to
  misc_feature: GI Number: 47085897; NR Description: zgc:64104 [Danio rerio]
MANENEPAKLLLPYLQRADELQKHEPLVAYYCRLYAMERGLKIPQSERTKTTNALLVSLMKQLEKDKKSIQLGPEDNLYLEGFALNVFGKADKQDRAGRADLTTAKTFYAASIFFEILNQFGAVQPDLEQKQKYAVWKAAEIRKALKEGRKPTAGPPDGDEDLSVPLSSSSDRYDLGTTENTVSSPGPESDSSRSYHNPANYQNLPSIHPAAPKFHDTVNDQHSANIPPSMPFHDRVDNNKHSSVVSPSSHSFTPGVYPSQDYHSPPPSRDYHSPPPSQDYHSPPSSQDYHPPPPSQDYHPPPSQDYHPPPARSEGSYSELYNHQQYSPENSQHLGPNYPSHETSSYSYPHFQSYPSFTESSLPSVPSNYTHYQGSDVSYSSQSAPLTTNHSSSAQHSSRNETVEPKPTTTQAYQYDSNYQPAPEKIAEAHKAARFAVGALAFDDVSVAVDFLKKSLELLTNPSAGQ

SEQ ID NO: 4659 - DNA, 2416 bp, Glycine max
  misc_feature (1)..(2416): Ceres cDNA ID no. 21995866
  misc_feature (1)..(2416): Ceres CLONE  ID no. 549232
  misc_feature (1)..(2416): Also known as  Ceres CDNA ID no. 23672521
gttgagtgatgggagtcgtagtatgacacctcaaataaaaaatgaattattgaaacctgttgaacaaaatagaagcatggatatcctggatagtgctggtgaaagaactttggtttctgatgtttctctttcagctgttaaattgaacaaccagttgtcttctctaccattagccggagatagtggtagaggcagctttactgcaactaacacaactagttcaattgacatcactcgacaaccattaagctttggtcctgaggaagcagttatatctacctgtgaagagattgagaatttgtcctgcgagttttcttctgtttacattgatagaaatgcccaaaataaacactacagcctatccatacctagcagctcacctgataatgtgttggttaaatctatgcaatctcaagaattgcagtataatactgacaaattgaaagatttaatgattaaaaatgcagacagtaaagctgctgcattatataatgaggtttgtaatttaaaggaacagtgtgatttgtcattggattctcaatctcaagtagtatcagctaatactgaagtggaagatgatgtaacaacttttgataatcagagacttaaggatccagaagttattggttcttatttgcccgagtcagccagtttccttcatgtctcaaatcattctagtcctcttcttctgcagcgtggtgacccatgtaatgttgtaaatgctggttttttagatgccaatgataaagttgaggataactcactattacatgcacataacatatgcaatggatattctgatgagatcagtaccagttcttattggttccgccatgatgcaagcaatgagcaccacattggaagattagttagtgatgcagttaatattggaagtgatgctgttatggacaagggtgagagtagtataatttcaaatatattatcgatggagtttgatgcctgggatgactcgctggcatcacatgagagtttgaccaagttgttgggtgacaacactgacagccagaatggtccgttaaaaaaatctagttctaggaaagttcaaagtaacaatcaatcaagattttcttttgcatggcaggaggaatccaaattccaagccaatgtacctccatcttctggtgctacccagccatttccaaagaatggctcactcatccaggattttgtggaaagagacttttctttgaacaagctgggttttgcaaatggcttcccctccaataacctcaaggaatctggaaatcttggcagtggtcatttcattgcttcaaacaataagctttcagctgtttcaagagcacaaatttcagcaccgccaggattctctgttccgaacagggcaccacctcctggtttctcttcagttgagagaatggggcaggcttttgactccctctctgggaattcattgctggacccttctttcttactgagaaattcttatcaaacaccctcaaatggaaatattggtggtccaggtgacgttgaatttatggatcctgctattttggcagttagtaaaggccctgaacagtttaactactttgaaaatgaggccagagttcaattattgatgcaaagatctccctcaccacagcaagaccttcgattttctgaaattgggaattccttttctcagtttggtgattcttatggcatttcttcaaggttaaatcaatcacaagttagtaatctggcttcatttcctcagttatctctgcagcagtctagaaatgcagtcttgtcaaatggccaattggatgggcggaatggaaatggtctgggtgtggcagagcttttgagaaatgaaagacttggatttaacaagttttatagaggatatgatgattcaaaatatcggatgcctaattctatggatgtgttcaacaggacatttgggatttgagattgttgggtatattggccatggtaaagccaagtcagaaataaacaaacagaatttttctgcattgccaaaggtgatggggatggctcatgacataacctgtctattgggctacgaaaggatgaaactctcgcttatagctgcagctggttactgttcttgatttgcagaagcaagctgcgttgagatttaagaaatcaatcatggatcggaaagtatttggcaggtagatcttagttgagtggtttctcttagtacagaacatggaaacctgttgatcgatcgactatcaaataatctctcctattttgttaatgatattttttcttttaccgatattgtggatatagatagaggtttgattattttttaatatgtatattttgtatgaaatacgtcactttttaaagttggaaatcccttctgatatgtgtatgaaagagatcttttactaaaaaaaaaaaaaagaaaaaaaaaaaaaaaaaa

SEQ ID NO: 4660 - protein, 2416 aa, Glycine max
  misc_feature: GI Number: 15238634; NR Description: RNA recognition motif
  misc_feature: GI Number: 8885568; NR Description: general negative
GTTGAGTGATGGGAGTCGTAGTATGACACCTCAAATAAAAAATGAATTATTGAAACCTGTTGAACAAAATAGAAGCATGGATATCCTGGATAGTGCTGGTGAAAGAACTTTGGTTTCTGATGTTTCTCTTTCAGCTGTTAAATTGAACAACCAGTTGTCTTCTCTACCATTAGCCGGAGATAGTGGTAGAGGCAGCTTTACTGCAACTAACACAACTAGTTCAATTGACATCACTCGACAACCATTAAGCTTTGGTCCTGAGGAAGCAGTTATATCTACCTGTGAAGAGATTGAGAATTTGTCCTGCGAGTTTTCTTCTGTTTACATTGATAGAAATGCCCAAAATAAACACTACAGCCTATCCATACCTAGCAGCTCACCTGATAATGTGTTGGTTAAATCTATGCAATCTCAAGAATTGCAGTATAATACTGACAAATTGAAAGATTTAATGATTAAAAATGCAGACAGTAAAGCTGCTGCATTATATAATGAGGTTTGTAATTTAAAGGAACAGTGTGATTTGTCATTGGATTCTCAATCTCAAGTAGTATCAGCTAATACTGAAGTGGAAGATGATGTAACAACTTTTGATAATCAGAGACTTAAGGATCCAGAAGTTATTGGTTCTTATTTGCCCGAGTCAGCCAGTTTCCTTCATGTCTCAAATCATTCTAGTCCTCTTCTTCTGCAGCGTGGTGACCCATGTAATGTTGTAAATGCTGGTTTTTTAGATGCCAATGATAAAGTTGAGGATAACTCACTATTACATGCACATAACATATGCAATGGATATTCTGATGAGATCAGTACCAGTTCTTATTGGTTCCGCCATGATGCAAGCAATGAGCACCACATTGGAAGATTAGTTAGTGATGCAGTTAATATTGGAAGTGATGCTGTTATGGACAAGGGTGAGAGTAGTATAATTTCAAATATATTATCGATGGAGTTTGATGCCTGGGATGACTCGCTGGCATCACATGAGAGTTTGACCAAGTTGTTGGGTGACAACACTGACAGCCAGAATGGTCCGTTAAAAAAATCTAGTTCTAGGAAAGTTCAAAGTAACAATCAATCAAGATTTTCTTTTGCATGGCAGGAGGAATCCAAATTCCAAGCCAATGTACCTCCATCTTCTGGTGCTACCCAGCCATTTCCAAAGAATGGCTCACTCATCCAGGATTTTGTGGAAAGAGACTTTTCTTTGAACAAGCTGGGTTTTGCAAATGGCTTCCCCTCCAATAACCTCAAGGAATCTGGAAATCTTGGCAGTGGTCATTTCATTGCTTCAAACAATAAGCTTTCAGCTGTTTCAAGAGCACAAATTTCAGCACCGCCAGGATTCTCTGTTCCGAACAGGGCACCACCTCCTGGTTTCTCTTCAGTTGAGAGAATGGGGCAGGCTTTTGACTCCCTCTCTGGGAATTCATTGCTGGACCCTTCTTTCTTACTGAGAAATTCTTATCAAACACCCTCAAATGGAAATATTGGTGGTCCAGGTGACGTTGAATTTATGGATCCTGCTATTTTGGCAGTTAGTAAAGGCCCTGAACAGTTTAACTACTTTGAAAATGAGGCCAGAGTTCAATTATTGATGCAAAGATCTCCCTCACCACAGCAAGACCTTCGATTTTCTGAAATTGGGAATTCCTTTTCTCAGTTTGGTGATTCTTATGGCATTTCTTCAAGGTTAAATCAATCACAAGTTAGTAATCTGGCTTCATTTCCTCAGTTATCTCTGCAGCAGTCTAGAAATGCAGTCTTGTCAAATGGCCAATTGGATGGGCGGAATGGAAATGGTCTGGGTGTGGCAGAGCTTTTGAGAAATGAAAGACTTGGATTTAACAAGTTTTATAGAGGATATGATGATTCAAAATATCGGATGCCTAATTCTATGGATGTGTTCAACAGGACATTTGGGATTTGAGATTGTTGGGTATATTGGCCATGGTAAAGCCAAGTCAGAAATAAACAAACAGAATTTTTCTGCATTGCCAAAGGTGATGGGGATGGCTCATGACATAACCTGTCTATTGGGCTACGAAAGGATGAAACTCTCGCTTATAGCTGCAGCTGGTTACTGTTCTTGATTTGCAGAAGCAAGCTGCGTTGAGATTTAAGAAATCAATCATGGATCGGAAAGTATTTGGCAGGTAGATCTTAGTTGAGTGGTTTCTCTTAGTACAGAACATGGAAACCTGTTGATCGATCGACTATCAAATAATCTCTCCTATTTTGTTAATGATATTTTTTCTTTTACCGATATTGTGGATATAGATAGAGGTTTGATTATTTTTTAATATGTATATTTTGTATGAAATACGTCACTTTTTAAAGTTGGAAATCCCTTCTGATATGTGTATGAAAGAGATCTTTTACTAAAAAAAAAAAAAAGAAAAAAAAAAAAAAAAAA

SEQ ID NO: 4661 - DNA, 1345 bp, Glycine max
  misc_feature (1)..(1345): Ceres cDNA ID no. 21995867
  misc_feature (1)..(1345): Ceres CLONE  ID no. 553656
  misc_feature (1)..(1345): Also known as  Ceres CDNA ID no. 24367370
ggagctgcatagacggttcaaaactactagttaatcaggagtaatgatacaacattgcatatgcaacagaagtcaacaaaacaacaattaaatcacaccttgagagagagagatagatggattgagaggcaccctttaacgcttgcttttactactgagcaacagaagatttcctcaccttcaacagcaagggccaattcaccaaacataaacatgagaagcaattttgaggctgaaagtcagtacttaacggagctgctagcagaacaccagaagcttgggcctttcatgcaagtcctacccttgtgtaccaggctcttaaatcaagagattttaagggtttctggaaagaatggaatgatgcagaaccaagggtttagtgactatgacagagtgcagttcggaagccccaaacccaatcttatgccttctttagacatacaaccaaattttacaggctggaacagcttgtcacatgaagggttagctggagtacaaggactaaacgtggattggcaaacatcgccaggtgtcccaagctctcacattgtgaagaggatattgcgcttggatattgctaatgatagctatccaaatttcaatttggttggaaggcttcttggccctaggggtaattcactgaagcgagtggaggctaccacaggttgccgtgtatttatcagagggaaaggttcaataaaagaactagataaggaagagttgttaaggggaaggccaggctacgaacacttaaatgaaccactgcacgttttgattgaggctgagttacctgtcaatgttgttgatataaggctgaggcaagcacaggaaatcatagaagaactactcaaacccatggatgagtcacaggatctctacaaaaggcaacaactaagagaacttgctatgctgaattccaattttagagaagagagccctcaactcagtgctagtccctctacattcaactccaacgaaatgaaacgggccaaaactgacctatagtatgtgtctacattgagaatcatagcatatttgatgtcagttcctgcatgttaattctgcaaagcagctacaggaaaacttcactaaaagatgggaagaaaaacgggagggggtacacatattcattgccacaatcaattcaattgtatcaatagacttgtaaaattaggagaatttcgttattattatattttgaccgattgattagtatatatatctgtaatgtctataaatataaccctgctgggactaaactgattattgttattattgtaagtttatgattgaatggaaagaacagttagtttaaaaaaaaaaaaaaaaaaaaaaaaaaaaaaaa

SEQ ID NO: 4662 - protein, 314 aa, Glycine max
  misc_feature: PFam Name: KH_1; PFam Description: KH domain
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 34909270; NR Description: P0454H12.18 [Oryza sativa (japonica cultivar-group)] >gi|15128399|dbj|BAB62585.1|
  misc_feature: GI Number: 24030184; NR Description: putative RNA-binding protein [Arabidopsis thaliana] >gi|9758634|dbj|BAB09296.1| RNA-binding protein-like [Arabidopsis thaliana] >gi|15241136|ref|NP_200425.1| KH domain-containing protein
MQQKSTKQQLNHTLRERDRWIERHPLTLAFTTEQQKISSPSTARANSPNINMRSNFEAESQYLTELLAEHQKLGPFMQVLPLCTRLLNQEILRVSGKNGMMQNQGFSDYDRVQFGSPKPNLMPSLDIQPNFTGWNSLSHEGLAGVQGLNVDWQTSPGVPSSHIVKRILRLDIANDSYPNFNLVGRLLGPRGNSLKRVEATTGCRVFIRGKGSIKELDKEELLRGRPGYEHLNEPLHVLIEAELPVNVVDIRLRQAQEIIEELLKPMDESQDLYKRQQLRELAMLNSNFREESPQLSASPSTFNSNEMKRAKTDL

SEQ ID NO: 4663 - DNA, 1933 bp, Glycine max
  misc_feature (1)..(1933): Ceres cDNA ID no. 21995868
  misc_feature (1)..(1933): Ceres CLONE  ID no. 556644
  misc_feature (1)..(1933): Also known as  Ceres CDNA ID no. 24366806
aaagatgtcgttggtggatcaagtatcattcagtgctaaagagtgaggaaaatgggttgtcaactgaaaactcaattgtttcttcttttccttgtctggggatcatggacatttctatgttatggtctcccaagtgagtactccatactagcccttgaaattgacaagtttccttcggaggaaggggtgattgagctgttccaacgatggaaggaggaaaataagaagatttacaggagcccagatcaagaaaagttaaggttcgagaatttcaagaggaacttgaaatacattgcagagaagaactcgaagcgaatttctccttacgggcagagtctcggattgaacaggtttgctgacatgagcaatgaggagttcaagagtaagtttacttcaaaggtgaagaagccatttagcaaaaggaatggcttgtctggtaaggatcactcttgcgaagatgcaccttactctttggattggaggaagaagggtgttgtgactgctgtgaaggaccaaggctattgtggctgttgttgggcattctcttccactggtgccatagaaggaataaatgcaatagtctcaggggaccttataagcctttccgaaccggaacttgtggactgtgacagaactaatgatggatgtgatggaggccacatggactatgcttttgaatgggttatgcacaatggtgggatcgacacggaaactaattatccttatagtggtgcagatggtacatgcaatgtagcaaaggaggaaaccaaggttattggcattgatggctactacaatgtggagcaatcagatcgttctctattgtgtgctacagtgaagcaacccatcagtgccggtatagatggctcttcatgggattttcaactatatattggcggaatctatgatggagattgctcaagtgatccagatgatattgaccatgcaattttggttgtgggttatggctcagagggtgatgaagattactggattgtgaagaattcatggggaacctcatggggaatggaagggtacatttatattagaaggaatactaatttaaaatatggcgtgtgtgcaatcaactacatggcctcttatcctaccaaagagcctactgcaccatccccaagtagtcctccttcaccaccatcatcaccaccgccttcaccattaacaccaccggcactaccgccaccttcaccaccggcaacaccgccactttctccaccattaccgccagcaacaccgccacccctcccaccacctccacctagtaaatgtggacaattctcatattgtccagctcatgagacatgttgctgcctttatgagttctttggtttctgcttagtttatggttgttgtgaatataagaatgctgtgtgttgcatttggaccgagtactgttgcccaagtgattaccccatttgtgatattagagatggactctgtctccagaagcatggagatttaatgggagtggctgcaaagaagataaagaagggaaggcacaagttaccatggactaaatttgaacaaacagaaaagacatatcatcaccttcagacggggaggaatgcttttgctgcagtgctttgaatttaattttttctcctcagctgttagtatctctaatgaaaaatattttatgaacatccaatgtgttatatgacacccagtgaaaaaggaaaaagagtaaaaatatatgtattagaagttatattatatgatctaatgggaggaaacagataaagaaaaataataaattgttaacgtagtgtttaaaaaaagtgagtgtccatgtaactcacctctcatgtttagattttctctatattgtgtaccattggcatggattatatctatctgttagttagtttcttctcaatacaagaagcactgagttgcactaaaaaaaaaaaaaaaa

SEQ ID NO: 4664 - protein, 517 aa, Glycine max
  misc_feature: PFam Name: Peptidase_C1; PFam Description: Papain family
  misc_feature: GI Number: 5853329; NR Description: thiol protease
  misc_feature: GI Number: 27728675; NR Description: cysteine protease
  misc_feature: GI Number: 32396018; NR Description: cysteine protease
  misc_feature: GI Number: 18391078; NR Description: cysteine protease,
  misc_feature: GI Number: 14600257; NR Description: papain-like cysteine
MGCQLKTQLFLLFLVWGSWTFLCYGLPSEYSILALEIDKFPSEEGVIELFQRWKEENKKIYRSPDQEKLRFENFKRNLKYIAEKNSKRISPYGQSLGLNRFADMSNEEFKSKFTSKVKKPFSKRNGLSGKDHSCEDAPYSLDWRKKGVVTAVKDQGYCGCCWAFSSTGAIEGINAIVSGDLISLSEPELVDCDRTNDGCDGGHMDYAFEWVMHNGGIDTETNYPYSGADGTCNVAKEETKVIGIDGYYNVEQSDRSLLCATVKQPISAGIDGSSWDFQLYIGGIYDGDCSSDPDDIDHAILVVGYGSEGDEDYWIVKNSWGTSWGMEGYIYIRRNTNLKYGVCAINYMASYPTKEPTAPSPSSPPSPPSSPPPSPLTPPALPPPSPPATPPLSPPLPPATPPPLPPPPPSKCGQFSYCPAHETCCCLYEFFGFCLVYGCCEYKNAVCCIWTEYCCPSDYPICDIRDGLCLQKHGDLMGVAAKKIKKGRHKLPWTKFEQTEKTYHHLQTGRNAFAAVL

SEQ ID NO: 4665 - DNA, 2482 bp, Glycine max
  misc_feature (1)..(2482): Ceres cDNA ID no. 21995869
  misc_feature (1)..(2482): Ceres CLONE  ID no. 556681
  misc_feature (1)..(2482): Also known as  Ceres CDNA ID no. 23691942
atctatctatctttgttaaatttattttttatgtttagttccatcttcagggtcaaacttctcttctctttagctagctagctgcagagattaacaacatggagatagaatcatcagcagcggccaccgataacaacaattggggtggtcgtggtgttgagagagagatgccatacagtggctttgacagaggaaccttcttggcttggcaagatctgagagtggtgattcctaactttggaaagggaccaaccaagaggttgcttaatggactcaatggctatgctgagcctggtagaatcatggctattatgggtccttctggctctggaaaatccacccttcttgattcacttgcaggtagactctcaaaaaatgtggtcatgacaggaaatgttcttctcaatgggaagaaaaaaggcataggagccggctacggtgttgttgcatacgtaactcaagaagatgtgctgcttggaacacttactgtgaaggagaccatatcctactcagcccatctacgtcttccaacatcaatgagcaaagaagaagttaacagcatcattgatggaacaatcatagaaatgggtcttcaagactgtgctgataggttaattggtaactggcacttaagagggataagtggaggggagaagaagagacttagcattgcacttgagattcttacaaggcctcgcttactgttccttgatgaaccaaccagtggacttgatagtgcctctgcattttttgttgttcaaactcttagaaatgttgctcgtgatggaaggactgtcatctcttccattcatcaaccaagcagtgaagtctttgcactctttgatgacctcttcttactatctgggggcgaaacagtttattttggagaagcaaaatcggcaattgagttttttgctgaagctggtttcccttgtccacgtaaaagaaatccttctgatcacttcctacgatgtatcaattctgatttcgacattgtaacagctacactgaagggatctcaaagaattcatgatgttccaaattcagcagatcctttcatgaatttggctacagcagagattaaggcaacactagttgagaaatataggcgttcaacatatgccagaagggcaaaaaacagaattcaagaactgtctaccgatgaagggcttcaacctccaacacaacatggaagtcaagctagtcggtggaagcaactattaacgttgacaaagagatcatttgtgaacatgtgtagagatgtgggttactactggttgaggatcataatttacatcattgtatccatatgtgtgggaaccgtttattttgatgttggctatagctacacttccatcctggcccgtggtgcctgcggtgcatttatatcaggatttatgacattcatgtcaattggtggctttccatcatttattgaagaaatgaaggtattttatcgagaaaggctaaatggatactatggagtagcagcatatattttagccaacttcctttcttcattcccattcttggttgcaattgctctgacatctagcaccattacgtataacatggtgaaattcaggccaggaatcagtcactttgtgtttttctttctcaacatctacagctgcatctcggtaatagagagcctcatgatggttgtagcttcacttgttccaaatttcctcatgggaataattacaggggctggaataataggaatcatgatgatgacctccggattcttcaggttgctctctgatcttccaaagccggtttggcgctacccaatttcatatatcagttatggttcttgggcaatccagggttcctacaagaatgacttgcttgggcttgagtttgatcctctgttacctggtgacccaaaattgagtggagaatacgtcatcacacacatgttaggcattgaattaaaccattccaagtggtgggacttagcagctctatttgtgattctcatatgttacagacttctcttctttactgttctcaagttcaaggagagagcatccccattgtttcagacactctatgccaagagaaccatacaacagcttgaaaaaagaccctctttcaggaagatgccatctttcccttcacagaggcatcaacccctccattcactttcttctcaagatggtcttgattctccactccactaaaatcaataatatcaaccacaaataaaaaagtgttgcacttgcatgcacctggattttcggattataacatacaaaattgtatttgttatctcttaattagcatatgtatagagaaaaatgtttcataaccgtttaaggtacaaacagacaaattaatgggacattgtctacgtccttccattacattttttctttctttctttcaattaaaatctctaaattgggataattaccttgtacaaatgcaggtatctctagctcatggtccttggcctagcaaaaaaaaaaaaaaaaaa

SEQ ID NO: 4666 - protein, 695 aa, Glycine max
  misc_feature: PFam Name: ABC2_membrane; PFam Description: ABC-2 type transporter
  misc_feature: PFam Name: ABC_tran; PFam Description: ABC transporter
  misc_feature: GI Number: 32364696; NR Description: ABC transporter
  misc_feature: GI Number: 22331230; NR Description: ABC transporter family
  misc_feature: GI Number: 11994269; NR Description: ABC transporter-like
  misc_feature: GI Number: 37535660; NR Description: putative ABC transporter [Oryza sativa (japonica cultivar-group)] >gi|22128707|gb|AAM92819.1| putative ABC transporter [Oryza sativa (japonica cultivar-group)] >gi|31432832|gb|AAP54419.1|
  misc_feature: GI Number: 50900394; NR Description: putative ABC transporter [Oryza sativa (japonica cultivar-group)] >gi|47848378|dbj|BAD22237.1| putative ABC transporter [Oryza sativa
MEIESSAAATDNNNWGGRGVEREMPYSGFDRGTFLAWQDLRVVIPNFGKGPTKRLLNGLNGYAEPGRIMAIMGPSGSGKSTLLDSLAGRLSKNVVMTGNVLLNGKKKGIGAGYGVVAYVTQEDVLLGTLTVKETISYSAHLRLPTSMSKEEVNSIIDGTIIEMGLQDCADRLIGNWHLRGISGGEKKRLSIALEILTRPRLLFLDEPTSGLDSASAFFVVQTLRNVARDGRTVISSIHQPSSEVFALFDDLFLLSGGETVYFGEAKSAIEFFAEAGFPCPRKRNPSDHFLRCINSDFDIVTATLKGSQRIHDVPNSADPFMNLATAEIKATLVEKYRRSTYARRAKNRIQELSTDEGLQPPTQHGSQASRWKQLLTLTKRSFVNMCRDVGYYWLRIIIYIIVSICVGTVYFDVGYSYTSILARGACGAFISGFMTFMSIGGFPSFIEEMKVFYRERLNGYYGVAAYILANFLSSFPFLVAIALTSSTITYNMVKFRPGISHFVFFFLNIYSCISVIESLMMVVASLVPNFLMGIITGAGIIGIMMMTSGFFRLLSDLPKPVWRYPISYISYGSWAIQGSYKNDLLGLEFDPLLPGDPKLSGEYVITHMLGIELNHSKWWDLAALFVILICYRLLFFTVLKFKERASPLFQTLYAKRTIQQLEKRPSFRKMPSFPSQRHQPLHSLSSQDGLDSPLH

SEQ ID NO: 4667 - DNA, 1096 bp, Glycine max
  misc_feature (1)..(1096): Ceres cDNA ID no. 21995870
  misc_feature (1)..(1096): Ceres CLONE  ID no. 556833
  misc_feature (1)..(1096): Also known as  Ceres CDNA ID no. 23382782
attttgttccccaaccgagtaaaagaaaaggctgtgtccgttactcgggagtggaagatggcgacggcgccgggaaatcaaatgttggagggcggaggaggagcgccgcagcctccgggtacagacatgaccggaatatgcttccgggatcagctctggctcaatagcttccctctggatcgcaacttggtcttcgattacttcgcactctcccctttctacgactggacctgcaacaacgagcagctccgcatgcgctccgttcaccccctcgacatctctcaactctcgaaaatgacggggacggagtatatgctcagcgaagttatggagccgcacctgtttgtcattcgcaagcagaagagagatagccccgacaaagttacacctatgctcgcgtattacgtcctcgatggttccatttaccaggcaccgcaactgtgcaatgtttttgccgccagaattggaagggccctttattacatacaaaaggcttttactacagctgcctcaaagttggagaagattggatatgctgggtcagctgattctgaaaatgagactgcattgttggaatcaaagactgctaaggagacaattgacataaaggaagttaagcgagttgatcatattcttgcatccttgcaacgcaagttaccaccagctcctcctccaccaccatttccagaaggttatgttccacctccaactgcagaaacggagaaaggcactgaaactcaagaagcagcagaaacgcaagctcctactgctgatccgataattgatcaaggaccagcaaaaagaatgaaattttgatataaaagacatactgcaacggctattaatacttatacaggtggaggaaaattatattattctttaacaagcggccgttgctaaaacatgattaacttaatgttattctctggtctaaaatgcgttgctcttttcctgtcttcaccataaatgtagatattatcactgaaataggattaagttctcctgttttttcattctagacaatgtattgagcaattgtaacttgtaagggtaaacgaaactagtgtccttttcgcatcaaaaaaaaaaaaaaaaa

SEQ ID NO: 4668 - protein, 1096 aa, Glycine max
  misc_feature: PFam Name: MED6; PFam Description: MED6 mediator sub complex
  misc_feature: GI Number: 51091148; NR Description: putative RNA polymerase transcriptional regulation mediator [Oryza sativa (japonica
  misc_feature: GI Number: 50797383; NR Description: PREDICTED: similar to RNA polymerase transcriptional regulation mediator, subunit 6 homolog (Activator-recruited cofactor 33 kDa component) (ARC33)
  misc_feature: GI Number: 66508965; NR Description: PREDICTED: similar to
  misc_feature: GI Number: 34867365; NR Description: similar to RNA polymerase II transcriptional regulation mediator (Med6, S.
  misc_feature: GI Number: 30583885; NR Description: Homo sapiens mediator of RNA polymerase II transcription, subunit 6 homolog (yeast)
ATTTTGTTCCCCAACCGAGTAAAAGAAAAGGCTGTGTCCGTTACTCGGGAGTGGAAGATGGCGACGGCGCCGGGAAATCAAATGTTGGAGGGCGGAGGAGGAGCGCCGCAGCCTCCGGGTACAGACATGACCGGAATATGCTTCCGGGATCAGCTCTGGCTCAATAGCTTCCCTCTGGATCGCAACTTGGTCTTCGATTACTTCGCACTCTCCCCTTTCTACGACTGGACCTGCAACAACGAGCAGCTCCGCATGCGCTCCGTTCACCCCCTCGACATCTCTCAACTCTCGAAAATGACGGGGACGGAGTATATGCTCAGCGAAGTTATGGAGCCGCACCTGTTTGTCATTCGCAAGCAGAAGAGAGATAGCCCCGACAAAGTTACACCTATGCTCGCGTATTACGTCCTCGATGGTTCCATTTACCAGGCACCGCAACTGTGCAATGTTTTTGCCGCCAGAATTGGAAGGGCCCTTTATTACATACAAAAGGCTTTTACTACAGCTGCCTCAAAGTTGGAGAAGATTGGATATGCTGGGTCAGCTGATTCTGAAAATGAGACTGCATTGTTGGAATCAAAGACTGCTAAGGAGACAATTGACATAAAGGAAGTTAAGCGAGTTGATCATATTCTTGCATCCTTGCAACGCAAGTTACCACCAGCTCCTCCTCCACCACCATTTCCAGAAGGTTATGTTCCACCTCCAACTGCAGAAACGGAGAAAGGCACTGAAACTCAAGAAGCAGCAGAAACGCAAGCTCCTACTGCTGATCCGATAATTGATCAAGGACCAGCAAAAAGAATGAAATTTTGATATAAAAGACATACTGCAACGGCTATTAATACTTATACAGGTGGAGGAAAATTATATTATTCTTTAACAAGCGGCCGTTGCTAAAACATGATTAACTTAATGTTATTCTCTGGTCTAAAATGCGTTGCTCTTTTCCTGTCTTCACCATAAATGTAGATATTATCACTGAAATAGGATTAAGTTCTCCTGTTTTTTCATTCTAGACAATGTATTGAGCAATTGTAACTTGTAAGGGTAAACGAAACTAGTGTCCTTTTCGCATCAAAAAAAAAAAAAAAAA

SEQ ID NO: 4669 - DNA, 1586 bp, Glycine max
  misc_feature (1)..(1586): Ceres cDNA ID no. 21995871
  misc_feature (1)..(1586): Ceres CLONE  ID no. 557571
  misc_feature (1)..(1586): Also known as  Ceres CDNA ID no. 25088243
agcactagcactgcaattcactgtaatgggtcaagtgttacaagatcagagaggtttgtggactcagatacagagacctttttggacacaatgcagaggagttggtccatgttgccatggaatagaagcttcgagggatggactttcaaaagaacctcctcaagtaaacgagagcctttgacctcacattcaactcattccatgggaccatactttgatcacaataaatgcactgcaagtggctgggaaaatagggaactttggagtagagatgggaaaacaaagctcaaaaccaatgtgttctttgcttcctttgatcaaagaagcaaaaaagcatgtggtgagagtgcatgtacagcactagcagtgtgcatagctcactggcttcattccaaccacaacatgccaacaagggctcaatttgatagcctcatcaaaaagggttcctctaaatggagaaagctgagtcatagtgatcactacctaaagcttttccctgataagcattttgatttagagacaatcttggaagccaacattaggccactagttgttatccctcaaaattcctacacaggatttttctcccctgagaagtttaaatgcttagaaggagccatgtcctttgatgatatttgggatgagataactagaaatgatggtgtggttgatcatgagccaagaatttacatagtgagttggaatgaccatttctttgttctgaaagtggaagttgatgcttgttatgtgattgacactttgggggagaggctttttgagggatgcaaaaaggctttcatgttgaagtttgatggttcaagtttgatgcatgcaaagggaagtaagaaaggaagaggtgagatagtttgcaaaggaaaagagtgttgtaaagagttcatcaaacgctttcttgctgccataccacttaggcaactagaagaggaagagcaaaataaagggactgtctataatccttattttcacaggaaattgcagattgacttccattatagtttgttatcatccttgtcttcagtttcttcaattggtgaacctttacaacctaattatatagcaagacattagttatataactcaattgctaaccttgtgagtcttgagcaattgttacaattagaaaaccaaaaaacccggcttcttgtctgaagacaaaatgttcaggtgagataagtcctaagcactcattaggataaggtaagcctcaaagcttgaagagtgtttatagaaatacttatagataacctatcaacaagttccttgcattggtaataggcttcgaacttaaattcttgtaagatgagtcttattcttaaaaactagaccaactttcgttggcaaaaactcagcttcttttctagcagagtttgctggcagcttctttttggtgacaactactactaaccctttacaaagtgtgattttactggattgagcaacccaaatatccattagcatcactcagagaataaaacctttgaggctgattcttgttaacgttgctgtatttagtggagtggatctgaatgaaaaagaaaagaaattggtctaaaaaaaaaaaaaaaaaa

SEQ ID NO: 4670 - protein, 331 aa, Glycine max
  misc_feature: GI Number: 34906476; NR Description: P0671B11.30 [Oryza sativa (japonica cultivar-group)] >gi|9988448|dbj|BAB12714.1| P0671B11.30 [Oryza sativa (japonica cultivar-group)] >gi|10934077|dbj|BAB16855.1| P0001B06.8 [Oryza sativa (japonica
  misc_feature: GI Number: 17063176; NR Description: SYNC1 protein
MQRSWSMLPWNRSFEGWTFKRTSSSKREPLTSHSTHSMGPYFDHNKCTASGWENRELWSRDGKTKLKTNVFFASFDQRSKKACGESACTALAVCIAHWLHSNHNMPTRAQFDSLIKKGSSKWRKLSHSDHYLKLFPDKHFDLETILEANIRPLVVIPQNSYTGFFSPEKFKCLEGAMSFDDIWDEITRNDGVVDHEPRIYIVSWNDHFFVLKVEVDACYVIDTLGERLFEGCKKAFMLKFDGSSLMHAKGSKKGRGEIVCKGKECCKEFIKRFLAAIPLRQLEEEEQNKGTVYNPYFHRKLQIDFHYSLLSSLSSVSSIGEPLQPNYIARH

SEQ ID NO: 4671 - DNA, 1299 bp, Glycine max
  misc_feature (1)..(1299): Ceres cDNA ID no. 21995872
  misc_feature (1)..(1299): Ceres CLONE  ID no. 557659
  misc_feature (1)..(1299): Also known as  Ceres CDNA ID no. 23692932
ggcagcaaagtgaataatggcttcactttccaccttcctcacactcactctcttcttcctctcacacgttaacgccaaagaaatcgtcatcaccgaagagggttacaccgtgaccaccgtattcgacggccacaagcctcacatcttccctttcaccgttctccagcgacccttttcctccgatctcatccttctcgattccgtcaacagcactttctacacggcgcaattccccattactgaagaaagcgttttcacgaggctttctggcgatgggtctgtggggtattctgatggggacgtgggttctgctcggttcgccaaacccagaagctttgcttttgatatgagagggaatgtgtatgttgctgataagtccaaccgtgcaataaggaaaattagtgccaagggtgtgaccacgattgctgggggagagttctcagaaaagtcaagaacaaaggatgggcctgcacttaatgcatcattttcaaatgattttgacctgactttcattcctgggctgtgtgctttgctcgtgtcagatcacatgcatagattggtccgccagattaatttgatggaggaggattgcacccttggttctaaacctggactaggtgcagttatgacttggactcttggattaggactttcatgcttacttggcttagtaattggaattgtggtgcgtccttacatcatccctaatacagaaaggcaccaacccttgccacttcaccgagacatggaagcgttacctaaccagtctggggaagctagcacagacgctcttcttcggcgccaaaagcgcaattgctagctgcagttgctcctctgtttacaaaatcctgatgagcttttggagattgagtctctctcatcttgtttgcatgtctagaattagaatcaacatagtttctccaaggccacatctggaatcagtgtctttgctagatttagatgcctgcaatagcggtgaggtaacaaagtcaggtaagtattatgaccaattgaaggatttgatgagttttgatgaagattcaaacaatggcaaggcaacctttaacaaaggaaatgatagcataggaaggaggaatgtgtgctatgaaggtgatgtcatgatgaaggctaacatgggctttgtagagacacctaaagataacaataacattgttcgtcaagaatcttctgtgtgtaaaatgggtattgtgaagcgtagatgaagttatttgtaagacatgaactatgttatgaaactagcatgcatatattttgtcaccgaaaaaaaaaaaaaaaaaa

SEQ ID NO: 4672 - protein, 267 aa, Glycine max
  misc_feature: PFam Name: NHL; PFam Description: NHL repeat
  misc_feature: GI Number: 16974539; NR Description: At1g23890/T23E23_13 [Arabidopsis thaliana] >gi|15724248|gb|AAL06517.1| At1g23890/T23E23_13 [Arabidopsis thaliana] >gi|18395326|ref|NP_564209.1| NHL repeat-containing protein
  misc_feature: GI Number: 42571623; NR Description: NHL repeat-containing
  misc_feature: GI Number: 25402992; NR Description: protein T23E23.6 [imported] - Arabidopsis thaliana >gi|9369410|gb|AAF87158.1|
  misc_feature: GI Number: 53793193; NR Description: NHL repeat-containing
  misc_feature: GI Number: 30685100; NR Description: NHL repeat-containing
MASLSTFLTLTLFFLSHVNAKEIVITEEGYTVTTVFDGHKPHIFPFTVLQRPFSSDLILLDSVNSTFYTAQFPITEESVFTRLSGDGSVGYSDGDVGSARFAKPRSFAFDMRGNVYVADKSNRAIRKISAKGVTTIAGGEFSEKSRTKDGPALNASFSNDFDLTFIPGLCALLVSDHMHRLVRQINLMEEDCTLGSKPGLGAVMTWTLGLGLSCLLGLVIGIVVRPYIIPNTERHQPLPLHRDMEALPNQSGEASTDALLRRQKRNC

SEQ ID NO: 4673 - DNA, 801 bp, Glycine max
  misc_feature (1)..(801): Ceres cDNA ID no. 21995873
  misc_feature (1)..(801): Ceres CLONE  ID no. 560876
  misc_feature (1)..(801): Also known as  Ceres CDNA ID no. 24366868
ctcttttggtgttcgaacaaattagggttttcccaaccctcttcccttgttcgaaactagcctaatcaaaaccgaaacaaacgattacaaaaacaagaaaagaagaaaaataatcattcattgctcggtgagaagagagagaggaacggcccgatgaccgggaaggcgaagcccaagaagcacacggcgaaggaaatcgccgcgaaggtggacgccgccaccactaaccgcggcggcgggaaggccggcctgaaggaccgatccgggttggagaagggcgggcacgcgaaatacgagtgccctcactgcaaagtgacggcgccggacgtgaaatcaatgcaaattcaccacgacgcgcgtcaccccaagattccctttgaggaggacaaagtcgtcaatcttcacgcgacgcacgttcctgaatcctccaagcctcgccccggtgttcgcggaagcctcaagaagtgatcgtgatcgcaatcgatcgtcgcttttgtttttatggccccttcattcgtagtgttctcagtctctgttttttttttctttttcttgtttttttttgttgcctaagttgttgttgttaaatattttggaagtgggttttttaagggaaggggttatgaattgtgatgatgccgtgtatgaaggggcggcagagaagggtttttcctcctttgcaggaatgagattgactatgttgttaactgagcccttctttttaaagatggaatatgtatattgttccatataatgaaagttaaagtggtgttgttgacctactgaaaaaaaaaaaaaaaa

SEQ ID NO: 4674 - protein, 104 aa, Glycine max
  misc_feature: PFam Name: zf-C2H2; PFam Description: Zinc finger, C2H2 type
  misc_feature: GI Number: 53792608; NR Description: zinc finger protein-like [Oryza sativa (japonica cultivar-group)] gi|53792616|dbj|BAD53630.1| zinc finger protein-like [Oryza sativa
MTGKAKPKKHTAKEIAAKVDAATTNRGGGKAGLKDRSGLEKGGHAKYECPHCKVTAPDVKSMQIHHDARHPKIPFEEDKVVNLHATHVPESSKPRPGVRGSLKK

SEQ ID NO: 4675 - DNA, 1287 bp, Glycine max
  misc_feature (1)..(1287): Ceres cDNA ID no. 21995874
  misc_feature (1)..(1287): Ceres CLONE  ID no. 563414
  misc_feature (1)..(1287): Also known as  Ceres CDNA ID no. 24766348
aaaaaaaaagaaaaaggagataaggatcgaggttgtgttggtgttggtgccggtgcaggaagagagggcttgttggtggatccgattcagaaaaaatgggttcaaacccgtcgtttgtcccggagatcggatccgatggtcttcccagacaatcttccgttatcacttacaccgaacagataatcgaagcagaacagcttcaattgaagaagtacattcaagaaaactatactaaaattcgtgatgtggagcgtgagcttgcaaatcttggattagagatgaagcttacatctggaccaaagaaagcagcgctggaacatatgagaaagaagatagaggcatcaaccgagaaaattcgtgtggcaaagatacaggaagaacaggcacgcaaggtgtgggaatcagcatcaaaaacagtgcaagaagaagaggcaataaagcagaagttatgtgaagacttaagcaaactggtcgaagagagcaataactctcagttgtctaggctggaggatttaaaaagacgattagaagctatgaatccgaatcgaagttcaactagtctgcatagtgatggaagatcaagttctctggatagtgcaatccaaggaggatcggctgggaatgttccataccaaaataatggtctgaaagttccagtgaccaatgagcataaaccacagcctcctagtgaagaaggaagaaataaaaagaaagttaactatcaaagaggaaaaggaattggcgcggtgcccaaaactaggtcttcaactcctgactggactggtgctggctttgatgtagatggcagaacctgagagtagtatggtaatacgttactgcactaaatacatttttggctgagaagtcattagggtctgcacaagttgacacagaatgacagaccagataatttatttgtgctagactgcttgtacaaacttgtgaataggatattttcatatggaagatcagatcaattcatcaagacatctctagaaggtgcagtgcgtgtttggttcaaaagcttccgaagaaaacttaaaaaaatatatattttttttcaactttaatctttaccagacatggtggaagaaactaatttccactttgaccatatgattagtttgtagttcgattgttatcggttcatttccgttcaacatttgggttttacgtgttattttaaccacacccattcaatttgtaccaaatttctacttacgaatacaattgataaaaaaatgattaaatattattttggtccttcataaaaaaaaaaaaaaaaaa

SEQ ID NO: 4676 - protein, 239 aa, Glycine max
  misc_feature: GI Number: 48209904; NR Description: expressed protein
  misc_feature: GI Number: 21593113; NR Description: unknown [Arabidopsis thaliana]
MGSNPSFVPEIGSDGLPRQSSVITYTEQIIEAEQLQLKKYIQENYTKIRDVERELANLGLEMKLTSGPKKAALEHMRKKIEASTEKIRVAKIQEEQARKVWESASKTVQEEEAIKQKLCEDLSKLVEESNNSQLSRLEDLKRRLEAMNPNRSSTSLHSDGRSSSLDSAIQGGSAGNVPYQNNGLKVPVTNEHKPQPPSEEGRNKKKVNYQRGKGIGAVPKTRSSTPDWTGAGFDVDGRT

SEQ ID NO: 4677 - DNA, 1702 bp, Glycine max
  misc_feature (1)..(1702): Ceres cDNA ID no. 21995875
  misc_feature (1)..(1702): Ceres CLONE  ID no. 563957
  misc_feature (1)..(1702): Also known as  Ceres CDNA ID no. 24727130
gagtagcaattgacatttattagcactgagtaacacgcccgaatatggcaccctcaatctccgacgaaatgccaagcaccaccacctctctcctccgccgcaaccggtggctcccctccagcatcaaactgaaaacaacccttttctcagaactctccggcgcggtgggtgacctaggcacctacatccccatagttctagccttatccttagtgaacaacttggacctcaccaccacactggtcttcactgctctctacaacatcgccaccggtctcctcttcggcctccccatgccggtccagcccatgaagtccatcgccgccgtcgccatctccgcagcgccccccctcaccatcccccaaatctcggccgctggcctctccgtcgccgccgtgctcctcctcctcggtgccaccggcctcatgtccgtcctctaccgctacctccccctccccgtcgtccgcggcgtccaactctcccaaggcctctccttcgccttctccgccgtcaaatacattcgctacgaccaagacctcgccaaatcaaaatccggtcccccccgcccctggctagcagtcgacggcgtcgccgtcgccctcgccgccgtcctcttcctcgtcctcaccaccggcgccggcgacgagccacctccaccaccaccacaacaacaagaagaagaaatcgacgatcgccgtgaaaaagttcggcggaggttgagggttttgtctacgattccggcggcgctaatagtgtttttgttcggcttagtgttgtgttttattcgtgacccttcgattttcggagatcttaggtttgggccttcgaggatttctttgattaagattacatgggaggatttgaagattgggtttgtcagcgccgcaattccgcaaataccgttatccgttttgaattccgttatcgcggtatgtaagctgtccggggatttgtttcccgaacgtgaggcttcggcgatgcatgtttcggtgagtgtggggcttatgaattttgtagggtgttggttcggagccatgccttgttgccacggggctggtggtttggcgggacagtacaggttcgggggtaggagtggtgcttcggtggtgttccttgggattgcaaagttggtgcttgctttggtgtttggaaactctcttggcagaattttgggtcagtttcctattgggattctgggagtgcttttgttgtttgcgggaattgagttggctatggctgctaaggatatgaacactaaacaagagtcgtttgttatgcttgtttgtgcggctgtttctctcactggatcaagtgctgccttggggttctttgttggcattgtgctttacttgctcttgaaattgagggaggttgaatgtagagggtttggcttttgtggatcaaaccacaccaagtcttctcttgaggacgaacaagctagcttgattgcctagacaacaatttgattcacattttgcaaattgaagtagcttgcttaatgtactactactatatatgtgcaattatttgcaaattggctttggtccagaaaatgatcaccaatgttgtgatcatgtgggaaatcttgtgtgatatgtattagtgtaatgcttcaaaaatagagtgaacaatatatgtgtagttaactagttatagatattggatagagttcttcatccatttgaaaaaaaaaaaaaaaaaa

SEQ ID NO: 4678 - protein, 469 aa, Glycine max
  misc_feature: PFam Name: Sulfate_transp; PFam Description: Sulfate
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Atrophin-1; PFam Description: Atrophin-1 family
  misc_feature: GI Number: 34911726; NR Description: P0707D10.27 [Oryza sativa (japonica cultivar-group)] >gi|13603442|dbj|BAB40169.1| P0707D10.27 [Oryza sativa (japonica cultivar-group)] >gi|21901979|dbj|BAC05530.1| P0038D11.6 [Oryza sativa (japonica
  misc_feature: GI Number: 14270245; NR Description: putative sulfate
  misc_feature: GI Number: 51244140; NR Description: probable sulfate permease (SulP) [Desulfotalea psychrophila LSv54] >gi|50875177|emb|CAG35017.1| probable sulfate permease (SulP)
  misc_feature: GI Number: 66846940; NR Description: transporter, putative
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
MAPSISDEMPSTTTSLLRRNRWLPSSIKLKTTLFSELSGAVGDLGTYIPIVLALSLVNNLDLTTTLVFTALYNIATGLLFGLPMPVQPMKSIAAVAISAAPPLTIPQISAAGLSVAAVLLLLGATGLMSVLYRYLPLPVVRGVQLSQGLSFAFSAVKYIRYDQDLAKSKSGPPRPWLAVDGVAVALAAVLFLVLTTGAGDEPPPPPPQQQEEEIDDRREKVRRRLRVLSTIPAALIVFLFGLVLCFIRDPSIFGDLRFGPSRISLIKITWEDLKIGFVSAAIPQIPLSVLNSVIAVCKLSGDLFPEREASAMHVSVSVGLMNFVGCWFGAMPCCHGAGGLAGQYRFGGRSGASVVFLGIAKLVLALVFGNSLGRILGQFPIGILGVLLLFAGIELAMAAKDMNTKQESFVMLVCAAVSLTGSSAALGFFVGIVLYLLLKLREVECRGFGFCGSNHTKSSLEDEQASLIA

SEQ ID NO: 4679 - DNA, 1409 bp, Glycine max
  misc_feature (1)..(1409): Ceres cDNA ID no. 21995876
  misc_feature (1)..(1409): Ceres CLONE  ID no. 564927
  misc_feature (1)..(1409): Also known as  Ceres CDNA ID no. 24727131
aaaaaaccttaatcatttacgctttcacagcttatgactcacctggtcactcgcactcaactcgctagagtcacgcagctctctcatcgccccaaacccctcttcttcacaccaaaaccaacactttatcgttcccaaaccctctctctcccccaactctccacactctcctccgccaccttccgccgccgaacgcaccctctcctccgcccgacgatggacccgcaaccgccggaaccttccgcgcccgccgcctcggcggaggacttcgtccacgtcacggatctgaagatggagagcctctccgagagcatggttcgaatcgacgagccttccgaagccgacgccgctccctccgctccggactccgatcgccgtccagccacgctctcgccggagctctcaagaaacgtgctcgtcctgtcgtgcgagtccgctgccgaaggcggcgtctgcgacgtttacttggtcggcaccgctcatgtctccgaggaatcgagcagagaagttcaagctatagtgaattttctgaaacctcaggttgtcttcctggaattgtgctcgagtcgggtggcagtgcttacccttcaaaatcttaaggtacccaccatgggagaaatggttacaatgttgaagaaaaaacataacatgtttgaagtactttatggctggttccttgccaagattgctagtaagcttgaggtatttcctggctctgagtttcgtgtggcatatgaagaagccatcaagtatggtggcagagtgatacttggtgatcgtcctgtacagattacattgaggagaacatggagtaagatgccactttggcataagacaaaattgttatactctttacttttccaagcagtatttttgcccagctctgatgatcttaataagatgctgaaggaaatggatgacagtgacatgctaactcttgttattcaggaaatgagcaaggagtttccaactttaatggagactcttgtgcatgaacgagatcagtacatgtcctccacattattaaaagtggcgagtgagaatagctcagttgttgctgttgttggaaagggccatctacagggaataaagaagcattggaagcaacctgtcgtgatgaaggatctaatgacagttccatctcccaaaccagctgtctctgcaacaagaatcgttacgtctattggtgttgccgtagccggcgtggccattatatcgggcatttatctttcatgcaagaaataactttcctaggagagagatgctgtcatccacaggaacgttgatgtaggaattgaaatatgtaacattgattcaaccatcaactaagttgatgcataagtcattacaattttttttttaaatctttccatggaaataattacaatttcttaaaaaaaaaaaaaaaa

SEQ ID NO: 4680 - protein, 403 aa, Glycine max
  misc_feature: PFam Name: TraB; PFam Description: TraB family
  misc_feature: GI Number: 30685271; NR Description: TraB family protein
  misc_feature: GI Number: 48839748; NR Description: COG1916: Uncharacterized homolog of PrgY (pheromone shutdown protein) [Methanosarcina
  misc_feature: GI Number: 20088907; NR Description: TraB family protein [Methanosarcina acetivorans C2A] >gi|19913750|gb|AAM03462.1| TraB
  misc_feature: GI Number: 53731198; NR Description: COG1916: Uncharacterized homolog of PrgY (pheromone shutdown protein) [Methanococcoides
  misc_feature: GI Number: 21227421; NR Description: Pheromone shutdown protein [Methanosarcina mazei Go1] >gi|20905787|gb|AAM31015.1|
MTHLVTRTQLARVTQLSHRPKPLFFTPKPTLYRSQTLSLPQLSTLSSATFRRRTHPLLRPTMDPQPPEPSAPAASAEDFVHVTDLKMESLSESMVRIDEPSEADAAPSAPDSDRRPATLSPELSRNVLVLSCESAAEGGVCDVYLVGTAHVSEESSREVQAIVNFLKPQVVFLELCSSRVAVLTLQNLKVPTMGEMVTMLKKKHNMFEVLYGWFLAKIASKLEVFPGSEFRVAYEEAIKYGGRVILGDRPVQITLRRTWSKMPLWHKTKLLYSLLFQAVFLPSSDDLNKMLKEMDDSDMLTLVIQEMSKEFPTLMETLVHERDQYMSSTLLKVASENSSVVAVVGKGHLQGIKKHWKQPVVMKDLMTVPSPKPAVSATRIVTSIGVAVAGVAIISGIYLSCKK

SEQ ID NO: 4681 - DNA, 1294 bp, Glycine max
  misc_feature (1)..(1294): Ceres cDNA ID no. 21995877
  misc_feature (1)..(1294): Ceres CLONE  ID no. 565104
  misc_feature (1)..(1294): Also known as  Ceres CDNA ID no. 23705638
gtactcaaaccctaatccccaataaaaacacactcaaaaacccttttttttttcttattcatcctctagttcttctttgacattcacaatgccttcaattccagaagagccattgttggcaccgaacccggaccggttctgcatgttcccaatccaatatcctcaaatctgggaaatgtacaagaaagccgaagcctcgttctggacggcggaggaggtggacctctcgcaggacctccgccactgggactccctgaccgacggcgagcgccacttcgtcagtcacgtcctcgccttcttcgccgcctccgacggcatcgtacttgagaacctcgctgggcgcttcacgaaggaaatccaaatccccgaggcccgcgccttctacggcttccagatcgccatcgagaacattcactccgagatgtacagcctcctcctcgaaacctacatcaaggactcctcccagaagagccacctcttccgcgccatcgacaccatcccgtgcgttaccaagaaagcccagtgggccctacgctggatcgattcttccgactccttcgccgagcgtctcgttgccttcgcatgtgtggaaggtatcttcttctccggaagcttctgcgctgtcttctggctcaaaaaacgtggactcatgcccgggctcactttctcaaatgaactaatatcacgcgatgaaggtcttcattgtgatttcgcgtgtcttttatactctctgctgagacagaagctcaccgaggagcgcgtaagggagattgtgaaggacgcggtggacattgaacgggagtttgtgtgcgacgcgcttccctgcgcgttggtggggatgaacggtgatttgatgagccagtacattgaatttgttgcggatcggttgctgggtgcgctagggtgcgggaaggtgtacaatgttcagaatccgttcgattggatggagctgatttctctgcaggggaagaccaacttcttcgagaagcgcgtcggggaatatcagaaggcttctgttatgtccagcttgaacgggaacggtggtgggaaccacgtgttcaagatggatgaggatttctaatttattattatgggaatgagaattaggtttaggggcgaatgctgataatgatagtatttctgtattgttaaatatatttacgtttttttttcttttttacttttttagcatactatttattttttttgtaatggttattgttcatttgttgtttttgatctctctccttcagcaatgggatgctaaattatactttcaaaaaaaaaaaaaaaa

SEQ ID NO: 4682 - protein, 330 aa, Glycine max
  misc_feature: PFam Name: Ribonuc_red_sm; PFam Description: Ribonucleotide
  misc_feature: GI Number: 23505945; NR Description: At3g23580/MDB19_7 [Arabidopsis thaliana] >gi|9294514|dbj|BAB02776.1| ribonucleotide reductase [Arabidopsis thaliana] >gi|27735240|sp|P50651|RIR2_ARATH
  misc_feature: GI Number: 34898038; NR Description: putative ribonucleoside-diphosphate reductase [Oryza sativa (japonica cultivar-group)] >gi|25553567|dbj|BAC24838.1| putative ribonucleoside-diphosphate reductase [Oryza sativa (japonica
  misc_feature: GI Number: 52077275; NR Description: putative ribonucleotide reductase R2 [Oryza sativa (japonica cultivar-group)] >gi|52077136|dbj|BAD46182.1| putative ribonucleotide reductase R2
  misc_feature: GI Number: 21436297; NR Description: putative ribonucleotide reductase small subunit [Arabidopsis thaliana] >gi|17380726|gb|AAL36193.1| putative ribonucleotide reductase small subunit [Arabidopsis thaliana] >gi|9279629|dbj|BAB01087.1|
MPSIPEEPLLAPNPDRFCMFPIQYPQIWEMYKKAEASFWTAEEVDLSQDLRHWDSLTDGERHFVSHVLAFFAASDGIVLENLAGRFTKEIQIPEARAFYGFQIAIENIHSEMYSLLLETYIKDSSQKSHLFRAIDTIPCVTKKAQWALRWIDSSDSFAERLVAFACVEGIFFSGSFCAVFWLKKRGLMPGLTFSNELISRDEGLHCDFACLLYSLLRQKLTEERVREIVKDAVDIEREFVCDALPCALVGMNGDLMSQYIEFVADRLLGALGCGKVYNVQNPFDWMELISLQGKTNFFEKRVGEYQKASVMSSLNGNGGGNHVFKMDEDF

SEQ ID NO: 4683 - DNA, 981 bp, Glycine max
  misc_feature (1)..(981): Ceres cDNA ID no. 21995879
  misc_feature (1)..(981): Ceres CLONE  ID no. 566653
  misc_feature (1)..(981): Also known as  Ceres CDNA ID no. 23697692
agtagcatcgacaaccaaatgtttgtaccaaacatctgcttaccagcctgaaaaaaacaaccttgtttgtacctctcaacaagttgtcttacataatactgaagatacgacggcaacaatgctggcaccacctaaactagacagacataaagattctgcagctccagacttccatctccattgtgaaaaccataactgtattgctgacaacatgaagcaccagctgccacctgatcatgatgctgaatctataaagaaaatggccactgctgctccacattgtggatcatcaaatgcggttgaagtgctagttgaaggtaatgttggaaaccacagtatcaatagaagtgcctcaggcagcaacaatggaagcaatggacaaaatgggagcagcacggcggttaatgctggagggacaaacatgaaaagcaacaatggactcactgggaatagtggcagtggtgatgctagcggaagtgtaagtgccaacagagtagatcaaaacaagacttctcaaagggaagcggccttaactaaatttcgccaaaagagaaaagagagaagggagaggtgctttcataaaaaggttcgatatcagagcagaaagagattagctgaacaacgacctcgatttcgtggacaatttgttcgacagtcctctaacgaaaatgcaagtgaggcaacaacagatagctgattcagagcatttgccacaatggcataatgatggggatatgcgagaaaaggtcgaggagtctgcatgtagaatttgggaattgttctgtgtgtttgtgttaaaaaggtataatgactctggttattccaacttgttcatttgaaacctgaatcaatttatgtggtgagagattgttatatgctgattgatgctcggataacttatagcgactcaataatttcaattacttgtcgatcttgtgcttgaagaatcaaatgtgttagttcaaaaaaaaaaaaaaaaaa

SEQ ID NO: 4684 - protein, 192 aa, Glycine max
  misc_feature: PFam Name: CCT; PFam Description: CCT motif
  misc_feature: GI Number: 34979117; NR Description: pseudo-response
  misc_feature: GI Number: 51571885; NR Description: pseudo-response
  misc_feature: GI Number: 51571879; NR Description: pseudo-response
  misc_feature: GI Number: 50940205; NR Description: putative pseudo-response regulator [Oryza sativa (japonica cultivar-group)] >gi|34394035|dbj|BAC84066.1| putative pseudo-response regulator
  misc_feature: GI Number: 51571877; NR Description: pseudo-response
MLAPPKLDRHKDSAAPDFHLHCENHNCIADNMKHQLPPDHDAESIKKMATAAPHCGSSNAVEVLVEGNVGNHSINRSASGSNNGSNGQNGSSTAVNAGGTNMKSNNGLTGNSGSGDASGSVSANRVDQNKTSQREAALTKFRQKRKERRERCFHKKVRYQSRKRLAEQRPRFRGQFVRQSSNENASEATTDS

SEQ ID NO: 4685 - DNA, 677 bp, Triticum aestivum
  misc_feature (1)..(677): Ceres cDNA ID no. 21995880
  misc_feature (1)..(677): Ceres CLONE  ID no. 567223
  misc_feature (1)..(677): Also known as  Ceres CDNA ID no. 24408554
accagccaactcaccatcgatctctgctccaacacttcgatcgatcgccaacaccggccaagcaaagcaagctaccatgggcaacagcaaggccgcggtgtgcgtgctggcgctcgtcctgtgcggcctgctcgccgcagacacggcggcggcggcggggtgcgacgcgagcgcgctgaggccgtgcgtgggcgctatcatgctgggcggggcggtgacgccggggtgctgcgcgcggctgcgcgcccagcgggcgtgcctgtgccagtacgcacgcgacccgtcctaccgcggctacgtcaacagcccaagggcgcagagcgtcgtcgccgcctgcggcctccccgggcccaagtgctgatcgcccgcccggcgcgctatacatatcgactccgccccgtgtggccggcgtcgtgcacgatgccgggcaccggtggacggcggtctacgtaatgtaatatgtggttaattacacggtcgacgacgccatcgagctggcacgtacgtgcgtgcgtgtacggttgagttgtggacgtctgtctaaataaacgtggtttgctccaagctgcgcaagcatatatacgtgcgtgcgttgaggcggctggttgtgtacgttctctcatgttttcccccagcattaattccatctgtttttttaggcaaaaaaaaaaaaaaaa

SEQ ID NO: 4686 - protein, 677 aa, Triticum aestivum
  misc_feature: PFam Name: Tryp_alpha_amyl; PFam Description: Protease
  misc_feature: GI Number: 50932651; NR Description: putative lipid transfer protein [Oryza sativa (japonica cultivar-group)] >gi|47900499|gb|AAT39256.1| putative lipid transfer protein [Oryza sativa (japonica cultivar-group)]
  misc_feature: GI Number: 47155245; NR Description: lipid transfer protein
  misc_feature: GI Number: 7489428; NR Description: probable lipid transfer protein - barley >gi|1848225|gb|AAB47967.1| nonspecific lipid
  misc_feature: GI Number: 18893; NR Description: aleurone specific protein [Hordeum vulgare] >gi|19041|emb|CAA49448.1| lipid transfer protein [Hordeum vulgare subsp. vulgare] >gi|19043|emb|CAA40542.1| putative
  misc_feature: GI Number: 34922456; NR Description: Probable nonspecific
ACCAGCCAACTCACCATCGATCTCTGCTCCAACACTTCGATCGATCGCCAACACCGGCCAAGCAAAGCAAGCTACCATGGGCAACAGCAAGGCCGCGGTGTGCGTGCTGGCGCTCGTCCTGTGCGGCCTGCTCGCCGCAGACACGGCGGCGGCGGCGGGGTGCGACGCGAGCGCGCTGAGGCCGTGCGTGGGCGCTATCATGCTGGGCGGGGCGGTGACGCCGGGGTGCTGCGCGCGGCTGCGCGCCCAGCGGGCGTGCCTGTGCCAGTACGCACGCGACCCGTCCTACCGCGGCTACGTCAACAGCCCAAGGGCGCAGAGCGTCGTCGCCGCCTGCGGCCTCCCCGGGCCCAAGTGCTGATCGCCCGCCCGGCGCGCTATACATATCGACTCCGCCCCGTGTGGCCGGCGTCGTGCACGATGCCGGGCACCGGTGGACGGCGGTCTACGTAATGTAATATGTGGTTAATTACACGGTCGACGACGCCATCGAGCTGGCACGTACGTGCGTGCGTGTACGGTTGAGTTGTGGACGTCTGTCTAAATAAACGTGGTTTGCTCCAAGCTGCGCAAGCATATATACGTGCGTGCGTTGAGGCGGCTGGTTGTGTACGTTCTCTCATGTTTTCCCCCAGCATTAATTCCATCTGTTTTTTTAGGCAAAAAAAAAAAAAAAA

SEQ ID NO: 4687 - DNA, 1260 bp, Triticum aestivum
  misc_feature (1)..(1260): Ceres cDNA ID no. 21995882
  misc_feature (1)..(1260): Ceres CLONE  ID no. 568294
  misc_feature (1)..(1260): Also known as  Ceres CDNA ID no. 24369635
cttccgattgaatctacccacaacccaacccttccaacatggccgcctcctacatagcactcttgctcatcctcgccgcagttgccccacgcccctcctccgcgcggcacgtcgtctccttcatccctagtcgcggcgtctccccctcctccctggcctgggaccccaccgctcagcacttcgtcgtcgccggcggaggcgacgccgtcctttccgtatccgacgccggcgtgaccgaattgatcgcgtcccccggtgcctccgcagtcgccgttgacgaccgccgccgtcgcctcatagtagcgtccgccggttccgtctccgctttcgacctccgcacccctcggccccatcgcctcctcttctccaccacgctccccgaccccgccgcgcccggcggcgtcgccgtggacccacaatctggcgtcgccttcctcaccttgggcgcccaaatctacagcctttccactgacggcgacctcgccgcgctccctgcttcgcccgtctatggctcggagcccctctcctccctcgccgcacacgtgagccgggggttcctcctcgtcggccgtcccagcaccggccacctcctccgcgtcgacatggaggacggatccgcaagagacgtttcagggccctttacgccccccacgccggtcgccgtcgcggtgcggagcgatgggatggtggcggtgggcggggccgcgactctgcgcctggtcgggagcaacgacgggtgggtgtcttgcgcggagcatgacgtgggggaaccggacggctccgtcgcggcggtggcggtggcggtaagggagcggaagcgggtgtacgcgctggtggaggcggaggtggaggggaagagggaatggcggatcgaggaggtggagtggaaaaaggagggggagggggagatggtggcgctgttaatcttggtcggcgccgccctcgccatcttcatgttctggaggttccagatgcggcagctcgccggcaacatgaacaagaagatcagatagaaggatcacagtgcctggcggccatccccagctttatttttttatttccttctgcatttagttgacgcaggtattcttgtgtattagacatgttataatcatttttcattaactgtgaatcccttgatctttgcttgcgcagttgttttgcttggcacatccacgatgtaatagattcttttcctttctcagaatcacgatgtaatggaactgggcataactgatactagcaaaaaaaaaaaaaaaa

SEQ ID NO: 4688 - protein, 324 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: GI Number: 34912468; NR Description: P0704D04.8 [Oryza sativa
  misc_feature: GI Number: 41400381; NR Description: minus agglutinin
  misc_feature: GI Number: 57472005; NR Description: minus agglutinin
  misc_feature: GI Number: 60678627; NR Description: plus agglutinin
  misc_feature: GI Number: 41400384; NR Description: plus agglutinin
MAASYIALLLILAAVAPRPSSARHVVSFIPSRGVSPSSLAWDPTAQHFVVAGGGDAVLSVSDAGVTELIASPGASAVAVDDRRRRLIVASAGSVSAFDLRTPRPHRLLFSTTLPDPAAPGGVAVDPQSGVAFLTLGAQIYSLSTDGDLAALPASPVYGSEPLSSLAAHVSRGFLLVGRPSTGHLLRVDMEDGSARDVSGPFTPPTPVAVAVRSDGMVAVGGAATLRLVGSNDGWVSCAEHDVGEPDGSVAAVAVAVRERKRVYALVEAEVEGKREWRIEEVEWKKEGEGEMVALLILVGAALAIFMFWRFQMRQLAGNMNKKIR

SEQ ID NO: 4689 - DNA, 1339 bp, Triticum aestivum
  misc_feature (1)..(1339): Ceres cDNA ID no. 21995883
  misc_feature (1)..(1339): Ceres CLONE  ID no. 568544
  misc_feature (1)..(1339): Also known as  Ceres CDNA ID no. 23721314
tttttttggttggttgatgcaaagttgcctagctacgcttgcagattaactatcaagccccatggtcgttgtcgtctacttataagcatccattgctggaccgtcagaccttcaagtagctaggagctccagttggtttgcttgctttgattggcgatgaacggtgcggcgctagacaacgtgatccggcggctgctggaggtgcggcgggggcggccggggaagcagcaagtgcagcaggtgcagctgggcgagggggagatccggcagctctgcgccgccgccaaggacgtcttcatgcgccagcccaacctgctccagctcgacgcccccatcaagatcgccggtgacatccacggtcagtacacggacctgctgcggctgtttgagctgggcggcttcccgccgcagcacaagtacctgttcctgggcgactacgtggaccgcggcaagcagagcatcgagaccatctgcctgctgctcgcctacaagctccggtacccggagcacttcttcctcctccgcggcaaccacgagtgcgcctccgtcaaccgcgtctacggcttctacgacgagtgcaagcgccgctactccgtccgtctctggcgccacttctccgactgcttcaactgcatgcccgtcgccgccctcgtcgagtcgcgcatcctctgcatgcacggcggcctctccccggacctccgccacgtccgcgacatcgccggcctctccaggcccgtcgacgtccccgacaccggcctcctctgcgacctcctctggtccgaccccggcggcgccgccgggtgggggcccaacgagaggggcgtgtcgtacacgttcggggcggacgtggtggcggcgttcatggagaggcacgacctggacctcgtgtgccgggcgcaccaggtggtggaggacggctacgagttcttcgccgggcggcggatggtcaccgtcttctccgcgcccaactactgcggcgagttcgacaacgccggcgccctcatgtgcgtcgacgacgacctcacctgctccttccagatactcaagcccgtggacaacaggcagcggcgattcgccttcggcatgggatcatccgcaactactactagcagggggatccgatcaccgtggtgctaattaatatgcatccttggtcaaaacggatgcatgcaataaacccatccatctttgatttcattaccaattttgtatacgagttttcttgcatgcatggtgtaactcgcataaacaacaggaaaagcaacgcttgtactattttcttcggtaatgataactcccaaacgttcgggagttaagcatggcaaaaaaaaaaaaaaaa

SEQ ID NO: 4690 - protein, 326 aa, Triticum aestivum
  misc_feature: PFam Name: Metallophos; PFam Description: Calcineurin-like
  misc_feature: PFam Name: Mucin; PFam Description: Mucin-like glycoprotein
  misc_feature: PFam Name: Cation_efflux; PFam Description: Cation efflux family
  misc_feature: GI Number: 25289017; NR Description: phosphoprotein phosphatase (EC 3.1.3.16) 1 catalytic chain (clone TOPP1) -
  misc_feature: GI Number: 23296753; NR Description: putative phosphoprotein phosphatase type 1 catalytic subunit [Arabidopsis thaliana] >gi|19424068|gb|AAL87342.1| putative phosphoprotein phosphatase type 1 catalytic subunit [Arabidopsis thaliana]
  misc_feature: GI Number: 5053113; NR Description: phosphatase PP1
  misc_feature: GI Number: 2654373; NR Description: protein phosphatase 1 [Acetabularia cliftonii] >gi|1346753|sp|P48481|PP12_ACECL
  misc_feature: GI Number: 34902038; NR Description: putative SERINE/THREONINE PROTEIN PHOSPHATASE PP1 [Oryza sativa (japonica cultivar-group)] >gi|29893635|gb|AAP06889.1| putative SERINE/THREONINE PROTEIN PHOSPHATASE PP1 [Oryza sativa (japonica
MNGAALDNVIRRLLEVRRGRPGKQQVQQVQLGEGEIRQLCAAAKDVFMRQPNLLQLDAPIKIAGDIHGQYTDLLRLFELGGFPPQHKYLFLGDYVDRGKQSIETICLLLAYKLRYPEHFFLLRGNHECASVNRVYGFYDECKRRYSVRLWRHFSDCFNCMPVAALVESRILCMHGGLSPDLRHVRDIAGLSRPVDVPDTGLLCDLLWSDPGGAAGWGPNERGVSYTFGADVVAAFMERHDLDLVCRAHQVVEDGYEFFAGRRMVTVFSAPNYCGEFDNAGALMCVDDDLTCSFQILKPVDNRQRRFAFGMGSSATTTSRGIRSPWC

SEQ ID NO: 4691 - DNA, 887 bp, Triticum aestivum
  misc_feature (1)..(887): Ceres cDNA ID no. 21995884
  misc_feature (1)..(887): Ceres CLONE  ID no. 569428
  misc_feature (1)..(887): Also known as  Ceres CDNA ID no. 24408437
aaacagcactcatctcaagtctcaacgacaacgagcctccacacgcgcacttctagacgtgggtgtcatggcgggtccggcggagaggaagatgaaggtgtgggagctggtgctgcggtgcctcgtcggcggcttcggcgcggtggcggcggcgctggtggtcaccgacagccagaccaggaccttcttctccctcgagcggagggccaagtacaccgacatgaaggctctggtgctcctggtggccgccaacggcgctgccgtcgtgtacagtctactgcaggcggcgcgctgtgccgtggcgatggcgaggggaggcggcgcgctggtcatgagcagaagggtgctcgcctggtcggtcttctccggcgaccagctgctggcgtacgcgatgctggccgcgacggcggcggcgctgcagtcgtcgctgctcgggaagctcgggcagccggagctgcagtggatggggatctgcggcctctacggcgccttctgtaggcaggtcggcgcgggcatcgcgtgcgccgtcgtcgccggactcgccgccgtgctcctcgcatccttctccgcgttcaacctgttccgcctctacggcggcaacaaggggagcaatagtactagaaacggcgcaacgtggtactaggatagaaagtcaagtcagtgaagataaaatcgatctcagctacttcagatttcagattgtagagtggatcggtgaatcttttttaacttttcttggtgtgactcaacaagctggactgaagacatcgatcctaaagcattgcggctcctatgtcaggacttcagatcttggtgttctgcaccaaaatacgtagttccctttccaattacaatcaaaatatggtgttggagaaaaaaaaaaaaaa

SEQ ID NO: 4692 - protein, 191 aa, Triticum aestivum
  misc_feature: GI Number: 21617945; NR Description: unknown [Arabidopsis thaliana]
  misc_feature: GI Number: 51536393; NR Description: integral membrane protein-like [Oryza sativa (japonica cultivar-group)] >gi|51535626|dbj|BAD37569.1| integral membrane protein-like [Oryza
  misc_feature: GI Number: 57282656; NR Description: putative membrane
  misc_feature: GI Number: 50252057; NR Description: integral membrane
MAGPAERKMKVWELVLRCLVGGFGAVAAALVVTDSQTRTFFSLERRAKYTDMKALVLLVAANGAAVVYSLLQAARCAVAMARGGGALVMSRRVLAWSVFSGDQLLAYAMLAATAAALQSSLLGKLGQPELQWMGICGLYGAFCRQVGAGIACAVVAGLAAVLLASFSAFNLFRLYGGNKGSNSTRNGATWY

SEQ ID NO: 4693 - DNA, 1351 bp, Triticum aestivum
  misc_feature (1)..(1351): Ceres cDNA ID no. 21995885
  misc_feature (1)..(1351): Ceres CLONE  ID no. 569584
  misc_feature (1)..(1351): Also known as  Ceres CDNA ID no. 23721172
acacccacccaccccctcctccttacttgacctagaacctggcctcgggccgacgcctcctgctccctctcgctgtcgcgtctcccggcgatcctctccgtcgacgccccggctagccgccatcgtttcccggcgaccagatcgacggcaatcccatcctccttgatctccctctcgggcgtcgggagatctacgtggggacatgcataagctggggagaggaagccgcgacaaggtgcaacagttcatggccataactggtgcaagcgagaaggtcgcccttcaggcactgaaagctagtgattggcacttagaagggtcttttgattatttctacagccagccacagatttctgtgaccaattctcgacatctttacagcagatacaaagaacgtgatgctgatatgatcatggtggagggcacatctcaactttgcaacgacctgttggtggatcctcaggatgttgtcatgcttgtcatatcatggcacatgaaagctgccacaatgtgtgaatttactcgccaggaattcattgatggtctgcagtcaattggggtagattcaattgagaagctccgtgagaaacttccatcactgcgagctgagataaaggacgataataagttccgtgagatatacaactttgcatttgcttgggctagggaaaagggtcagaaatcccttccactggagacagctattggaatgtggaggttgctgtttgctgaaaggcattggcccttaatcgatcactggtgtcagtttctccaggtcaggcataacaaagccatctctagggacacatggtctcagctgttggaatttgttaagacaattgatccacagttatccaattatgacgaagaaggtgcttggccctacctaattgatgaatttgtggagtacctaaccgagaatggatgcgttcagcgtaacaagtgaaccattcgaggctgcattctgacttggatatcatgatttggtggtacaaacatgattcatgtcgatcaatagaatatttatctttggatgtcggcattgttccagctccccttcacaaagcagatgatgtcgtttggtggaatctacttgcgcaggggtgatttcactggctaggattgcaaactatctatctggtttgtattttgtgctgcacctatctgctacagcatacccaaaatagttattggtttactgctgaatgggcgatgggtctatagttcatgtaggtctaggtatgaggtaatgcgaacttgtgctatcggtattgatcgattgttgccagatggggcacctttctatgaggtaatgcaaacttgtgatatctttcgaaaaaaaaaaaaaaaa

SEQ ID NO: 4694 - protein, 247 aa, Triticum aestivum
  misc_feature: PFam Name: UBA; PFam Description: UBA/TS-N domain
  misc_feature: GI Number: 51535194; NR Description: putative leucine zipper
  misc_feature: GI Number: 34784818; NR Description: C13orf17 protein [Homo
  misc_feature: GI Number: 45387523; NR Description: Unknown (protein for MGC:77887) [Danio rerio] >gi|41389078|gb|AAH65884.1| Unknown
  misc_feature: GI Number: 62643615; NR Description: PREDICTED: similar to
  misc_feature: GI Number: 55621550; NR Description: PREDICTED: similar to RP42 homolog; squamous cell carcinoma-related oncogene [Pan
MHKLGRGSRDKVQQFMAITGASEKVALQALKASDWHLEGSFDYFYSQPQISVTNSRHLYSRYKERDADMIMVEGTSQLCNDLLVDPQDVVMLVISWHMKAATMCEFTRQEFIDGLQSIGVDSIEKLREKLPSLRAEIKDDNKFREIYNFAFAWAREKGQKSLPLETAIGMWRLLFAERHWPLIDHWCQFLQVRHNKAISRDTWSQLLEFVKTIDPQLSNYDEEGAWPYLIDEFVEYLTENGCVQRNK

SEQ ID NO: 4695 - DNA, 1625 bp, Glycine max
  misc_feature (1)..(1625): Ceres cDNA ID no. 21995887
  misc_feature (1)..(1625): Ceres CLONE  ID no. 574525
  misc_feature (1)..(1625): Also known as  Ceres CDNA ID no. 24403229
atcatctagtccacttttccactccaccaccaaactcctaccagactcactcactctctctctctctccaccctccaactgcaactgcaatggccgtcccttccttctccgcgcgttctttctctctccccgcccaaaaccactactgccacctctcttctctcccactaccctccttcactctctcatctcgccgcccaagatattcttcttccaacctcttcacacctcttcgctctcccacaacccccatttttgcatcggcccacggcggtggcaccggaggcggacatgccggcggaggtggagctggaggtggagggggaggcgaccatgaatcggaggacagggatcggaacagagaggaggcgctgctggttctcgccgaggcagggcggccgctggagaaattgccagcggatttagcggcggcgattggggcggggcgagtgccgggctcgattgtgaagaggttgttcgagctggaaaaatcggcagtgttccggtggctgctgaatttcggagggtttagggagaggttactggccgatgatttgttcctcgctaaggttgccatggagtgcggtgttggcatctttacaaagactgctgcggagttggagaagcgcaaagaaaattttactaaggagcttgattttgtttgtgccgatgtggtaatggccatcgtagcagattttatgcttgtgtggcttcctgcccccacagtttctctccgaccaccacttgctgttagtgctggaactattgctaaattcttctatggctgccctgaaaatgcttttcaggtggctttggctgggacctcatattcacttattcagagaataggtgctatagtgagaaatggagcaaagctatttgcagttggaactggtgcatcactgattggtacaggtgtaactaatgcgttgatcaatgcaagaaaagttgttgataaatcttttgctgctgaggcagaggatgtaccgataatatcgacaagtattgcctatggggtttacatggcagtatccagcaacttaaggtaccaagtactagctggagttattgaacaacggattcttgaacctttgctgcaccagcacaaacttatgctaagcgcaatttgctttgctgttagaactggaaacactttcttgggctcactattgtgggtggattatgctcgctgggttggagtccagaagatacgggattaggcataatggttcttcagttacaagatattttcataggatgatttgggtcaaatcttgtctgttgattcattattgaagtacagttggtttgttgtatttttttttattcctcctgaaagcaatgttgtaaattgagcaataacggagggcagcaagcaccttcacttgagtctccaattatcaccgtttatgctggccagtgaaggtataagatccatctctcgtagctagcagaaagctgcagcatgagatgaatttgagtcacacatcttcactagacatttgtggggcaatgcctatattgttcttgtgtgttttgccttctaaagttaaaaatgaatagagacaaattcaaattggcagtgccctaaaaaaaaaaaaaaaaaaaaaaaaaaaaaaaaaaaa

SEQ ID NO: 4696 - protein, 376 aa, Glycine max
  misc_feature: PFam Name: Ras; PFam Description: Ras family
  misc_feature: PFam Name: Arv1; PFam Description: Arv1-like family
  misc_feature: PFam Name: GRP; PFam Description: Glycine rich protein family
  misc_feature: PFam Name: Nsp1_C; PFam Description: Nsp1-like C-terminal region
  misc_feature: PFam Name: Ribosomal_60s; PFam Description: 60s Acidic
  misc_feature: GI Number: 34905738; NR Description: OJ1294_F06.10 [Oryza sativa (japonica cultivar-group)] >gi|20805202|dbj|BAB92870.1|
  misc_feature: GI Number: 20857082; NR Description: At2g40400/T3G21.17 [Arabidopsis thaliana] >gi|4586056|gb|AAD25674.1| chloroplast lumen common protein family [Arabidopsis thaliana] >gi|15294188|gb|AAK95271.1| At2g40400/T3G21.17 [Arabidopsis
  misc_feature: GI Number: 34907912; NR Description: B1088C09.1 [Oryza sativa (japonica cultivar-group)] >gi|15624043|dbj|BAB68096.1| B1088C09.1
  misc_feature: GI Number: 57834123; NR Description: OSJNBb0065J09.14 [Oryza
  misc_feature: GI Number: 34909204; NR Description: P0425G02.25 [Oryza sativa (japonica cultivar-group)] >gi|18844779|dbj|BAB85250.1| P0425G02.25 [Oryza sativa (japonica cultivar-group)] >gi|20161467|dbj|BAB90391.1| P0432B10.9 [Oryza sativa (japonica
MAVPSFSARSFSLPAQNHYCHLSSLPLPSFTLSSRRPRYSSSNLFTPLRSPTTPIFASAHGGGTGGGHAGGGGAGGGGGGDHESEDRDRNREEALLVLAEAGRPLEKLPADLAAAIGAGRVPGSIVKRLFELEKSAVFRWLLNFGGFRERLLADDLFLAKVAMECGVGIFTKTAAELEKRKENFTKELDFVCADVVMAIVADFMLVWLPAPTVSLRPPLAVSAGTIAKFFYGCPENAFQVALAGTSYSLIQRIGAIVRNGAKLFAVGTGASLIGTGVTNALINARKVVDKSFAAEAEDVPIISTSIAYGVYMAVSSNLRYQVLAGVIEQRILEPLLHQHKLMLSAICFAVRTGNTFLGSLLWVDYARWVGVQKIRD

SEQ ID NO: 4697 - DNA, 1454 bp, Triticum aestivum
  misc_feature (1)..(1454): Ceres cDNA ID no. 21995889
  misc_feature (1)..(1454): Ceres CLONE  ID no. 575502
  misc_feature (1)..(1454): Also known as  Ceres CDNA ID no. 24409056
actgtcgccgctgcctaaccaggctacaatcagacagtttctggctacgacacggcacgacgcgacgcgaggctctcgagagcgcgagcgagatcgtcgtctgctgcggctagggaggtgtcgtcggtggtggtctgcctcatgggctccgccatggaccacgtcggcgcggcgggcgggagggccaagaaggcgtccggcggctcgcagctgtggaagaaggcgctgctgcattccagcctctgcttcgtcatgggcttcttcacgggcttcgccccctcctccgtctccgactggcggtccgtcgcgcccgccggggtggggagcagccacgtggtgaagacgccgcaagtgatcgcgtcgggcgcggccatggaccggagcctgctggcgcgggacgcggccgcgagaatcgggggcgtcccgcggcctctcctggtggtcgtgacgacgaccgagtcgacgcctacggcggccggcgagcgggcggcgatgctgaccaggatggcgcacaccctgcggctcgtgccgccgccgctgctgtgggtggtggtggaggccgcccccgacgtgccggcgacggcgaagctgctgcgcgacacggggatcctgtaccgccacctgacctacaaggagaacttcacggccgccgaggtcgccgcgggcaaggagcgccaccaccagcgcaacaccgcgctggagcacatcgagcggcaccgcctcgccgccatcgtccacttcgccggcctcggcgacgtctacgagctgcgctttttcgaccagctccggcagatcagtacattcggtgcgtggccggtggcgaggatgtcgcggaacgagcggaaggtggtcatccagggccctgcgtgcagctcctccaaggtcctcggctggttctccagggacctgatgagcaacggcaccgccggcacgggcggcggcacggcggcgacctcgcctgagattgacgtccacggcttcgccttcaacagctccgtgctctgggaccccgagcgctggggccgctacccgacctccgagcccgacaagtcccaggactcgatgaggtttgtgcagcaagtggtgtcggaggattatagcaaggtgaagggcattcctccagattgcctggagatcatggtgtggggcgtcgacacgccgccgccgccggccccgtcttcctcgcaacaaactccggggaataagaggaggtagatgggagagttgtagaagagatcgtcggatccaagagccgaacaagctgctgcctatactgtacatgcaagggtcgcaccagtaaggtgttgatgctcctactagctgcaaacataagaacttttttggttttcgttataggggacggatcggcaagtatcctcccgggcttgtacatcgtacttaccttttcttttctcttcaacaaactgtgatatatgccaaaaaaaaaaaaaaaa

SEQ ID NO: 4698 - protein, 357 aa, Triticum aestivum
  misc_feature: PFam Name: Glyco_transf_43; PFam Description:
  misc_feature: GI Number: 32879543; NR Description:
  misc_feature: GI Number: 33771692; NR Description:
  misc_feature: GI Number: 60657594; NR Description: secondary cell wall-related glycosyltransferase family 43 [Populus tremula x
  misc_feature: GI Number: 32968187; NR Description:
  misc_feature: GI Number: 63087724; NR Description: glycosyltransferase
MGSAMDHVGAAGGRAKKASGGSQLWKKALLHSSLCFVMGFFTGFAPSSVSDWRSVAPAGVGSSHVVKTPQVIASGAAMDRSLLARDAAARIGGVPRPLLVVVTTTESTPTAAGERAAMLTRMAHTLRLVPPPLLWVVVEAAPDVPATAKLLRDTGILYRHLTYKENFTAAEVAAGKERHHQRNTALEHIERHRLAAIVHFAGLGDVYELRFFDQLRQISTFGAWPVARMSRNERKVVIQGPACSSSKVLGWFSRDLMSNGTAGTGGGTAATSPEIDVHGFAFNSSVLWDPERWGRYPTSEPDKSQDSMRFVQQVVSEDYSKVKGIPPDCLEIMVWGVDTPPPPAPSSSQQTPGNKRR

SEQ ID NO: 4699 - DNA, 1618 bp, Triticum aestivum
  misc_feature (1)..(1618): Ceres cDNA ID no. 21995890
  misc_feature (1)..(1618): Ceres CLONE  ID no. 575642
  misc_feature (1)..(1618): Also known as  Ceres CDNA ID no. 24409084
atatacggaaacaaaccgaccgagaaggcccttaattaacagctagctagctctcttggtcgaatatggtaactgctaatgctattggctccggcgacctgagcatccgtgtcctgagtcgccgccttgtcaaggcctccgacccatctaccaagccgcacgtagccgccttctcgaacctcgacctctaccctggcaacgagcaggcctcgatagtatgcctctaccccaagctcccaaacgccggtgacttcccggcggttgtagccaccttcgactccatcctcccgtcgttgctcaacgacttctaccatttcgccgggcgcatccgcaccaacccaagctccggcctccccgagctgctctgcgacaaccaaggcgcagagctggtggtcggcgaggccggtgtcgccatggccagcctggactacggcctggcggagcagtcgttgaagaagataatgcttccgtacgccgaggacgtcacgctctcggttcagctgctctccttcgcctgtggcggcttctccgtcgtgtgggcgaccaacaaccttgtgtgtgacggccaagccttcaccatgttcgtcaggaggtggtccgagctcgcccgaactgggcgcatcgtcgacggaccgcccaaccatgaccgctcggtgttcagccctcgcaggccgccgtcgtacggagcctcgatcagggacatgttcgcgacgtacgaccatgaccggctggtgaacgtgctgacggcgcacgacagcttcgtcgagcgcctctactacatcgaggcgagcgacatcgctgccctgcgggaggcggcaagcagcaagctccagcgcccgtcgcgcgtccaggcggtgtccgcgtacctgtggaaggccctcgcccgcgtggtggccgcgtcccgcgtgccggaggagcgctgctgcatggggtggatggtggacgcgcggcggcgggtgaaggcgccggagctcgtccgggcgatgggcaactacttcggcaacgttacggcctacgctctcggggaggcagccgttgaggagatacaggagaaggagctgtcggaggtggcggccatggtgcgggagaccatcacgtctatcgactacgatgagtacacccaggagctggtggactgggtggaggagcacaagacagagaggctgatggagaagggcgtcatcgggctcggtacgcccaccttgaaccagacggtgttcgcgtcgttcccgctcgacaccgacttcggcttcggccatgccgtgctggcaatgcccatgtgcgactacgggaggctcagctcggggtacctgtcgatcggagctcggccgggaggcgacggctcctggctggtcaacgcctacatatggcctcgcctcgcggcggcgcttgagtcggaccagcagcgcatcttcaagcctctcacggcggagtatctagggctcgtctaggcgtaccactctgctgtctgcccggtttcttcttcaataagtctttgcttcgtcttttgaggcatgaaagcagctcgtgcttgttttacttccacctattttgcaataccccaaataaagcccttctgtgtggagggtagtttgtttgagcaaaaaaaaaaaaaaaa

SEQ ID NO: 4700 - protein, 461 aa, Triticum aestivum
  misc_feature: PFam Name: Transferase; PFam Description: Transferase family
  misc_feature: GI Number: 50935419; NR Description: anthranilate N-hydroxycinnamoyl/benzoyltransferase-like protein [Oryza sativa (japonica cultivar-group)] >gi|34393204|dbj|BAC82918.1| anthranilate N-hydroxycinnamoyl/benzoyltransferase-like protein
  misc_feature: GI Number: 50941335; NR Description: anthranilate N-hydroxycinnamoyl/benzoyltransferase-like protein [Oryza sativa (japonica cultivar-group)] >gi|37806151|dbj|BAC99656.1| anthranilate N-hydroxycinnamoyl/benzoyltransferase-like protein
  misc_feature: GI Number: 56783990; NR Description: anthranilate N-hydroxycinnamoyl/benzoyltransferase -like [Oryza sativa (japonica cultivar-group)] gi|56783827|dbj|BAD81239.1| anthranilate N-hydroxycinnamoyl/benzoyltransferase -like [Oryza
  misc_feature: GI Number: 6910569; NR Description: Highly similar to YUP8H12R.39. [Arabidopsis thaliana] >gi|25403166|pir||G86453 YUP8H12R.39. homolog F9L11.9 [imported] - Arabidopsis thaliana >gi|15223333|ref|NP_174567.1| transferase family protein
  misc_feature: GI Number: 15219263; NR Description: transferase family
MVTANAIGSGDLSIRVLSRRLVKASDPSTKPHVAAFSNLDLYPGNEQASIVCLYPKLPNAGDFPAVVATFDSILPSLLNDFYHFAGRIRTNPSSGLPELLCDNQGAELVVGEAGVAMASLDYGLAEQSLKKIMLPYAEDVTLSVQLLSFACGGFSVVWATNNLVCDGQAFTMFVRRWSELARTGRIVDGPPNHDRSVFSPRRPPSYGASIRDMFATYDHDRLVNVLTAHDSFVERLYYIEASDIAALREAASSKLQRPSRVQAVSAYLWKALARVVAASRVPEERCCMGWMVDARRRVKAPELVRAMGNYFGNVTAYALGEAAVEEIQEKELSEVAAMVRETITSIDYDEYTQELVDWVEEHKTERLMEKGVIGLGTPTLNQTVFASFPLDTDFGFGHAVLAMPMCDYGRLSSGYLSIGARPGGDGSWLVNAYIWPRLAAALESDQQRIFKPLTAEYLGLV

SEQ ID NO: 4701 - DNA, 936 bp, Triticum aestivum
  misc_feature (1)..(936): Ceres cDNA ID no. 21995891
  misc_feature (1)..(936): Ceres CLONE  ID no. 575778
  misc_feature (1)..(936): Also known as  Ceres CDNA ID no. 24412580
acacaccagcagctatcgtcgtcgaacactggagccagccagcagaagagagcgcgcactagctccaacctccacgaacacttcgccgatcgttatgatggcgagtccggcgttcttgctgctgctcttgctggccgtgtcgatcaggggatcagaggcggagtggtgcgtgtgcaggtcggacgcgaacgagacggcgctgcaggagacgctggactacgcgtgcgggcagggcgcggactgcgcgccggtggccacgggagggagctgccacagccccgactcggtggtggcgcactgctcctacgcggtcaacagctactaccagaggagcagccagaccaagggcgccacctgcgacttcggcggcaccgccaccctctcctccgccgaccccagctcgggaacctgcaagtaccctgcaaccgcaagtgcggctgggacgagcaccgggaacggcacagggacaggctccggcgccggcaccaactcgtcttccccgggctcgacgaacccagctacgcccggcatgggagggagcttcaccacgccgatcggcagcgcgtccggccctacggcgagcatcataggccccgagagcagcggtgtcgctgccgctgcggccgctttcgctggcgtccgtggcctcgtcggcgtcgccgtggcctccgtcctcgctttctaggtgcggtgttgatcatgaagcagcgagaaacgtagtgcattctttttaatcatctccaattcctagtgcgttgttgctttggtggagacgtgctgtcgttctgctttagtgtttgtctgtgtacgcctttaatgctcttttagtccatgtatatggagtttaatttctttgcctcatgtcgatgtcgtatttgtgtcccgtgaaacaatttgcatcatggatgtgatgttactacaaaaaaaaaaaaaaaa

SEQ ID NO: 4702 - protein, 936 aa, Triticum aestivum
  misc_feature: PFam Name: X8; PFam Description: X8 domain
  misc_feature: PFam Name: Cornifin; PFam Description: Cornifin (SPRR) family
  misc_feature: GI Number: 57899559; NR Description: glycosyl hydrolase
  misc_feature: GI Number: 34909796; NR Description: P0403C05.4 [Oryza sativa (japonica cultivar-group)] >gi|15289889|dbj|BAB63584.1| P0403C05.4
  misc_feature: GI Number: 50939031; NR Description: glycosyl hydrolase family 17-like protein [Oryza sativa (japonica cultivar-group)] >gi|22775658|dbj|BAC15512.1| glycosyl hydrolase family 17-like protein [Oryza sativa (japonica cultivar-group)]
  misc_feature: GI Number: 21592859; NR Description: unknown [Arabidopsis thaliana]
  misc_feature: GI Number: 34912962; NR Description: beta-1,3 glucanase-like protein [Oryza sativa (japonica cultivar-group)] >gi|20161490|dbj|BAB90413.1| beta-1,3 glucanase-like protein [Oryza
ACACACCAGCAGCTATCGTCGTCGAACACTGGAGCCAGCCAGCAGAAGAGAGCGCGCACTAGCTCCAACCTCCACGAACACTTCGCCGATCGTTATGATGGCGAGTCCGGCGTTCTTGCTGCTGCTCTTGCTGGCCGTGTCGATCAGGGGATCAGAGGCGGAGTGGTGCGTGTGCAGGTCGGACGCGAACGAGACGGCGCTGCAGGAGACGCTGGACTACGCGTGCGGGCAGGGCGCGGACTGCGCGCCGGTGGCCACGGGAGGGAGCTGCCACAGCCCCGACTCGGTGGTGGCGCACTGCTCCTACGCGGTCAACAGCTACTACCAGAGGAGCAGCCAGACCAAGGGCGCCACCTGCGACTTCGGCGGCACCGCCACCCTCTCCTCCGCCGACCCCAGCTCGGGAACCTGCAAGTACCCTGCAACCGCAAGTGCGGCTGGGACGAGCACCGGGAACGGCACAGGGACAGGCTCCGGCGCCGGCACCAACTCGTCTTCCCCGGGCTCGACGAACCCAGCTACGCCCGGCATGGGAGGGAGCTTCACCACGCCGATCGGCAGCGCGTCCGGCCCTACGGCGAGCATCATAGGCCCCGAGAGCAGCGGTGTCGCTGCCGCTGCGGCCGCTTTCGCTGGCGTCCGTGGCCTCGTCGGCGTCGCCGTGGCCTCCGTCCTCGCTTTCTAGGTGCGGTGTTGATCATGAAGCAGCGAGAAACGTAGTGCATTCTTTTTAATCATCTCCAATTCCTAGTGCGTTGTTGCTTTGGTGGAGACGTGCTGTCGTTCTGCTTTAGTGTTTGTCTGTGTACGCCTTTAATGCTCTTTTAGTCCATGTATATGGAGTTTAATTTCTTTGCCTCATGTCGATGTCGTATTTGTGTCCCGTGAAACAATTTGCATCATGGATGTGATGTTACTACAAAAAAAAAAAAAAAA

SEQ ID NO: 4703 - DNA, 1183 bp, Triticum aestivum
  misc_feature (1)..(1183): Ceres cDNA ID no. 21995892
  misc_feature (1)..(1183): Ceres CLONE  ID no. 575795
  misc_feature (1)..(1183): Also known as  Ceres CDNA ID no. 24368773
ttgcctctccggtgcttactcggctcctgctccgatatccacctcgtccggcgcttccacctcggaacggaccaccaccagcggcgcaggcacggctgagccgcacgcaggcagcacgcgaggacactgccgcagcgatgccgcccgccgccaccttctcgtcgttctccgcgttgatgcgccggcctccgccgccggcccggcgcctcctcgtcgccgccgcgcgcgcgcacagcactgccggggccagccgtgctcgcggcggcctgccgcggttccactccccgtctctcccctcgtccaagggtgaggtggttcgcatccaaggcgacgagttctggcacatgacacgggtgttgcgccttggtatcaatgacagggttgaactatttgacggggctggtggcttagttgaaggatccatacaaaaagttgacaagaatggatcagatgttgagttggtagagaatgctaggctcattgctcctcaaggaattcaatggcatgtctttgctgcatttgggacgctgaaaggcggacgcgcagattggcttatagagaaatgtactgaacttggcgcttccagtgttacgcctcttttgactgaacgatgccatacgatagcagaaaatagagtggacaggttgcaacggctggtgttagctgcagttaaacaatgccagagagtgcatgatatgtcactgaagcccccaatccagatacatgatcttccgctggctgtgtcacaatcgaagcttgctttcttagcatctgctgaagcgcctcctgttttgagcgttttgccaaagtgcagcagcgaggaggaaagtgggcttttaatcattggaccggaaggagactttacggaggaggaggtgaaggttttgaaggcggctggtgcggtccctgttggtctgggtccatgcaggctacgcgtggagacagctaccatctcactcctttcagcgctcatgctgtggtcagacgctgctcggcaccaagaagcacagcggcaacgcggatagttcataataatttgttaaccatttataacatgtggttggacttgacttttccaagagcatgcatgtatacgtagtcgacaatcaatcagtcaactgaactggatctgagatagtataatataatagtattatacacgtaactaaaaaaaaaaaaaaaa

SEQ ID NO: 4704 - protein, 295 aa, Triticum aestivum
  misc_feature: GI Number: 23103487; NR Description: COG1385: Uncharacterized
  misc_feature: GI Number: 48730906; NR Description: COG1385: Uncharacterized
  misc_feature: GI Number: 53727131; NR Description: COG1385: Uncharacterized
  misc_feature: GI Number: 49082184; NR Description: PA0419 [synthetic construct]
  misc_feature: GI Number: 48860316; NR Description: COG1385: Uncharacterized
MPPAATFSSFSALMRRPPPPARRLLVAAARAHSTAGASRARGGLPRFHSPSLPSSKGEVVRIQGDEFWHMTRVLRLGINDRVELFDGAGGLVEGSIQKVDKNGSDVELVENARLIAPQGIQWHVFAAFGTLKGGRADWLIEKCTELGASSVTPLLTERCHTIAENRVDRLQRLVLAAVKQCQRVHDMSLKPPIQIHDLPLAVSQSKLAFLASAEAPPVLSVLPKCSSEEESGLLIIGPEGDFTEEEVKVLKAAGAVPVGLGPCRLRVETATISLLSALMLWSDAARHQEAQRQRG

SEQ ID NO: 4705 - DNA, 1487 bp, Triticum aestivum
  misc_feature (1)..(1487): Ceres cDNA ID no. 21995893
  misc_feature (1)..(1487): Ceres CLONE  ID no. 576111
  misc_feature (1)..(1487): Also known as  Ceres CDNA ID no. 25088402
gaagccatctcgtacggactccatagctcccacctccaagcacgatcaccagcgagctcccgaaccccatggcaggcggcggcgggaaggtggcgtgcgcggcgtggatccggcgccgggaggacaaggccacccgcgtcttcgcggtgcacggccggccctccccgccggccctggaggttctcggcttcgactccgggagctgctcgctctccgaggagcccctggcgaggattgtgctcggggacgatccagacgacgcgccgctcgccgtcgcggtgcaccccaccggcgacgagctcgtgtgcaccacggccaaggggtgcaggctatttaaactgatttttgaagagttcaccgttcgctttattgaaagtaaagctccagcgatcgaatctgttggactgcagaaatgtgttgccttcagcacagatggtgctaaatttgctatcggtggtgaggatgggcatctaagaatatttcattggccaagcatgaaggtgctcttagatgaacccaacgctcataaatccttcagagacatggatatcagcttagattcagagtttttagtttcatcgtctactgatggcactgcaagaatttggaagataaatgagggggtaccattggtcaacttgactcgatcttcggacgagaagattgagtgttgccgcttttctagggatggcatgaaaccgttcctgttttgcacagttgcaaaaggtagcaaagctgtgactgttgtttggaacataagtgattggtctagaattgggtacaaaagactactgggaaaacctgcctccacactttcagttagcttggatgggaaatttctggctttaggaaaccaggatggtgatttttgtgttgtggatgtaaaggagatggagatttctcactggagcaagaaggtccatcttggttcccctatatgcggaattgaattttgtcctactgaaagagttgtaatctccacatcgccacagtggggagcagagctgacaagactgaatgtgcctgctgactggaaagaatggcaaatctggctcatactcttggcgctcttccttgcatcagccgtcctgttctacgtattctaccagaactccggttccttctggagcggaacgccccgacgggacgtcatcgacctaccaagccatgcagagttctgaacgagcctcctcggtctcgtgaaaaccaaaactcctggtgaaactgttcaccagtgtgattccctttcaagcaatccagcactgcagtgttatttatttcattcataccaagagctctttctttctttactagtgtagtcaatgttgtatcaatccagtggcgcgcctatctatctggcgacgtcagtatttatcggggggaacactgtaaaatgacactgtaaatgataatagttcgagaatgtcatcgagtgttaatgggacattcaagatcgccaactgaaaaaaaaaaaaaaaaaaaaaaaa

SEQ ID NO: 4706 - protein, 370 aa, Triticum aestivum
  misc_feature: PFam Name: WD40; PFam Description: WD domain, G-beta repeat
  misc_feature: GI Number: 50934809; NR Description: transducin / WD-40 repeat protein-like [Oryza sativa (japonica cultivar-group)] >gi|34394605|dbj|BAC83907.1| transducin / WD-40 repeat protein-like
  misc_feature: GI Number: 34897162; NR Description: putative membrane protein [Oryza sativa (japonica cultivar-group)] >gi|28209528|gb|AAO37546.1| putative membrane protein [Oryza sativa
  misc_feature: GI Number: 9758764; NR Description: St12p protein [Arabidopsis thaliana] >gi|22327692|ref|NP_680414.1| WD-40 repeat family protein / St12p protein, putative [Arabidopsis thaliana]
  misc_feature: GI Number: 8777388; NR Description: protein transport protein
  misc_feature: GI Number: 11358859; NR Description: St12p protein [imported]
MAGGGGKVACAAWIRRREDKATRVFAVHGRPSPPALEVLGFDSGSCSLSEEPLARIVLGDDPDDAPLAVAVHPTGDELVCTTAKGCRLFKLIFEEFTVRFIESKAPAIESVGLQKCVAFSTDGAKFAIGGEDGHLRIFHWPSMKVLLDEPNAHKSFRDMDISLDSEFLVSSSTDGTARIWKINEGVPLVNLTRSSDEKIECCRFSRDGMKPFLFCTVAKGSKAVTVVWNISDWSRIGYKRLLGKPASTLSVSLDGKFLALGNQDGDFCVVDVKEMEISHWSKKVHLGSPICGIEFCPTERVVISTSPQWGAELTRLNVPADWKEWQIWLILLALFLASAVLFYVFYQNSGSFWSGTPRRDVIDLPSHAEF

SEQ ID NO: 4707 - DNA, 1868 bp, Glycine max
  misc_feature (1)..(1868): Ceres cDNA ID no. 21995896
  misc_feature (1)..(1868): Ceres CLONE  ID no. 581480
  misc_feature (1)..(1868): Also known as  Ceres CDNA ID no. 23472726
aaacataattcgttcctgggagtctctctgtcttctacttgtttgttagggttccttttcccgtttcgtttcgtttcgttttttttgcaatggaagaaagccctcgtggtcgcagaaagcgagcacacccttcttctccttctcctccttcgccaatctccaagaagccccaaaccttcccttcgttccaagacatccccaatctcccttctaacatcaaatccctctgccacctcatcgccaccacctccgccgccaccgtcgagcactccctccaatccgccgccatctccgtcatccctcacgacgtcgaagaagtcctcaaactctcctacggcttcccgggccaatccgtcaaattcttccgctggagcggccgccacctcaacgacaaccacacgccctattcctggaacctcgttgtcgatatcctcggcagaaaccgcttcttcgaccccatgtgggacgccgttaagtcaatgaacaaagaagggttactctcgctcgccacattcgcctccgtcttcagcagctatgttgccgctgacagaatccgtgaagcaattatggcgtttgagattatggacaattacggttgtgtgagggatgcttttgctttgaattcgcttttgagtgcaatttgtagcaatggtaggactcttgatgcttgtgattacttgcaggttgctaagaaattcgtccgaccggatacggatacttacgcgattttaatggaggggtgggaaggggagaagagtatggttagtgctaaggagacatttgctgagatggtgattgagattggatgggatcctgcgaatgtgccggcttatgattcgttcttgtgtacacttgttagagggcatgatggattgcttgaggctattaagtttgttgattccatgagggataggaggtgttaccccggtgtgaggtttctgaaggctgcattggatgagtgtgttaagtgccatgatgttaggacagctgagtttttctgggaggtgttggtggttgggaaggtgttgcagcccacctctgagatgtacaatttgatgatcggtttgtgttgctatcgcggtgacaccgatgctgcaaggaggatgctccatgagatggtttaccaaggggcttttcctgatgtggtgacttataacttgttgtttaagttcttgctcaaggggaggaaactgagggaggcttcgtcggtgtttgcggagatggtgcagaatgagtgtgtgccggagcaggataactgtgatttggcagttaaggcgtatgtggattgcggggagcctgttatggcgatcaaggtttggaagtgtttggtggagaattataagaagggtttggagcagaccgcgaattttctggttgtggggctttgcaatttgaacaggccacaggtggcggttaagtatgccgaggatatgattggcaggggaatcagtttgtcctcttccacattgtcgaagctgagacaaagccttgtcaaggagagaagagaatatgtgtatgaggatcttttgagaaagtggaaatctcactaggtagtttggattttttttgctaaaactgtgtaacttaatattagtgccgaatttgaatgttttgcttttgtctgatagagaggggaagaattttgaagtggttattattatctaaaagatgatactttggttctgcattgggataaataggctccagcatgtgttatctttgtatatagttactgcaaaagatcctactagaattgctttagaaggttaaaggtagaggaagtttatataggtttttgtatcaaacttatattataaaaaataaaaaaaagctttatctatttacctatcttaaaaaaaaaaaaaaaa

SEQ ID NO: 4708 - protein, 486 aa, Glycine max
  misc_feature: PFam Name: PPR; PFam Description: PPR repeat
  misc_feature: PFam Name: Vitellogenin_N; PFam Description: Lipoprotein
  misc_feature: GI Number: 50912049; NR Description: pentatricopeptide (PPR) repeat-containing protein-like [Oryza sativa (japonica cultivar-group)] >gi|41052650|dbj|BAD07498.1| pentatricopeptide (PPR) repeat-containing protein-like [Oryza sativa (japonica
  misc_feature: GI Number: 42565430; NR Description: pentatricopeptide repeat
  misc_feature: GI Number: 17386104; NR Description: At1g20300/F14O10_8 [Arabidopsis thaliana] >gi|15450347|gb|AAK96467.1| At1g20300/F14O10_8 [Arabidopsis thaliana] >gi|25513639|pir||F86336 F14O10.10 protein - Arabidopsis thaliana
  misc_feature: GI Number: 15228788; NR Description: pentatricopeptide (PPR)
  misc_feature: GI Number: 50918647; NR Description: putative reverse transcriptase [Oryza sativa (japonica cultivar-group)] >gi|21686921|gb|AAK71569.2| putative reverse transcriptase [Oryza
MEESPRGRRKRAHPSSPSPPSPISKKPQTFPSFQDIPNLPSNIKSLCHLIATTSAATVEHSLQSAAISVIPHDVEEVLKLSYGFPGQSVKFFRWSGRHLNDNHTPYSWNLVVDILGRNRFFDPMWDAVKSMNKEGLLSLATFASVFSSYVAADRIREAIMAFEIMDNYGCVRDAFALNSLLSAICSNGRTLDACDYLQVAKKFVRPDTDTYAILMEGWEGEKSMVSAKETFAEMVIEIGWDPANVPAYDSFLCTLVRGHDGLLEAIKFVDSMRDRRCYPGVRFLKAALDECVKCHDVRTAEFFWEVLVVGKVLQPTSEMYNLMIGLCCYRGDTDAARRMLHEMVYQGAFPDVVTYNLLFKFLLKGRKLREASSVFAEMVQNECVPEQDNCDLAVKAYVDCGEPVMAIKVWKCLVENYKKGLEQTANFLVVGLCNLNRPQVAVKYAEDMIGRGISLSSSTLSKLRQSLVKERREYVYEDLLRKWKSH

SEQ ID NO: 4709 - DNA, 1022 bp, Glycine max
  misc_feature (1)..(1022): Ceres cDNA ID no. 21995897
  misc_feature (1)..(1022): Ceres CLONE  ID no. 593783
  misc_feature (1)..(1022): Also known as  Ceres CDNA ID no. 25088264
acagtatatgcaaacaaagcctccaccaatgtcgctgctgccgccgccgaaacctcaccggagctccggtaactcccctggcgacagcattccagactggatctccgaatcaatcaacggcggctccctccgccgcgtcgacctcaactccggcaccaacggctgggcgtcgccgccaggctccgtgttctccctccgctccgaaagttactttcagaaccgccaaaaatgtcccgccggcgactacctcctctcgccggcgggcatggactggctcaaatccgccgcgaaactcgaccacgtgctctcacgcgcggacaaccgcgtgatgcacgcgctgcgaagatgtcaaaccctaggtcgctccctaaagagcttcgtcttcgcggtgaacctccagatcccgggcgcgaaggagcaccacagcgcggtgttctacttcgcgaccgaggaaccggatccggtccgaaccggttcactcttaaaccggttcgtgcacggcgacgacgcgtttcggaaccagcggttcaagctggtgaaccggatcgcgaaggggccgtggatcgtgaagaaggccgtggggagccacagcgcgtgcttgttagggaaagcgttgaattgcgcttactacaaaggttcgaattacctcgaaattgacgtcgatatcggaagcagcgcgatcgcgaacgcgattctgcacctcgcgttggggtgcgtgacgacggtgacgatcgatatggggtttgtggtggaggcacaggcggaggatgagttgccggagcggttgatcggtgcgattagggtttgccagatggagatggcgtcggccacggtggttgaggcgttgcacgtgccgcgcggggttgggtgggccaaggtgaatcatcataagtctgcggatgagcttgctttggatgattagatatttgtttagtgatagtagtacgaagtttatgatttttttttatattttaattattcttcaatggattttaatttcttgttcaaaaaaaaaaaaaaaa

SEQ ID NO: 4710 - protein, 1022 aa, Glycine max
  misc_feature: GI Number: 21592409; NR Description: unknown [Arabidopsis thaliana]
  misc_feature: GI Number: 21618178; NR Description: unknown [Arabidopsis thaliana]
  misc_feature: GI Number: 18086359; NR Description: AT5g45560/MFC19_23 [Arabidopsis thaliana] >gi|22327599|ref|NP_199369.2| pleckstrin homology (PH) domain-containing protein / lipid-binding START
  misc_feature: GI Number: 42566947; NR Description: pleckstrin homology (PH) domain-containing protein / lipid-binding START domain-containing
  misc_feature: GI Number: 30694123; NR Description: pleckstrin homology (PH) domain-containing protein / lipid-binding START domain-containing
ACAGTATATGCAAACAAAGCCTCCACCAATGTCGCTGCTGCCGCCGCCGAAACCTCACCGGAGCTCCGGTAACTCCCCTGGCGACAGCATTCCAGACTGGATCTCCGAATCAATCAACGGCGGCTCCCTCCGCCGCGTCGACCTCAACTCCGGCACCAACGGCTGGGCGTCGCCGCCAGGCTCCGTGTTCTCCCTCCGCTCCGAAAGTTACTTTCAGAACCGCCAAAAATGTCCCGCCGGCGACTACCTCCTCTCGCCGGCGGGCATGGACTGGCTCAAATCCGCCGCGAAACTCGACCACGTGCTCTCACGCGCGGACAACCGCGTGATGCACGCGCTGCGAAGATGTCAAACCCTAGGTCGCTCCCTAAAGAGCTTCGTCTTCGCGGTGAACCTCCAGATCCCGGGCGCGAAGGAGCACCACAGCGCGGTGTTCTACTTCGCGACCGAGGAACCGGATCCGGTCCGAACCGGTTCACTCTTAAACCGGTTCGTGCACGGCGACGACGCGTTTCGGAACCAGCGGTTCAAGCTGGTGAACCGGATCGCGAAGGGGCCGTGGATCGTGAAGAAGGCCGTGGGGAGCCACAGCGCGTGCTTGTTAGGGAAAGCGTTGAATTGCGCTTACTACAAAGGTTCGAATTACCTCGAAATTGACGTCGATATCGGAAGCAGCGCGATCGCGAACGCGATTCTGCACCTCGCGTTGGGGTGCGTGACGACGGTGACGATCGATATGGGGTTTGTGGTGGAGGCACAGGCGGAGGATGAGTTGCCGGAGCGGTTGATCGGTGCGATTAGGGTTTGCCAGATGGAGATGGCGTCGGCCACGGTGGTTGAGGCGTTGCACGTGCCGCGCGGGGTTGGGTGGGCCAAGGTGAATCATCATAAGTCTGCGGATGAGCTTGCTTTGGATGATTAGATATTTGTTTAGTGATAGTAGTACGAAGTTTATGATTTTTTTTTATATTTTAATTATTCTTCAATGGATTTTAATTTCTTGTTCAAAAAAAAAAAAAAAA

SEQ ID NO: 4711 - DNA, 1372 bp, Glycine max
  misc_feature (1)..(1372): Ceres cDNA ID no. 21995898
  misc_feature (1)..(1372): Ceres CLONE  ID no. 597191
  misc_feature (1)..(1372): Also known as  Ceres CDNA ID no. 25891526
gaatgaatgaatgaatcattcgttattaaggcttttgttcagttccaaattcctcgtacgaaagcaattgtgttgttggacttggaggcatggagaaggagcagcttgaatatgtgttggtgccattgggtctgttggtgtacctgacataccatatatggcttgtctataccattgtacgcaaccctcttcgaactgtcattggccttaatgctgagtctcgtcatcagtgggttcttttcatgatgagtgatccgttgaagaatggggttttggcagttcaaactattcgcaacaatatcatggcatgtactcttctatctacaacggccatcacactcagttcacttattggtatttttgctagcggcacatggagttctgatgacacggctttcataccttatggccgtacttcaatcaaacatatttctgtcaccatttgcttccttgttgcatttttatgcaatgtgcagtctataagatactattgccatgtcagtttcttaatcactgcaccaacactcagagacaaaagggagtatatggaatatattgctgtgactttgaatcgtgggagtcatgcctggtccattggacttcgagcattttacttgtcatttccattcttcctctggatttatgggcccatacccatgtttgcatgttgctgcttgacgtcacttgttttgttcttcttggatacaacagctaaaatcacgcggaatcttcatagtaactcattcaggaaagagaggggaactcatgatgtagagtctgctgtggaacctgattatcatcctttgcctgcaattcggtattgaagctcatccaaggaaagctccaatcatcaagcaggtccattggcagctccctcctcccccttggctcaaatgcaatacagatggggcagctagggggagccctggcctcttcattgacgacaatgcttttttcttttgggaggttttgctgccaatttaggcattcaatcagctcctgcttgctgtcatcatcgccatagagatggctatggagaaaaattggagtgtcctttggttagaaacaaactcttctcttcttgtcaatgcgttcaagaatccttctagcgggccttggtctttgttcaactgctggaagaattgtatatctttaaccaatagttttagttttagaattttgcatatttatcgtgaggcaaatgcttgtgcagattctctggcctcttttggtgcacataatctaggatttatttggtgggactccccaccctcattcatatccatggagctccttaggtacagacaggacctcccttcttataaatttgcttagctttttcttaaaaaaaaaaagaaaaaaaaaaaaaaaa

SEQ ID NO: 4712 - protein, 244 aa, Glycine max
MEKEQLEYVLVPLGLLVYLTYHIWLVYTIVRNPLRTVIGLNAESRHQWVLFMMSDPLKNGVLAVQTIRNNIMACTLLSTTAITLSSLIGIFASGTWSSDDTAFIPYGRTSIKHISVTICFLVAFLCNVQSIRYYCHVSFLITAPTLRDKREYMEYIAVTLNRGSHAWSIGLRAFYLSFPFFLWIYGPIPMFACCCLTSLVLFFLDTTAKITRNLHSNSFRKERGTHDVESAVEPDYHPLPAIRY

SEQ ID NO: 4713 - DNA, 1490 bp, Glycine max
  misc_feature (1)..(1490): Ceres cDNA ID no. 21995899
  misc_feature (1)..(1490): Ceres CLONE  ID no. 607478
  misc_feature (1)..(1490): Also known as  Ceres CDNA ID no. 23559126
aatttggaaatgtaaaaaaaaattgggtgtttccgatagtagtagttgtagcggtcaagccgagccgatccgatgacgcgagccactcacacactgggggttcccccaacaacacgcgcccctccccggcgaccgtaccgtattatccctcaccattcccactctttcgccttgccgtttcgctttctctctcttcttcttcttctttctctttctctttctctttctcttttccctttctctttatctctcttccaaccctaattccctttttccgatgccggacttccacgactccctcctcaccaccacgccgccgccatcgcgccccgtccccgtccgcgaggactgctggtccgaggaggcctcctccacgctcgtcgacgcctggggccgccgctacctcgagctcaaccgcggcaacctccgccaaaaggactggcaggacgtcgccgacgccgtcaacgcgctccacggccacaccaaaaagacgcaccgcaccgacgtccagtgcaaaaaccgcatcgacaccattaagaagaagtacaagatcgagaaggctagggtttcggcctccaacggtactctctcttcctcttggcctttctacgagcgcttggacgctctaatcggccctaattttagcgcgaagaaatcaacctcttcgccgtctccgtcgccgccggtggctcttcctttgctgccgcatcggaagaaccagaaccaaaaccagaacccttcctcttctcctgcgattgcggtgccgccgacggccgtcgctctgccgcagaagcgctcctcggcagcggcgatggacgagggttacttcagaaggaattactccgccgtggctgccgcggcggcggcagcggaggctgatgaggacgatgaggaggaagacgaggaggaggcggaggatttggaggaggaggaggaggaagaatgtgaagaggaagggagagggagcgaagtggaggaaggggataaggagagggaagggatgaggaggttggcgaaggcgatagagaggtttggggaagtttatgagagagtggaggcgcagaagctgaggcagatggtggatttggagaaacagaggatgcagtttgctaaagatcttgaagtgcagaggatggagatgtttatggacacacaggttcagctcgagagaattaagcgcggtaaaagatctggctctaatggtgagatacaaaaaaaaattcggccttttatttgcttcccttttggcttgatttgatcacacgttgtactttttagtgttttgttttcaacgaatgaatgatgttttggacttgaggataagtgggtcgctagaggattattctccagtgagttcctttttggtggtaaaagaaaaatagattggtttggactctagagggtgcactgaatgctctgaattggttgtttcttgtagtcctacaattaaatatactagcatgtgatgcactttaaaaaaaaaaaaaaaa

SEQ ID NO: 4714 - protein, 326 aa, Glycine max
  misc_feature: GI Number: 18149189; NR Description: 6b-interacting protein 1
  misc_feature: GI Number: 21537288; NR Description: unknown [Arabidopsis thaliana]
  misc_feature: GI Number: 34911060; NR Description: putative 6b-interacting protein 1 [Oryza sativa (japonica cultivar-group)] >gi|21644624|dbj|BAC01183.1| putative 6b-interacting protein 1
  misc_feature: GI Number: 50909591; NR Description: putative 6b-interacting protein 1 [Oryza sativa (japonica cultivar-group)] >gi|46390357|dbj|BAD15822.1| putative 6b-interacting protein 1
  misc_feature: GI Number: 38347591; NR Description: OSJNBa0042I15.4 [Oryza
MPDFHDSLLTTTPPPSRPVPVREDCWSEEASSTLVDAWGRRYLELNRGNLRQKDWQDVADAVNALHGHTKKTHRTDVQCKNRIDTIKKKYKIEKARVSASNGTLSSSWPFYERLDALIGPNFSAKKSTSSPSPSPPVALPLLPHRKNQNQNQNPSSSPAIAVPPTAVALPQKRSSAAAMDEGYFRRNYSAVAAAAAAAEADEDDEEEDEEEAEDLEEEEEEECEEEGRGSEVEEGDKEREGMRRLAKAIERFGEVYERVEAQKLRQMVDLEKQRMQFAKDLEVQRMEMFMDTQVQLERIKRGKRSGSNGEIQKKIRPFICFPFGLI

SEQ ID NO: 4715 - DNA, 1570 bp, Triticum aestivum
  misc_feature (1)..(1570): Ceres cDNA ID no. 21995901
  misc_feature (1)..(1570): Ceres CLONE  ID no. 615718
  misc_feature (1)..(1570): Also known as  Ceres CDNA ID no. 24412846
gctccaatcccgtccctcgagtccccacccgtcagatcgggaacgccaatacgcgcagcgcacctatcccccactaccaccggcaaccgacgaaacccgcacccactccaccccatcctcctcctctccggcagcccgaccgacgccgcagccggcgcatcgccgcgatgggccgcaagctcgcgctcctggtgggcatcaactaccccggcaccaaggccgagctcaagggatgccacaacgacgttgaccgcatgcacaagtgcctcgtcgaccggttcggcttcgacgaggagaacatcaccgtcctcctcgaccgcggctcctccgggccgcagcccaccggcgccaacatccgccacgcgttggccaagctcgtcggggacgcgcgccgtggggacttcctcttcttccactacagcggccacggcacgcggctgccggccgagaccgggcaggacgacgacaccgggtacgacgagtgcatcgtgcccagcgacatgaatctcataacagatcaagatttcagagatctggtgcagaaggtcccggatggttgcatatttaccatcgtctccgactcatgccacagtggtggcctactggacaaggcaaaggaacagataggcaatagcaccaggcagaatcagacccagtctcgtgaacccgaagaagagcgatctcattctggcagcgggttccggtccttcctcaaagagaccgttcgtgacgcgtttgagtctcatagccgccacggaggtgaggaccaggatgagcaaccaactggggatggtctcactaaaaatcgctcgctgccactctcaacacttattgagatgctcaaggagcaaactgggaaggatgacattgaggagggctcaatccggctgactctgtttaacgtcttcggggacgatgccagcccaaagatcaagaagttcatgaaagtcatgcttgataagttccatgaaggtggatcaggtgagcagggcggtgtcatgggcatggttggttcgctagctcaccagttcctgaaggctaagcttgaaggcaacgaggaagagactttcaagccagcgatagaacaagatatgggcagtgctgaagaggcgtatgccgggactaagtcatgggcgcctaacaacggcatcctcatcagtgggtgccaaaccagccagacatcagcagatgcaaccataccggggggtacgtcctttggcgcgatgagcaatgcaatccaggccattcttgcgagcgatgatgggaagataacaaacaaggatctcgttatgaaagcacgcgcggcactgtccaagcaaggatacactcagcagcctggcctctactgcagtgatgagcatgttcatgtggctttcatctgctgaaacatggattgatgttgtgctttgttttctttctgtgatgagctgtgcacgagaggtttcagttttccctttgctcccccctggtttgctgtggttatgtatttattatgtcaaaaactgtgagttgaaatacgtcagtactgaaataaggaattgccatgtaaactttaaaaaaaaaaaaaaaa

SEQ ID NO: 4716 - protein, 405 aa, Triticum aestivum
  misc_feature: PFam Name: Peptidase_C14; PFam Description: Caspase domain
  misc_feature: GI Number: 34908928; NR Description: putative latex-abundant protein [Oryza sativa (japonica cultivar-group)] >gi|20804732|dbj|BAB92418.1| putative latex-abundant protein [Oryza
  misc_feature: GI Number: 50931901; NR Description: putative latex-abundant protein [Oryza sativa (japonica cultivar-group)] >gi|29367583|gb|AAO72653.1| latex-abundant protein-like protein [Oryza sativa (japonica cultivar-group)] sativa (japonica
  misc_feature: GI Number: 4235430; NR Description: latex-abundant protein
  misc_feature: GI Number: 23343885; NR Description: metacaspase 1
  misc_feature: GI Number: 40644374; NR Description: metacaspase type II
MGRKLALLVGINYPGTKAELKGCHNDVDRMHKCLVDRFGFDEENITVLLDRGSSGPQPTGANIRHALAKLVGDARRGDFLFFHYSGHGTRLPAETGQDDDTGYDECIVPSDMNLITDQDFRDLVQKVPDGCIFTIVSDSCHSGGLLDKAKEQIGNSTRQNQTQSREPEEERSHSGSGFRSFLKETVRDAFESHSRHGGEDQDEQPTGDGLTKNRSLPLSTLIEMLKEQTGKDDIEEGSIRLTLFNVFGDDASPKIKKFMKVMLDKFHEGGSGEQGGVMGMVGSLAHQFLKAKLEGNEEETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 4717 - DNA, 953 bp, Triticum aestivum
  misc_feature (1)..(953): Ceres cDNA ID no. 21995903
  misc_feature (1)..(953): Ceres CLONE  ID no. 618526
  misc_feature (1)..(953): Also known as  Ceres CDNA ID no. 24408669
acaatcgtcccagatctcaagctctcaactcacctcacctcgcatctcaaacagtcttctcttttcggttggcataattgctagaagcagggttctatccatggcaatggtggtgaaggccctcctcgttgccgtcgtggccgtggcagcgcttgcgcagctcaccgtggcagtggatcaccaggtgggcggcagcggcgcgacctgggccaccagcggcggctacgactcgtggtcggggaagcagaagttctctccgggagacagcctcgtattttcgtactcgccggcgcacgacgtcgtggaggtgagcaaggccgactacgacgcctgcacggccagcaaagtcgtcgccagatacaccggcggcaagaccaccgtcaagctcaccactgccggaaagcgctacttcatctgcagcatcaccggccactgcgacgccggcatgaagctccaggtgaacgtcgccgccgcgaccgccgcccccaccaagcccaggggccagaggagcgtcgcccctgtcgccgccccggcgccggcaccggaggggtcggccaccgacgagcagctgccgacagtgtcgtcgcctacgggaacaccgacgcccagttcaccgtccggctcgggcgccgctagcatcggtgcgagcgctgcggtggcgctcgccatgggcatggccgtggcgttggccatttgagagggatctggccgatccatgtgtaccaaggcttagttttggagtgctcaagtcttaatcacgtcgatacatttgcggatttgttcttgttattcttggctggcagtggcatgcacattgccttccctgcatgttccttccttcctactagtacagtgctatcagggttcagtgtactactgtgcgatttatttgttgtatttgtctgtcggagaataaatacaattcacattctttagtaaaaaaaaaaaaaaaa

SEQ ID NO: 4718 - protein, 198 aa, Triticum aestivum
  misc_feature: PFam Name: Cu_bind_like; PFam Description: Plastocyanin-like
  misc_feature: PFam Name: Pyr_redox_2; PFam Description: Pyridine
  misc_feature: GI Number: 50933685; NR Description: uclacyanin 3-like protein-like protein [Oryza sativa (japonica cultivar-group)] >gi|22324455|dbj|BAC10370.1| uclacyanin 3-like protein-like protein [Oryza sativa (japonica cultivar-group)] [Oryza sativa
  misc_feature: GI Number: 50911371; NR Description: putative uclacyanin 3 [Oryza sativa (japonica cultivar-group)] >gi|49387518|dbj|BAD24983.1| putative uclacyanin 3 [Oryza sativa
  misc_feature: GI Number: 50940937; NR Description: putative blue copper binding protein [Oryza sativa (japonica cultivar-group)] >gi|38636763|dbj|BAD03006.1| putative blue copper binding protein [Oryza sativa (japonica cultivar-group)] [Oryza sativa (japonica
  misc_feature: GI Number: 50940939; NR Description: putative blue copper binding protein [Oryza sativa (japonica cultivar-group)] >gi|38636764|dbj|BAD03007.1| putative blue copper binding protein [Oryza sativa (japonica cultivar-group)] [Oryza sativa (japonica
  misc_feature: GI Number: 3831466; NR Description: putative uclacyanin I [Arabidopsis thaliana] >gi|3399767|gb|AAC32038.1| uclacyanin I [Arabidopsis thaliana] >gi|25408225|pir||D84731 probable uclacyanin I [imported] - Arabidopsis thaliana
MAMVVKALLVAVVAVAALAQLTVAVDHQVGGSGATWATSGGYDSWSGKQKFSPGDSLVFSYSPAHDVVEVSKADYDACTASKVVARYTGGKTTVKLTTAGKRYFICSITGHCDAGMKLQVNVAAATAAPTKPRGQRSVAPVAAPAPAPEGSATDEQLPTVSSPTGTPTPSSPSGSGAASIGASAAVALAMGMAVALAI

SEQ ID NO: 4719 - DNA, 910 bp, Triticum aestivum
  misc_feature (1)..(910): Ceres cDNA ID no. 21995906
  misc_feature (1)..(910): Ceres CLONE  ID no. 631920
  misc_feature (1)..(910): Also known as  Ceres CDNA ID no. 23462101
accacaagcagcctggtagcatatctgtctcgtgggagatcgtgtcaaccaaacaccaccgtgcgtgtcagccatgtcgctcatgccttggttcggcggcggccggggagggatggaccccttctcctccgacctctgggaccccttcggcgcttcgtggcccttggacgccgggcgccgaggcggcgaaggcggcagccgtgacgacgccaccgccatggctcgcaccaacgtcgactggcacgagaacgacaaggagcacatcttctcggccgagatccccggggtgaggaaggaggacgtgaaggtggaggtggaggacggcaacgtgctcaagatcagcggggagaagacgcgggaggaggagcacaagggcgacgcctggaaccgggtggagcgcagcttcgggtccttcatgcgacggttccgcctgccggagaacgccaaggcggacggcatccggtgcaccatgcaggacggcgtgctcagggtcgtcgtgcccaaggacgagcaagcccagaagcagcgcaacgtccgctccatcgacatcgcctaacggctaaaagcaccgcaccgacgcatgcagtcaacggcttcctagcgtgacatgccctctccttcaacaccactgaactatgtatggcgatgacgtgtctcttactttatttgcgtgtactggtagtagccaatctgtatcgtgtgttctattttagcagtatgtactgtaaggctaggctattctgtacggtagtttagaagtgtgttgtatgcgccatatagctgctacagcatactgtacttcccatctccagtatccatcgtaaactgcagtacgaaggaccagaaatatatttttaagactggcagggacaacagagaagcatacacaacctcaaaaaaaaaaaaaaaa

SEQ ID NO: 4720 - protein, 160 aa, Triticum aestivum
  misc_feature: PFam Name: HSP20; PFam Description: Hsp20/alpha crystallin family
  misc_feature: GI Number: 21689719; NR Description: putative heat shock protein 18 [Arabidopsis thaliana] >gi|17979311|gb|AAL49881.1| putative heat shock protein 18 [Arabidopsis thaliana] >gi|9758837|dbj|BAB09509.1| 18.2 kD class I heat shock protein
  misc_feature: GI Number: 21618106; NR Description: heat shock protein 18
  misc_feature: GI Number: 2465461; NR Description: low molecular weight heat-shock protein [Brassica rapa] >gi|7441319|pir||T14381
  misc_feature: GI Number: 23505765; NR Description: At3g46230/F12M12_200 [Arabidopsis thaliana] >gi|15294150|gb|AAK95252.1|
  misc_feature: GI Number: 46359518; NR Description: cytosolic class I small heat-shock protein HSP17.5 [Castanea sativa] >gi|3819743|emb|CAA08908.1| cytosolic class I small heat-shock
MSLMPWFGGGRGGMDPFSSDLWDPFGASWPLDAGRRGGEGGSRDDATAMARTNVDWHENDKEHIFSAEIPGVRKEDVKVEVEDGNVLKISGEKTREEEHKGDAWNRVERSFGSFMRRFRLPENAKADGIRCTMQDGVLRVVVPKDEQAQKQRNVRSIDIA

SEQ ID NO: 4721 - DNA, 1077 bp, Triticum aestivum
  misc_feature (1)..(1077): Ceres cDNA ID no. 21995907
  misc_feature (1)..(1077): Ceres CLONE  ID no. 633787
  misc_feature (1)..(1077): Also known as  Ceres CDNA ID no. 24410698
atcgatccaccacacagttcgccactcctccctgcatctctactcttccagacctcgccggcggaagccagcaagcatgacggcgaaagtggccggctgccggaagcgcggggcggaggccttcatggaggaccccttcgcggcgctcccgccgttgaacacgaagagggggcgatgctcgccgtccgccgccgccgacgtggccgaactcggggtcagcatggacttcgaccccgtcgacgcgctccagctcatcttccccggcgccgatccgcagcttcttcggggctattttgaagcatcaggaaatgtcttggatgctgcaatcagaggcttcaaggattatttggcatcgggttcatcaccgaccaatgctgatgcggcctcatctggagtggcatctgatgtggcgaagatgaatactccaacagacggtactgactgggcagagctaatagtcaaggagatgtcggctgcttcagatttgatcgacgccaagaatcgagccttcaggatacttgaattgtttgacaaatctgccgcagactgcaatactcctgatgaaaagcagaaaatgtgtgaggagcacaagatactgaagcagatgctgggaggcctgcttcaccagaacggcgtcctgaagagggcctttcttatccagcacaaccggctcaaggactaccaggacatggtgcaggagcggtcccagttcaaggagatcgtcggcaagtaccagcagcagatcaaggcgctgtaggataggaactatgtgctgtcgttgcatctcgcgcagtcggatcatcggagtggcatatctgggcaccgcaaccccgacgtcttctaggcctctattgcaccctgctggattcgaatgtgagaacctgaagctgtgattgttgaagaaatcatgaatacaagaaaacatctttgggtagttatgttgacacaatatatatgtgtggtgcgatctgtccgaattcgtatcggtagcattgaggagcgtgcgtgaactcgtatctggttgactcttgatgagacaaagagatgcaacaagtgatgacaaaaaaaaaaaaaaaa

SEQ ID NO: 4722 - protein, 226 aa, Triticum aestivum
MTAKVAGCRKRGAEAFMEDPFAALPPLNTKRGRCSPSAAADVAELGVSMDFDPVDALQLIFPGADPQLLRGYFEASGNVLDAAIRGFKDYLASGSSPTNADAASSGVASDVAKMNTPTDGTDWAELIVKEMSAASDLIDAKNRAFRILELFDKSAADCNTPDEKQKMCEEHKILKQMLGGLLHQNGVLKRAFLIQHNRLKDYQDMVQERSQFKEIVGKYQQQIKAL

SEQ ID NO: 4723 - DNA, 1155 bp, Triticum aestivum
  misc_feature (1)..(1155): Ceres cDNA ID no. 21995908
  misc_feature (1)..(1155): Ceres CLONE  ID no. 634402
  misc_feature (1)..(1155): Also known as  Ceres CDNA ID no. 24412564
aaccatcaccaccgagctacctccagcctccagccatcactcagctcaaagacacaatcaggcaatcagcggcggcgagaacacacacagagtcacagatgaccttcagcgtctcgccggcgacgggggcgagccaggagtacatgatccggttcgacggccacttcgaggacccgagctccgcggccgcgagcgccgagccacccctgccgttcgccggcagggctttctcgccacagcaggagcagagcgccatggtcgccgcgctgctgcacgtcgtctccgggtacaccacgccggcgcctgacctcttcttcccggcgcgcaaggaggcgtgcacggcgtgcgggatggacgggtgcctcgggtgcgagttcttcggcgcggaggccgggcgcgcggtcgcggcatcggacgcgccgagagcgccggcggccggcgggccgcagaggaggcggaggaacaagaagaaccagtaccgcggcgtcaggcagcggccgtggggcaagtgggcggcggagatccgcgacccgcgccgcgccgtgcgggtgtggctcgggaccttcgacacggccgaggacgccgccagggcctacgaccgcgccgccgtcgagttccgcggcccgcgcgccaagctcaacttctccttccccgagcagcagcagcagcagctaggcggcagcggcaatgccgcggccaagtcagacgcgtgctcgccctcgccttcgccccgcagcgcggacgaggacgaaacaggggacctgctctgggacggcttggtggacttgatgaagctggacgagagcgacctctgcttactgctcccggtcgacaacacggataaatttcacatagaggggaagagacgatcaggatcaggggtacccctctgctactagtgttagactattagcgagtaccagatagacaatcagcagtcctaatcctgctcactacgtggttagcacacgtcctagcttcggttgtaattctgcataaataggcacccgatcaatggaaaagttgtgttcaaccatactcatctgccatgttgtatgtagacaaatccaatttggggcttatttgttggaactataatggtttctattaatagaaaccaggggaaaccccttttgcacaaaaaaaaaaaaaaaa

SEQ ID NO: 4724 - protein, 266 aa, Triticum aestivum
  misc_feature: PFam Name: AP2; PFam Description: AP2 domain
  misc_feature: GI Number: 51536200; NR Description: ethylene-binding
  misc_feature: GI Number: 50346542; NR Description: ethylene-responsive
  misc_feature: GI Number: 34894554; NR Description: B1011A07.25 [Oryza sativa (japonica cultivar-group)] >gi|20805105|dbj|BAB92777.1| putative ethylene response factor 2 [Oryza sativa (japonica
  misc_feature: GI Number: 66777243; NR Description: Ribonuclease PH [Anaeromyxobacter dehalogenans 2CP-C] >gi|66856937|ref|ZP_00400996.1| Ribonuclease PH [Anaeromyxobacter
  misc_feature: GI Number: 66778264; NR Description: LigA [Anaeromyxobacter dehalogenans 2CP-C] >gi|66856061|ref|ZP_00400131.1| LigA
MTFSVSPATGASQEYMIRFDGHFEDPSSAAASAEPPLPFAGRAFSPQQEQSAMVAALLHVVSGYTTPAPDLFFPARKEACTACGMDGCLGCEFFGAEAGRAVAASDAPRAPAAGGPQRRRRNKKNQYRGVRQRPWGKWAAEIRDPRRAVRVWLGTFDTAEDAARAYDRAAVEFRGPRAKLNFSFPEQQQQQLGGSGNAAAKSDACSPSPSPRSADEDETGDLLWDGLVDLMKLDESDLCLLLPVDNTDKFHIEGKRRSGSGVPLCY

SEQ ID NO: 4725 - DNA, 868 bp, Triticum aestivum
  misc_feature (1)..(868): Ceres cDNA ID no. 21995910
  misc_feature (1)..(868): Ceres CLONE  ID no. 639047
  misc_feature (1)..(868): Also known as  Ceres CDNA ID no. 24405388
gacacaaagagagagggagggggatctgattttttgaaggggatggcgcatggcagaggcggttcccggcggctgcatgcgcgtctactcgcggtggtcgggctcctcgcctgcgccgccttcgcgccgcgctcctcggcgctcaacgtcggcctccagaccctcgacgccgacgccgacggcgtgagcaagcagcaggcgtgcagccgaacgtgcgagtccgaccactgcacgacggcgcccttcctccggtacggcaagtactgcggcatcctctacagcgggtgccccggcgagcggccgtgcgaccccctcgacgcctgctgcatgcaccacgacaactgcgtcctcgtcaagaatgactacctgagcacggagtgcaacgagggcctgctggagtgcctggcggagctgcgggctggcacgggcacgttcgaggggaacaagtgcatgatcgacgaggtcatcgacgtgatcaccgtcgtcatcgaggccgccgtcgtcgccggccgggtcctgcacaagccctagctacatagtaccacggcggcgcgcgccggagccggcgagctggaggacaagcagcaaacaacttgctcggtaggtgggtggtgcatgccttttctgcttggtgtcactcgtcagtcacggtgtgtgtccgtgtcctgtcacgcatgcaccggcgcctcacgtacagtctcgcgggcacgggcgtgacatggttggtgcttcagctaagatcgacgatggcgccggattttgcgacatgtatatgggcatggttaccataacctgctttgcaggatttaatttacttgattgatgagttggttcgtctttgccagtttgccgaaaaaaaaaaaaaaaa

SEQ ID NO: 4726 - protein, 162 aa, Triticum aestivum
  misc_feature: PFam Name: Phospholip_A2_1; PFam Description: Phospholipase A2
  misc_feature: PFam Name: Cupin_1; PFam Description: Cupin
  misc_feature: GI Number: 50918171; NR Description: putative phospholipase [Oryza sativa] >gi|13937291|gb|AAK50122.1| putative phospholipase
  misc_feature: GI Number: 28952037; NR Description: putative phospholipase
  misc_feature: GI Number: 60592662; NR Description: phospholipase A2
  misc_feature: GI Number: 4585708; NR Description: putative phospholipase A2
  misc_feature: GI Number: 32454820; NR Description: phospholipase A2
MAHGRGGSRRLHARLLAVVGLLACAAFAPRSSALNVGLQTLDADADGVSKQQACSRTCESDHCTTAPFLRYGKYCGILYSGCPGERPCDPLDACCMHHDNCVLVKNDYLSTECNEGLLECLAELRAGTGTFEGNKCMIDEVIDVITVVIEAAVVAGRVLHKP

SEQ ID NO: 4727 - DNA, 1080 bp, Triticum aestivum
  misc_feature (1)..(1080): Ceres cDNA ID no. 21995911
  misc_feature (1)..(1080): Ceres CLONE  ID no. 639857
  misc_feature (1)..(1080): Also known as  Ceres CDNA ID no. 24412478
catcaatcacaacggagccgccaccaccaccaccgcagcctccactctccaccgcatccggcagcggcgcgcggcggagaagccggtccggggaagcaggcgagcgacaggaagcagcagcaccggcagcaagaagaagaaggagaagaagaatcggacgccataatgcagcagcatcaaggggttcctaaatttgggaactgggaggacgagggccaaggctacacgcagtacttcgaaaacgcccgcaaatctccaggaaggcccgtcaaccagaacgatcgcaaccaaggcgctgcacaggcacccccgaacgacccgccgtcggtcaaggcctcccccttgaggccggggtccgagccggggctgcgcaagaacagggacgaaaggcgtgccacccgagaagacgacctccgtcggcacgagcccgctgcccggaaaacacatgccgagtcgcccaaccatagatatggtgaccagagcaactacgaaggcgctgcgaggaaagcgagcaatgagaggtcacccatccatcctcggcagcaggcaaggcttgcaaacaaaggtggggtttcatctcctgttgcggatcgcaggggttctgctcccaccacgcctggaaggtccaagatgaggccaaccggccgcggcgatgaaacgcccgagagaggatcagctgtgccgaagtttggagactgggatgagaaagacccttcgactggtgaaggtttcactgacatatttgagaaggtgagggaggagaagcagtccggcgcggatactgtcggcaccagccatgcatataaggaccgctacaaccaaggggacagatatgaatcttcgggctgctcatgcttcagctggttcaagaagtgacacccaccctgcctgtaacatacctgtggcgattgtatctttgtgaaatgagtagccaaatctgttgttattttgttgagatgttatgttatagcgagacatgtatcggagcatgaattattcgcaaggctgtgattcagcattttttttgagcatttgtaatcagtggctggtttcctgaattttgcaaaaaaaaaaaaaaaa

SEQ ID NO: 4728 - protein, 236 aa, Triticum aestivum
  misc_feature: PFam Name: NOI; PFam Description: Nitrate-induced NOI protein
  misc_feature: GI Number: 34897468; NR Description: putative nitrate-induced protein [Oryza sativa (japonica cultivar-group)] >gi|28269407|gb|AAO37950.1| putative nitrate-induced protein [Oryza
  misc_feature: GI Number: 50899034; NR Description: NOI protein [Oryza sativa (japonica cultivar-group)] >gi|7489517|pir||T02212 NOI protein - rice >gi|2642217|gb|AAB86939.1| NOI protein [Oryza sativa] >gi|47848486|dbj|BAD22341.1| NOI protein [Oryza sativa
MQQHQGVPKFGNWEDEGQGYTQYFENARKSPGRPVNQNDRNQGAAQAPPNDPPSVKASPLRPGSEPGLRKNRDERRATREDDLRRHEPAARKTHAESPNHRYGDQSNYEGAARKASNERSPIHPRQQARLANKGGVSSPVADRRGSAPTTPGRSKMRPTGRGDETPERGSAVPKFGDWDEKDPSTGEGFTDIFEKVREEKQSGADTVGTSHAYKDRYNQGDRYESSGCSCFSWFKK

SEQ ID NO: 4729 - DNA, 644 bp, Glycine max
  misc_feature (1)..(644): Ceres cDNA ID no. 21995913
  misc_feature (1)..(644): Ceres CLONE  ID no. 653695
  misc_feature (1)..(644): Also known as  Ceres CDNA ID no. 24765978
gaacagagtgaaaagaagggtttgtaagagaaagaaaaaagaggcgcaagatgagtggtagggtttctgggaaggtgaagtggttcaacgatcagaaggggtttggattcataacccctgacgatggcagcgaggaactcttcgttcaccaatctcagatcaaatctgacggtttccgaagcctagctgaaggagagtccgttgagttcgctattgaatctgaatctgacggacgcgccaaggctgttgatgtcactggccccgacggcgccagcgtccagggaaccagacgcggcggtggagacaggtacggcggaggcggtggtggtggtggcaggtatggaggcggcgctggcgggaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaaaaaaaaaaaaaaaa

SEQ ID NO: 4730 - protein, 644 aa, Glycine max
  misc_feature: PFam Name: CSD; PFam Description: 'Cold-shock' DNA-binding domain
  misc_feature: PFam Name: GRP; PFam Description: Glycine rich protein family
  misc_feature: PFam Name: Acyl-CoA_dh_M; PFam Description: Acyl-CoA
  misc_feature: PFam Name: Keratin; PFam Description: Keratin
  misc_feature: PFam Name: Chorion_1; PFam Description: Chorion protein
  misc_feature: GI Number: 21322752; NR Description: cold shock protein-1
  misc_feature: GI Number: 4803937; NR Description: glycine-rich protein (AtGRP2) [Arabidopsis thaliana] >gi|16323178|gb|AAL15323.1| At2g21060/F26H11.18 [Arabidopsis thaliana] >gi|15226451|ref|NP_179702.1| cold-shock DNA-binding Arabidopsis
  misc_feature: GI Number: 14532850; NR Description: putative glycine-rich protein 2 [Arabidopsis thaliana] >gi|13430580|gb|AAK25912.1| putative glycine-rich protein GRP2 [Arabidopsis thaliana] >gi|22137152|gb|AAM91421.1| AT4g38680/F20M13_240 [Arabidopsis
  misc_feature: GI Number: 19743; NR Description: nsGRP-2 [Nicotiana sylvestris] >gi|121631|sp|P27484|GRP2_NICSY Glycine-rich protein 2
  misc_feature: GI Number: 42391858; NR Description: cold shock domain
GAACAGAGTGAAAAGAAGGGTTTGTAAGAGAAAGAAAAAAGAGGCGCAAGATGAGTGGTAGGGTTTCTGGGAAGGTGAAGTGGTTCAACGATCAGAAGGGGTTTGGATTCATAACCCCTGACGATGGCAGCGAGGAACTCTTCGTTCACCAATCTCAGATCAAATCTGACGGTTTCCGAAGCCTAGCTGAAGGAGAGTCCGTTGAGTTCGCTATTGAATCTGAATCTGACGGACGCGCCAAGGCTGTTGATGTCACTGGCCCCGACGGCGCCAGCGTCCAGGGAACCAGACGCGGCGGTGGAGACAGGTACGGCGGAGGCGGTGGTGGTGGTGGCAGGTATGGAGGCGGCGCTGGCGGGAGGTACGGTGGTGGTGGAGGAGGTGGTGGCGGCGGAGGAAGCTGCTACAGCTGTGGAGAGTCTGGGCATTTCGCCAGAGATTGCCCATCAAGTGCTCGTTGAAATTACTGTTATGGTGGTTTATGTTATGCGGATTGTTTTAAGTTTTTACTTTAACATGTTGTAGGGATTTTAATGGTTTCTGTCAAAGCTGTGGCTTCTTATAAGTAGATGCGTGAGATTTTTCTTTTTTTTGGTTATTTAAATGAAAGTTTCTGTGTTATCGTTACAAAAAAAAAAAAAAAA

SEQ ID NO: 4731 - DNA, 1276 bp, Glycine max
  misc_feature (1)..(1276): Ceres cDNA ID no. 21995915
  misc_feature (1)..(1276): Ceres CLONE  ID no. 657374
  misc_feature (1)..(1276): Also known as  Ceres CDNA ID no. 23680096
attttcactaaactaacttcctcaaatcaattacaatttttggacattttctctctcaaccctccaacaatattcccttctctctcatcattctcatgacataatcacatcacacaattgatttcctcaattacttctaatccacaatcaaatagcgcagcatggaagaatctgcgccccaacccaaaccaatcttacagaaaccccccggttaccgggaccccaactccaaaccgccaccacctcctcctcgaaagctcatgctgcccccccccttccagcccaaacggaagcgtcgcaacttctgccgcatatgctgctgtaccttctgcatcctcatcctcatcctcctccttgtgctcgttatcgccgccgctctcttctacctcatctacgacccctccctccctgagtttcacctcggctccttccgcgtccccaaacttaacgtcaccaatgccgccgacggggcctacctggctgccgacacggccgcacgtgtcgaggtcaagaaccgcagcggcaggatgtcgtggcatttctcccagagccgcttctcggtttcggcggagaacggggacctgaatctggggtccacgaaggtggccgggttcacggtgaaggagaagggcgtgaccgagctgaaggcggagacgagcgtaaaggagctggcattgaatgagaagcagaggagaaggcttaagagcgctgtggagagcaaagcgttggtccccaccgtggaggttcgaaccaaaaccggtgttggcttggagggttggaactcaccctccatctccgtcactgtcgtctgcggagatgccaccgtgagacaactcgataaaggagaccctcccctttgctccatcactctcctcaaatggatcaaaatacgatgagttggggatgtgttctgccagattgatgtccactgcgcgccatttagatcgaggtgaagattttgtgcgcttgtatctaaattatttttatattcttcttttttctctttacaaagtaaaggaagaatgaaaatgtaaattctttgcttagaaaaaagaaaagagtctcttctacagcagatcaacttgctgctggttctcccaaatgcgatgtgggatgcacataagaccaatacgtgaggttgtatttatcaaatatttattgttttttatgtggctggtgatcgtaggaatcgtaagtactcgagaaaatgttctctgtctttctctttttaataagaagaaaaccacaatgtgatgaggcaaaaaaaaaaaaaaaa

SEQ ID NO: 4732 - protein, 244 aa, Glycine max
  misc_feature: PFam Name: Hin1; PFam Description: Harpin-induced protein 1 (Hin1)
  misc_feature: PFam Name: FH2; PFam Description: Formin Homology 2 Domain
  misc_feature: GI Number: 34903552; NR Description: P0001B06.28 [Oryza sativa (japonica cultivar-group)] >gi|10934097|dbj|BAB16875.1| P0001B06.28 [Oryza sativa (japonica cultivar-group)] >gi|14646778|dbj|BAB61941.1| P0498B01.14 [Oryza sativa (japonica
MEESAPQPKPILQKPPGYRDPNSKPPPPPPRKLMLPPPFQPKRKRRNFCRICCCTFCILILILLLVLVIAAALFYLIYDPSLPEFHLGSFRVPKLNVTNAADGAYLAADTAARVEVKNRSGRMSWHFSQSRFSVSAENGDLNLGSTKVAGFTVKEKGVTELKAETSVKELALNEKQRRRLKSAVESKALVPTVEVRTKTGVGLEGWNSPSISVTVVCGDATVRQLDKGDPPLCSITLLKWIKIR

SEQ ID NO: 4733 - DNA, 1449 bp, Glycine max
  misc_feature (1)..(1449): Ceres cDNA ID no. 21995917
  misc_feature (1)..(1449): Ceres CLONE  ID no. 664588
  misc_feature (1)..(1449): Also known as  Ceres CDNA ID no. 24766350
aacaacagaagcagcaggttcaaacttcaattcatggaagtgtgattctaatctccacaacaaacctaaccctaaaaagctaacccttttttttttttttttaaatattgtttctttttttacttaccctagatgttagagccatggacataaccccaacaacaacgatcaacaacaacaacactactcccagtgcaacaacaaaatccccagaaaatgaaacagaaacaccgaccaggatcaccacccccatcactcccacaacgacaaaaacctcatctttctcgaatggtgtcctcaaacgcacccaccaccaccaccacctccaccaccctatccctccggtggttacctacaaagaatgcctcaaaaatcacgccgccaacttgggtggccacgccttagatggctgcggcgagttcatgccctctccgaccgccaccgctgccgaccccagctccataaaatgcgccgcctgcggctgccaccgcaacttccaccgccgcgagccggaggagccccccatcgcctccaccaccacgcacgtcatcgagtatcagccccaccaccgccaccaccctcccccgccgctgcacgcggcggcggtagccacccgcagccccaattctgcttccccaccgccgatctcctcgtcgtactacccctccgcgccgcacatgctcctcgccctctccgccggactggcggctccgccggagagcaccgccgcgcctgccgccgcgcccacgagaaagcggttccgcacgaagttcagccaagagcagaaggagaagatgcacaagttcgcggagaaagtagggtggaagattcagaagcgcgacgaggatttgattcacgaaatttgcaacgaagttggcgttgatagaagcgttctcaaggtttggatgcataacaacaaaaacacctttgccaaaaaggataacaataatattgttactagtaatgatattaatattactactaaaaataatatttctactgataatgatgcaaatgggagtgatgtcaaggtttttgaaaaccctaacaatgatggtggtgaagatcgcgctgaagatccgagtagtaatcactatgatggggtgaacgttgttggtgctaatggatcttctagttcttgatctaagggggaagaaaataataatgtattagataggttaatgatgattatgatgatgatgatgatgctacaaggttaattaatcagctgtttttaatttcttttcttttcttttttttgtttttaattgtttagtttttatattgttaatgagagcatgatgatcaatcagtttaatgggagagaatgttatatccggaagagagtttattttgcttttaatggttttatgctgaattaagttagcttttagttgttaccacttgttatgaatgtatattatgtttatctttaaaaaaaaaaaaaaa

SEQ ID NO: 4734 - protein, 332 aa, Glycine max
  misc_feature: PFam Name: ZF-HD_dimer; PFam Description: ZF-HD protein
  misc_feature: PFam Name: Homeobox; PFam Description: Homeobox domain
  misc_feature: PFam Name: FH2; PFam Description: Formin Homology 2 Domain
  misc_feature: PFam Name: Pyr_redox_2; PFam Description: Pyridine
  misc_feature: PFam Name: Mucin; PFam Description: Mucin-like glycoprotein
  misc_feature: GI Number: 21592512; NR Description: unknown [Arabidopsis thaliana]
  misc_feature: GI Number: 53689757; NR Description: ZF-HD homeobox
  misc_feature: GI Number: 13277218; NR Description: ZF-HD homeobox protein
  misc_feature: GI Number: 13277216; NR Description: ZF-HD homeobox protein
  misc_feature: GI Number: 13277220; NR Description: ZF-HD homeobox protein
MDITPTTTINNNNTTPSATTKSPENETETPTRITTPITPTTTKTSSFSNGVLKRTHHHHHLHHPIPPVVTYKECLKNHAANLGGHALDGCGEFMPSPTATAADPSSIKCAACGCHRNFHRREPEEPPIASTTTHVIEYQPHHRHHPPPPLHAAAVATRSPNSASPPPISSSYYPSAPHMLLALSAGLAAPPESTAAPAAAPTRKRFRTKFSQEQKEKMHKFAEKVGWKIQKRDEDLIHEICNEVGVDRSVLKVWMHNNKNTFAKKDNNNIVTSNDINITTKNNISTDNDANGSDVKVFENPNNDGGEDRAEDPSSNHYDGVNVVGANGSSSS

SEQ ID NO: 4735 - DNA, 1082 bp, Glycine max
  misc_feature (1)..(1082): Ceres cDNA ID no. 21995918
  misc_feature (1)..(1082): Ceres CLONE  ID no. 669851
  misc_feature (1)..(1082): Also known as  Ceres CDNA ID no. 24372923
gccaaaccaactccccaaaggggaccttagagagcaatcttcttccttctctctctctctctctctctctctctttcaatggcttcctcgtcttccagaactaagtccagtgggcccgttctacgctccctctcaccctccagtagattctgctcatacaccacatccaaaacccctttctcttctccttcatccgcattcgcttcctccacaagctctggcttctcctcttcaaccttcttcaaccagccacgtcagcatcactctcaaagccatcacagccaccaccgtgccgcatcgcccacacgtgtcaatctatacagccccgcccctctctcttccggcgtccggttctctatcgacccccggtctatatcacccaaccggtccatatcgaaccagatcatcacgacgaagaacaaccgtccgatctctggccagaagaagacgtgtatgtgctcgcctacgatgcaccctggctcgttccgatgcagcctccacaagaacatcgggaacaacaaccaccactccgattcatacccctcgaatcggcttaacatgcgtagatctgctatgaagaactcgctcgtgagaatcggaggcgtggagggcgagtgggtgaaacgggccctgacagcactgattcggcccagttcgcatcaacagaggaggagagcggggttcgagcccaggcccagtcgtctctctgtcatgtccaaagcccaggatctatgattttcttttagaaaaaaggttttttctatttacaccttgcaggttgttcttgattttgctggtttatataccataccacccatggcgccctgatctgccgccagagttggattccggcgaagcggttgggaggtagcggcgagtcctatccggcgagttttggtttcgtcgtctggagcagattggtgaatttggctgcatagatctatgacactggacctacacattgattttgtacataaattttgctatggaagcagagtttggacccccttttgttttatgccttgtgcataatttgattacagtgaacatacatacatacatacacaaaaaaaaaaaaaaaa

SEQ ID NO: 4736 - protein, 218 aa, Glycine max
  misc_feature: GI Number: 16974351; NR Description: AT5g25280/F18G18_20 [Arabidopsis thaliana] >gi|15529141|gb|AAK97665.1| AT5g25280/F18G18_20 [Arabidopsis thaliana] >gi|15146224|gb|AAK83595.1| AT5g25280/F18G18_20 [Arabidopsis
  misc_feature: GI Number: 21618161; NR Description: serine-rich protein
  misc_feature: GI Number: 24461857; NR Description: CTV.15 [Poncirus trifoliata]
  misc_feature: GI Number: 15241329; NR Description: serine-rich
MASSSSRTKSSGPVLRSLSPSSRFCSYTTSKTPFSSPSSAFASSTSSGFSSSTFFNQPRQHHSQSHHSHHRAASPTRVNLYSPAPLSSGVRFSIDPRSISPNRSISNQIITTKNNRPISGQKKTCMCSPTMHPGSFRCSLHKNIGNNNHHSDSYPSNRLNMRRSAMKNSLVRIGGVEGEWVKRALTALIRPSSHQQRRRAGFEPRPSRLSVMSKAQDL

SEQ ID NO: 4737 - DNA, 2308 bp, Triticum aestivum
  misc_feature (1)..(2308): Ceres cDNA ID no. 21995923
  misc_feature (1)..(2308): Ceres CLONE  ID no. 685826
  misc_feature (1)..(2308): Also known as  Ceres CDNA ID no. 24408240
acagccgacgaatacaaaacatttcctgattctggcagccgagacggcactgtcaaaccaaggctcctagcaacaagaaagaatgtcgtcccttgtacgccttatcctgacaatctccttgggcctaaacctcgcagccttgatcaccaccgccaacgaccaattcatctactccggattcagtggttccaacctcgccgtcgacgacaccgccaccatcacgccggacgggctcctggagctgacaaacggcacggcgtaccagaaaggccacgcgttccacccggccccgttccgcctccgcgactccacggccaacggcgtcggcgatggcaaggtgcggtccttctccgtcgccttcgtgttcggcatcgtctccgcctaccccgacttcagcgcccacggcatggccttcgtcatcgccccgcggaggaacttctccgatgctcttcctgccaagtatctgggccttaccaacgtccagaacgatggcaacgccagcaacagcatcttcgccgtggagctggacaccatccagagcgtggagttcaaggacatcaacgccaaccacgtcggcatcgacatcaacggcctgcagtccctacggtcatacaacgccggctactacgatgacgagagcggcgacttccgaggcatgaagctcatcagccgcgaggccatgcaagtgtggattgattaccacggggagaggaaggagatcaacgtgacactggctcccttcgacatggccaagcctgctaggccactcctctcggccagctacgacctctccacggtgctcactgagctggtgtatctcgggttctcagcggcgaccggtcgtgtcaactcgcggcatttcgttctcggttggagcttgggcgtgagcagacaagctccggccatcgacatggccaagctgcccaagttgcctcgggttggccccaagcctcggtccaaggtcctggacatcgttctaccaatagttacggccacatttgtacttggtttgggtggtatccttgtcctggtcatgcggaggagatcaaggtacgctgaactgcgggaagattgggaggttgagttcggaccacaccgcttcttgtacaaggatttattccgtgcaactgacggattcaaggacaagcatctacttggcgcaggggggtttggaagggtatacagaggcgtgcttgagacatctaaactggaggttgcggtgaagagggtgtctcacgagtcaagacaggggatgagggagttcatagctgagattacaagcatcggccgcatccgacatcgtaatcttgtagagttgctcggttactgccgtcgaaaaggtgaacttcttttggtgtacgcctacatgcccaacggaagcctggataaacatctatacaacactagagaggatcagcctactctgaattgggctttgaggtttcagaccgtcaaagatgtcgcgtccggcttgctttatctgcatgagaggtgggagaaagttgtcatccacagagacatcaaggccagcaacgtgctcctcgacaaagacatgaacgcccagcttggtgactttgggctagcaaggctgtacgaccatggggcagactcgcaaaccacgcacgtggtcggcaccatgggttacttggctccggagctcatacgcacgggcagggcgtcccctctgaccgatatgttcgcctttggcatattccttcttgaggttgcatgcggacagaaacccatcaaggagaatgcgcaaggcggacagatagcgctcgtcgactgggtgctggagcactggcgtgatggtacgctcatggagacggtggacgcgaggctccagggtgagttcgacatcgaccaggcagggctggtgctcacgctagcgctcatgtgctcacaccttctcgctagcgcgaggcctggcattggacaagtcatgcgctatctgaccggtgttacgcccctccctgagctcacaccaacagatgtgctcaccttgatgcaaaacaaggggtttgacgaatccgccatgtcatatccggatctggtgtcgagctttggcacaatttccaccctctcgggaggaagataacctcagtgctagcttaattcacggcttcaataagttttactagtattatgcatgtgtagtgccagaagttcgtaattagaattgtaaacccaataattatcctttggccgcagtacactttcaaattaccgtggccaacatgtaagaagttatattgttcaaaactcagaactcgaaacaaggtgatacggggcaaaaaaaaaaaaaaaa

SEQ ID NO: 4738 - protein, 671 aa, Triticum aestivum
  misc_feature: PFam Name: Pkinase; PFam Description: Protein kinase domain
  misc_feature: PFam Name: Lectin_legB; PFam Description: Legume lectins
  misc_feature: PFam Name: Pkinase_Tyr; PFam Description: Protein tyrosine kinase
  misc_feature: GI Number: 7269002; NR Description: AT4g02420 [Arabidopsis thaliana] gi|3193290|gb|AAC19274.1| contains similarity to a protein kinase domain (Pfam: pkinase.hmm, score: 165.48), to legume
  misc_feature: GI Number: 38112427; NR Description: lectin-like receptor
  misc_feature: GI Number: 58864770; NR Description: putative lectin
  misc_feature: GI Number: 50933967; NR Description: putative receptor kinase Lecrk [Oryza sativa (japonica cultivar-group)] >gi|28564578|dbj|BAC57687.1| putative receptor-like protein kinase [Oryza sativa (japonica cultivar-group)]
  misc_feature: GI Number: 50933977; NR Description: putative receptor kinase Lecrk [Oryza sativa (japonica cultivar-group)] >gi|28564584|dbj|BAC57693.1| putative receptor-like protein kinase [Oryza sativa (japonica cultivar-group)]
MSSLVRLILTISLGLNLAALITTANDQFIYSGFSGSNLAVDDTATITPDGLLELTNGTAYQKGHAFHPAPFRLRDSTANGVGDGKVRSFSVAFVFGIVSAYPDFSAHGMAFVIAPRRNFSDALPAKYLGLTNVQNDGNASNSIFAVELDTIQSVEFKDINANHVGIDINGLQSLRSYNAGYYDDESGDFRGMKLISREAMQVWIDYHGERKEINVTLAPFDMAKPARPLLSASYDLSTVLTELVYLGFSAATGRVNSRHFVLGWSLGVSRQAPAIDMAKLPKLPRVGPKPRSKVLDIVLPIVTATFVLGLGGILVLVMRRRSRYAELREDWEVEFGPHRFLYKDLFRATDGFKDKHLLGAGGFGRVYRGVLETSKLEVAVKRVSHESRQGMREFIAEITSIGRIRHRNLVELLGYCRRKGELLLVYAYMPNGSLDKHLYNTREDQPTLNWALRFQTVKDVASGLLYLHERWEKVVIHRDIKASNVLLDKDMNAQLGDFGLARLYDHGADSQTTHVVGTMGYLAPELIRTGRASPLTDMFAFGIFLLEVACGQKPIKENAQGGQIALVDWVLEHWRDGTLMETVDARLQGEFDIDQAGLVLTLALMCSHLLASARPGIGQVMRYLTGVTPLPELTPTDVLTLMQNKGFDESAMSYPDLVSSFGTISTLSGGR

SEQ ID NO: 4739 - DNA, 1476 bp, Triticum aestivum
  misc_feature (1)..(1476): Ceres cDNA ID no. 21995924
  misc_feature (1)..(1476): Ceres CLONE  ID no. 686040
  misc_feature (1)..(1476): Also known as  Ceres CDNA ID no. 25088282
agcgaatcgggcggaaacacaacgacgcagtcacgcaccggctctttcctccacccctcgtagggctagctagggtttctccgcccaaatcgtgtaataataacccacttgaagattcgcgcgaaagctgcggcgatggccaccaccgtccaaccccactccccggacccaacagccatcaccaccacccctgcccctccccctcctccttctccacctcgccaggagaacccgaccgccgcgggggaaggcgtagagatcgcggcgctcgatgagcagcctgccgccgtcgccgtcgccgacaaggggaatacggcccccggcggcgggaagctggtggcggaggccatgcgcaagtgcgcggcgccccggtcgtcgcgctaccacggcgtgacgaggctcaagtggagcggcaagtacgaggcacacctctgggacaacaccagccaggttgaggggcgcaagcgcaagggcaagcatgtgtacttgggaagctatgttactgaagagaatgctgcaagggcacatgaccttgcagccctgaaatattggggcataactcaacccaccaaactaaacttcaatatttctgattatgcaaaagaaattgagatcatgaagagcatgaatcaagatgaatttgtggcctacataaggaggcagagtagttgtttctcaagaggaacatcgtcatacaggggtgtaacaagacgaaaggatggtaaatggcaagcacgtattggtaggattggtgagagtagagacactaaagacatctatcttgggacctttgaaactgaagtggaggcagctgaagcgtatgacctagcagcaattcagctccgtggtgttcatgctgtgaccaactttgatatcagcaactactccgaagaaggtttgaagaaactagaaggctcatctgaggtagtgaacctggaggaccaatcagaagtcactaagttagctgtgaccaacttggatattagcaaacactgcgaagatggtttgaagaaactagatggcgcatcccaggtagtgaacctggagggccaatcagaagtcaccaagttatctgtgactaactttgatattagcaactgctgtgaagatggtttgaagaaactagaaggctcatccgaggtagcgaacctggaggaccaatcagaagtcacaaagttagctggacaatagatattagaatagcaacatgtaaattatttatttcttcctttttatcttttctctgatcgtcaatctctccacctttctcttttcttgattgatgatgagagtgtcttttcttcgtctgcctttcctgaaacttttttttcccaaggaatttcccttcgctggttgccaactctattatttaccagctccagagtaggatcgtgtgatgctgtactctgtattctcatgtacactgattacaaaccattgatagtatttgtagacattacaaaaaaaaaaaaaaaa

SEQ ID NO: 4740 - protein, 351 aa, Triticum aestivum
  misc_feature: PFam Name: AP2; PFam Description: AP2 domain
  misc_feature: GI Number: 50941533; NR Description: ovule development protein aintegumenta (ANT)-like [Oryza sativa (japonica cultivar-group)] >gi|40253775|dbj|BAD05714.1| ovule development protein aintegumenta (ANT)-like [Oryza sativa (japonica
  misc_feature: GI Number: 40644766; NR Description: putative AP2-like
  misc_feature: GI Number: 46451387; NR Description: AP2/EREBP transcription
  misc_feature: GI Number: 46254989; NR Description: PLETHORA2 [Arabidopsis thaliana] >gi|42562665|ref|NP_175530.2| ovule development protein,
  misc_feature: GI Number: 47176942; NR Description: AP2/EREBP transcription
MATTVQPHSPDPTAITTTPAPPPPPSPPRQENPTAAGEGVEIAALDEQPAAVAVADKGNTAPGGGKLVAEAMRKCAAPRSSRYHGVTRLKWSGKYEAHLWDNTSQVEGRKRKGKHVYLGSYVTEENAARAHDLAALKYWGITQPTKLNFNISDYAKEIEIMKSMNQDEFVAYIRRQSSCFSRGTSSYRGVTRRKDGKWQARIGRIGESRDTKDIYLGTFETEVEAAEAYDLAAIQLRGVHAVTNFDISNYSEEGLKKLEGSSEVVNLEDQSEVTKLAVTNLDISKHCEDGLKKLDGASQVVNLEGQSEVTKLSVTNFDISNCCEDGLKKLEGSSEVANLEDQSEVTKLAGQ

SEQ ID NO: 4741 - DNA, 843 bp, Triticum aestivum
  misc_feature (1)..(843): Ceres cDNA ID no. 21995925
  misc_feature (1)..(843): Ceres CLONE  ID no. 686102
  misc_feature (1)..(843): Also known as  Ceres CDNA ID no. 24411169
acgttctgcctgcagtcctcgtaccctagcctccagttccccaccaccagagcacacccgagcggaccgacgccgccgccgccgccgtccgtccgttgaggagggcatgaagggcgggaggaagaacctgcgtcgcgcgtgcgaggagggcaccgcggtgacgctggcggagggcgagagcatcatgcaggtcgtcacgctgcgcggctccaacctcatcgaggtcaccgacggcgagggcgtcaagtctctcgccctcttccccgccaagttccagaagagcttctggatcaagaacgggaatttcgtggttgtggatgctagtggcagggacgaggctctcgaatctggaagcaagatagcctgtgtcgtgtcacgggtcctctttcacgaccaggttcgcgccctcgagaaatccggccaatggccggctatcttcaagtcaactcccaatgggtgggcgacagggccacaaggaacgacatcacaggctgaggaagagcagaactctgatgaagacgtcgatgatgatatgccgccacttgaggcaaacacgaacagaaatagaccgtttgacgtgcattccgatacagaaagtgactctgattcttgaactggtagacgacttgggaatagtcatcatcctatggttaccgtccacctgtacacctaatgtatttatgcttgtcgaatttgggcatgacatcataaacttacggcccaatctgtcaaagatatagtagtcagtgcgttttgtcgacattaagtggcagggcatgtggaggcctgtcacctgtagtgtaatatgaagaaaacaagaatgttccaaaaaaaaaaaaaaaa

SEQ ID NO: 4742 - protein, 168 aa, Triticum aestivum
  misc_feature: PFam Name: eIF-1a; PFam Description: Eukaryotic initiation
  misc_feature: GI Number: 13477313; NR Description: MGC11102 protein [Homo
  misc_feature: GI Number: 20884771; NR Description: RIKEN cDNA 2010003J03 [Mus musculus] >gi|22137613|gb|AAH24640.1| 2010003J03Rik protein
  misc_feature: GI Number: 62859797; NR Description: LOC549450 [Xenopus tropicalis]
  misc_feature: GI Number: 31236123; NR Description: ENSANGP00000006162 [Anopheles gambiae] >gi|30174815|gb|EAA14364.2| ENSANGP00000006162
  misc_feature: GI Number: 48675891; NR Description: obelix [Gallus gallus]
MKGGRKNLRRACEEGTAVTLAEGESIMQVVTLRGSNLIEVTDGEGVKSLALFPAKFQKSFWIKNGNFVVVDASGRDEALESGSKIACVVSRVLFHDQVRALEKSGQWPAIFKSTPNGWATGPQGTTSQAEEEQNSDEDVDDDMPPLEANTNRNRPFDVHSDTESDSDS

SEQ ID NO: 4743 - DNA, 1625 bp, Triticum aestivum
  misc_feature (1)..(1625): Ceres cDNA ID no. 21995930
  misc_feature (1)..(1625): Ceres CLONE  ID no. 700295
  misc_feature (1)..(1625): Also known as  Ceres CDNA ID no. 24766914
gtcatcctgtcatctgctgccgccgcacggtcgcagccgccgtccatggcgacggcggaggaaggcgagagaggagagccaccaggattagggagggggaggtgtccaagattccggcgatctgaggcgacccgcgacatggccggaggcggcggcgctgggggaaaggaggatggcggcacggagcccctactcctgtccgtcctcgctctccccgcaacggcgctccccgccgtcgtctcccgcctggaggccgccgtcccgcggaaggcgcgcagctacctcccccgcaacgtcccgtcggcctggtggtcactcaggatccccttcatccagccgctgccgccggctggggacccggcaaacgaagaggaggggagaaggttcccccgcccccagcgcgtgcaggtggctccgtctctcgatccaggcacggccgataagccgcccaagagattgaagaggtgcctgcactgcaaggcggtggagacgccgcagcggaggtcagggccgatggggcggggtaccctctgcaacgcctgcggagtctggtacagtaagaacgggacgctgccggagcaccttccggtggcaagcccaatcgtcgattcgccgctggagaacccgatctgggagcccgaggtgcctggggccatctacctggtcagaaagtcggccacggagaggatgcctcccaggacagaagccgcaccagcgccacggccggggacgagctgcttgcactgcgggtcgtcggagccgcctttgtggatagaagggtcgatgaggcggagggaggtctgcaccgcctgcggcatgcggtacaagaaagggaggttgctgccggagtgccgtccagcagagtgctcagtgacggattcccggcaggagagcccagtcatcaactccccgccagagagtcccatctgggaacctgaggcgcctccgtccgtgcacctgccaagaaagccttcaaaaaagaagaagaggaggcggtcgagaagcgaagccccttcggcgccatggccggcaaataaggggaagaggtgccagcactgtgggtcgtcagagacgccgcagtggagggaggggccaaaggggcgagccacgctgtgcaacgcgtgcggcgtgcggtacaggcaggggaggctactgccggagtaccggcccatggcgagccctacatttgtgccaacaaagcatgccaattcccaccgcaaggtgctccagttgcatcggaccaggcaaagcaacgacgagcatccatcaccgctgcctgccgacagcgtcaccaacctgcccccaatccgcgacgagctcccgaccaccagcacggcaggtcttgccagtgaggatccgaccgacgcaccgggctacaccgacaacccaatcaacgtgccgagctcactggactcgctgctgctcgacgggccgtcggcaccactcatcgtagagagtgaagattttgcgattagctagcctatgaagaataattcagctgagatgagatactgatcctttttacttcgtttgttcagatactgatgcttggaaattttaaactttcaatcactgaaggccactgcacaggccctagcagtgatcaaacaaaaaaaaaaaaaaaa

SEQ ID NO: 4744 - protein, 446 aa, Triticum aestivum
  misc_feature: PFam Name: GATA; PFam Description: GATA zinc finger
  misc_feature: GI Number: 8778844; NR Description: T6D22.9 [Arabidopsis thaliana]
  misc_feature: GI Number: 34909448; NR Description: OSJNBa0014K08.18 [Oryza sativa (japonica cultivar-group)] >gi|21902044|dbj|BAC05593.1|
  misc_feature: GI Number: 37572445; NR Description: AG-motif binding
  misc_feature: GI Number: 50911202; NR Description: putative AG-motif binding protein-4 [Oryza sativa (japonica cultivar-group)] >gi|49387618|dbj|BAD25814.1| putative AG-motif binding protein-4 [Oryza sativa (japonica cultivar-group)] [Oryza sativa (japonica
  misc_feature: GI Number: 15239503; NR Description: zinc finger (GATA type)
MAGGGGAGGKEDGGTEPLLLSVLALPATALPAVVSRLEAAVPRKARSYLPRNVPSAWWSLRIPFIQPLPPAGDPANEEEGRRFPRPQRVQVAPSLDPGTADKPPKRLKRCLHCKAVETPQRRSGPMGRGTLCNACGVWYSKNGTLPEHLPVASPIVDSPLENPIWEPEVPGAIYLVRKSATERMPPRTEAAPAPRPGTSCLHCGSSEPPLWIEGSMRRREVCTACGMRYKKGRLLPECRPAECSVTDSRQESPVINSPPESPIWEPEAPPSVHLPRKPSKKKKRRRSRSEAPSAPWPANKGKRCQHCGSSETPQWREGPKGRATLCNACGVRYRQGRLLPEYRPMASPTFVPTKHANSHRKVLQLHRTRQSNDEHPSPLPADSVTNLPPIRDELPTTSTAGLASEDPTDAPGYTDNPINVPSSLDSLLLDGPSAPLIVESEDFAIS

SEQ ID NO: 4745 - DNA, 1912 bp, Triticum aestivum
  misc_feature (1)..(1912): Ceres cDNA ID no. 21995933
  misc_feature (1)..(1912): Ceres CLONE  ID no. 703114
  misc_feature (1)..(1912): Also known as  Ceres CDNA ID no. 24412750
atcgcgtcacatccgagggaggcaaaaccctaggcagatccctcccgaagcctaccgcgaccttccgcccccggaggagatgcagggcggcaaccacatgctcctcgaggagcccgtccgcctcgcctccgtcctcgcccccgccaagcccaaagttttcccatccctcactaagattgttgggacgcttgggcccaactcgcactcagtcgaagtgattgaagaatgtctcactgctgggatgtcagttgcgcggtttgatttctcttggaaggatgctacttatcatcaggagaccctcgacaatctgaggaaagcggcacagaatgtgaagaagttatgtcctataatgctggatacagtgggtccagaaattcaggttcacaattcaactggtggagcaatcgagttgataggggggaatcatgtcacaataacaccagatctttctaaagctccttcggctgatatcctaccaattaaatttggcgatcttgcaaaagttgtgaagaagggtgatactcttttcattggtcaatatcttttcacaggaagtgaaacaacatctctatggcttgaagttacggagacttctggtgcagaagtgatttgttacgtgaagaacacagctacactgtcagggcccattttcactctgcatgtttcacaagtacatatcagtatgcccactttgagtgaatatgataaacaggtcatatcaacgtgggggctgcaaaacagtgttgacattatatcgctttcccatacccgctcttctgaagatgtcagggagcttagagcctttttaaaatctcatgatcttcaagacacacagatatatgcgaaggttgaaaatgctgagggtttggagcattttgatgaaattctccaagaggcggatggtatcatcatatcgcgaggagacctgggaattgacctcccaccagagagggtgttcatgtcccaaaagactggtattcataaatgcaacatggccggcaaacctgtgatcattactagagttgtggacagcatgattgacaatctgcgccctactcgcgcagaagctactgatgttgcaaatgctgtcctagatggaactgatggcattttgctcggtgcggagacacttcgagggcagtatcctgttgacgctgtgcgtactgtgggcagaatatgtgcagaagctgagaccgtgtataaccagtcacttcacttcaagaaagtagtgaggcatgtaggtgaaccaatggtccatgaagaatctgtggcatcatcagcggttcgttctgcaatgaaggtaaaagctgctgcaattgttgtgttcaccttctcggggagagctgctaggttaattgctaaatacagggccccaatgccagttttagcagttgtgttcccgcgtgagggctctgatccatcgaagtggcgttcttatggcacgacacaggcgaggcaatgtttttctgtgagaggtgtctaccctttgatggggagtactgacgatgctgaaactggtgggctcaccaaggaagaatacgggataaaacttgcactgaactatggccggtcagtaggcataataaagccatacgacagggtgattatttttgaaaagatcggtgattcctctgttgtcaagatcatcgagtgcgacgattctgaaagatgaatgacccttctcaggcaacagtttcaactatacgcctgagattgcctcctctttttgttctccattcactttgaccagagataaaagagtagtatagcacgacaaggttgtcatgtttagcaccttggtattttagatttacatacttgttgccctaataaagtgaagagagctcattcactcaaacatccaagttttggacaaaattataggattgttgagataaaaaaaaaaaaaaaa

SEQ ID NO: 4746 - protein, 530 aa, Triticum aestivum
  misc_feature: PFam Name: PK; PFam Description: Pyruvate kinase, barrel domain
  misc_feature: PFam Name: PK_C; PFam Description: Pyruvate kinase,
  misc_feature: GI Number: 23308151; NR Description: At2g36580/F1O11.21
  misc_feature: GI Number: 24111299; NR Description: At3g52990/F8J2_160 [Arabidopsis thaliana] >gi|23397188|gb|AAN31877.1| putative pyruvate kinase [Arabidopsis thaliana] >gi|21537185|gb|AAM61526.1| pyruvate kinase-like protein
  misc_feature: GI Number: 25287747; NR Description: probable pyruvate kinase
  misc_feature: GI Number: 21537122; NR Description: putative pyruvate kinase
  misc_feature: GI Number: 20197921; NR Description: putative pyruvate kinase [Arabidopsis thaliana] >gi|17978970|gb|AAL47446.1| At2g36580/F1O11.21 [Arabidopsis thaliana] >gi|18404169|ref|NP_565850.1| pyruvate kinase, putative
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRAPMPVLAVVFPREGSDPSKWRSYGTTQARQCFSVRGVYPLMGSTDDAETGGLTKEEYGIKLALNYGRSVGIIKPYDRVIIFEKIGDSSVVKIIECDDSER

SEQ ID NO: 4747 - DNA, 1907 bp, Triticum aestivum
  misc_feature (1)..(1907): Ceres cDNA ID no. 21995934
  misc_feature (1)..(1907): Ceres CLONE  ID no. 704696
  misc_feature (1)..(1907): Also known as  Ceres CDNA ID no. 24408536
gtcatctcgcttcattaccagtagctcggaatcggaggcttgcgatcgagtaggtgatcctgctacataattataacctattgttgacggaggagccgatgtcaattgccgcggccgtcaccggaaccgccaccgcggcggtgcacgcgcccgtgcaccacgcgccacaccacgcctctacgcagcgcacggcgccgcggcgcgagcagtcgccgctcaacccgagctcgcaggcgctgcgcgcggccgggtccggggcctcgccgcccgcggatggcgtgaggacgcacatcgccaaccttgaccgcgtgctcgggaagccgccgaggacgccgagccaggcggggccgcccagcagcaagcaggagcaggagagcgagcaggagccgctcaacatccggcacggcctgctcaacgcgctcaacctctccttcttcgtgcccatgccggggatgcgggcgcgcatggccgcggacgagcacatgtcgccgcgcagcctcatgcacatgcagcagctcctctcggccgactccccgcgcgcgtccccgaggagcaccatcggcccccggtggcgcgccctccacggggagggcgggtgggccggactcctcgacccgctcgactccgacctccgccgcgagctcctccgctacggcgacttcgtgcaggcggcctaccaggccttccactcgctgcccaccgcggcggcgaggcaccgtggcctcatgctcccggaccgctcctaccgccccacgcgcagcctcttcgccacctccgcgctctccatgccgccgtgggccaagcgccccaacacccccgagtggctcacgcagcagtccaactggatcggctacgtcgccgtgtgcgagtccgagcgggaggtcgcccgcatgggccgccgggacatcgccatcgtgctgcgcgggacggccacctgcctcgagtgggccgagaacctgcgcgcctcgctcgtgcccctcgacggcgaggccggcgagggcaagcaagccggacctgaggatcccaaggtggcgcgcggattccggagcctctacaagacggccggggaagaggtgaagagcctctcggaggacgtcatggacgaggtgagacgcctcatggagaagtacaagggcgaggagctgagcatcacgatcgtcgggcacagcctcggcggcgcgctggcgctcctggtggccgacgagatcgccaccaccgtccccgacgcgccgccggtcgccgtggtctccttcggcggcccgaaggtgggcaacgccgcgttcgtggataagctcaagcagagcggcaaggtcaacgtcctccggatcgtcaacgccggcgacatggtgaccaaggtgcccggggtggcgccgcggctgccgctgagcaaggagcagtaccagcacgtgggcgcggagctgcgcatcgacagcaagaactcgccgtgcctgcgccccgacgtgggcccggcgagccggcacgacctggaggcgtacctgcacctcatcgacgggttcaccgcgacggggcacccgttccggtacgacgcgcggcgcagcgtgatacgcctgctgcagctgcagaaggggaacgtgaagaaggagtacgtgaaccgcgcccgggagctcggcgtcgaccccgccgcgccggcggacgtcggccggagcatggcgtacggcaactgcgccgtcgcgagcccgtcatgaccaaatcgcggagtaaattagttttgtactgtagaaacaaacaattctttcgttagtcggcagggtgtcggttccaggaaaatatctcgtttccatcttctcgttttcgtttcgatgcatgtacaggaaaatcatgtatgtgtgcgtgacataattgatcaggcgaaggctcgagtgttttgaccaaaaaaaaaaaaaaaa

SEQ ID NO: 4748 - protein, 535 aa, Triticum aestivum
  misc_feature: PFam Name: Lipase_3; PFam Description: Lipase (class 3)
  misc_feature: PFam Name: Pyr_redox_2; PFam Description: Pyridine
  misc_feature: PFam Name: Glutenin_hmw; PFam Description: High molecular
  misc_feature: PFam Name: Pkinase; PFam Description: Protein kinase domain
  misc_feature: PFam Name: HlyD; PFam Description: HlyD family secretion protein
  misc_feature: GI Number: 51979324; NR Description: PREDICTED P0491E01.40 gene product [Oryza sativa (japonica cultivar-group)] >gi|51979322|ref|XP_507515.1| PREDICTED P0491E01.40 gene product [Oryza sativa (japonica cultivar-group)] [Oryza sativa (japonica
  misc_feature: GI Number: 14140134; NR Description: lipase-like protein
  misc_feature: GI Number: 37536870; NR Description: putative lipase [Oryza sativa (japonica cultivar-group)] >gi|13569989|gb|AAK31273.1| putative lipase [Oryza sativa] >gi|31433519|gb|AAP55024.1| putative
  misc_feature: GI Number: 18414755; NR Description: lipase class 3 family
  misc_feature: GI Number: 7268433; NR Description: triacylglycerol lipase like protein [Arabidopsis thaliana] >gi|2245036|emb|CAB10455.1| triacylglycerol lipase like protein [Arabidopsis thaliana] >gi|7488220|pir||E71435 probable triacylglycerol lipase -
MSIAAAVTGTATAAVHAPVHHAPHHASTQRTAPRREQSPLNPSSQALRAAGSGASPPADGVRTHIANLDRVLGKPPRTPSQAGPPSSKQEQESEQEPLNIRHGLLNALNLSFFVPMPGMRARMAADEHMSPRSLMHMQQLLSADSPRASPRSTIGPRWRALHGEGGWAGLLDPLDSDLRRELLRYGDFVQAAYQAFHSLPTAAARHRGLMLPDRSYRPTRSLFATSALSMPPWAKRPNTPEWLTQQSNWIGYVAVCESEREVARMGRRDIAIVLRGTATCLEWAENLRASLVPLDGEAGEGKQAGPEDPKVARGFRSLYKTAGEEVKSLSEDVMDEVRRLMEKYKGEELSITIVGHSLGGALALLVADEIATTVPDAPPVAVVSFGGPKVGNAAFVDKLKQSGKVNVLRIVNAGDMVTKVPGVAPRLPLSKEQYQHVGAELRIDSKNSPCLRPDVGPASRHDLEAYLHLIDGFTATGHPFRYDARRSVIRLLQLQKGNVKKEYVNRARELGVDPAAPADVGRSMAYGNCAVASPS

SEQ ID NO: 4749 - DNA, 1247 bp, Glycine max
  misc_feature (1)..(1247): Ceres cDNA ID no. 21995937
  misc_feature (1)..(1247): Ceres CLONE  ID no. 709200
  misc_feature (1)..(1247): Also known as  Ceres CDNA ID no. 23706581
aaaaaagttgaagaatatgagcagcagtgcagggaagttggtgtgtgtcaccggtgctgccggttatattgcttcatggattgtcaagttcctacttgaacgtggttacactgtcagggccactgttcgaaacccaaatgatcacacgaaggtagaacatttgctaaaacttgaaggtgcaaaggagagactgcacctttttaaggcagatcttttgggtgaaaattcttttgactccattgttgagggctgtgatggcgtctttcatactgcttctccttttattatcaacgtcaaagacccacaggctgacctacttgacccagcagtgaagggaactcttaacgttcttaaatcatgtgtaaaatcgccatctgtgaaacgagtcatcttaacatcttctgtggctgcagttgcatataataaaaggcctaaaagtcctgaagttgtagttgatgaaacctggtggtctgatccagattactgtaaggaattaaagctgtggtatttactttcaaagactttggctgaagatgctgcctggaaatttgccaaagaaaacgaccttgacttggttgttgttaacccagcaatggttgtagggcctcttttgcaagcagagcttaacactagtgctgctattattttaaacctaataaatggttcagaaactttttcaaatgatacatatggatggatcaatgtgaaagatgttgcaaacgcccatattcaggcatatgagattgcttcagctagtggaagatattgtttagttgagagagtggcacactactctgaactcgccaggattttacgtgatcagtacccgacatatcaaattccagaaaagtctgcagacgataagccttatgtaccaacatttcaggtttccaaagaaaaggcaaagaccttggggattgaatttattcctttggaagtgagtcttagagagacagtggaaactttgaaagaaaagaactttgccaacttttagtctctgatatctctgcttgatcaggagtgaacacgttgagaatctcaacggtgtttcgtttgtggttctggttttagaatctcattgcttgaaaataaactattgtactgaaatgtcaagcttgtgtgttgtaataaaacaagattaattgttggttttatttcggtttgtactcatgaaggaaaccaacgtgtggtataaaaagataataattaagtatcaggctatttctagtccaaaaaaaaaaaaaaaa

SEQ ID NO: 4750 - protein, 325 aa, Glycine max
  misc_feature: PFam Name: Epimerase; PFam Description: NAD dependent
  misc_feature: PFam Name: 3Beta_HSD; PFam Description: 3-beta
  misc_feature: GI Number: 2981475; NR Description: putative cinnamyl alcohol dehydrogenase [Malus x domestica] >gi|7488627|pir||T16995 probable
  misc_feature: GI Number: 1143445; NR Description: cinnamyl alcohol dehydrogenase [Eucalyptus gunnii] >gi|7431409|pir||T10736
  misc_feature: GI Number: 5852203; NR Description: aldehyde reductase [Vigna
  misc_feature: GI Number: 37029996; NR Description: NADPH-dependent cinnamyl
  misc_feature: GI Number: 30694964; NR Description: cinnamyl-alcohol
MSSSAGKLVCVTGAAGYIASWIVKFLLERGYTVRATVRNPNDHTKVEHLLKLEGAKERLHLFKADLLGENSFDSIVEGCDGVFHTASPFIINVKDPQADLLDPAVKGTLNVLKSCVKSPSVKRVILTSSVAAVAYNKRPKSPEVVVDETWWSDPDYCKELKLWYLLSKTLAEDAAWKFAKENDLDLVVVNPAMVVGPLLQAELNTSAAIILNLINGSETFSNDTYGWINVKDVANAHIQAYEIASASGRYCLVERVAHYSELARILRDQYPTYQIPEKSADDKPYVPTFQVSKEKAKTLGIEFIPLEVSLRETVETLKEKNFANF

SEQ ID NO: 4751 - DNA, 1016 bp, Glycine max
  misc_feature (1)..(1016): Ceres cDNA ID no. 21995938
  misc_feature (1)..(1016): Ceres CLONE  ID no. 710123
  misc_feature (1)..(1016): Also known as  Ceres CDNA ID no. 24372890
tattaaattactaccgtgtttgttttacggaacatttgaaaaacctaattaaacttttaactatatttgagatttatttattttcgggtgcaaggggctaaagccccaaccctccaaagaacaaagatccaaagtgagtggagatgtcaggcagagggcggggacggggaggatggggacgaggaggtggatttaatacatttgcctctcaagttccatttgatctttttcctgaggctgttactttgcctgatgttaaccttgatgatattcatgatgataccaaaaagttgcttcgttgggatagtcaccttcaaaattattgggaagcctctccttattttctcgaggacaaaacctccaagaagagacaaagtatgcacatagctaaattctcggacaggaagaagaatgatttcactcgtgactctctctcacaagttttaatgttcaatgatttccctcaggagatagttcaaggtgcatctaagcgtgcgtcgagaagaaaaaagtttcgatggaacccagagtcagagatgaagaaacttgatttctttgaacaacaagagaaaacaaaccagggcaaagaggaaaatgatgaaaatgaaaagaaagatggagaagatggagacgaggatgaaaatgcacaagaggaggatgaagaagatattagtgatgatgattataatcagaatatagattttgatgacgatgaagatgattataatgatgtagatgacggggatgatgaacctacctattagatatcagtatggagaatgttcttctgctcatcccgtgacagctatacaagcatggactgttgctcctttaattttacagtttggaagttaaaattgttcgttagccttatttggcttttactttgtcactattttaacttgttcaattactaacggatgttttccttgtaaatgtttagattaaagaagtataccgcttgacgagaaagaaaatatggttgtagaaaacttgaaagaaaaaaaaaaaaaaaa

SEQ ID NO: 4752 - protein, 206 aa, Glycine max
  misc_feature: PFam Name: Mucin; PFam Description: Mucin-like glycoprotein
  misc_feature: PFam Name: Mak16; PFam Description: Mak16 protein
  misc_feature: PFam Name: Mpp10; PFam Description: Mpp10 protein
  misc_feature: PFam Name: Aldose_epim; PFam Description: Aldose 1-epimerase
  misc_feature: PFam Name: Prothymosin; PFam Description:
  misc_feature: GI Number: 31239451; NR Description: ENSANGP00000011763 [Anopheles gambiae] >gi|21288243|gb|EAA00564.1| ENSANGP00000011763
  misc_feature: GI Number: 60649721; NR Description: Unknown (protein for
  misc_feature: GI Number: 51968337; NR Description: aspartic acid-rich
  misc_feature: GI Number: 31240455; NR Description: ENSANGP00000021189 [Anopheles gambiae] >gi|21288154|gb|EAA00475.1| ENSANGP00000021189
  misc_feature: GI Number: 23486915; NR Description: casein kinase ii beta
MSGRGRGRGGWGRGGGFNTFASQVPFDLFPEAVTLPDVNLDDIHDDTKKLLRWDSHLQNYWEASPYFLEDKTSKKRQSMHIAKFSDRKKNDFTRDSLSQVLMFNDFPQEIVQGASKRASRRKKFRWNPESEMKKLDFFEQQEKTNQGKEENDENEKKDGEDGDEDENAQEEDEEDISDDDYNQNIDFDDDEDDYNDVDDGDDEPTY

SEQ ID NO: 4753 - DNA, 2098 bp, Triticum aestivum
  misc_feature (1)..(2098): Ceres cDNA ID no. 21995941
  misc_feature (1)..(2098): Ceres CLONE  ID no. 738929
  misc_feature (1)..(2098): Also known as  Ceres CDNA ID no. 23436240
atctcccgggctcttcttgttgcgtctacaaagtatctgtgtctataactctatatatcttgctctctccgccgttgcagttggattgcaggagcactagctagctagccaggcagagagcatggaagtctcggccatggaggaagccgccgttcgtgtccctgtccctgcggcgaggaggaagggcggcctcagaaccataccgttcatcatctcgaacgagatcttcgagaaggtggcgacgtacgggctgcaagcgaacatggtcgtatacctcaccaagcggtacaacatgacgccggccgccagcgccatggtgctctacctttggtccgccctcaccaacttcctgcccatcggcggcggcgtgttgtcggacgttttcttcggccggttcccggtcatcgccgtgggatgcgtcgtcagcctctcggggatgtgcctgctattggtgactgcgatcctgccggtgtacaagaagactctggggtgcgacccggccaacccgagcgcgtgcacgatgctgccgtgccagctgccgctactgttcacgtcgttcatgctcatgtcgctcggggcgggcggcatccggccgtgcgcgctggcgttcggagcggaccagctggacaagcgggacaacagcaccaagaacgtgaggaggctgcagaccttcttcaactggtactacaccgtgctggggctctccctcgtcgttgccgtcctcgtcatcgtctacatacaggaccacatggggtgggtcgtcggcttctccgtgcccgtcgtgctcatgctcgccgctctcatgctcttcctggccggctcgcctttgtacctcaaggcggaggccgacaggagcgtgctggtgggcatcgtgcaggtgctcgtcgccagctacaagaaccggcgcgagctgttgccgccggacacggccgaagcgtcgtgctttcacaacaaagctggctccaggcccagagttcccaccaagaagatggtgtctatgaaccgggcgtgcgtgctcaggaacccgagcaaggagctcaacagcgacgggtcggcgtgtgacccgtggcggctgtgcacggtgcagcaggtggaggacgccaaggccgtcatccgcgtgctgccgatatggtccacggggatcataccgggcgtgatcgtcgcccaggtgatgttccccgtgctgcaagcaggtacgatggatcggcagatgggcaaggtggaggtccccgccgcatcctacagcgtcttcggcatcatcacgctcaccgtctgggtggccttgtacgaccgcgtgcttgtgcggcccctctcgcggctcaccggccacgcgcgcgggctcagcctgcgacagcgcatgggagccgggctggcggtcttcgccgtggccatggctgtggccgcgcgaaccgaggccctccgccgcggcgcggccatcgcggagggcttccaggaccaaaagcatgcggtggtacacatgtcggcgatgcggcttgtgccgcagcactgcctcatcgggctcgccgacgcgttgaacctgatcgggcagatcgagttctactactccgagttccccaagaccatgtccagcatcggggtgtcgctgctcgccctcggcgtgggcttcggcgccgtgctggggagcgccatcgtggggatcatgaacagcgccaccgggagggacgggcgcgacagctggttgtccagcaacctcaacaggggccgctacgactactactatctggttctcgcggcgctgtccgtggccaacttggtgtacttcatctggtgcagctgggcgtacggcgaggaagggcagatcagaattatggcgttggcggctgaggaggcggaggaggaagagaccaaacaagaacagcacaaatgataggcaaggcattcgccgggcagtgacgcagtgtgctgttgtgctcgtttgaccttgcgcgcgcctttctctcttgcgaattgctgaattgtgaattgtgatattgatgtgctacgttagtgtagaaacaacggatacacccggtctatatcatcattcatcattcggtcatgttacatgtttctagttgcatcaaaaaaaaaaaaaaaa

SEQ ID NO: 4754 - protein, 588 aa, Triticum aestivum
  misc_feature: PFam Name: PTR2; PFam Description: POT family
  misc_feature: GI Number: 50902022; NR Description: putative peptide transporter [Oryza sativa (japonica cultivar-group)] >gi|14587308|dbj|BAB61219.1| putative peptide transporter [Oryza sativa (japonica cultivar-group)] >gi|20804676|dbj|BAB92364.1|
  misc_feature: GI Number: 25405532; NR Description: probable peptide transporter [imported] - Arabidopsis thaliana >gi|15218183|ref|NP_175630.1| proton-dependent oligopeptide transport (POT) family protein [Arabidopsis thaliana]
  misc_feature: GI Number: 15233307; NR Description: proton-dependent
  misc_feature: GI Number: 20466248; NR Description: putative transport
  misc_feature: GI Number: 50902020; NR Description: putative peptide transporter [Oryza sativa (japonica cultivar-group)] >gi|14587307|dbj|BAB61218.1| putative peptide transporter [Oryza sativa (japonica cultivar-group)] >gi|20804675|dbj|BAB92363.1|
  misc_feature: Utility: Useful for making plants tolerant to low nitrogen
  misc_feature: Utility: Useful for making plants with enhanced tolerance to
  misc_feature: Utility: Useful for making seeds with altered carbon/nitrogen
MEVSAMEEAAVRVPVPAARRKGGLRTIPFIISNEIFEKVATYGLQANMVVYLTKRYNMTPAASAMVLYLWSALTNFLPIGGGVLSDVFFGRFPVIAVGCVVSLSGMCLLLVTAILPVYKKTLGCDPANPSACTMLPCQLPLLFTSFMLMSLGAGGIRPCALAFGADQLDKRDNSTKNVRRLQTFFNWYYTVLGLSLVVAVLVIVYIQDHMGWVVGFSVPVVLMLAALMLFLAGSPLYLKAEADRSVLVGIVQVLVASYKNRRELLPPDTAEASCFHNKAGSRPRVPTKKMVSMNRACVLRNPSKELNSDGSACDPWRLCTVQQVEDAKAVIRVLPIWSTGIIPGVIVAQVMFPVLQAGTMDRQMGKVEVPAASYSVFGIITLTVWVALYDRVLVRPLSRLTGHARGLSLRQRMGAGLAVFAVAMAVAARTEALRRGAAIAEGFQDQKHAVVHMSAMRLVPQHCLIGLADALNLIGQIEFYYSEFPKTMSSIGVSLLALGVGFGAVLGSAIVGIMNSATGRDGRDSWLSSNLNRGRYDYYYLVLAALSVANLVYFIWCSWAYGEEGQIRIMALAAEEAEEEETKQEQHK

SEQ ID NO: 4755 - DNA, 1853 bp, Glycine max
  misc_feature (1)..(1853): Ceres cDNA ID no. 21995943
  misc_feature (1)..(1853): Ceres CLONE  ID no. 745843
  misc_feature (1)..(1853): Also known as  Ceres CDNA ID no. 24402137
tatttaggataaagaaggagagactggactagctgagttagggtgagttgcaggcagtgtcatctctcctttgacgacaagatgagcatcccaattccccatcggcagttattcatagacggagactggaaagtccccgtcctcaagaatcggattcccatcatcaacccttccacccaacacatcatcggggatatcccagcagctactaaggaagacgttgatctcgctgtcgctgccgccaaagctgccctctcccgcaacaagggcgccgattgggcctccgcttccggctccgttcgggctcgctacctccgcgccatcgctgccaagatcaccgagaaaaagcctgaactagcaaaactcgaagctattgactgtggaaaaccgctcgatgaagccgcctgggacatcgacgatgttgctggttgctttgagttctatgctgaccttgctgaaaaattggacgcacagcaaaaggctcatgtgtctcttcccatggacacattcaagagttatgttcttaaggagccgattggagtcgttgctttaataactccttggaattatcctctgttgatggctacgtggaaggttgctcctgctctggcggccggctgtgctgcaatattgaagccctctgagttggcatctgtgacatgcttggagctggctgaaatttgcaaagaagtcgggcttcctcctggcgtgttgaacattctcactggattaggacctgaagcgggtgctcctttagcagctcatcccgatgtagacaagattgcctttactggaagctctgcaactgggagcaaaattatgacagctgcagctcagctgatcaagcctgtttcactagagcttggtgggaaaagcccaatcattgtttttgaggatgttgaccttgacaaggctgctgaatggaccatatttggttgcttctggacaaatggtcagatatgcagtgcaacttcccgccttattgtacatgaaagtatagcaacagaatttttgaataggattgtgaaatgggtcaaaaacatcaaaatttctgatcccttggaagaaggttgcagactaggccctattgttagtgaaggacagtatgaaaagatattgaagtttatctcaaatgctaagagtgagggtgcaaccattttgactggtgggtctcgcccagagcatctaaagaagggattctttgttgaaccaactgtcataactgatgtaactacctccatgcaaatttggagagaagaagtatttggaccagttctctgtgtaaaaacatttagcactgaggaagaagctattgatctagcaaatgacactgtatatggcttgggttctgctgtaatatcaaatgatctagaaagatgtgagcgcattactaaggcttttaaggctggaattgtgtggattaattgctctcaaccatgcttcactcaagccccatggggaggcattaaacgcagtggttttggtcgtgaattaggagaatggggacttgataattacttgagtgtgaagcaagtgacccaatatatctctgatgaaccgtggggctggtaccagtctccttcaaggctgtgataggtatccaaaagctaacattaataagttgtgggtaatatcaaattatgattatgaccccaaagtcgagaagacatgatgtctatgtataacattgaaatggtttgcactttgcagtcaagattatgttggtagtgtttttatttgatttgtttatggttggctccaccacatgcttctaatgtttgaatttcatcatggaagacttccatcattacattatattgaagcatttcttgcgctcaaaaaaaaaaaaaaaa

SEQ ID NO: 4756 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 4757 - DNA, 1795 bp, Triticum aestivum
  misc_feature (1)..(1795): Ceres cDNA ID no. 21995944
  misc_feature (1)..(1795): Ceres CLONE  ID no. 747110
  misc_feature (1)..(1795): Also known as  Ceres CDNA ID no. 25088311
atttgtgttcgcgactcgcgaggattcccctctccctcgatccccttcttgacccgtgccccgtccgccatggttccctctccccgtgcacaaacatagctccccccacgcagccatgggcaccaatttcccgcagagccaccacctccagaacacgcccttctcgctccccaggaagcaattcctcacctacatcctctacgccctcctccccctcgcgctcttccactacctcctcttcaacccgctggccgcgcccaagccgccgctcctggcgcgagaggcggcgccgtcccagcacgggcacgcgcccgtcaatgcgcttgaggagcagctgcccccgccccctcccggccgagggggcgaagtgttggcattgggggaaactcaaggcggggacgtgtcggcgtcaggatccgcgtcgccggcgtgcgactactccgacggcgagtgggtgccggacgggcgcccgccgctgtacgacgggacgagctgcggcaccatcaaggacggccagaactgcatggcgcacggccgcccggacaccgggtacctccactggcggtggcggccgcggcggtgccacctccccgccttctccccggaggcgttcctccgctggctccgcaacaggcacctggccttcgtcggcgactccatggcgcgcaaccagggcgagtcgctgctctgcctcctcgcctcccgctcccggccggacctcgtgtaccgggacggcgaggagaacaagttccggcggtgggtcttccgggagtacaacgccaccgtgtccatcttctggtcgccgctcctggtgagggtcgtcgagaaggcggagcaggacggcgtgcggcacaacaacgtgttcctcgactcgttcgacgagcggtggatgtcgcagctgggcgcggtcgacgcggccgtcctgtccgtcgggcactggttcctgatccccggcgtctaccacgacggcggcagggtcgtgggctgccacgactgcgcggacctcaacctcaccgagacggccttcttcggcgtgttcaaggaagccgtgcaccgcacgctcgccgaggtcgcccggcggcacggcgcggacaggaaggtggtcgcggtcaccacgttctcgccggcgcacttcgagggggactgggacaaggccggcgcgtgccccaggagacacccgtacagggaggacgagaaggagctgggctacacggagaatgagatgaggaagaccgtcctggaggcggtggccgcccacgccggcgacgggcccctgcggtttgcggcgctcgacgtgacgaagctggccaacctgcggccggacggccacccggggccgtacatgcgcagcgacccgttcgccggcggggcggacgcgcgggtgcagaacgactgcgtgcactggtgcatgcccggcccgatcgacacgttcaacgagatcctgctacagaccgtcgcggggtgaccgccatgatcgtgagttggtgacatctctgatcgtgcgctgagttgtgtctgtgatctaggaaccgagaattttgggccagtgagcgtgcgtgatgcgtaatgattcttttgctcgtcggtcagaggattagggtacgagataggtcgtgatgtgctgtggtgtgctttggtatgctgggagtatgaattgctttgaggtcctagaaggtctaatttgctgacgaatctgtaagttgtaattttcagaaacagactgctagttatcagggttgtgttttgccaaaaaaaaaaaaaaaaaaaaaaaaaaaaaagaaaaaaaaaaaaaaaa

SEQ ID NO: 4758 - protein, 449 aa, Triticum aestivum
  misc_feature: PFam Name: Drf_FH1; PFam Description: Formin Homology Region 1
  misc_feature: GI Number: 51535844; NR Description: leaf senescence protein-like [Oryza sativa (japonica cultivar-group)] >gi|51535124|dbj|BAD37787.1| leaf senescence protein-like [Oryza
  misc_feature: GI Number: 50899900; NR Description: leaf senescence protein-like [Oryza sativa (japonica cultivar-group)] >gi|49387686|dbj|BAD26032.1| leaf senescence protein-like [Oryza
  misc_feature: GI Number: 51535842; NR Description: leaf senescence protein-like [Oryza sativa (japonica cultivar-group)] >gi|51535122|dbj|BAD37785.1| leaf senescence protein-like [Oryza
  misc_feature: GI Number: 51535843; NR Description: leaf senescence protein-like [Oryza sativa (japonica cultivar-group)] >gi|51535123|dbj|BAD37786.1| leaf senescence protein-like [Oryza
  misc_feature: GI Number: 51535841; NR Description: leaf senescence protein-like [Oryza sativa (japonica cultivar-group)] >gi|51535121|dbj|BAD37784.1| leaf senescence protein-like [Oryza
MGTNFPQSHHLQNTPFSLPRKQFLTYILYALLPLALFHYLLFNPLAAPKPPLLAREAAPSQHGHAPVNALEEQLPPPPPGRGGEVLALGETQGGDVSASGSASPACDYSDGEWVPDGRPPLYDGTSCGTIKDGQNCMAHGRPDTGYLHWRWRPRRCHLPAFSPEAFLRWLRNRHLAFVGDSMARNQGESLLCLLASRSRPDLVYRDGEENKFRRWVFREYNATVSIFWSPLLVRVVEKAEQDGVRHNNVFLDSFDERWMSQLGAVDAAVLSVGHWFLIPGVYHDGGRVVGCHDCADLNLTETAFFGVFKEAVHRTLAEVARRHGADRKVVAVTTFSPAHFEGDWDKAGACPRRHPYREDEKELGYTENEMRKTVLEAVAAHAGDGPLRFAALDVTKLANLRPDGHPGPYMRSDPFAGGADARVQNDCVHWCMPGPIDTFNEILLQTVAG

SEQ ID NO: 4759 - DNA, 1709 bp, Triticum aestivum
  misc_feature (1)..(1709): Ceres cDNA ID no. 21995945
  misc_feature (1)..(1709): Ceres CLONE  ID no. 748712
  misc_feature (1)..(1709): Also known as  Ceres CDNA ID no. 24407662
atcatcatgtcatctgcctcctcatgcaaatgatgccaagaagtgataagcagcaggcgcgagggtgatagatcagcgagagccgaacgccgctcgaatctcagcttgattagctccgtggacttgcaaaaaggcggcgcgtttgaggagattcggcggggccctggtgccgggaagatgaacaaggacaggtcccggatctcggcggacggcggcggcggcgacggcctgccgccgcagccgtcgcgccgctctgcgactcccccgccggagtacgacatcagccgcatgccggacttccccaccaggaacccgggccaccggcgcgcgcactccgagatccttagcctccccgacgacctcgacctctgcgcgcccgggggcggcgacgggccctcgctgtcggacgagaacgacgaggagctcttctccatgttcctcgacgtggacaagctcaactcgtcgtgcgggccgtcgtcggaccaggcggagtcgtcgtcagccgctgctgccggcgggggcgaggcggccagggcgggccacgtgatgaggccgaagcaccagcacagccagtccatggacgagtcgatgtcgatcaaggccgaggacctggtgggggcgccggggatggaggggatgtccactgtggaggccaagaaggcggtgtccgcggcgaagctggccgagcttgctcttgtcgaccccaagagggcaaaaaggatttgggctaatagacaatccgcggcaagatcgaaggaaaggaaaatgcgctatattggtgaacttgagcgcaaggtacaaaccctgcagacagaagcaacaacattgtcagcccagttgtcattgctacagagagataccagtgggctaacaagtgagaatagtgaattgaagatacgtctgcagaacatggagcagcaagtccacctacaagatgctctaaatgacaccctgaaaacagaggttcagcggctgaaggtggcaacaggccagatgggcaacggtggggggatgctgatgaactacggcggcatgtcgcaggcgccacaccagttcggaggcagccagcagatgttccacagcaaccagtccatgcagtctctcctagcgacgcaccagctgcaacagctccagctccatcagcagccccagcagcagcaacagccgatgcgccctcagcaccaccagcagcagcagcagccactgcacccgctgcaagcacagcagttccagcaggcggcgcgcgacctcaagatgaaagggccgatgtggggcgacgggaagtcgccgggaggcggcggcatctgaaacaactaggtccagagatgataatgatgatgatgatgatgatgatgatgcgcaggtgtagtggctttggtgttggcttttttagtttcggttgaacagttgggacgatcggtcacaggtgttgacagtgtcgtgggaggcgtttgtttgtagttgttgaaggaagtcactttgggaattctaggttgaaccttttggttttggtccggtagaagatgcattgttgcgtccagttatgggcataccccatgttgttgttgttgttgttgttgttgttgttgttaacctaaactcaggcactgatgggtttgcccgttgggcatgttagagggaaaatgaacaggctaattgcatgactgttagtgctggaaccattttatttgtcaaaaaaaaaaaaaaaa

SEQ ID NO: 4760 - protein, 376 aa, Triticum aestivum
  misc_feature: PFam Name: bZIP_1; PFam Description: bZIP transcription factor
  misc_feature: PFam Name: bZIP_2; PFam Description: Basic region leucine zipper
  misc_feature: GI Number: 21553831; NR Description: transcriptional
  misc_feature: GI Number: 21360501; NR Description: At2g31370/T28P16.14 [Arabidopsis thaliana] >gi|16429|emb|CAA43366.1| posF21 [Arabidopsis thaliana] >gi|4589968|gb|AAD26486.1| bZIP transcription factor (POSF21) [Arabidopsis thaliana]
  misc_feature: GI Number: 20465783; NR Description: putative bZIP transcription factor [Arabidopsis thaliana] >gi|18377632|gb|AAL66966.1| putative bZIP transcription factor [Arabidopsis thaliana] >gi|2651296|gb|AAB87576.1| putative bZIP
  misc_feature: GI Number: 2246376; NR Description: b-Zip DNA binding protein [Arabidopsis thaliana] >gi|25453519|pir||T52624 b-Zip DNA binding
  misc_feature: GI Number: 39579226; NR Description: bZIP transcription
MNKDRSRISADGGGGDGLPPQPSRRSATPPPEYDISRMPDFPTRNPGHRRAHSEILSLPDDLDLCAPGGGDGPSLSDENDEELFSMFLDVDKLNSSCGPSSDQAESSSAAAAGGGEAARAGHVMRPKHQHSQSMDESMSIKAEDLVGAPGMEGMSTVEAKKAVSAAKLAELALVDPKRAKRIWANRQSAARSKERKMRYIGELERKVQTLQTEATTLSAQLSLLQRDTSGLTSENSELKIRLQNMEQQVHLQDALNDTLKTEVQRLKVATGQMGNGGGMLMNYGGMSQAPHQFGGSQQMFHSNQSMQSLLATHQLQQLQLHQQPQQQQQPMRPQHHQQQQQPLHPLQAQQFQQAARDLKMKGPMWGDGKSPGGGGI

SEQ ID NO: 4761 - DNA, 2021 bp, Triticum aestivum
  misc_feature (1)..(2021): Ceres cDNA ID no. 21995948
  misc_feature (1)..(2021): Ceres CLONE  ID no. 783674
  misc_feature (1)..(2021): Also known as  Ceres CDNA ID no. 24437808
cttttcctttccttcccttcgtctcctaggtttagcgccccacgcgaaccccaccgtaccaacccaccagcgggcgtccctcccgcagcggttgctctgtcggcttcctgctgcccccgctcccttcatggtggccgcccaatcgtgaggctgcgctcaacgatcagaagatgaggcgctatgccgctgtgctgagggtcgctgtggtgggcctgttggtgctcggcctcgccctccctccgctggccgcggcgctgcggcctctcagggagcgcgtcgcgtccgccggagccgcggcctcctccggatcgtgggccgatgagcatgcattctacaagagggatgataatgacatgagcccatattcatggaatattacaggaacatataaaggaagttggagctttgctggtgctacaaatggttcttctaggtttcttgagttcatgacatctaaaggcgactcggttttggaattactgagtacaccaacaaagataagcggggtacactatgttcagggaacaataacattccatgatgttattgacaaatcacatgatcgtggggctgctcaaataaggttagaaggcgtgtatatatggccttttagacaacttcgtatggtggcaaacagcggtgcagatggtgaaccgcttcaagaagaggattacttcttgtcaaatccataccatctgctgcggattttctcctctcaagttttccaagattcttctgaagagaagaaccgaaggaagaactctctcacacatgacatggagaaacactgtaacatagaaatagccgctaaagtggtccgggtgtcaactaaccaaaatgaaggagagcatgagaagtaccgattggagggtttgatggaaagtccatcagtggatgatgatggagaatgcttctcatctatcttgctaaattcaacatcgctgaatgttgaagcttattacaacaaagcagttaactatacactgatggtcacttttatctcttttctccaagttttgctgcttattagacaaatggaacacagcaacacccagtcaggagctgctaaggtgtctattattatgattgggcaacaagctatcatggatgcatatctttgtctactgcatctgactgctggaatattggttgagtcactctttaatgcctttgcaacagctgccttcttcaaattcgttgttttttctatttttgagatgaggtatcttcttgctatatggaaagcaagtaggccattgaacagtggagaaggttgggaaataatgaggcgtgaactttctgttctttacagccgcttttacggcattcttttgggaggaatccttctcatgtatgagttgcacaatttcttgcgcccgcttcttttcctgatgtactccttttggattcctcaaattgtcacgaatgtcatccgggatacaagaaaaccgctgcaccctcagtatattttaggcatgactgctacccgggtcgccatcccgctatatatatttggttgtcctagcaacttcatgcgcattgagcccgacaagaaatggtgcatagctgtgacggcattcatgggtatccaagcagctgtgctgctgctccagcactatcttggttctcgctgctttattccccgccagatcctccctgagaaatactgctaccacaggaaggtagaggatagcacaaatcagcccattgattgtgtaatctgcatgactacaattgatctctcccaaagaacaagtgaatacatggtggcaccgtgcgagcatatattccactcgggctgtttacaacgttggatggacatcaagatggagtgcccaacttgcaggcgctctctaccaccagcttagaggaacaatactttgtacaatatatagttgacaaaaagtaggtagcccagccaaagtgcctatatctcagctcgagctcagatgcgaccttaatcctccccatgtatactggccggtataaatattgtatttgaaacaaaaaaaaaaaaaaaa

SEQ ID NO: 4762 - protein, 565 aa, Triticum aestivum
  misc_feature: PFam Name: zf-C3HC4; PFam Description: Zinc finger, C3HC4
  misc_feature: GI Number: 42569190; NR Description: zinc finger (C3HC4-type RING finger) family protein [Arabidopsis thaliana] >gi|42570835|ref|NP_973491.1| zinc finger (C3HC4-type RING finger)
  misc_feature: GI Number: 30687941; NR Description: zinc finger (C3HC4-type
  misc_feature: GI Number: 6322817; NR Description: Transmembrane Ubiquitin Ligase; Tul1p [Saccharomyces cerevisiae] >gi|549667|sp|P36096|YKD4_YEAST Hypothetical 87.9 kDa protein in PTM-IRX1 intergenic region precursor >gi|539155|pir||S37855
  misc_feature: GI Number: 41581287; NR Description: possible RING finger
MRRYAAVLRVAVVGLLVLGLALPPLAAALRPLRERVASAGAAASSGSWADEHAFYKRDDNDMSPYSWNITGTYKGSWSFAGATNGSSRFLEFMTSKGDSVLELLSTPTKISGVHYVQGTITFHDVIDKSHDRGAAQIRLEGVYIWPFRQLRMVANSGADGEPLQEEDYFLSNPYHLLRIFSSQVFQDSSEEKNRRKNSLTHDMEKHCNIEIAAKVVRVSTNQNEGEHEKYRLEGLMESPSVDDDGECFSSILLNSTSLNVEAYYNKAVNYTLMVTFISFLQVLLLIRQMEHSNTQSGAAKVSIIMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLFLMYSFWIPQIVTNVIRDTRKPLHPQYILGMTATRVAIPLYIFGCPSNFMRIEPDKKWCIAVTAFMGIQAAVLLLQHYLGSRCFIPRQILPEKYCYHRKVEDSTNQPIDCVICMTTIDLSQRTSEYMVAPCEHIFHSGCLQRWMDIKMECPTCRRSLPPA

SEQ ID NO: 4763 - DNA, 1080 bp, Triticum aestivum
  misc_feature (1)..(1080): Ceres cDNA ID no. 21995949
  misc_feature (1)..(1080): Ceres CLONE  ID no. 787059
  misc_feature (1)..(1080): Also known as  Ceres CDNA ID no. 24409882
acccagccaaacccccacgatttcatctcctccaaacccaaccgccgccgccgccgccggctcctcgtcgccccgccatgccgccgcggaagcgcccgctggaaccgtcctcgggcatgccagcccaaccggatgccaagcccgtcatttctccggcctccaaatccacctccgcccccgcccccgcccccgcctccgcgccggagatcctgcctgcctccatcctcaacaacctcccggggccggagcgggaggtctacaagcgcatctacgaggcgggcaacaagggaatgtggagccaggacatccgctacgcgatgaagctcgccgccccgaccctcaccaagctcacccgcgccctcgtccagcggggcatcctcaaggaggtcacggatgtccgccaccgcgggaagaaggtcttcatggacgcccgcatcgagccctcccccgagatcaccggcggaacctggtatcacaacggccagctcgataccgacgccgtggcggccgtgcgccgcaggtgcctggaccagattgacaggctcggcgctgccaccccggacatggtccacaagggcgtcgagagggaagaccccagggcagggtacgctatcgaccagatcagggacatcctgcagaccatggcgcttgacagggtgctggaggagtgcaggagcacaggggagggggagtttagcgctgtcagagccgggagggtgtgctaccggcggggtggcgcgccgcagggcggcatgatagaagggattccatgtggggtttgtcccaggatcgatgagtgctcgccggatggggtcatctcgccaaccacttgcgtctactacaagaagtggctgcagatggacttctaggcagggagccctcttcagcatgtgaaatgtgctgggatgggttggtgaatcgtcgttagtatacactttgtgggattgccgtacttctgatcatatggtgttgtttttgtgctctagaatgtggtagtcatgccaggtgcataccttatttgagtatttatactgataatcagttacagagctaaaaaaaaaaaaaaaaaaaaaaaaaaaa

SEQ ID NO: 4764 - protein, 263 aa, Triticum aestivum
  misc_feature: PFam Name: RNA_pol_Rpc34; PFam Description: RNA polymerase
  misc_feature: PFam Name: FH2; PFam Description: Formin Homology 2 Domain
  misc_feature: PFam Name: Pyr_redox_2; PFam Description: Pyridine
  misc_feature: PFam Name: Vitellogenin_N; PFam Description: Lipoprotein
  misc_feature: PFam Name: Extensin_2; PFam Description: Extensin-like region
  misc_feature: GI Number: 42542458; NR Description: Polr3f protein [Danio rerio]
  misc_feature: GI Number: 50756109; NR Description: PREDICTED: similar to DNA-directed RNA polymerases III 39 kDa polypeptide (RNA polymerase
  misc_feature: GI Number: 33598952; NR Description: DNA-directed RNA polymerase III 39 kDa polypeptide F; DNA-directed RNA polymerases III 39 kDa polypeptide; RNA polymerase III C39 subunit; polymerase (RNA) III (DNA directed) polypeptide F RNA polymerase III 39 kDa
  misc_feature: GI Number: 27703680; NR Description: similar to DNA-directed RNA polymerases III 39 kDa polypeptide (RNA polymerase III C39
  misc_feature: GI Number: 57104040; NR Description: PREDICTED: similar to DNA-directed RNA polymerases III 39 kDa polypeptide (RNA polymerase
MPPRKRPLEPSSGMPAQPDAKPVISPASKSTSAPAPAPASAPEILPASILNNLPGPEREVYKRIYEAGNKGMWSQDIRYAMKLAAPTLTKLTRALVQRGILKEVTDVRHRGKKVFMDARIEPSPEITGGTWYHNGQLDTDAVAAVRRRCLDQIDRLGAATPDMVHKGVEREDPRAGYAIDQIRDILQTMALDRVLEECRSTGEGEFSAVRAGRVCYRRGGAPQGGMIEGIPCGVCPRIDECSPDGVISPTTCVYYKKWLQMDF

SEQ ID NO: 4765 - DNA, 1767 bp, Triticum aestivum
  misc_feature (1)..(1767): Ceres cDNA ID no. 21995950
  misc_feature (1)..(1767): Ceres CLONE  ID no. 792717
  misc_feature (1)..(1767): Also known as  Ceres CDNA ID no. 23728332
agaacaaccaatttccttgaaaaatacaataccatggagcaaccgtgagaacgtcagttttctctctctccaaagtaaagataaaatacttgtaaacagataacggtctgcttcccccgctcccgcattttgtcgagcaccttgcaaggccgcgatgccgctcttccaccccgccccatgcgctcgccccgccgccgggcgcgccgcgtcccgcttttccggggcggtggtcgccgccagcggcgccggaggagcgcgtcctccgaaggcgcccccgcggcgcccgcgcggcaagccccggttctcgcggcagtcggccatcaagaagagcttccagcaggagcaggtggtctcctccacccccgtgcccgccgaccccaccgtcgccatcatcggaggcggagcctctggcctcgcctgcgcgtccgccctcgccgcccgcggcgtccgcgccgtcgtattcgacacgggtatgcacggcttaggtggcaggatggcgaccaggatggtcgacgacgggcggcggctggtgttcgaccacgcggcacagttcttcaccgcgagcgaccagaggttccaggagctggtcgatgagtgggtcgagaaagggttggcccgcgaatggaggggctcgatcggtgagctcgaggcaggtggccatttcacagctataccttcctcgacgccaaggtatatcggcgtgagaggaatgcgcccgcttgccgacgcaatgctgcccgagaatgacctgattaaagttgtaaggccttcctggataagcaagcttgagccgttcaacggcctgtggcgcttgtttgagaatgagaagccccagggtcaatatgatgccgttgtaatagcacacaatgggaaatgtgcaaaccgtctgctttctacgtcaggtctaccccaactgacaaggcaaatgaagagactggagttgagttctgtctgggcactacttgcggcatttgatgatcctcttccaatcccacaagataactcttatggcacatttgaaggagcatttgtgagagatattgattctctctcttggatggccaacaatactcggaagcttttccctttggagacaaacagacccgagtgctggacatttttcagcactgcttcttatggaaagaaaaacaaagttccacaggaaaatatcccaaatgccactgcagaaaaagtgaaacgagacatgcttgggggagttgaacttgctctggggctctcgacaggatctcttcagcgaccattttacacaagagtacagttgtggggtgcagctttaccgatgaacactccaggagtaccatgcatatttgatccccagggtcgagcaggcatttgtggtgactggctcacgggttcaagtatagaagcagcagtattgagcggaatgtctcttggagatcatgtcgctgactactttgcgagcggtggggaacggcctgaggagtttgcgattggtctggatgacagcctaaaccgagtagaaggtcatgacatcgggcagttcccaggtttggacccccagaagccacaggtagctgaacctcagctggcaccgagcatatgaactgtctttgcctgatcctgcactgatcattgctgtagcattgtaaatgatgagcagattgttttctcgcaagggattcgtgtgctgtagcctgcagaatgtaaaatatgtactatgtatgtagaaattttgtcgtaagctgatgcccctgtatgttttttccttcaaaaaaaaaaaaaaaa

SEQ ID NO: 4766 - protein, 476 aa, Triticum aestivum
  misc_feature: PFam Name: Amino_oxidase; PFam Description: Flavin
  misc_feature: PFam Name: FH2; PFam Description: Formin Homology 2 Domain
  misc_feature: PFam Name: Extensin_2; PFam Description: Extensin-like region
  misc_feature: PFam Name: Drf_FH1; PFam Description: Formin Homology Region 1
  misc_feature: PFam Name: Pyr_redox_2; PFam Description: Pyridine
  misc_feature: GI Number: 17545252; NR Description: PUTATIVE TRANSMEMBRANE PROTEIN [Ralstonia solanacearum GMI1000] >gi|17427543|emb|CAD14061.1| PUTATIVE TRANSMEMBRANE PROTEIN
  misc_feature: GI Number: 22655396; NR Description: At1g55980/T6H22.19 [Arabidopsis thaliana] >gi|17978976|gb|AAL47449.1| T6H22.19/T6H22.19 [Arabidopsis thaliana] >gi|22330276|ref|NP_175996.2| amine oxidase-related [Arabidopsis
  misc_feature: GI Number: 32475803; NR Description: probable deoxyribodipyrimidine photolyase [Pirellula sp. 1] >gi|32446346|emb|CAD76174.1| probable deoxyribodipyrimidine
  misc_feature: GI Number: 61100637; NR Description: putative transmembrane protein [Erythrobacter litoralis HTCC2594] gi|60737316|gb|EAL75573.1| putative transmembrane protein
  misc_feature: GI Number: 23470144; NR Description: COG3380: Predicted NAD/FAD-dependent oxidoreductase [Pseudomonas syringae pv. syringae
MPLFHPAPCARPAAGRAASRFSGAVVAASGAGGARPPKAPPRRPRGKPRFSRQSAIKKSFQQEQVVSSTPVPADPTVAIIGGGASGLACASALAARGVRAVVFDTGMHGLGGRMATRMVDDGRRLVFDHAAQFFTASDQRFQELVDEWVEKGLAREWRGSIGELEAGGHFTAIPSSTPRYIGVRGMRPLADAMLPENDLIKVVRPSWISKLEPFNGLWRLFENEKPQGQYDAVVIAHNGKCANRLLSTSGLPQLTRQMKRLELSSVWALLAAFDDPLPIPQDNSYGTFEGAFVRDIDSLSWMANNTRKLFPLETNRPECWTFFSTASYGKKNKVPQENIPNATAEKVKRDMLGGVELALGLSTGSLQRPFYTRVQLWGAALPMNTPGVPCIFDPQGRAGICGDWLTGSSIEAAVLSGMSLGDHVADYFASGGERPEEFAIGLDDSLNRVEGHDIGQFPGLDPQKPQVAEPQLAPSI

SEQ ID NO: 4767 - DNA, 1648 bp, Triticum aestivum
  misc_feature (1)..(1648): Ceres cDNA ID no. 21995951
  misc_feature (1)..(1648): Ceres CLONE  ID no. 797555
  misc_feature (1)..(1648): Also known as  Ceres CDNA ID no. 25088321
ctttattttcgttcggaaaggggcgcccgcgccgctgccgcttgcgttccaagaactattcaccctgctcctcgacctgttcttggattggatctatgcgtgcgccttctgatgaatgcgtttgcttggccctgtgactgtgaaggccccaaccccagctccaagtcctccagcaacgtcaccgtcgccaacttcccgtcgctcgccagtccgcatggagtagtggggtcgttgggcatggcggcgccgggaatggcatttgcggcggcggaggccggccggttctgcatgccgagggcggccgcgcagcagctcgagaactggggcgactccctctccggcatcgtcgtcaccagcccgctcaccgagacctccacggacctcgacgacagcggcgacaagcaccacgccctcatgggcggtggtggcgccggcgccggcgccggcggaggggcgcattcccagcgacgggtggggtgtgccgattcctctgaaagaacaggagatgagaagaccgcacggaggcttgcgcagaaccgcgaggcggcccggaaaagccgcatcaggaagaaggcttaccttgcgcagctggaaaacagccgatccaagctgacgcaccttgagcaagagcttcagagggcaaggcagcagggaatcttcatcgccggtggtggctccggtgactgctcaagcggaggcgccctggcgttcgatttggagtatgcgcggtggctcgacgaccaccagcgccacatcaacaacctcagggtggccgtgatcgcggacatgggcgacgacgagctgcgcatcctcgtcgagtccgtgctgctgcactacgacgagttcttcaggctcaagaacctggcgaccaagtccgacgtgttccacgtcctgtcgggcatgtggatgagccccgccgagcggttcttcatgtggctcggcgggttccgctcgtcggagatcctcaaggtactcgccagccaccttgagccgctgacggaccagcagctgatgggcatctgcaacctgcagcagtcgtcgcagcaggcggaggacgcgctgtcgcaggggatggaggccctgcagcaggcgctgtccgagacgctcgcggcggcggcgggggccgggccgctggccggcgccggcaacgtgaccaactacatggggcagatggccatcgccatggggaagctgagcacgctggagaacttcctccggcagggcgacctcctgaggcagcagaccctgcagcagatgcaccggatcctgacgacccggcaggccgcccgcgcgctgctcgtcatcagcgactacttctcccggctccgggcgctgagctccctgtggctcgcgcggccgagggactagcgtcggcgacgacgttcgatcggctggctgttggtgttgggccgccatgagagggagacgcccgctcgctgagctgcgaattggattcttccgagattttgagtacgtacaactagctagtatatgtaacacgcgacgttgtggatggctgctgccgagtagtagcggacaactagcagtgtagcggaatgtttatctaacttaatccatccggccggagtcttgattggaaagacgtcggtgtagaaagaacactctgcttccaaaaaaaaaaaaaaaa

SEQ ID NO: 4768 - protein, 418 aa, Triticum aestivum
  misc_feature: PFam Name: bZIP_1; PFam Description: bZIP transcription factor
  misc_feature: PFam Name: TT_ORF1; PFam Description: TT viral orf 1
  misc_feature: GI Number: 53793173; NR Description: putative ocs-element
  misc_feature: GI Number: 34921538; NR Description: Transcription factor HBP-1b(c1) >gi|1076782|pir||C54415 transcription factor HBP-1b(c1) - wheat (fragment) >gi|5926682|dbj|BAA02305.2| transcription factor
  misc_feature: GI Number: 297018; NR Description: ocs-element binding factor 3.2 [Zea mays] >gi|422029|pir||S33222 transcription factor OBF3.2 -
  misc_feature: GI Number: 47499874; NR Description: bZIP transcription
  misc_feature: GI Number: 34909110; NR Description: putative transcription factor HBP-1b [Oryza sativa (japonica cultivar-group)] >gi|13872972|dbj|BAB44077.1| putative transcription factor HBP-1b
MNAFAWPCDCEGPNPSSKSSSNVTVANFPSLASPHGVVGSLGMAAPGMAFAAAEAGRFCMPRAAAQQLENWGDSLSGIVVTSPLTETSTDLDDSGDKHHALMGGGGAGAGAGGGAHSQRRVGCADSSERTGDEKTARRLAQNREAARKSRIRKKAYLAQLENSRSKLTHLEQELQRARQQGIFIAGGGSGDCSSGGALAFDLEYARWLDDHQRHINNLRVAVIADMGDDELRILVESVLLHYDEFFRLKNLATKSDVFHVLSGMWMSPAERFFMWLGGFRSSEILKVLASHLEPLTDQQLMGICNLQQSSQQAEDALSQGMEALQQALSETLAAAAGAGPLAGAGNVTNYMGQMAIAMGKLSTLENFLRQGDLLRQQTLQQMHRILTTRQAARALLVISDYFSRLRALSSLWLARPRD

SEQ ID NO: 4769 - DNA, 1349 bp, Triticum aestivum
  misc_feature (1)..(1349): Ceres cDNA ID no. 21995952
  misc_feature (1)..(1349): Ceres CLONE  ID no. 797642
  misc_feature (1)..(1349): Also known as  Ceres CDNA ID no. 24404235
gaccgaatggcgcgccgcgcaagccgctaggcggtgagataaggcgccgagagaaagtcgcgagctgcgcttctcgctgtctccacactgcactctcttcttcctcactccctcctcgcgtgcttctgcgcggcgatcgatccatggagcaggcggcgtccttcctctcctccctcctcggcggcggcggcggcggccaggaaccgtcgggagagccggcggcgacggtggcgtccatcctcatataccccgtcaagtcctgcaggggcgtctccgtgcctcaggcacccgtcacctccaccgggttcaggtgggatcggcagtggctggtggtgaacgccaagggcagggcgctcacgcagagggtggagcccaagatggcgctggttgaggtggagttgccgccggcggccttcgacgaggactggcagcccacccccgactcctgcttggttataagagcacctggaatggacacgctgaaggtccctcttgttgcggagcgtgccacgctcgatgatgtctccgtgtgggagtggtctggttctgcctatgatgaaggagctgaagcagccgaatggctctccgcttatttagggaagccgagtcgactcgtgcggtttaaagaagactctgaaatcaggccgactgatcctgagtatgctcaaggttacaagctcaagtttacggatgtcttccctttcctcatggcctcccagggctcactggatgcactaaatgaggttcttaaggaacctgtaccaatcaatcgcttcagaccaaatattttagttgatggatgccacccatactcggaggatatgtggaaaaccataaagataaacaagctgacatttgacggggtgaagttatgcgaccgttgcaaggtaccagccgttaatcaagagaatggaatacttggcaccgaaccaacagaaactatgctgacattccggtccggtgaagtgatctgtccgagccacaagaataaacacaaggtgtactttgggcaatatctggtctgcaaggaatcggtatcagcaaagggaaaagggaggatcgtcaaggtcggcgacccggtttatgttcttcagacgtacccttcatccgacgaagttcctgcctgagcaagggcatggtagcacctacccatatactccctccgtcccaaaacaagtgtctcaactttagtactaatgttactaaaagttgagacatttttgggacagagggagtatgttttatgtgtgtttcgaagagacgacttgttggttgaatttgtgcacactctacgtaaattcaactttgcaataaagtaaatcagcttagcaataaaaaaaaaaaaaaaa

SEQ ID NO: 4770 - protein, 327 aa, Triticum aestivum
  misc_feature: PFam Name: MOSC; PFam Description: MOSC domain
  misc_feature: PFam Name: MOSC_N; PFam Description: MOSC N-terminal beta
  misc_feature: GI Number: 52077048; NR Description: molybdenum cofactor sulfurase protein -like [Oryza sativa (japonica cultivar-group)] >gi|52076954|dbj|BAD45965.1| molybdenum cofactor sulfurase protein
  misc_feature: GI Number: 52077049; NR Description: molybdenum cofactor sulfurase protein -like [Oryza sativa (japonica cultivar-group)] >gi|52076955|dbj|BAD45966.1| molybdenum cofactor sulfurase protein
  misc_feature: GI Number: 21593583; NR Description: unknown [Arabidopsis thaliana]
  misc_feature: GI Number: 42573573; NR Description: molybdenum cofactor
  misc_feature: GI Number: 48783960; NR Description: COG3217: Uncharacterized
MEQAASFLSSLLGGGGGGQEPSGEPAATVASILIYPVKSCRGVSVPQAPVTSTGFRWDRQWLVVNAKGRALTQRVEPKMALVEVELPPAAFDEDWQPTPDSCLVIRAPGMDTLKVPLVAERATLDDVSVWEWSGSAYDEGAEAAEWLSAYLGKPSRLVRFKEDSEIRPTDPEYAQGYKLKFTDVFPFLMASQGSLDALNEVLKEPVPINRFRPNILVDGCHPYSEDMWKTIKINKLTFDGVKLCDRCKVPAVNQENGILGTEPTETMLTFRSGEVICPSHKNKHKVYFGQYLVCKESVSAKGKGRIVKVGDPVYVLQTYPSSDEVPA

SEQ ID NO: 4771 - DNA, 1077 bp, Triticum aestivum
  misc_feature (1)..(1077): Ceres cDNA ID no. 21995954
  misc_feature (1)..(1077): Ceres CLONE  ID no. 824580
  misc_feature (1)..(1077): Also known as  Ceres CDNA ID no. 25088325
aaagaacatcagatttggtaagcattcacaccgacttgtccctttcttccgtctcccgccgccttcgatgaccttcgccggcgcttcacgccgccggcgagtatctggttcccatccccctctccctctcatagccatcgtcctcctgctagtcttcccacctcctccccgcgcttacgcgctccgcgtcccactgcgcgaggtcgcctccctcctctccctctcccactccctcctcacccgcgtcgcggtcgcccgcgccgaccggggggacgccgctgccgctgcccgcgctcgccgaatcgcctcgcacctgtccattctctcctctcgcggtgcgtgggcactcggctgggactacctccgccactatgctttctcctccgtcaccggatgcggcttctcctgcgccactgccgccgcccgcctcctcgccgctgcggcggaggcctcgcgcctaaagtcaccggtcgaggcggcccagtggctgcgccgtaattacggtgacctcctagccgccgctactcagctcctaaacggcctcctctctaccttctccgagcaggggccgctaagggaggtggtgttggatgtgaagtgggaggtggaggaaggggggttgctgaaggattgccttcaggcgggagccaaagacttggagggcttgcttatcattgccaaagatctctttggtgcttcaagggcttcttcacgccacagtgaactctgaggtgagtcctgaccaagaaactacagccgctccattctgtcctccaccgatgcagaatgcttcagatccaacagttcacctacacaattaaagctgctccagtttggtgactctgcatacaacacatcatgttaagctatcttatctcttcgggaaaaaggttaagctaccttatcttgtccagtagttcctgaacagaaagattaaccctactgtttaatgacattgcagctttaactgtgattgtaatagaattgtgtcccttgtgtccgttctgttgactttggagtactgtttttgctaaatgataacttttagatggttgcaaggcaaaaaaaaaaaaaaaa

SEQ ID NO: 4772 - protein, 220 aa, Triticum aestivum
  misc_feature: PFam Name: FH2; PFam Description: Formin Homology 2 Domain
  misc_feature: PFam Name: Extensin_2; PFam Description: Extensin-like region
  misc_feature: PFam Name: Pyr_redox_2; PFam Description: Pyridine
  misc_feature: GI Number: 34910804; NR Description: P0042A10.31 [Oryza sativa (japonica cultivar-group)] >gi|12328492|dbj|BAB21151.1| P0456A01.7 [Oryza sativa (japonica cultivar-group)] >gi|20161161|dbj|BAB90089.1| P0042A10.31 [Oryza sativa (japonica
MTFAGASRRRRVSGSHPPLPLIAIVLLLVFPPPPRAYALRVPLREVASLLSLSHSLLTRVAVARADRGDAAAAARARRIASHLSILSSRGAWALGWDYLRHYAFSSVTGCGFSCATAAARLLAAAAEASRLKSPVEAAQWLRRNYGDLLAAATQLLNGLLSTFSEQGPLREVVLDVKWEVEEGGLLKDCLQAGAKDLEGLLIIAKDLFGASRASSRHSEL

SEQ ID NO: 4773 - DNA, 1373 bp, Triticum aestivum
  misc_feature (1)..(1373): Ceres cDNA ID no. 21995955
  misc_feature (1)..(1373): Ceres CLONE  ID no. 824675
  misc_feature (1)..(1373): Also known as  Ceres CDNA ID no. 24408614
gctaaacaagtaagaaactttgctccaaaccccccggcggcgccgtctcctcctcccgcacctccgccgccgtgtctcacgggagcgagagaggcagcacaagacgacgacgacggcgaccgcgatgaggaggcacgcgctccagcttgtcgcgcgcgcggtgcgcgcctccgctccccgtccccatcctccgcgccatccccatcaggtcgccgcgctgagagcgtcgacgggtttcttctcgaccgaagccgctgcaggcgcgtctgcatctgctactgccgaagcggcgcagggcgggtcgaagtccgctgcggctgcggctgcgtcttctggcgcggcgcaggccgcttcgaagcccgcggcggtggcgtcgggctctgacggcggtggcggagggggcgggcgggatgggaagtcgcagcaaggggactccgggaagtccgtccgaggagggcccgtctcgtggttgagttttcttctgcttcttgtgaccggaggaggaatcatagtctactacgacaaggaaaagaagcgtcacattgaagagctgaagaacaatacgaactcagtaaagccagcacaaacagtaggaactgctgctattggtggtccattcagtcttctaaatcatgatgggaaagccgtcactgaaaaggatttcttgggtaaatggacgctgctatattttgggttcacacactgccctgacatctgtccagatgaactgcagaagatggctgctgctattaataaaatcaaggaaaaggcaaaactagaaattgtgccagtattcatctcagttgatcctgaaagagacactgttgagcaagtccatgactatgttaaagagttccatcaagatctcataggactaactggtacctctgatgaggtgaggaaggttgctcgtgcttatcgagtctactatatgaagacagaggaggagggttctgactaccttgttgatcattcaatcgtcatgtacttgatgaacccgaaaatggagtttgtcaaattcttcggcaagaactatgacgaagacaccctggccgaaggcatcatcaaagaggtccgagagcacaagaggagctgagcagaaatcacgcgcaccatttcgtcttgttgccatttagaacttattattatatccttaaataaacaaattctgactccgttgctgctgctactagttcacgcgttttcattttcccttttttaaatcttgatgcctcctttgttgtggcagattttgttgtaccggcactgttttgctatagtgcctgacaactgaaggtgctctgttgagcgatgtggttgttcagtactttgactcttgtgttaaaaaaaaaaaaataaaaaaaaaaaaaaaa

SEQ ID NO: 4774 - protein, 323 aa, Triticum aestivum
  misc_feature: PFam Name: SCO1-SenC; PFam Description: SCO1/SenC
  misc_feature: GI Number: 6403490; NR Description: putative SCO1 protein
  misc_feature: GI Number: 62656254; NR Description: PREDICTED: similar to SCO cytochrome oxidase deficient homolog 1 (yeast) [Rattus
  misc_feature: GI Number: 4759068; NR Description: cytochrome oxidase deficient homolog 1; SCO (cytochrome oxidase deficient, yeast) homolog 1 [Homo sapiens] >gi|15930128|gb|AAH15504.1| Cytochrome oxidase deficient homolog 1 [Homo sapiens]
  misc_feature: GI Number: 66852510; NR Description: mitochondrial
  misc_feature: GI Number: 31212937; NR Description: ENSANGP00000012964 [Anopheles gambiae] >gi|30176389|gb|EAA10098.2| ENSANGP00000012964
MRRHALQLVARAVRASAPRPHPPRHPHQVAALRASTGFFSTEAAAGASASATAEAAQGGSKSAAAAAASSGAAQAASKPAAVASGSDGGGGGGGRDGKSQQGDSGKSVRGGPVSWLSFLLLLVTGGGIIVYYDKEKKRHIEELKNNTNSVKPAQTVGTAAIGGPFSLLNHDGKAVTEKDFLGKWTLLYFGFTHCPDICPDELQKMAAAINKIKEKAKLEIVPVFISVDPERDTVEQVHDYVKEFHQDLIGLTGTSDEVRKVARAYRVYYMKTEEEGSDYLVDHSIVMYLMNPKMEFVKFFGKNYDEDTLAEGIIKEVREHKRS

SEQ ID NO: 4775 - DNA, 998 bp, Triticum aestivum
  misc_feature (1)..(998): Ceres cDNA ID no. 21995956
  misc_feature (1)..(998): Ceres CLONE  ID no. 825405
  misc_feature (1)..(998): Also known as  Ceres CDNA ID no. 25891160
acagaaacacggacctctacccccttctcgtctcccactcccatggcggaagccgacgcccaaacccagagcaacgcgcactcctcctcgccgccggcggaggcgtcgggcgagccgatccggccgccccaggtaggcgctccaagtgctgcttctccgacgtttccgctcatgtacccgatgctcgtcccagggatgttctcccagcagggtatggatgaccaggctcagggtccagggatatatgccatacaggagaatcagttcatgggggcgatgggaggttacgccccaaagacattcataccgctcgcttacaatataccaactgaaagtgtcggtccattggctggagaggagcaaggacaggatgctaggcagcaaaatggccctcaaagacaagttgttgtgaggaggtttcactttgcttttcagcttgacctggctctgatcatcaagttagcagcagtggtctttttgtttagccaagaaggatcaaaacaaaggctgtttcttctcatattgtttgcgtccatgatttacctatatcaaactggagcgattacacctttcttaagatggctccagcgggcgggaggtgtggccgctcgtccgccacaggctcctgctaaccgtgctcctctggctgcccagaatgatggcaacgagcaacctggtggaaacctcgcagatcctgcaaaccctgaccaagccgcggagaaccaggaaccaggagcagcagcgggcaacgagaaccagcaaggtgcagagggagaagcaaaccggcgcagctggctcggcggcatcttgaaagaggtccagctggtcgttgtagggttcgtcgcgtcgcttcttcctggttttcagcacaatgactaggtgaaagtcttcccgtggcagaatcgaatattggcaccgtaactgtttgttgtgacatagggaggaagtacaagcagaggatatatataaagcgggttcaaaaaaaaaaaaaaaaaaaa

SEQ ID NO: 4776 - protein, 278 aa, Triticum aestivum
MAEADAQTQSNAHSSSPPAEASGEPIRPPQVGAPSAASPTFPLMYPMLVPGMFSQQGMDDQAQGPGIYAIQENQFMGAMGGYAPKTFIPLAYNIPTESVGPLAGEEQGQDARQQNGPQRQVVVRRFHFAFQLDLALIIKLAAVVFLFSQEGSKQRLFLLILFASMIYLYQTGAITPFLRWLQRAGGVAARPPQAPANRAPLAAQNDGNEQPGGNLADPANPDQAAENQEPGAAAGNENQQGAEGEANRRSWLGGILKEVQLVVVGFVASLLPGFQHND

SEQ ID NO: 4777 - DNA, 1095 bp, Triticum aestivum
  misc_feature (1)..(1095): Ceres cDNA ID no. 21995959
  misc_feature (1)..(1095): Ceres CLONE  ID no. 836165
  misc_feature (1)..(1095): Also known as  Ceres CDNA ID no. 24408869
gtagactccaggaaagggaattcctcaaccatactgccttttcatggatcattccagctgaggattaaggagagaaattaaccgcatcccggggccgcgcgcgagtgtgatgcgcgcagcttgccggcggcgatggatttgccgtggctggacctccccttcaccttcctcacgctgctcctggccacccgcctggcgtacgactactacggcgtcgtcgccgccaccttcgccggcagcttcgcgctccagatcttcctcttctactgcttcgcgcgctggtaccgccacaccatgggcgcccgcgccgagctgctcccctcgtcgacgacgtcgcagcagcgcgacgaggggtccccgcccgtcctgaccccgctgctggaggcgtcgagcggggccggcgccgccgcggccgcgggggccctgctggccaaccggtgcctggccttcgtgttcatggtgttcgtcccgctcatcatcgtcgtcttcgagcggagccaggcggacgtcgtcgcctacgcgctctgcctcgccaacatactcgtcatggtcgtctggctctcgccggaggcgcccggctccatgtcggccaccaagtccttcctggggctcagcgacgacgaggacgaggagagcggcggcgccgaggacaagtgctgcgtctgcctcgccggcatgcgggaggagcaggccctccgggacctgccgcggtgcgggcaccggttccatgagaagtgcatcggcaagtggctcaagaccgggcacccgacatgccccgtgtgccgggcgctggtcttgccgccgccggccgtgcacgcggacccgttcgacgactctgttagccccgtctagctctgtttctcccctgcatccagtctaacaatcattcccatagaaaatcagacccctattcagcatcagacgctggaaatggtgaattgctgggtaatttgctactctctcttcttgataatgcgtagttgtctgaacaaatgttcgactgtagcctgtaaataaggactgtacatttttcctttttactctgaaggttgagatgacggagtcttgcatgtttttgcaaaaaaaaaaaaaaaa

SEQ ID NO: 4778 - protein, 239 aa, Triticum aestivum
  misc_feature: PFam Name: zf-C3HC4; PFam Description: Zinc finger, C3HC4
  misc_feature: PFam Name: Peptidase_S8; PFam Description: Subtilase family
  misc_feature: PFam Name: Pkinase; PFam Description: Protein kinase domain
  misc_feature: GI Number: 34909640; NR Description: P0503C12.20 [Oryza sativa (japonica cultivar-group)] >gi|20160754|dbj|BAB89695.1|
  misc_feature: GI Number: 48958501; NR Description: At1g24580 [Arabidopsis thaliana] >gi|42571635|ref|NP_973908.1| zinc finger (C3HC4-type
  misc_feature: GI Number: 25403249; NR Description: protein F21J9.24 [imported] - Arabidopsis thaliana >gi|9743343|gb|AAF97967.1|
  misc_feature: GI Number: 13592175; NR Description: ppg3 [Leishmania major]
  misc_feature: GI Number: 11359723; NR Description: proteophosphoglycan, membrane-associated [imported] - Leishmania major (fragment)
MDLPWLDLPFTFLTLLLATRLAYDYYGVVAATFAGSFALQIFLFYCFARWYRHTMGARAELLPSSTTSQQRDEGSPPVLTPLLEASSGAGAAAAAGALLANRCLAFVFMVFVPLIIVVFERSQADVVAYALCLANILVMVVWLSPEAPGSMSATKSFLGLSDDEDEESGGAEDKCCVCLAGMREEQALRDLPRCGHRFHEKCIGKWLKTGHPTCPVCRALVLPPPAVHADPFDDSVSPV

SEQ ID NO: 4779 - DNA, 1054 bp, Triticum aestivum
  misc_feature (1)..(1054): Ceres cDNA ID no. 21995961
  misc_feature (1)..(1054): Ceres CLONE  ID no. 844584
  misc_feature (1)..(1054): Also known as  Ceres CDNA ID no. 24373133
attgcataaatatgtgaaatcattatttcattaccagctgtgttaccagaggtgtaaagttaaaatggaatatatactaagctagagccgagaggtttcaaactatttgcattctaattccagcctttcaattttccaacagtatttcaatcaaatattaatgaccgtacttgacgtgctgggtgactccgatccatctactagggagattgctttgtctttaattgctgagatgctcaacaatcagaaagacgctatggaagaatctattgagattgttcttgaaaaacttctgcatgtgacgaaagatgtggtggcaaagatttcaaatgaagcgaacagatgcataaatgttttgttggcaaaatacgatcctttcagatgtcttgctgttgtagtacctcttttggtcagtgatgatgaaaagatgctcgttgtgtgtatcaactgtttgacaaagcttgtcgcgcaccttccccaagaggaattgatggatcagctgcctacatttttgccagcactgtttgatgcttttagtaaccaaagtccagatgttcgaaagagtgttgtattctgcttggtggacatctacatcatgctggggaaagcgtttgtgccgtacctggaagggctgagcagcacacagctgcgcttggtgaccatctacgcgaaccggatttcgcaggcaaggtccggcacggcgattgacagcgctaaccaatgaggtgtaacattcttctgttttatatggacattttgtttggtaggggagtgagatttttggggggtcccgtttgtttgtgtaggtttgtgtatagtatataagcaaacgattcccttgtatttgggtgtttcctggctttggttctttgtgtgattatgtattccttttaactttttctttttcttttggttagcatgtggagaggagtgttagcgagcttgtgttgtcttgggttgtacaactaggtgacaatgtacaaagaaaggaaatgtaacgtaatggagaaagtgtgtgcaagttttgtcttggcctttaaaaaaaaaaaaaaaa

SEQ ID NO: 4780 - protein, 187 aa, Triticum aestivum
  misc_feature: PFam Name: HEAT; PFam Description: HEAT repeat
  misc_feature: GI Number: 38346560; NR Description: OSJNBa0043L24.9 [Oryza
  misc_feature: GI Number: 50915862; NR Description: CLIP-associating protein-like [Oryza sativa (japonica cultivar-group)] >gi|47848182|dbj|BAD22009.1| CLIP-associating protein-like [Oryza
  misc_feature: GI Number: 50370047; NR Description: Unknown (protein for
  misc_feature: GI Number: 50603946; NR Description: LOC445862 protein
  misc_feature: GI Number: 13508653; NR Description: CLIP-associating protein
MTVLDVLGDSDPSTREIALSLIAEMLNNQKDAMEESIEIVLEKLLHVTKDVVAKISNEANRCINVLLAKYDPFRCLAVVVPLLVSDDEKMLVVCINCLTKLVAHLPQEELMDQLPTFLPALFDAFSNQSPDVRKSVVFCLVDIYIMLGKAFVPYLEGLSSTQLRLVTIYANRISQARSGTAIDSANQ

SEQ ID NO: 4781 - DNA, 1391 bp, Triticum aestivum
  misc_feature (1)..(1391): Ceres cDNA ID no. 21995962
  misc_feature (1)..(1391): Ceres CLONE  ID no. 848613
  misc_feature (1)..(1391): Also known as  Ceres CDNA ID no. 24409617
agtgcactcaggtaggcaccatgacgctcaagctcctaatggaagtgagcccgcaggagctgctggagtctctggcggagctccagaaccacgtgctcggctacgtcaagtccacgtcgctcaagtgcgccgtggacctcggcatcccggccgccatccataagcgcggcggcaccgccaccctggccgacatcgcggccgacgccaaggtgcacccggccaaggtcgccgacctccggcgcatgatggcgctgctcagtgcctcgggcatcttcaccaccaccgccgccgccggcgccggggacgacggcggtgcgatcgacgacacggccgccgtgcagtacgggctgaccacgacgggccgcttcctcgtcggctggcgcaacctgtcccccgtggcgcccttcttcgtgaactctctcatcgtctcctccttcttcgacctgcctgcctggctcacgagggagccggcgccggccggcgctgcgtccctcttcgagcaggcgcacggctgctcccggcaggagatggcgggcaaggacgccgggttcggcggcgtcctcagagacgccatgaccgccgacagcgagctcttcctggaagtcattattgttgacaagggccgcatcttccgcggggtgagctccatcgtcgacgtcggcgccggcaacggcgccggcacgcgggtggtcgccaaggcgttcccgcgcatcaagtgcaccgtgctggaccttcctcagtccgtcgggcaggccgccgccgccggcgacgacaacctgagtttcgtcgcaggtgacatgttcgaatccattccaccggcggatgctgtcctgctcaagaatgttctgcgtgactggggccacgacgactgcgtcaagatacttcaacgttgcaaggaagccatccccgccaggagtgccggagggaaggtgataatcatagacatggtaagagggtctctgctcggcgataagaagatcgccgaggtggaagccttgcaggacatgttcgcgatgtgcaccaacggggtggaacgggacgagagcgagtggaagaggatcttttccgacgctggattcggccaagattacaagatcatgccggtgttgggtcccttatcagtgattgagatctacccatgaaaagccggcaactagaccgtactaatggacaccctaccgtatgttgcacgtatacctgaactacaacagttttattattggtatgtgcacatgaactgtctgtattgttaataagcaggctgccttgttaaatatgcctgtattgtcatttttataccttctagtatctctcagctactccagcaacatgtatttcggtacagaaggagtattaaataagcgtagctctttctaaaaaaaaaaaaaaaa

SEQ ID NO: 4782 - protein, 1391 aa, Triticum aestivum
  misc_feature: PFam Name: Methyltransf_2; PFam Description: O-methyltransferase
  misc_feature: PFam Name: Dimerisation; PFam Description: Dimerisation domain
  misc_feature: PFam Name: Atrophin-1; PFam Description: Atrophin-1 family
  misc_feature: GI Number: 55297348; NR Description: putative o-methyltransferase [Oryza sativa (japonica cultivar-group)] gi|55297295|dbj|BAD69125.1| putative o-methyltransferase [Oryza
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 51535782; NR Description: putative O-methyltransferase [Oryza sativa (japonica cultivar-group)] >gi|51535174|dbj|BAD37886.1| putative O-methyltransferase [Oryza
AGTGCACTCAGGTAGGCACCATGACGCTCAAGCTCCTAATGGAAGTGAGCCCGCAGGAGCTGCTGGAGTCTCTGGCGGAGCTCCAGAACCACGTGCTCGGCTACGTCAAGTCCACGTCGCTCAAGTGCGCCGTGGACCTCGGCATCCCGGCCGCCATCCATAAGCGCGGCGGCACCGCCACCCTGGCCGACATCGCGGCCGACGCCAAGGTGCACCCGGCCAAGGTCGCCGACCTCCGGCGCATGATGGCGCTGCTCAGTGCCTCGGGCATCTTCACCACCACCGCCGCCGCCGGCGCCGGGGACGACGGCGGTGCGATCGACGACACGGCCGCCGTGCAGTACGGGCTGACCACGACGGGCCGCTTCCTCGTCGGCTGGCGCAACCTGTCCCCCGTGGCGCCCTTCTTCGTGAACTCTCTCATCGTCTCCTCCTTCTTCGACCTGCCTGCCTGGCTCACGAGGGAGCCGGCGCCGGCCGGCGCTGCGTCCCTCTTCGAGCAGGCGCACGGCTGCTCCCGGCAGGAGATGGCGGGCAAGGACGCCGGGTTCGGCGGCGTCCTCAGAGACGCCATGACCGCCGACAGCGAGCTCTTCCTGGAAGTCATTATTGTTGACAAGGGCCGCATCTTCCGCGGGGTGAGCTCCATCGTCGACGTCGGCGCCGGCAACGGCGCCGGCACGCGGGTGGTCGCCAAGGCGTTCCCGCGCATCAAGTGCACCGTGCTGGACCTTCCTCAGTCCGTCGGGCAGGCCGCCGCCGCCGGCGACGACAACCTGAGTTTCGTCGCAGGTGACATGTTCGAATCCATTCCACCGGCGGATGCTGTCCTGCTCAAGAATGTTCTGCGTGACTGGGGCCACGACGACTGCGTCAAGATACTTCAACGTTGCAAGGAAGCCATCCCCGCCAGGAGTGCCGGAGGGAAGGTGATAATCATAGACATGGTAAGAGGGTCTCTGCTCGGCGATAAGAAGATCGCCGAGGTGGAAGCCTTGCAGGACATGTTCGCGATGTGCACCAACGGGGTGGAACGGGACGAGAGCGAGTGGAAGAGGATCTTTTCCGACGCTGGATTCGGCCAAGATTACAAGATCATGCCGGTGTTGGGTCCCTTATCAGTGATTGAGATCTACCCATGAAAAGCCGGCAACTAGACCGTACTAATGGACACCCTACCGTATGTTGCACGTATACCTGAACTACAACAGTTTTATTATTGGTATGTGCACATGAACTGTCTGTATTGTTAATAAGCAGGCTGCCTTGTTAAATATGCCTGTATTGTCATTTTTATACCTTCTAGTATCTCTCAGCTACTCCAGCAACATGTATTTCGGTACAGAAGGAGTATTAAATAAGCGTAGCTCTTTCTAAAAAAAAAAAAAAAA

SEQ ID NO: 4783 - DNA, 1508 bp, Triticum aestivum
  misc_feature (1)..(1508): Ceres cDNA ID no. 21995963
  misc_feature (1)..(1508): Ceres CLONE  ID no. 861528
  misc_feature (1)..(1508): Also known as  Ceres CDNA ID no. 23491052
atcccttcccccccgcctccacccctcccactgcccccacgcagcagcccgcgcccccaacccacccaacgcgccgccgccgctagggtttctccccctccccccgccgccgcccgcgcagagccccgaatctccctacccgcggcagccatgagcgacggcaaggacaccctcgacctctccgccctcggcgccgccgtccccaacgccgcagagctcagcgccgaggacaaggccaacctcgtggagtcgattaagaacacgctgcagggattggcggcgcggcacacggacgtgctcgagagcctggagcccaaggtcaggaagcgcgtcgaggcgctcagggagatccagagccaacatgatgaatttgaggcaaagttttttgaggagagagctgcacttgaagctaaatatcagaagatgtatgaaccactgtactcaaagcgtcatgatgttgtcaatggtgtggttgaggcagaaggcgtaaccaaagattcaggtgaagccgctccagatgagaaagaggaaaagggtgtgccagatttctggttgaatgcaatgaagaaccatgaaatccttgctgaggagattcaagagagggatgaggaagctctcaagtacctcaaggatatcaagtggtacagaattactgagccaaagggtttcaagcttgagttccacttcaatactaatccattcttcaagaatgaagtgctttcaaaaacgtaccacatgatcgatgaagatgaaccaatcctagagaaggctattggaactgaaattgaatggtatcctggaaagagcttgacacaaaaggtgctaaagaagaagccaaagaaggggtcgaagaacactaaacctatcacgaaaatcgaaaattgcgagagcttctttaatttcttcagtccacctcaagttcctgatgatgatgaggaaattgatgaggatacagctgagcagttgcagaaccagatggagcaagattatgatatcggatctaccatcagagacaagattattccacatgctgtttcatggtttactggagaggccgctcaagatgaggactttgatggcatcatggatgatgatgaagatgacgacgaagatgacgaggaggatgaagatgaggatgaggacgacgaggaagatgaagacgatgacgatggtgataagaagaagggcgggcgagttcctgcaggggaaggtcaggcaggggagcggcccgcagagtgcaagcaacagtgagatccttcccagacgaagactatttttcttggctgaagaatgtttggttctgcttgatgctatgtctttgagtttggttccgaggagccagtgggggattgattgagttgggttttgtggaagaaccggtggggggtttctttgtgggggacatggtattatatactggtagcatttcaattgttgtattgggttgaaatactttgtccgctgctgcgagtgatcatcgatggtgcccgttaaaaaaaaaaaaaaaa

SEQ ID NO: 4784 - protein, 366 aa, Triticum aestivum
  misc_feature: PFam Name: NAP; PFam Description: Nucleosome assembly
  misc_feature: PFam Name: Mucin; PFam Description: Mucin-like glycoprotein
  misc_feature: PFam Name: Extensin_2; PFam Description: Extensin-like region
  misc_feature: PFam Name: Pyr_redox_2; PFam Description: Pyridine
  misc_feature: PFam Name: Upf2; PFam Description: Up-frameshift suppressor 2
  misc_feature: GI Number: 2129840; NR Description: nucleosome assembly protein 1 - soybean >gi|1161252|gb|AAA88792.1| nucleosome assembly
  misc_feature: GI Number: 45433309; NR Description: nucleosome assembly
  misc_feature: GI Number: 45433315; NR Description: nucleosome assembly
  misc_feature: GI Number: 45433311; NR Description: nucleosome assembly
  misc_feature: GI Number: 45433317; NR Description: nucleosome assembly
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGVTKDSGEAAPDEKEEKGVPDFWLNAMKNHEILAEEIQERDEEALKYLKDIKWYRITEPKGFKLEFHFNTNPFFKNEVLSKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVSWFTGEAAQDEDFDGIMDDDEDDDEDDEEDEDEDEDDEEDEDDDDGDKKKGGRVPAGEGQAGERPAECKQQ

SEQ ID NO: 4785 - DNA, 1263 bp, Triticum aestivum
  misc_feature (1)..(1263): Ceres cDNA ID no. 21995964
  misc_feature (1)..(1263): Ceres CLONE  ID no. 862049
  misc_feature (1)..(1263): Also known as  Ceres CDNA ID no. 24407140
aatcttggcctcgctggccgacggcgccgtttcctcgttactgcgcagccagccagttcttttcttccccgcacctctttagtcctcatcgccgacccagcgccgccgcccccgattgaggcgagttcgctgaaggtcgcagcgaagaaagacggtgactgccatggacgggggtggtgaacgggggatcaccaagaaagaggcggaggccgagtaccattgccacgacttcgagtgggaggacctccgggcggatgtggaagccaacccttccttctcctaccacctgtcccctttccccacgaccaccgcctcgccgcagccaccgtcatcggaggcctggagaagcttccaccgccgccacgcctccggcaagttcttcaaggaaagaaggtatttgctgaaggaatttcctgaactgcttaacagcaaaggatgtgcaaaggttttagaggtggggtgtgggaatggaagcactgttgtccccattctacgatgtagtccaagcatcactgtctatgcttgtgactgtagtgaagacactctagagaaagcaaatgagattgtgtgtaatacacagggatttgatgccaaggataggttccacccttttttgttggatgtttctaaagaaaaacttccaggttggttgttctgcaaatattgtcaaagttcaaacggaaaggttgtcgagctctcactagattcaagtcatcttcatacaaggggaaaaaacccaatctcactgaaagaagatgagtgttgtgttcgtggcatagattttattaccatgatatttacgttgtcagccatacccttcaacacaattccagctactctagagcgttgcgtgtctgttctgaaaccaggtggccttgttttgttcagggattatggcgtttatgacatgacaatgcttcgattcttgcctcaccaaagagtgggatttcgggaatatatgcgttctgatggcacctattcatatttcttctcattagacactgtaagagaactctttcatgctgctggactactagagttggagctggaatactgctgtgtcagatcagtgaatagaaagaatggcaagaacatgcaaagggtatgggtgcatggcaaatttaaaaaacccacaagtcaatgacttggacacttggtggttcctcggatgtgcttctaatgtatgaatgctctgccgcgaacatgtaaattaacaaatttaattatatatgctttcacttcttgtcaaaaaaaaaaaaaaaa

SEQ ID NO: 4786 - protein, 326 aa, Triticum aestivum
  misc_feature: PFam Name: CheR; PFam Description: CheR methyltransferase,
  misc_feature: GI Number: 46228861; NR Description: conserved protein,
  misc_feature: GI Number: 20042939; NR Description: similar to Homo sapiens
  misc_feature: GI Number: 31233674; NR Description: ENSANGP00000022786 [Anopheles gambiae] >gi|30174616|gb|EAA43537.1| ENSANGP00000022786
  misc_feature: GI Number: 50732822; NR Description: PREDICTED: similar to
  misc_feature: GI Number: 44890548; NR Description: Zgc:56175 protein [Danio
MDGGGERGITKKEAEAEYHCHDFEWEDLRADVEANPSFSYHLSPFPTTTASPQPPSSEAWRSFHRRHASGKFFKERRYLLKEFPELLNSKGCAKVLEVGCGNGSTVVPILRCSPSITVYACDCSEDTLEKANEIVCNTQGFDAKDRFHPFLLDVSKEKLPGWLFCKYCQSSNGKVVELSLDSSHLHTRGKNPISLKEDECCVRGIDFITMIFTLSAIPFNTIPATLERCVSVLKPGGLVLFRDYGVYDMTMLRFLPHQRVGFREYMRSDGTYSYFFSLDTVRELFHAAGLLELELEYCCVRSVNRKNGKNMQRVWVHGKFKKPTSQ

SEQ ID NO: 4787 - DNA, 1022 bp, Triticum aestivum
  misc_feature (1)..(1022): Ceres cDNA ID no. 21995969
  misc_feature (1)..(1022): Ceres CLONE  ID no. 886961
  misc_feature (1)..(1022): Also known as  Ceres CDNA ID no. 24410625
agcagctcatttgcgcgcgccataccggccggcaccaccaaaagcaaatgaaaccgcttttggattagttaattgcgaattactacgattcaggtcggattttgacagggaaatcaacgccgcgatctttactactagtagtgtagtctggtggtgcagagcttgtgcgaggagcagagcagcgtgaccatggagacccagcaggagccggccaaagcgggtgcgatggtcgccggcgagccggccggcggcggcgccggacttctcgagaatggacctccggcgccaacaacagcacagcaaggacctgcagcccctccgggttcagcaactgacagagatgcggtgcttgccaaggtggagatgaatcggaaactgtcgatggttaaggcgtgggaggagaatcagaagagcaaggccgacaacagggctgagcataagacgtcatccatcctatcatgggagaacaccaagaaggccgcggtcgaagccaagctccgaacacgggaggagaagctggagaagaagaaggcggagtacgcggagaagatgcggaaccgggtcgcgatgatccacaaggaggcggaggagcagagggccgccgtcgaggcgaggcggcaggaggagatgatcaagtgccaggagatggccgccaagcaccgctcacaagggaccacgcccgccaagaagttcctcggctgtttcggctgaggagccactgaaatataatcatagtgatcgaaagttgagaactcgcttggctctgttctctctctactgctctttgctctgttcttttggaacatggatcataagcttgggtaatgcatggatgatggatctactgcttgcttttgtgtagtgtgatgcacatacatacataatgtaatgttgcatgttctgtcaggctgtgtgggatttggggttgctgtgtgagtgtatgtacgtactcggatttgagaaatgtcaagaaatgtttcttaacaaaaaaaaaaaaaaaaaaaaaaaaaaaaaaaaaaaaa

SEQ ID NO: 4788 - protein, 173 aa, Triticum aestivum
  misc_feature: PFam Name: Remorin_C; PFam Description: Remorin, C-terminal region
  misc_feature: GI Number: 50916024; NR Description: putative DNA-binding protein [Oryza sativa (japonica cultivar-group)] >gi|48717092|dbj|BAD22865.1| putative DNA-binding protein [Oryza
METQQEPAKAGAMVAGEPAGGGAGLLENGPPAPTTAQQGPAAPPGSATDRDAVLAKVEMNRKLSMVKAWEENQKSKADNRAEHKTSSILSWENTKKAAVEAKLRTREEKLEKKKAEYAEKMRNRVAMIHKEAEEQRAAVEARRQEEMIKCQEMAAKHRSQGTTPAKKFLGCFG

SEQ ID NO: 4789 - DNA, 1237 bp, Triticum aestivum
  misc_feature (1)..(1237): Ceres cDNA ID no. 21995970
  misc_feature (1)..(1237): Ceres CLONE  ID no. 887857
  misc_feature (1)..(1237): Also known as  Ceres CDNA ID no. 24411729
tcacatctcagcatcgatcacacattcatcgagttctttcccgctctctcgtcagtctctgtagccagcttgagctagccacactctgttcttcgaccacaaccacctgtcctctgtaatggccgtcgtttgtgcgaaggacagtgctgcttgcagctgtgatgcttgcgagcgtggcacagctttgcatgggcgcgaggcggcgcatggagctgtaccggccggacccggctgacatgctctcctaccacaatggcgccgtgctccacggcgacattgccgtgtccgtcctctggtacggcaacttcaagccggcgcagaaggcggtgatcgtcgacttcctcctctcgctcaccgccgagacccaggccgcctcgccgtccgtcgcgcagtggtggagcaccatcgaccagcagtacctgtcccccgcgagcgcgaagtccaacggcgcgggcgcgaagacccgtgtccttctcgcggaccagctctccgacggcgagtgctccacgggcaagtccctcaccctcgagcagatcaccgccctggccgcgacggctagccccaagaaaggcggcgtcgcggtggtgttcacggcgcaggacgtggcggtggagggcttcggcatgggccggtgcagcctgcacggctccgacgccagctccggcacgacccacatctgggtcggcaacccggagacgcagtgtcccggcgcgtgcgcgtggcccttccaccagccagcctatggcccccaggacgcgcccctcgtggcgcccaatggcgacgtcggggcggacgccatggtcatgaacttcgcgagcatgctcgccggcgcggcgaccaacccgttcggcgacgggtactaccagggcagcagcgacgccccgctggaggccgccaccgcctgcccaggagtcttcggcaacggcgcgtaccctggctacgccggcgacctcaaagtggaccaggccaccggggcgagctacaattgcaatggcgcgcatggcaggaagtacttgcttcctgcgctctacgacccttccaagtccgcttgtggcactttggtctagtcactgtagtgcattccagcattatttttgttgttcttctgttcagaagttagtgtatatatgtcagaactgaagctatgtaattctttcatcgatgagatcctcatgtgtcggcaataatgttgatcaacgaaatgaaatcgggttattctcgaaaaaaaaaaaaaaaa

SEQ ID NO: 4790 - protein, 301 aa, Triticum aestivum
  misc_feature: PFam Name: Phi_1; PFam Description: Phosphate-induced
  misc_feature: PFam Name: Pyr_redox_2; PFam Description: Pyridine
  misc_feature: GI Number: 50912937; NR Description: putative phi-1 [Oryza sativa (japonica cultivar-group)] >gi|46805677|dbj|BAD17078.1| putative phi-1 [Oryza sativa (japonica cultivar-group)] >gi|46805966|dbj|BAD17260.1| putative phi-1 [Oryza sativa
  misc_feature: GI Number: 50912939; NR Description: putative phi-1 [Oryza sativa (japonica cultivar-group)] >gi|46805678|dbj|BAD17079.1| putative phi-1 [Oryza sativa (japonica cultivar-group)] >gi|46805967|dbj|BAD17261.1| putative phi-1 [Oryza sativa
  misc_feature: GI Number: 51964396; NR Description: PREDICTED P0627E03.37-2 gene product [Oryza sativa (japonica cultivar-group)] >gi|50912931|ref|XP_467873.1| putative phi-1 [Oryza sativa (japonica cultivar-group)] >gi|46805673|dbj|BAD17074.1| putative
  misc_feature: GI Number: 51535371; NR Description: putative phi-1 [Oryza
  misc_feature: GI Number: 50912929; NR Description: putative phi-1 [Oryza sativa (japonica cultivar-group)] >gi|46805674|dbj|BAD17075.1| putative phi-1 [Oryza sativa (japonica cultivar-group)] >gi|46805963|dbj|BAD17257.1| putative phi-1 [Oryza sativa
MLASVAQLCMGARRRMELYRPDPADMLSYHNGAVLHGDIAVSVLWYGNFKPAQKAVIVDFLLSLTAETQAASPSVAQWWSTIDQQYLSPASAKSNGAGAKTRVLLADQLSDGECSTGKSLTLEQITALAATASPKKGGVAVVFTAQDVAVEGFGMGRCSLHGSDASSGTTHIWVGNPETQCPGACAWPFHQPAYGPQDAPLVAPNGDVGADAMVMNFASMLAGAATNPFGDGYYQGSSDAPLEAATACPGVFGNGAYPGYAGDLKVDQATGASYNCNGAHGRKYLLPALYDPSKSACGTLV

SEQ ID NO: 4791 - DNA, 1187 bp, Triticum aestivum
  misc_feature (1)..(1187): Ceres cDNA ID no. 21995975
  misc_feature (1)..(1187): Ceres CLONE  ID no. 905160
  misc_feature (1)..(1187): Also known as  Ceres CDNA ID no. 24412424
aagcaattagtagcagaagacgccacgcaaagcccagtccggcgtcgcctcctcctcctccggcgatagggtttcccccgatggagcagccctccacctcctcgccggcggcgccgcccccgcccccgcggcggccgccgacgaaggtccggctgcggcgccagaggctggaggcgctcctgcaggagctccggcagacgctcgacgggatgggcgacgccgatctcggcgcctcgctctccgacgcggacgccggctccgaggcgcccgagtacggggacggcgagggcggcggagacgacgacgacgacggtgactcggcggcttcgatggccagcgactccgaccgcgccacggaccaggtgtttgatctccttaaatctaggtttgagtcaccagaatttcttcaggagttccatgaaattcaaaagtctgtatgtcaaaatggtgcggttgaattggataaatcatgggatgtaataaaggcgggagatgtgtgggaagatgatgacgacaatggatatgttcttgttaagccagaggatgcagctgaagggatagctttctttgtagccacatacttatcaacacttacaaaaaccaaggaattatctcctgatcgacttcagaaagcccttaagaagacattttcagccgagaagagaaaaggcaaacttcggaaggcatgggatgggacaaaagtcatttataatgtagcttcatggggtgctacagctgttggcatctacaataaccaatcaattcttaaggcagcaggcacagccattcagatgtcctggcgtgtggtgtccaagttcctgtgagtgatcggtggtggtgattgttgtaactggcgtgctacatttatttaggtaaaggataccacattggttggaaatgtccgagtagttgatatactgccgattgaagaattgtggtctagagtatgtctgttgggatgtttgaaggattgaggcttagcgtttaggtttgttgattgaaggcgcggaagcccatttaaataaattatgttggtgctagaatgtaaataggccatttatctggctgtgtgcggcaactgaagctcggcatatgtatccccaaaatgtaaatatgacattcatgtcaacaacattgcattgtgccagaataaactttgtgaatgaactgcaaaaaaaaaaaaaaaa

SEQ ID NO: 4792 - protein, 247 aa, Triticum aestivum
  misc_feature: GI Number: 50915302; NR Description: MADS box interactor-like [Oryza sativa (japonica cultivar-group)] >gi|47497407|dbj|BAD19444.1| MADS box interactor-like [Oryza sativa
  misc_feature: GI Number: 29367481; NR Description: unknown [Oryza sativa
  misc_feature: GI Number: 8655987; NR Description: Contains weak similarity to tail completion gi|5354213 from coliphage T4 gb|AF158101. ESTs gb|AA650799, gb|AA041054, gb|R29873, gb|AA712908 come from this
MEQPSTSSPAAPPPPPRRPPTKVRLRRQRLEALLQELRQTLDGMGDADLGASLSDADAGSEAPEYGDGEGGGDDDDDGDSAASMASDSDRATDQVFDLLKSRFESPEFLQEFHEIQKSVCQNGAVELDKSWDVIKAGDVWEDDDDNGYVLVKPEDAAEGIAFFVATYLSTLTKTKELSPDRLQKALKKTFSAEKRKGKLRKAWDGTKVIYNVASWGATAVGIYNNQSILKAAGTAIQMSWRVVSKFL

SEQ ID NO: 4793 - DNA, 1970 bp, Triticum aestivum
  misc_feature (1)..(1970): Ceres cDNA ID no. 21995976
  misc_feature (1)..(1970): Ceres CLONE  ID no. 906800
  misc_feature (1)..(1970): Also known as  Ceres CDNA ID no. 24411274
acagaaaaagcagctgacttgatgtggtataggttctccccctccctccctcactccctcaggcctgtccctccgccgtcccatcccaaaggggtttgatttgatttgatccgtgtggagggtggcgcagaggcaacgtggagcaaataatgcagccctgagtggcagcagctttgacgtgcgagtaggagcagcggcaccggagatctcgggctctggcatgggctcgttcgggatggagtggaaccagaggagctcggtgctgtgggactgggagaatttcccgccgataggcgagaaccccaagaacgcgatgcaggccgatccaagatttgccgccgttgcggctaccatggggaatgaaccgctccattcttctggcggtagcggcaccttctcttccagctcagagatggggtatggctcttccaagagctccatgtccgcgtcgatcgattcttcgaacagggctgggaacaacatggagttcagatttgcgcctgtcaaaaaccctgataggaacacgagcaagaacaccgagctgggtaaagttgataacacgagaactggaacatctccgtcgcctgtggtggcagtgagcagtggagagccggtgatcggcctgaagcttggcaagagaacttacttcgaggatgtctgtggagggcagaatgtcaagagctcgccatcgggtgctgcgagcgcgccaaacaaatctcctgctttgggcaagaaggcaaaggcggaacaacagaagccacataactcgtactgtcaggttgaaggctgcaaagtcgacctctcttctgttaaagattaccatcgaaagcacagagtctgtgaacttcactctaaggctccgaaagttgttgtcgctggtctggagcgacgcttttgccaacagtgcagccggtttcatgctttagctgagtttgaccagaaaaagcgaagctgccgtaggcgtctcaatgatcataattcccgcaggcggaagccacagccagaagcaatttctttcagttcatcaaggatgtctacgatgttttatgatgcaaggcaacagccaaatttcctatttggtcaggctccttatgttcaaatgagaagctgtggaagttcttcatgggatgacccaggaggcttcaaagttacacacacaaaagctccttggttaaaaccaacaactgctgcaggtgttcatgggatacatttatctagtcagcagatgtcggacaatattatgccacatggtgcacatcatggtttcgatgggttcatggcattcaagggaacttgtacaaagttccctaatcaaggtgtccaagcttctgctgttgcttccgactccagtggagccccggatcttcagcatgctctctctcttctgtcaagcaacccagtgggtgctgccaacctccagccaagtccccagatgcactctggggtggcagccattgccggcgcccccaaccccgcgatgcacgcgctgggatcatcgacggggctctggctagacggcagccagcccctcgatgatcacccgcggttccaggtcttcgagcgcttgggggaccatgacagcgagctccagctcccaaagccttcctacgaccatgcctcgcacttcgaccggatgcactgatgatggctccggtccactgggtgcgtgattttgtcacgcgatcaacgccgtttcttcggcctgaaaatcgtaatgctgaatttactttgctttgacgccgttgcctgtctagaggcctatggttttggcaatgcctagaataaaggcgcacacgaacagacttaggatcaaatcgacccagttgtgttgccatggagaaagattttgatccatcattagccatttgtctgaataattctgaacttgctatgtttctgaatggcttctccaactgtaactgatcatggttttaaattcttgatgatgacaaaaaaaaaaaaaaaaaaaa

SEQ ID NO: 4794 - protein, 473 aa, Triticum aestivum
  misc_feature: PFam Name: SBP; PFam Description: SBP domain
  misc_feature: GI Number: 50905195; NR Description: putative squamosa promoter binding protein 2 [Oryza sativa (japonica cultivar-group)] >gi|42408998|dbj|BAD10252.1| putative squamosa promoter binding
  misc_feature: GI Number: 53791916; NR Description: squamosa promoter
  misc_feature: GI Number: 10177389; NR Description: squamosa promoter binding protein-like 2 [Arabidopsis thaliana] gi|5931649|emb|CAB56578.1| squamosa promoter binding protein-like 2 [Arabidopsis thaliana] gi|5931645|emb|CAB56576.1| squamosa promoter
  misc_feature: GI Number: 5931647; NR Description: squamosa promoter binding protein-like 2 [Arabidopsis thaliana] >gi|25456646|pir||T52604 squamosa promoter binding protein 2 [imported] - Arabidopsis
  misc_feature: GI Number: 50905649; NR Description: squamosa promoter binding protein-like [Oryza sativa (japonica cultivar-group)] >gi|49388973|dbj|BAD26190.1| squamosa promoter binding protein-like
MGSFGMEWNQRSSVLWDWENFPPIGENPKNAMQADPRFAAVAATMGNEPLHSSGGSGTFSSSSEMGYGSSKSSMSASIDSSNRAGNNMEFRFAPVKNPDRNTSKNTELGKVDNTRTGTSPSPVVAVSSGEPVIGLKLGKRTYFEDVCGGQNVKSSPSGAASAPNKSPALGKKAKAEQQKPHNSYCQVEGCKVDLSSVKDYHRKHRVCELHSKAPKVVVAGLERRFCQQCSRFHALAEFDQKKRSCRRRLNDHNSRRRKPQPEAISFSSSRMSTMFYDARQQPNFLFGQAPYVQMRSCGSSSWDDPGGFKVTHTKAPWLKPTTAAGVHGIHLSSQQMSDNIMPHGAHHGFDGFMAFKGTCTKFPNQGVQASAVASDSSGAPDLQHALSLLSSNPVGAANLQPSPQMHSGVAAIAGAPNPAMHALGSSTGLWLDGSQPLDDHPRFQVFERLGDHDSELQLPKPSYDHASHFDRMH

SEQ ID NO: 4795 - DNA, 1811 bp, Triticum aestivum
  misc_feature (1)..(1811): Ceres cDNA ID no. 21995977
  misc_feature (1)..(1811): Ceres CLONE  ID no. 907838
  misc_feature (1)..(1811): Also known as  Ceres CDNA ID no. 23406674
acacacgaaaaatcccaccttggccacgtctccgacccatccaccccacccacccccgagagtccccgtcgcggcggcgcccgaaccagtcgaggcgagatgtcggaccgccgggagaagcggccgtcagacgcggccggcgccggcgacggcccggaggccaagcgcgcccgcgagccggccgccccggcgttccccacgtacaaggacgcgcccgacctagcccccaagatccgtctcctctgcgagatcctggcttcctccgcctccgacgtggaggcggccctcgacgacgccgacgtccgcgtcaccacctccgacgtcgagcaggtgctccgcttctcctacgcgcacccgcgcggcgccgccgccttcttccgctgggcgggccaccgccacctgcaccaccagcactccccctactcgtggaacctcatcatcgacctcctcggcaagaaccgattgtttgatcccatgtgggacaccgtcggctccatgcgggcccagggcctgctctccctcgccaccttcgcctccgtcttctcctccctggcggccagccccaccagctcccccctcaaggcgtttgtggaaatgccgaggtacggcatggaccgcgacacgccggcgctcaactcgctgctgtccgcgctctgccgcgcctcccggctggatgacgcccgcgccgcgatccccgtggcacgtgcggaggccggcactcggccggatgccgactcctacgccatccttctggagggttgtgaggctgccggcaacgcggccgttgcgcgcgaggtgtttgacgaaatggtgcacgcgctcgacttcgatcctgccaatgtgcctgcctacgactctttccttacaacactggtttcaagtggctcttccacggcgctctcggatgcgatggagtatctggctgtcttgcgccggtacaggtgttcaccgggcgagaagtttcttcgtgctgcactggccgcacaccttgaggcacgtgaattgcgcagtgctgtggttctctgggatgactttgtccttcgccgggggctcgtcccagataaggaaatgtacaacacgatgatcatgttgcagggcactctggggcatgccgaggttactgtgaagtacctcgatgacatggccatctatggagtgtttcctgacacagacacatacaatgtggtcctcaagctcttgctcaaggggaggaagctccgggaggcgtcggcaatatttaaagagatggtcaagaacgagtgttggccaaatgaggcgaattgttcacttgcgctcagcgtgttcttggatactcgtgactgggagacagggatcaaggtgtggaaatgcatggcagcgaatagcctgcctccactggaggagggcggtaacatgcttgtatcaaagttgaaggatgagatgttgcctgaggcatgcaagtatgcagaggacatgatcgatcagggtatcaagttgagctcctcaacgctggcaaagctgaggcacagcctaggaaaggtcaagaaaggagacattcacgaccgcttgcttgcaaaatggaaggcgcactaggttcttctctcttatgtcatatactgtatggttttgggttatgtaggattgggaataggagatgactctcttcagttaacggtttcatgataacttgctttgctggaactataagaagttgttagtcgtgcatataatgtttgcagatgtggcaattcagttctgtaaactaggtgtgcaatttaacctgtcaggtcagaatggtttagtaaaaaaaaaaaaaaaaaaaaaaaaaaaaa

SEQ ID NO: 4796 - protein, 490 aa, Triticum aestivum
  misc_feature: PFam Name: PPR; PFam Description: PPR repeat
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Drf_FH1; PFam Description: Formin Homology Region 1
  misc_feature: GI Number: 50912049; NR Description: pentatricopeptide (PPR) repeat-containing protein-like [Oryza sativa (japonica cultivar-group)] >gi|41052650|dbj|BAD07498.1| pentatricopeptide (PPR) repeat-containing protein-like [Oryza sativa (japonica
  misc_feature: GI Number: 42565430; NR Description: pentatricopeptide repeat
  misc_feature: GI Number: 15228788; NR Description: pentatricopeptide (PPR)
  misc_feature: GI Number: 50918647; NR Description: putative reverse transcriptase [Oryza sativa (japonica cultivar-group)] >gi|21686921|gb|AAK71569.2| putative reverse transcriptase [Oryza
  misc_feature: GI Number: 50910193; NR Description: putative pentatricopeptide (PPR) repeat-containing protein [Oryza sativa (japonica cultivar-group)] >gi|47848296|dbj|BAD22160.1| putative pentatricopeptide (PPR) repeat-containing protein [Oryza sativa
MSDRREKRPSDAAGAGDGPEAKRAREPAAPAFPTYKDAPDLAPKIRLLCEILASSASDVEAALDDADVRVTTSDVEQVLRFSYAHPRGAAAFFRWAGHRHLHHQHSPYSWNLIIDLLGKNRLFDPMWDTVGSMRAQGLLSLATFASVFSSLAASPTSSPLKAFVEMPRYGMDRDTPALNSLLSALCRASRLDDARAAIPVARAEAGTRPDADSYAILLEGCEAAGNAAVAREVFDEMVHALDFDPANVPAYDSFLTTLVSSGSSTALSDAMEYLAVLRRYRCSPGEKFLRAALAAHLEARELRSAVVLWDDFVLRRGLVPDKEMYNTMIMLQGTLGHAEVTVKYLDDMAIYGVFPDTDTYNVVLKLLLKGRKLREASAIFKEMVKNECWPNEANCSLALSVFLDTRDWETGIKVWKCMAANSLPPLEEGGNMLVSKLKDEMLPEACKYAEDMIDQGIKLSSSTLAKLRHSLGKVKKGDIHDRLLAKWKAH

SEQ ID NO: 4797 - DNA, 2119 bp, Triticum aestivum
  misc_feature (1)..(2119): Ceres cDNA ID no. 21995978
  misc_feature (1)..(2119): Ceres CLONE  ID no. 908717
  misc_feature (1)..(2119): Also known as  Ceres CDNA ID no. 23733179
ctattgaacctattctcggaccaaggccatctcctttgcagagaatgtcatcatatcctcaccaagagccgcaatacaataatattgaactgattcgtgggaatggtagcagatttacaccagctttgatgcagcatccaaatggatttataccacctcaaatgccgccaccccatcaacaaaacggaatgctcccaattcaacactctccaccccagttctcacaactacatgcccagatgcttggtgcccaacattctccgccacaaaatctgcagatgtttggtcctcggcatccttcaccacaaatgatgggtagatttgatccaaattttgttatgcctgacttgagtgatcccagagccagatcgatgttacaccatggaaggcatggcccgcgctatcctccccaaggttttgagcctggtaatatgagaatggataataggtggcagcggttcagatccaagtacatgtccactgaagaaattgagaacatcgcaaggatgcagaaagctgccactcagatcaccgatccatatattgatgattactatcatcaagcttgtttggccagaaaatcagcaggagcacaactgaagcactacttctgtccaaccttgatcagagatacatcttctcgtacacgcagtaaggatgagccacatgcgtatcttcaggttgatgctcttgggaggcttccattttcctccatccgcaggccccgtccgctccttgatgttgaagaagcctctgaaccaagtgatagcactactgaaaaatctgcttcaaaatctcttgaccaagagccgatgctggctgctagaatcacaattgaagatggcctttgcctactactggatgtggatgatatagatcgtttgcttcactttagtaaacagccagatggtggtttgcaacttagaaacagaagacaggctcttctcgagcagctggcagaatcactgcaattagttgatccacttacatctaataaggatgcacctctgtcgcaaaatgatgatctagtgtttctccgcatagtatctctaccgaagggccggaaactactttctcgttatattgatcttgttacttcaggtagtgagcttgcaagggttgtttgcatggcagttttccggaatctaagatctatattcggcaatttgccctctgatagcagcatagctgggaccacaactaaacttgtatgtgccgtatccacctgtgttgttcggatggacttgagtggactcagtgcttgtcttgcagctgttgcgtgttcgtcacagcaaccacctcttcgacctctgggatatgctgctggtgatggcgcttctgtcatcataaagtctctactggacagagctacagatcttcttactgatcaacatgtggcctctgcttacagcatgcagaaccgaactctatggcaggcatcatttgatgccttcttcgggctacttatggggtattgcatgagtaaatttgatactgtggttcatacagtgcaaatgcaacctgctgctgcagctgtgataagcagggaaacaccagtggagctgttgcgtgccagccttcctcacacaaatgagtatcagcgcaagcagttgctcagtttcgctcagcgcactgtgcctgtcaacagctctagttcccatgggtctggtaatgtgccgatggcatcagaatatgtccagagctgaaatagaagaacagagctgcttttcataatctatatacttgatatggttcttgcgagtggtgggaagaacatagatattgtggtgacgacaaagaatgacgacaaagaatgatggtctcggtcaaatattcaaaggatgatctttggccactttaggaagctcaaattgatgaattatgttgctgagacagaggtagagaaggctcctagaatggatgttgcccgaggggaacatgatcgctgaatgtcctaagcctttgttctgtcagccaaaacttttagggtgctttctgttgcattccattgcacgacctaaacttgttttagcgctttagttttgttattcgtatatgaattttgttgttttgctgatgacctgtaagctgtttttctgttctaaaaaaaaaaaaaaaa

SEQ ID NO: 4798 - protein, 2119 aa, Triticum aestivum
  misc_feature: GI Number: 34909888; NR Description: B1143G03.11 [Oryza
CTATTGAACCTATTCTCGGACCAAGGCCATCTCCTTTGCAGAGAATGTCATCATATCCTCACCAAGAGCCGCAATACAATAATATTGAACTGATTCGTGGGAATGGTAGCAGATTTACACCAGCTTTGATGCAGCATCCAAATGGATTTATACCACCTCAAATGCCGCCACCCCATCAACAAAACGGAATGCTCCCAATTCAACACTCTCCACCCCAGTTCTCACAACTACATGCCCAGATGCTTGGTGCCCAACATTCTCCGCCACAAAATCTGCAGATGTTTGGTCCTCGGCATCCTTCACCACAAATGATGGGTAGATTTGATCCAAATTTTGTTATGCCTGACTTGAGTGATCCCAGAGCCAGATCGATGTTACACCATGGAAGGCATGGCCCGCGCTATCCTCCCCAAGGTTTTGAGCCTGGTAATATGAGAATGGATAATAGGTGGCAGCGGTTCAGATCCAAGTACATGTCCACTGAAGAAATTGAGAACATCGCAAGGATGCAGAAAGCTGCCACTCAGATCACCGATCCATATATTGATGATTACTATCATCAAGCTTGTTTGGCCAGAAAATCAGCAGGAGCACAACTGAAGCACTACTTCTGTCCAACCTTGATCAGAGATACATCTTCTCGTACACGCAGTAAGGATGAGCCACATGCGTATCTTCAGGTTGATGCTCTTGGGAGGCTTCCATTTTCCTCCATCCGCAGGCCCCGTCCGCTCCTTGATGTTGAAGAAGCCTCTGAACCAAGTGATAGCACTACTGAAAAATCTGCTTCAAAATCTCTTGACCAAGAGCCGATGCTGGCTGCTAGAATCACAATTGAAGATGGCCTTTGCCTACTACTGGATGTGGATGATATAGATCGTTTGCTTCACTTTAGTAAACAGCCAGATGGTGGTTTGCAACTTAGAAACAGAAGACAGGCTCTTCTCGAGCAGCTGGCAGAATCACTGCAATTAGTTGATCCACTTACATCTAATAAGGATGCACCTCTGTCGCAAAATGATGATCTAGTGTTTCTCCGCATAGTATCTCTACCGAAGGGCCGGAAACTACTTTCTCGTTATATTGATCTTGTTACTTCAGGTAGTGAGCTTGCAAGGGTTGTTTGCATGGCAGTTTTCCGGAATCTAAGATCTATATTCGGCAATTTGCCCTCTGATAGCAGCATAGCTGGGACCACAACTAAACTTGTATGTGCCGTATCCACCTGTGTTGTTCGGATGGACTTGAGTGGACTCAGTGCTTGTCTTGCAGCTGTTGCGTGTTCGTCACAGCAACCACCTCTTCGACCTCTGGGATATGCTGCTGGTGATGGCGCTTCTGTCATCATAAAGTCTCTACTGGACAGAGCTACAGATCTTCTTACTGATCAACATGTGGCCTCTGCTTACAGCATGCAGAACCGAACTCTATGGCAGGCATCATTTGATGCCTTCTTCGGGCTACTTATGGGGTATTGCATGAGTAAATTTGATACTGTGGTTCATACAGTGCAAATGCAACCTGCTGCTGCAGCTGTGATAAGCAGGGAAACACCAGTGGAGCTGTTGCGTGCCAGCCTTCCTCACACAAATGAGTATCAGCGCAAGCAGTTGCTCAGTTTCGCTCAGCGCACTGTGCCTGTCAACAGCTCTAGTTCCCATGGGTCTGGTAATGTGCCGATGGCATCAGAATATGTCCAGAGCTGAAATAGAAGAACAGAGCTGCTTTTCATAATCTATATACTTGATATGGTTCTTGCGAGTGGTGGGAAGAACATAGATATTGTGGTGACGACAAAGAATGACGACAAAGAATGATGGTCTCGGTCAAATATTCAAAGGATGATCTTTGGCCACTTTAGGAAGCTCAAATTGATGAATTATGTTGCTGAGACAGAGGTAGAGAAGGCTCCTAGAATGGATGTTGCCCGAGGGGAACATGATCGCTGAATGTCCTAAGCCTTTGTTCTGTCAGCCAAAACTTTTAGGGTGCTTTCTGTTGCATTCCATTGCACGACCTAAACTTGTTTTAGCGCTTTAGTTTTGTTATTCGTATATGAATTTTGTTGTTTTGCTGATGACCTGTAAGCTGTTTTTCTGTTCTAAAAAAAAAAAAAAAA

SEQ ID NO: 4799 - DNA, 1792 bp, Triticum aestivum
  misc_feature (1)..(1792): Ceres cDNA ID no. 21995980
  misc_feature (1)..(1792): Ceres CLONE  ID no. 914278
  misc_feature (1)..(1792): Also known as  Ceres CDNA ID no. 24411780
atcgcaggcagagtgatctagtatcacccgcaccgctcgcacgctaggcaagatcgaccaactcactcactcaccatggaactctccttggcctcatcctttcccctcctcctcctccctctcctccctcttctctactttctctacctgcggccggaccccaagaagcagcctcgtgggcatggcctcaaggtctaccccatcctcggcacgctgccgcacttcgtcaagaaccaggaccgcttcctcgagtggtacaccggcgtcatgcagggcagccccacgcacaccctcgccttcaaggtgcccggcctcaccggcggcgccatcaccgccgacccggcatgcgtcgagcacatactcaaggctaactttgggaattaccccaagggcgagctctcggtctccatgctcgaggacttcctcggccacggcatcttcaactccgacggcgagcagtggctgtggcagcgcaaggccgccagctacgagttcaacaagcgctcgctgaggaacttcgtggtcgacgccgtccgcttcgaggtcgtcgagcggctgctgccgctgctcgaccgcgcggggcgcgacgggcggacgctggacgtgcaggacgtgctggagcgcttcgcgttcgacaacatctgccgcgtggccttcggcgaggacccggcctgcctcgccgaggagagcatggccgcgcccgagagcgcggagttcatggccgccttcaacgacgcgcagaacaccatcatggcccggttcatgtcgcctgccaagtggctgtggcgcgtcaagaggctactcgacatggagccggagaggcggatgcgctcagcgctcgccacgatccacggctacgccgacaagatcgtccgtgagcgcaaggagagaggggaggctgggctggtcagcagggacgacttcctgtcgcgcttcgccgcggccggcgagcacagcgacgagagcctccgcgacgtggtcaccaacttcatcctcgccggccgcgacacgacctcgtccgcgctgacctggttcttctggttagtgtccacgcggcccgacgtggaggagaagatcacgcgcgagatccgcgcggtgcgtgcgtcgggcgacggcgcgtcgtcgactctcagcttcgacgagctacgcgagatgcactacctccacgcggccatcacggagtcgatgcggctgtacccgccggtggccgccgacacgcacagctgcaaggaggacgatttcctcccggacggcacgttcgtcggaaaaggctggctgatgacatactgcgcgttcgccatggcgcggctggagggcgtctggggcaaggactgcgaggagttcaggccggagcgttggctcgacgaggagggcgcgttccggccggagagcccgtttaagtacgcggtcttccacgcggggccgaggatgtgcctcggcaaggagatggcctacatacagatgaagtccatcgtggcgtgcgtgctggagaggttcagcatccggtacgccggcggcgaggggcatcccaagctcataatgtcactgacgctgcggatgggaggcggcctgccgatgcaggtgaagaatagaacaggggagactagctaggatgcttggaggagtccattttgtcacaaaacacaattgctctgtactccatctctcttgtgttcttgcttggttcgggcaaaaaattactagagggtttaaaggttttcatttacatccgcaacttttaataaactagtaatatgctggtatttgttcatggccaaaaaaaaaaaaaaaa

SEQ ID NO: 4800 - protein, 511 aa, Triticum aestivum
  misc_feature: PFam Name: p450; PFam Description: Cytochrome P450
  misc_feature: GI Number: 34909016; NR Description: cytochrome P450-like protein [Oryza sativa (japonica cultivar-group)] >gi|20804563|dbj|BAB92255.1| cytochrome P450-like protein [Oryza
  misc_feature: GI Number: 34909018; NR Description: cytochrome P450-like protein [Oryza sativa (japonica cultivar-group)] >gi|20804564|dbj|BAB92256.1| cytochrome P450-like protein [Oryza
  misc_feature: GI Number: 34909022; NR Description: cytochrome P450-like protein [Oryza sativa (japonica cultivar-group)] >gi|20804566|dbj|BAB92258.1| cytochrome P450-like protein [Oryza
  misc_feature: GI Number: 34909024; NR Description: cytochrome P450-like protein [Oryza sativa (japonica cultivar-group)] >gi|20804567|dbj|BAB92259.1| cytochrome P450-like protein [Oryza
  misc_feature: GI Number: 34909030; NR Description: cytochrome P450-like protein [Oryza sativa (japonica cultivar-group)] >gi|20804570|dbj|BAB92262.1| cytochrome P450-like protein [Oryza
MELSLASSFPLLLLPLLPLLYFLYLRPDPKKQPRGHGLKVYPILGTLPHFVKNQDRFLEWYTGVMQGSPTHTLAFKVPGLTGGAITADPACVEHILKANFGNYPKGELSVSMLEDFLGHGIFNSDGEQWLWQRKAASYEFNKRSLRNFVVDAVRFEVVERLLPLLDRAGRDGRTLDVQDVLERFAFDNICRVAFGEDPACLAEESMAAPESAEFMAAFNDAQNTIMARFMSPAKWLWRVKRLLDMEPERRMRSALATIHGYADKIVRERKERGEAGLVSRDDFLSRFAAAGEHSDESLRDVVTNFILAGRDTTSSALTWFFWLVSTRPDVEEKITREIRAVRASGDGASSTLSFDELREMHYLHAAITESMRLYPPVAADTHSCKEDDFLPDGTFVGKGWLMTYCAFAMARLEGVWGKDCEEFRPERWLDEEGAFRPESPFKYAVFHAGPRMCLGKEMAYIQMKSIVACVLERFSIRYAGGEGHPKLIMSLTLRMGGGLPMQVKNRTGETS

SEQ ID NO: 4801 - DNA, 2145 bp, Triticum aestivum
  misc_feature (1)..(2145): Ceres cDNA ID no. 21995981
  misc_feature (1)..(2145): Ceres CLONE  ID no. 914482
  misc_feature (1)..(2145): Also known as  Ceres CDNA ID no. 24433963
gtctgattggccccccaccgcaccagcgagccgcacgaacccgcgcgcgccacgggcgcgcgcggtcccacccgcagtcgccgtcgccgtggggccctcggtgttgcgggaatcgaatctctcctccccctcccccctccctttcccccggtcccgtgagcgacgcatcgctctccagtctctccacccccctcctctctctctccgtccgccctccgcatctccgcgccgccgctgccgctacgcctctccccgggaagcctcgccggcggccaggtggaagatggagacaggcggcaaagatggcaaccctttgaagaattaccgtattgggaagaccctggggattggttcgttcgggaaggtcaagattgccgagcatataaaaactggtcacaaggtggccgtcaagatccttaaccgccggaaaatcaaaaacatggagatggaagagaaagtgaaaagagagatcaagatattaagattattcatgcacccacatatcatccgcctttatgaagtgatagaggcaccagctgatatttatgtggttatggagtatgttaagtctggtgaattgtttgattacattgttgagaaaggtaggctacaggaggaagaggcccgccgtttctttcaacagatcatatctggtgttcaatattgccacaggaacatggtggtgcaccgcgatctaaagccggagaaccttcttttggacaataattgtgatgttaagattgcggattttggcttaagtaatgttatgcgtgacggccactttcttaagacaagttgtggtagcccaaattatgcagctccggaggttatatctggaaaactgtacgctgggcctgaagttgatgtatggagctgcggtgttattctttatgctcttctatgtggtactcttccatttgatgatgagaacatacccaacctttttaagaaaataaagggtggaatatatacccttccaagccatttatcaggcccagcaagggatttgattccaaggatgctagttgttgatcctatgaagaggataaccattcgtgaaatacgcgagcatccatggtttgaagctcaactcccacgatatttagccgtgcctccaccagatactgcacaacaagttaaaaagattgatgaagaatctcttgttaaagttatcagtctgggatttgacaaaaacctgctggttgaatcaattcataatagattgcaaaatgaggcaacagttgcatattatttatttttggataataagagtcgcacaacaactggctatcttggagctgggtatcaagaagctatggaatcgtctttctcacccattactccaagtgaaacacaaagtccagctcatggaaatcggcaacaaccatatatggaatctccagttggcttgagaccacattttccagctgataggaaatgggctcttgggcttcagtctcgagcacatccaagagaagttatgactgaagtgctgaaggctctgcaagaactgaatgtatactggaaaaaaattggacactataacatgaaatgtagatggagtcctcctggctttcccggtcaggagaatatgaatcataccaattataacttcagtgcagagcctattgaaaccgacgacctgggtgacaagttaaatttaattaagttcgaacttcagctttacaaaacaagagatgagaaataccttctggatttgcaaagggcgagcgggccgcatctcctctttcttgatctatgtgccgcctttctagctcagctgagagtcctttgataccagatgtgcccgaggaatgtatgttgtatcactctaaagagatgtaaatagcaagctttctccagcggatcaaagtcgtggagtatgtagacatgcggagctgttgtgtgcttatttcggcgcctatatgctgaatttagacctggcaggggcgggcaagtgaagcaagcaaggaactattgccatcaggttatttccagctgccgccaaaggcactaggatatagaagtattattgattaatcctatattggccccttgggacatactcctactctactgctgtttacttgcatgtaatttttactgtctgggtctccagaccagaccagaaaaaaaaaaaaaaaa

SEQ ID NO: 4802 - protein, 503 aa, Triticum aestivum
  misc_feature: PFam Name: Pkinase; PFam Description: Protein kinase domain
  misc_feature: GI Number: 34098893; NR Description: At3g01090 [Arabidopsis thaliana] >gi|20260542|gb|AAM13169.1| putative SNF1-related protein kinase [Arabidopsis thaliana] >gi|38503401|sp|Q38997|KI10_ARATH SNF1-related protein kinase
  misc_feature: GI Number: 400982; NR Description: Carbon catabolite derepressing protein kinase >gi|101523|pir||A41361 serine/threonine-specific protein kinase (EC 2.7.1.-) RKIN1 - rye
  misc_feature: GI Number: 7672782; NR Description: SNF1 [Lycopersicon esculentum]
  misc_feature: GI Number: 1743009; NR Description: SNF1-related protein kinase [Cucumis sativus] >gi|7434354|pir||T10449 probable
  misc_feature: GI Number: 575292; NR Description: SNF1-related protein
METGGKDGNPLKNYRIGKTLGIGSFGKVKIAEHIKTGHKVAVKILNRRKIKNMEMEEKVKREIKILRLFMHPHIIRLYEVIEAPADIYVVMEYVKSGELFDYIVEKGRLQEEEARRFFQQIISGVQYCHRNMVVHRDLKPENLLLDNNCDVKIADFGLSNVMRDGHFLKTSCGSPNYAAPEVISGKLYAGPEVDVWSCGVILYALLCGTLPFDDENIPNLFKKIKGGIYTLPSHLSGPARDLIPRMLVVDPMKRITIREIREHPWFEAQLPRYLAVPPPDTAQQVKKIDEESLVKVISLGFDKNLLVESIHNRLQNEATVAYYLFLDNKSRTTTGYLGAGYQEAMESSFSPITPSETQSPAHGNRQQPYMESPVGLRPHFPADRKWALGLQSRAHPREVMTEVLKALQELNVYWKKIGHYNMKCRWSPPGFPGQENMNHTNYNFSAEPIETDDLGDKLNLIKFELQLYKTRDEKYLLDLQRASGPHLLFLDLCAAFLAQLRVL

SEQ ID NO: 4803 - DNA, 932 bp, Triticum aestivum
  misc_feature (1)..(932): Ceres cDNA ID no. 21995982
  misc_feature (1)..(932): Ceres CLONE  ID no. 915181
  misc_feature (1)..(932): Also known as  Ceres CDNA ID no. 24410711
aaaatccctctccttcgctcgatcccccacctccccactcgcgctcgcgatagggttacagggccgccgccgccgcgccgaccgacagcccgccccggccgctcccccgtcccgcccgctcaccttaagccgctggcctcaacgcccgacgccgcctcgccggagttcgctcgggccgtcgcctaagggttcaaagctatggttgcagatgaaaaactgccagcttctggagatgctaacaactcagagcagcagcttcatgatactgaattggatgaccattcttggccttccaccaaaaaaggcttctgcaaatgatcaagtcccaccaaatgagcaacaacagacacaacacaaaacaagtgaggataccaaaaaacttgcggcaaatgctcttgcagctgttagagatgccgccactgctgcatctggaagagggaaagtggagataaccgaggtaagggactttgctggcaaggatattgagatcaagaaacttgtagatgcggattcaaaggaagcggttgagaaggccagtgcagcgggtgcctcgccgtccgctgtggacaacatcctggagcagataaggaagaagcagaagctgagcgtcctggacaagacgaagaaagactggggagagtacaaggcagagaagggcgtggaggaggagctgggggcgtacaagaagagctcgaaccagtaccttgataggcagtccttcttgaagagagccgattacagggagtacgagctcgagcgagacgcgcggttgtcgttgatggcgaagcggaagagcgagagtatgcaggacgatgatgtctaggctttgatgaaaattgcgaccatgttggctgcactttgccttttgttggactcggtggagattcttttgaggtaatggtaaagacgttatttcaaaaaaaaaaaaaaaa

SEQ ID NO: 4804 - protein, 204 aa, Triticum aestivum
  misc_feature: PFam Name: BCNT; PFam Description: Bucentaur or craniofacial
  misc_feature: GI Number: 34894794; NR Description: P0537A05.24 [Oryza
  misc_feature: GI Number: 21618133; NR Description: bcnt-like protein
  misc_feature: GI Number: 47027075; NR Description: BCNT [Hyacinthus orientalis]
  misc_feature: GI Number: 22775404; NR Description: bcnt [Gallus gallus]
  misc_feature: GI Number: 47575702; NR Description: craniofacial development protein 1; Nished [Gallus gallus] >gi|47115498|dbj|BAD18889.1|
MKNCQLLEMLTTQSSSFMILNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 4805 - DNA, 1851 bp, Triticum aestivum
  misc_feature (1)..(1851): Ceres cDNA ID no. 21995984
  misc_feature (1)..(1851): Ceres CLONE  ID no. 924052
  misc_feature (1)..(1851): Also known as  Ceres CDNA ID no. 24411134
gcacgtcccacagtggatcgcacaaggcacacgtagcagagagagagcacatggcagagcgatcggcggatccgcggtcgcttctgcggcaatgctactgctgagtgctggccctcgcagtcggcaaggtcgcgcagtgcttggcagaggccgatcagagcgagctctgccccgccggcgcggatgggcaaggcgggcaggtggctccgaagcttcttgccgggcaagaaggaccggggcaaggacgccgggaaccacaagaccggccccgaggagacgccgcggtgggtgccggcgtggactccgcagacggtgacgccggcgtcgaccccgggggccaaggagaagaggaggtggagcttccggcggcctgcgacggcggtggccgccggggcggggaaggacggcgcgttcttggagccgcgggtgctggaccccgaccagagcgccatcgcggtggcgatcgctaccgcggccgccgccgaggccgcggtggcggccaagcaggcggctgccgccgtcgtccggtacgccgcgtccgcgccggggtcgaagcgcgccgtcatcggcattgaggaggccgcggcgatcaagattcagtccgtcttcaaatcctacctggcgaggaaggcactgtgcgcgctcagggggctggtgaagctgcaggcgctcgtgcgcggccacctcgtccggcggcaggccagcaacacgctgcgctgcatgcaggcgctcgtcgccgcccagaacagggcgcgcacggcgcgcctccggctcctcgacgacgtcgagaggcccctccgcacgccacggatgacgcccacacgccgctccccgcaccatccccggctccgacagcatcaggagatggaggagaacatcaagatcgtggaggtggacaccggggcgggcgacgtgcgctgcacgccgaggacgtcgcggcgcagcagctgctacgccacgccgctctgccgcacgccgtccaaggtggagctgtaccagaaggtgtcgccgacgccgtcggcgctgacggacgcgagcgggcggtcctacagcgggcggtacgaggacttctcgttcggcaccgcgcgggccagcccgtaccactactactacgcctcggacgcgtcgtgcaagcagccaccgccgccgcagcagcagggccacggcgccggcgccggcgcggaccacccgctgctgttccccagctacatggccaacacgcagtcctcgcgcgccaaggcgcggtcgcagagcgcgcccaggcagcgcgcgtcggtgtcgtcggcccccgaggtggcgtcgccgtgggagaggcaggctagcgcgggccggcgcagggcgtcgctggaggggccggcgcaggccgccgcgcgcgggctggcgtccccgaagggcgccgtgcgcgtccagcggtgccagtcgcaggcgagcgcggcgtgcccgtggggcgtgaggctggacatgtcgagcgcgtccgtccacgacagcgagtgcgggtcgaccagcaccatgaggaccgcggccaccagcatgtactgctggtcggcggccgccaacagcaccggcgtcgcgtgacggcgccacggcacacgagatttctgaatcgaatcaggcagccgcagaagaagtgctagcgtctgtaacctctagggacaaacaagttccgtccagtactggggcactgaagtttctgtgactctagctagttgatagtagaagaagctgagcatgatggttttgatgtgtgtgagtggtcggtcggtctagcaaggtctgatgacattttcgtgtttgtgcgtgccaagaacattgcataacagtgttgtgtttttgacaaaaaaaaaaaaaaaa

SEQ ID NO: 4806 - protein, 463 aa, Triticum aestivum
  misc_feature: PFam Name: Cupin_1; PFam Description: Cupin
  misc_feature: PFam Name: Pkinase; PFam Description: Protein kinase domain
  misc_feature: GI Number: 30682982; NR Description: calmodulin-binding
  misc_feature: GI Number: 34906398; NR Description: P0710E05.11 [Oryza sativa (japonica cultivar-group)] >gi|9049461|dbj|BAA99426.1|
  misc_feature: GI Number: 50940489; NR Description: calmodulin-binding protein family-like [Oryza sativa (japonica cultivar-group)] >gi|42409298|dbj|BAD10560.1| calmodulin-binding protein family-like
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 50907219; NR Description: calmodulin-binding protein-like [Oryza sativa (japonica cultivar-group)] >gi|48716200|dbj|BAD23357.1| calmodulin-binding protein-like [Oryza
MGKAGRWLRSFLPGKKDRGKDAGNHKTGPEETPRWVPAWTPQTVTPASTPGAKEKRRWSFRRPATAVAAGAGKDGAFLEPRVLDPDQSAIAVAIATAAAAEAAVAAKQAAAAVVRYAASAPGSKRAVIGIEEAAAIKIQSVFKSYLARKALCALRGLVKLQALVRGHLVRRQASNTLRCMQALVAAQNRARTARLRLLDDVERPLRTPRMTPTRRSPHHPRLRQHQEMEENIKIVEVDTGAGDVRCTPRTSRRSSCYATPLCRTPSKVELYQKVSPTPSALTDASGRSYSGRYEDFSFGTARASPYHYYYASDASCKQPPPPQQQGHGAGAGADHPLLFPSYMANTQSSRAKARSQSAPRQRASVSSAPEVASPWERQASAGRRRASLEGPAQAAARGLASPKGAVRVQRCQSQASAACPWGVRLDMSSASVHDSECGSTSTMRTAATSMYCWSAAANSTGVA

SEQ ID NO: 4807 - DNA, 898 bp, Triticum aestivum
  misc_feature (1)..(898): Ceres cDNA ID no. 21995986
  misc_feature (1)..(898): Ceres CLONE  ID no. 927667
  misc_feature (1)..(898): Also known as  Ceres CDNA ID no. 24412722
aaaggcaaaccccaagaaaccccaaccggccaccaccaccaccacctcccgtcccgaccccgagacaaacacctcccactcgcggccatgcccccctgccaccgccgctgctgactagccatctgcgccgcgaccggtcaacatctatctcgccggaacatctgaatcaacatggacccggcccaggaggagctcgagcgccgcagccgctacctcagctcgctcgtccgccgcaccaggctcgacgacccgccccagccggagccggagccggagcgagagctcaaggtggagcggaaatcggcggcggagcccagcggcggggagggcaaggccgctaagccggaggccaaggacaacagggaggcggcgaaggtcaaaggggacgccgcgagcggggaggggaggaaggtggcggtgcgggtgcgcgcggcggacatgccgctggcgctgcagcggcgcgcgatctggatcgcccgggaggtcgtcctctccacgccgcgcctcgagagcaagcgcctcgcgctcgcgctcaagaaggaattcgacacgacatacgggcctgcttggcactgcattgtcggcacaagctttggctcctacgtcactcactccttaggaggcttcctgtacttttccgttgacaaggcgtacattcttctcttcagaaccgctgtcgagccactgagtaaaccgtgatgaggcctggaacctatcttctcacacacaagtgtagatttagcgcaaatgtgtaatttaaactgctgttttaggagctcgacggtagcaagtgtaagcagtggagaaggatcacctctccgcatacagaagtgtagcaaacatgcctctatgacctttaagtatctacgtaagctgctgctgaaaaaaaaaaaaaaaa

SEQ ID NO: 4808 - protein, 175 aa, Triticum aestivum
  misc_feature: PFam Name: Dynein_light; PFam Description: Dynein light
  misc_feature: PFam Name: GRP; PFam Description: Glycine rich protein family
  misc_feature: GI Number: 50253310; NR Description: putative dynein light chain 2 [Oryza sativa (japonica cultivar-group)] >gi|50251705|dbj|BAD27626.1| putative dynein light chain 2 [Oryza
  misc_feature: GI Number: 20465367; NR Description: putative dynein light subunit lc6, flagellar outer arm [Arabidopsis thaliana] >gi|17380802|gb|AAL36088.1| putative dynein light subunit lc6,
  misc_feature: GI Number: 45752676; NR Description: At5g20110 [Arabidopsis thaliana] >gi|15241269|ref|NP_197511.1| dynein light chain, putative [Arabidopsis thaliana] >gi|40822853|gb|AAR92244.1|
  misc_feature: GI Number: 66796189; NR Description: dynein light chain
  misc_feature: GI Number: 34913978; NR Description: dynein light chain - like protein [Oryza sativa (japonica cultivar-group)] >gi|20146287|dbj|BAB89069.1| dynein light chain - like protein [Oryza sativa (japonica cultivar-group)]
MDPAQEELERRSRYLSSLVRRTRLDDPPQPEPEPERELKVERKSAAEPSGGEGKAAKPEAKDNREAAKVKGDAASGEGRKVAVRVRAADMPLALQRRAIWIAREVVLSTPRLESKRLALALKKEFDTTYGPAWHCIVGTSFGSYVTHSLGGFLYFSVDKAYILLFRTAVEPLSKP

SEQ ID NO: 4809 - DNA, 1636 bp, Triticum aestivum
  misc_feature (1)..(1636): Ceres cDNA ID no. 21995987
  misc_feature (1)..(1636): Ceres CLONE  ID no. 928201
  misc_feature (1)..(1636): Also known as  Ceres CDNA ID no. 24404253
gtcctctgtttaccaatcaatcacacccctctcccaagtctcagtttcaatatctaataatctccctgctccttccgtcgcgtcgatcgccatgtcctcctccacggggagcttggaccacgcagggttcacgttcacgccgccgcacttcatcacgtccttcaccgagcttctgtcagggtccggcgccggcgacgcggagcggtcgccaagggggttcaaccgagggggccgggccggggcgcccaagttcaagtccgcgcagccgcccagcctgcccatctcgtcgcccttctcctgcttctccatccctgcgggcctcagccctgctgagctgctcgactcccccgttctcctcaactactcccatatcctggcgtctccgaccacaggtgcgatccctgcgcggaggtacgactggcaggcgagcgccgatctgaacacctttcagcaggatgagccctgccgaggagacagcggcctctttggcttctcctttcacgcagtgaagtccaacgccacggtcaacgctcaagcaaattgcttacctttattcaaggagcagcagcagcaacaacaacaagtggtagaagtgagcaacaagagcagcagcggcggcggcaacaacaagcaggttgaggacggatacaactggaggaagtacgggcagaagcaagttaaggggagcgagaacccgcggagctactacaagtgcacctacaacaattgctccatgaagaagaaagtggagcgctctctcgccgacggccgcatcacgcagattgtctacaagggcgcacacgaccacccgaagcccctctccacgcgccgcaactcctccggctgtgcggcggtcgtcgcggaggatcatgccaacggctcggagcactctgggccgacgccggaaaattcatccgtcactttcggagacgatgaggccgacaacgggttgcagctcagtgatggcgctgagcccgtgaccaagcgccggaaggagcatgccgacaacgagggcagttcaggtggcaccggcggctgcgggaagcccgtgcgcgagccgaggcttgtggtgcagacgctgagcgatatagacatactcgacgacggcttccggtggaggaagtacgggcagaaggttgtcaagggcaatcccaaccccaggagctactacaagtgcacaacggtgggttgcccggtgcgcaagcatgtggagcgggcctcgcacgacaaccgcgcggtgatcaccacctacgagggtaagcacagccacgacgtgccggtcggccggggccgcgcgctgccggcgacatcttcctccgacagctcgggcgtcatctggcctgccgccgtgccggccccgtacaccctcgagatgctcaccaaccctgccgccggacaccgaggctacgcggccggcggcgccttccagcgcaccaaggacgagccccgggacgacatgttcgtcgagtcgctcctctgctagctaggcaggctcggccgcggctcttggttcccatgtggcgtttacatgtgcgtccacctgtacaatataatagatacaacatgttttttagctgatgctttttcttgctgttgagtaaataagcaattgtttgattcaaaaaaaaaaaaaaaa

SEQ ID NO: 4810 - protein, 463 aa, Triticum aestivum
  misc_feature: PFam Name: WRKY; PFam Description: WRKY DNA -binding domain
  misc_feature: PFam Name: Mucin; PFam Description: Mucin-like glycoprotein
  misc_feature: GI Number: 50843964; NR Description: transcription factor WRKY12 [Oryza sativa (indica cultivar-group)] >gi|46394360|tpg|DAA05118.1| TPA: WRKY transcription factor 53
  misc_feature: GI Number: 14530681; NR Description: WRKY DNA-binding protein
  misc_feature: GI Number: 14530685; NR Description: WRKY DNA-binding protein
  misc_feature: GI Number: 5360683; NR Description: NtWRKY1 [Nicotiana tabacum]
  misc_feature: GI Number: 1159877; NR Description: DNA-binding protein [Avena fatua] >gi|2130023|pir||S61413 DNA-binding protein ABF1 -
MSSSTGSLDHAGFTFTPPHFITSFTELLSGSGAGDAERSPRGFNRGGRAGAPKFKSAQPPSLPISSPFSCFSIPAGLSPAELLDSPVLLNYSHILASPTTGAIPARRYDWQASADLNTFQQDEPCRGDSGLFGFSFHAVKSNATVNAQANCLPLFKEQQQQQQQVVEVSNKSSSGGGNNKQVEDGYNWRKYGQKQVKGSENPRSYYKCTYNNCSMKKKVERSLADGRITQIVYKGAHDHPKPLSTRRNSSGCAAVVAEDHANGSEHSGPTPENSSVTFGDDEADNGLQLSDGAEPVTKRRKEHADNEGSSGGTGGCGKPVREPRLVVQTLSDIDILDDGFRWRKYGQKVVKGNPNPRSYYKCTTVGCPVRKHVERASHDNRAVITTYEGKHSHDVPVGRGRALPATSSSDSSGVIWPAAVPAPYTLEMLTNPAAGHRGYAAGGAFQRTKDEPRDDMFVESLLC

SEQ ID NO: 4811 - DNA, 2042 bp, Triticum aestivum
  misc_feature (1)..(2042): Ceres cDNA ID no. 21995988
  misc_feature (1)..(2042): Ceres CLONE  ID no. 929305
  misc_feature (1)..(2042): Also known as  Ceres CDNA ID no. 25088344
tccccctcgtcatctcccattgcgcgggtcgccggagggggaaagcagcggccagcggtcctcttcccactctccgcctctccccccgctagatctcgaggcttctagaagcttctgccgacgttagtgtgctgtccagatctcgaaccttctagaagcctccacgggccgcggccctccccgcctcctccagatcccggaggacgcgagcgggggatccacgggaccttcgacttggagcacctgctgccagggatgccgagcatacaagaaccactgcattttaaacctcaagagcctaaagtagtcgtggcggagaacgagaacgacaagatggttgatgttcaggacaaggaggtcaccatggaaggcctctgctctgtggccgcttacgatcagtggacgcctctctcagtcccaggacagcgcccgaaacctcgatacaagcacggagctgccgtagttcaggaaaaaatgtatgtctttggtggaaaccacaatggccgttaccttggtgacattcaggttctggatttcaaaagtttgtcatggtcaaagctagaagctaaagtacaatcagaatcagctgaaccagcttctgttgctccatgtgctggtcattcactgattccatccggaaacaagattctctcacttgcaggacacaccagggagcatacagagagtctcagtgtaaaggagtttgatccgcaaacctgcacttggtcaattttgcgtacttatgggaagtcaccgagctcacgtggtggtcaatcagtaactcgtgttggggacactttagttgtgtttggaggtgaaggtggtgggaggtctcttctgaatgacctgcacgttcttgatcttgaaaccatgacttgggatgaatttgagagcacaggcactactccttctccaaggtcagagcatgctgctgcatgctatgcggactggtatctcttgatatttggtgggggatctcattctacatgtttcagtgatctatatctccttgacatgcaaacaatggaatggtcaagaccagagcagcacggtataattccagaaccaagagcagggcatgcaggcgtgacggttggggataactgggttatcactggtggtggtaatagtaagaaaggtgttccagaaacgcttgtgcttaacatgtctactttggtatggtcggttgttactagttttgaaggccgtgcaccccctacaagtgagggatcgagcttagtacttcacacaattaatggagaagattttctgttgtcatttggaggatacagtggacgttacagcaacgaggtttatgctctgaagacaagtctcagaccaagtgtgtcatcttcacgaatagatgaactggagacaaatggcatgaccccattatctgcagaagtaaattctagcagggaacctatattcgaaattgaagaacttcgagatgacaagaataagaagggaggagatatcagcaaaaccttggtgcaagcagtaaagcgtgagaagaaccaggtagaagaaagacttgaacaggaaaagctgcagagcttcaacctgaagaaggaactagctgatgtggagaacaaaaatgcggagcttactaaggaactccagtcggtccgtgatcaactctcagacgaagcagcgagggcttccaaactcgaggatgaagtttcagagattcaacaacggctgcagaaaatggaaacccttgaaaaggagttcgaattgcttcggagtgaaaggggtggcgggtctgacgaatcaggttcaggcagcaacaagaggcccagcagcgtgggcttccggaggtggtatggagatgacgagcgctgaagcggggactcttctctaggatcgcattctttcgtttttggtcggtttctgatcatatatatttttcggttaatccagtactgaggcttatatgaaaagcttgaaaatcattttgtaaaggaaaagactgaaagtattttttttaccaagatcaaatgccagagcctcagaaacttgaaagaacaaaaaaaaaaaaa

SEQ ID NO: 4812 - protein, 529 aa, Triticum aestivum
  misc_feature: PFam Name: Kelch_2; PFam Description: Kelch motif
  misc_feature: PFam Name: Kelch_1; PFam Description: Kelch motif
  misc_feature: PFam Name: Myosin_tail_1; PFam Description: Myosin tail
  misc_feature: GI Number: 42572263; NR Description: acyl-CoA binding family
  misc_feature: GI Number: 50919943; NR Description: putative transcription factor [Oryza sativa (japonica cultivar-group)] >gi|40714674|gb|AAR88580.1| putative transcription factor [Oryza
  misc_feature: GI Number: 50915992; NR Description: acyl-CoA binding protein-like [Oryza sativa (japonica cultivar-group)] >gi|48716283|dbj|BAD22898.1| acyl-CoA binding protein-like [Oryza sativa (japonica cultivar-group)] >gi|48716304|dbj|BAD22917.1|
  misc_feature: GI Number: 15724206; NR Description: AT5g04420/T32M21_20
  misc_feature: GI Number: 21950739; NR Description: RanGAP1 interacting
MPSIQEPLHFKPQEPKVVVAENENDKMVDVQDKEVTMEGLCSVAAYDQWTPLSVPGQRPKPRYKHGAAVVQEKMYVFGGNHNGRYLGDIQVLDFKSLSWSKLEAKVQSESAEPASVAPCAGHSLIPSGNKILSLAGHTREHTESLSVKEFDPQTCTWSILRTYGKSPSSRGGQSVTRVGDTLVVFGGEGGGRSLLNDLHVLDLETMTWDEFESTGTTPSPRSEHAAACYADWYLLIFGGGSHSTCFSDLYLLDMQTMEWSRPEQHGIIPEPRAGHAGVTVGDNWVITGGGNSKKGVPETLVLNMSTLVWSVVTSFEGRAPPTSEGSSLVLHTINGEDFLLSFGGYSGRYSNEVYALKTSLRPSVSSSRIDELETNGMTPLSAEVNSSREPIFEIEELRDDKNKKGGDISKTLVQAVKREKNQVEERLEQEKLQSFNLKKELADVENKNAELTKELQSVRDQLSDEAARASKLEDEVSEIQQRLQKMETLEKEFELLRSERGGGSDESGSGSNKRPSSVGFRRWYGDDER

SEQ ID NO: 4813 - DNA, 1787 bp, Triticum aestivum
  misc_feature (1)..(1787): Ceres cDNA ID no. 21995990
  misc_feature (1)..(1787): Ceres CLONE  ID no. 934417
  misc_feature (1)..(1787): Also known as  Ceres CDNA ID no. 24412113
aaaattagctgtgtgtgcaagcggcgtaataatctagctacgtactatcatggcggcggcgaccaccggtgcaagtgatccgtcgccgtcgatcgtgcagacaaggccggcgatcacggcggatgagccacggcccctgccgcgcgtcgtcctgctggccagccctggcatgggccacctcatccccctggccgagctcgcgcgccggctcgcggttgaccacggcttcgccgccacgatcgtcacgctcaccaacctcaccgacgcggccgccgacgccgccgtgctctcctccatgccggcgtcggtctcgaccgccgtgctccccgctgtcgcgctggacgacctcccgccgggcgtcggcttcggcgccctcatgttcgagctcctccgccgctcgctcccgcacctccgcgcgctcatgggcacggtggccggccccaccgccgcgctcgtgtgcgatttcttcggcaccgccgcgctccccctcgccgcggacctcggcgtcccggggtacgtctttttccccaacagcttcaccctggtctccgtcatgcggcgcctcgcggagctccacgacggcgccgcccccggcgagcaccgcgacctcccgaacacactccggctcccgggctgcgtgccgctgcgccacgccgagctgcccgacgggttccgcgacaagaccgaccctgtctacgcctacctcgtcgaggaggcgcggcggtacggccgtgccgacggcttcttggtcaacagcttcgaggagctagagcccgccgtcgcggaggcgttcgaccgggacgccgcggccggcgcgttcccgccggtgtaccccgtggggccgttcgtccgttcaagcagctccagcgaagaagccgacgagctggactgcttggcgtggctcgaccggcagccggcggggccggtggtgtacgtctccttcggcagcggcggcgcgctgtcggtcgagcagacggccgagctcgccaccggcctggagacgagcggccaccggttcctctgggtggtgcgcatgccaagccatgacgggaacaacaacgccttgggggccgatggtagcgacgaccggagccaggacgacccgctggcatggcttccggagggcttcgcggagaggacgaggagcaggggcctcgccgtggccgggtgggcgccgcaggtgcgcgtgctggcgcacccggcgacggcggggttcatgtcgcactgcgggtggaactcggcgctggagagcctggcgtccggcgtcccgatgatcacctggccgctgtacgccgagcagaagatgaacgcggccatcctgacggagctggtaggggtggcgctgcggccggcggtgagccgagaggacggcttcgtagcaggcgaggaggtcgcagcggccgtcagggagctcatggagggggagaagggaagagcggtgcgccaccaagcccggcggcttcaggaggcggcggcgcgggcgtgtacgccggagggcccgtcgcggcgggcgctggaaaaggtcgccggcaagtggaaggccgggcttggcaacggggattgacttggtgcgtgttctttagcgaaaataaacatatgatttgtacacataggacaaatcatgatactctgtttcctctcttcctactctgttttgtggagtgaacatgcacggtaattgtttgaagagttgtcctgattttcgtcctagttaaacatgttacttagatcacaatagttatatgtaagtcatctaaatttacgatttcggaaaaaaaaaaaaaaaa

SEQ ID NO: 4814 - protein, 504 aa, Triticum aestivum
  misc_feature: PFam Name: UDPGT; PFam Description: UDP-glucoronosyl and
  misc_feature: PFam Name: FH2; PFam Description: Formin Homology 2 Domain
  misc_feature: PFam Name: Pkinase; PFam Description: Protein kinase domain
  misc_feature: PFam Name: GRP; PFam Description: Glycine rich protein family
  misc_feature: PFam Name: Atrophin-1; PFam Description: Atrophin-1 family
  misc_feature: GI Number: 50252246; NR Description: putative Hydroquinone
  misc_feature: GI Number: 50252251; NR Description: putative Hydroquinone
  misc_feature: GI Number: 50252256; NR Description: putative Hydroquinone
  misc_feature: GI Number: 50252240; NR Description: putative Hydroquinone glucosyltransferase [Oryza sativa (japonica cultivar-group)] >gi|50251521|dbj|BAD28882.1| putative Hydroquinone
  misc_feature: GI Number: 50252241; NR Description: putative Hydroquinone glucosyltransferase [Oryza sativa (japonica cultivar-group)] >gi|50251522|dbj|BAD28883.1| putative Hydroquinone
MAAATTGASDPSPSIVQTRPAITADEPRPLPRVVLLASPGMGHLIPLAELARRLAVDHGFAATIVTLTNLTDAAADAAVLSSMPASVSTAVLPAVALDDLPPGVGFGALMFELLRRSLPHLRALMGTVAGPTAALVCDFFGTAALPLAADLGVPGYVFFPNSFTLVSVMRRLAELHDGAAPGEHRDLPNTLRLPGCVPLRHAELPDGFRDKTDPVYAYLVEEARRYGRADGFLVNSFEELEPAVAEAFDRDAAAGAFPPVYPVGPFVRSSSSSEEADELDCLAWLDRQPAGPVVYVSFGSGGALSVEQTAELATGLETSGHRFLWVVRMPSHDGNNNALGADGSDDRSQDDPLAWLPEGFAERTRSRGLAVAGWAPQVRVLAHPATAGFMSHCGWNSALESLASGVPMITWPLYAEQKMNAAILTELVGVALRPAVSREDGFVAGEEVAAAVRELMEGEKGRAVRHQARRLQEAAARACTPEGPSRRALEKVAGKWKAGLGNGD

SEQ ID NO: 4815 - DNA, 1497 bp, Triticum aestivum
  misc_feature (1)..(1497): Ceres cDNA ID no. 21995992
  misc_feature (1)..(1497): Ceres CLONE  ID no. 938230
  misc_feature (1)..(1497): Also known as  Ceres CDNA ID no. 24409886
ctcagctccacgccaattaaaccctactactcctgctaccagcactcctcctctcgcccccctcgcgttatctccgcccccctcgcgcagcccacgtacaaaaccaaacaaaaaagcgccgagcaacgcagcgccgcagatagaatcgttgcgtgcgtccaccgctctcgcggcggccatggaggccacggcgcccgactactacgcccgcgacaagaagggctccgacctcttcgtcgtcgacgacctcctcgcgctgccgtgcgacgacgaggaggaggaggaggaaggggtgggcgacgcgccgttcctgccggccaacgccgcctccgccgccgcagtcgtcgtcaagcaggaggccgggttcgggaacgcgtcggccgactcgtccaccgtcacggccctcgacagctgcagcaactccttctccggcctcgccgacggcgacttctccggcggcctctgcgagccgtacgatcagctggcggagctggaatggctgtccaactacatgggcgagggcgaggagagcttcgccacggaggacctacacaagctgcagctcatctctggcatcccctccggcggcttcccctcggcgaacgggccgcctgctccggcggccaccgctgccacggcgcagcccggcgtgttcctgccggagggccccgtccccgccaaggcccgtagcaagcgctcccgcgttgcgccgggcaactggtcgtcccgcctgctcgttctcccgccggccccggcctccccgccgtccccggcgtccatggccatctcgccggcggagtctggcgtctcagcccaggcgttccatgtcaagaagccttccaagccggccaagaagaaggaggtgccgccgcaggcgcaggcacaggctcagactcagtcggtgagcgcgcccacagcgccttcgggcgtcacggcggcggccaacgaaggtcggcggtgcctgcactgcgagacggacaagacgccgcagtggaggacggggcccatgggccccaagacgctgtgcaacgcgtgcggggtgcgctacaagtcggggcggctggtgccggagtaccgcccggccgcgagcccgacgttcgtgacgtcgaggcactccaactcccaccgcaaggtgctcgagctccgccgccagagggagatgcaccaccaccaccagccgtcgcagctccagcagcacgcggtcgccggcggcgtcgggaggataatgcacatggagagccacctgctgttcgatgggccggcggcgccgcccatcctcggcggcggcgacgacttcttgatccaccaccgcctagggacggcagactaccggcagcagctcatctagacgagtcgtcagtctgttagaactgatcagtttagcccagaaataataattaaaagcagctaaaaccccaagagccggaaatatcggaagaactgcaaatgtttgcttattaggagttatattttcccagtttaaaaaaaaaaaaaaaa

SEQ ID NO: 4816 - protein, 389 aa, Triticum aestivum
  misc_feature: PFam Name: GATA; PFam Description: GATA zinc finger
  misc_feature: PFam Name: MCPVI; PFam Description: Minor capsid protein VI
  misc_feature: PFam Name: TT_ORF1; PFam Description: TT viral orf 1
  misc_feature: PFam Name: Cupin_1; PFam Description: Cupin
  misc_feature: PFam Name: FH2; PFam Description: Formin Homology 2 Domain
  misc_feature: GI Number: 34909448; NR Description: OSJNBa0014K08.18 [Oryza sativa (japonica cultivar-group)] >gi|21902044|dbj|BAC05593.1|
  misc_feature: GI Number: 15239503; NR Description: zinc finger (GATA type)
  misc_feature: GI Number: 37572451; NR Description: AG-motif binding
  misc_feature: GI Number: 37572443; NR Description: AG-motif binding
  misc_feature: GI Number: 34098855; NR Description: At5g66320 [Arabidopsis thaliana] >gi|10177426|dbj|BAB10711.1| GATA-binding transcription factor-like protein [Arabidopsis thaliana] >gi|22531223|gb|AAM97115.1| GATA-binding transcription
MEATAPDYYARDKKGSDLFVVDDLLALPCDDEEEEEEGVGDAPFLPANAASAAAVVVKQEAGFGNASADSSTVTALDSCSNSFSGLADGDFSGGLCEPYDQLAELEWLSNYMGEGEESFATEDLHKLQLISGIPSGGFPSANGPPAPAATAATAQPGVFLPEGPVPAKARSKRSRVAPGNWSSRLLVLPPAPASPPSPASMAISPAESGVSAQAFHVKKPSKPAKKKEVPPQAQAQAQTQSVSAPTAPSGVTAAANEGRRCLHCETDKTPQWRTGPMGPKTLCNACGVRYKSGRLVPEYRPAASPTFVTSRHSNSHRKVLELRRQREMHHHHQPSQLQQHAVAGGVGRIMHMESHLLFDGPAAPPILGGGDDFLIHHRLGTADYRQQLI

SEQ ID NO: 4817 - DNA, 1989 bp, Triticum aestivum
  misc_feature (1)..(1989): Ceres cDNA ID no. 21995993
  misc_feature (1)..(1989): Ceres CLONE  ID no. 941263
  misc_feature (1)..(1989): Also known as  Ceres CDNA ID no. 24411717
actctgcacccctgcacagggtgtccccgaccaagtacaccaccaagctttaaactctgctctgctactagtctcgcccactcttcttctcgatctctaagctgcagcccacagcacgcaaacagcggaccgatgtgcaccaccacccctgcgccgtcggcgccagccgtggcagtctccggcggcaagggcctccatcacgtctatgtgacgctagcccagagcgcagacattcacgggcacgggggcgaggcgtccggcgctcattgtcacccccagctcaagtgccacggggttgacggccacgccgtgctcctgacggtgactggtggcgagactttccaggaggcggcggcactgtgccggctggcgtgcccgatcgcgctgacagcgctgctgctctactctcgcaccgcgctgtccatgctcttcctcggctccctcggcgacctccagctagcggcgggttcgctcgccgtcgccttcgccaacatcaccggctactcagtgctctccgggctctccctcggaatggacccgctttgctctcaggcgtttggcgccaaccagccgacgctcctgggcctcaccctctaccgctctgttctcttcttgctctgctgctcgctgccgctctctgcgctgtggctcaacatgtcaaagatcctcctcttcctcggccaggaccgcgatatcacggagctcgcgcagcagtacctcctattctccctccccgacctcttcaccttctccctgatccacccactacgcgtctacctccggtcgcaaggtgtcacgcagccgctcaccaccgccgcgggcgcagccgtgctgttccacgtgctggccaactacgtgctggtggggcgactcgggctcggcgccgagggggttgccgccgcggcctcggcttccaacttcgtgctactcggcgtgttgctggcgtacgtcagccggcgcgacacggcgttgcgggaggcatggggtcccacggcggagtggctcgccggatggggcccgcttgcgcggctggccgctcctagctgcgcgtcggtgtgcctggagtggtggtggtacgaggtgatgatcttgctgtgcgggctactgccggagccaaagccggcggtggcgtccatgggcgtgcttatgcagacgacggcgcttgtgtatgtcttcccgtcgtccctgggtctcggcgtgtcgacgcgggtgggaaacgagctgggcgcgaatcgcccaggccgcgcgcgctcttccgctcgggtggccatggtcggcgccgccgtaatgggactcttggccatgtcgttcgcagcgggtacgcgccacgcatggggtcgactcttcaccgccgacgccgacatcctccgcctaactgcagccgcgctgccggtcgtagggctgtgcgagctcggaaattgcccacagaccgtcggctgcggcgtgctccgcggcagcgcccggccgtcgcgagccgcgcacgtcaacctcggcgctttctatcttgtgggcatgcccgtcgccgtcgtgcttgcgttctggttcggcgtgggcttcgttgggctctgggtggggctcctcgccgcccaggtgtgctgcgccgggctcatgctgtgcgccgtgggatccaccgactgggaggcgcaggctcggcgggctcaggtgctgacatcgtcgtcctctccagacgtggagatgtccgacgctgggaagggcgggggccacgcgtcggcggcggcggccgcggcagggggagccgggcccgagaaaggggagcacgatgaggacagggcggacaggaggcgctacgagccattgatctcgaatgagagggccgagcccgggtcagtgcaggtgctttgagattggcggaaagcacgatgccattgtataatttctttcttattcttacttctgattaattggactgctattgctataataataccaagtactgtgctaatgtgttcaagaaaaaaaaaaaaaaaa

SEQ ID NO: 4818 - protein, 576 aa, Triticum aestivum
  misc_feature: PFam Name: MatE; PFam Description: MatE
  misc_feature: GI Number: 15241158; NR Description: MATE efflux
  misc_feature: GI Number: 50253264; NR Description: membrane protein-like
  misc_feature: GI Number: 53792971; NR Description: putative NIC2 [Oryza
  misc_feature: GI Number: 37536202; NR Description: putative membrane protein [Oryza sativa (japonica cultivar-group)] >gi|27311284|gb|AAO00710.1| putative membrane protein [Oryza sativa (japonica cultivar-group)] >gi|31433137|gb|AAP54690.1|
  misc_feature: GI Number: 50920489; NR Description: Putative membrane protein [Oryza sativa (japonica cultivar-group)] >gi|20532318|gb|AAM27464.1| Putative membrane protein [Oryza sativa (japonica cultivar-group)] >gi|27356666|gb|AAO06955.1|
MCTTTPAPSAPAVAVSGGKGLHHVYVTLAQSADIHGHGGEASGAHCHPQLKCHGVDGHAVLLTVTGGETFQEAAALCRLACPIALTALLLYSRTALSMLFLGSLGDLQLAAGSLAVAFANITGYSVLSGLSLGMDPLCSQAFGANQPTLLGLTLYRSVLFLLCCSLPLSALWLNMSKILLFLGQDRDITELAQQYLLFSLPDLFTFSLIHPLRVYLRSQGVTQPLTTAAGAAVLFHVLANYVLVGRLGLGAEGVAAAASASNFVLLGVLLAYVSRRDTALREAWGPTAEWLAGWGPLARLAAPSCASVCLEWWWYEVMILLCGLLPEPKPAVASMGVLMQTTALVYVFPSSLGLGVSTRVGNELGANRPGRARSSARVAMVGAAVMGLLAMSFAAGTRHAWGRLFTADADILRLTAAALPVVGLCELGNCPQTVGCGVLRGSARPSRAAHVNLGAFYLVGMPVAVVLAFWFGVGFVGLWVGLLAAQVCCAGLMLCAVGSTDWEAQARRAQVLTSSSSPDVEMSDAGKGGGHASAAAAAAGGAGPEKGEHDEDRADRRRYEPLISNERAEPGSVQVL

SEQ ID NO: 4819 - DNA, 1519 bp, Zea mays
  misc_feature (1)..(1519): Ceres cDNA ID no. 21995995
  misc_feature (1)..(1519): Ceres CLONE  ID no. 984090
  misc_feature (1)..(1519): Also known as  Ceres CDNA ID no. 24373651
atccgcgccccattagcaactgcgcgcacctcctgacctccactccagccgtctcctccctccgcgtccggctcccggttccgttccgcttccgcgatggggcagcaagagggccacagcaacccccaccccgacgaggcggcgctcccgacgaccaccgccgcaccgtcgccgtcgccgtcgccgtcgccgtcgccgtcctcgtccaggctctacacggcgtggctggtggcgtcgtggtacgcgtccaacatcggcgtgctgctgctcaacaagtacctgctctccgtgtacggcttccgcttcccgctgctgctgaccgcgtgccacatgtccgcctgcgccgtcctctccacgctcgcccagcacgcctcgccccgcccccgcagcagctcctccccgcgctcccaccgccagctcgctcgcgtcgcgctcctcggcgccgtcttctgcgcgtccgtcgtcgccgggaacgtctcgctccgccacctccccgtctccttcaaccaggccgtcggcgccaccacgcctttcttcaccgcgctcctcgcctacgccgtcgccgcccgccgcgaggcctgcgccacctacgccgcgctcgtccccgtcgtcgccggcgtcgccatcgccaccgggggcgagccgagcttccacctcttcggattcgtcatgtgcgtggccgccacggtggggcgcgcgctcaagaccgtgctgcagggcatcctgctatcgtccgaggaggagaagatggactccatggacctcctccgctacatggcgccggtggccgtgctgctgctggtaccggcgacgctggccatggagcgggacgcgttcggcgtggtggcgggcctcgcgcgggaggaccccagcttcctctggctcctgctctgcaactcctgcctcgcctacttcgtcaacctcaccaacttcctcgtcacaaagcacaccagcccgctcactctccaggtcctcgggaacgccaaaggcgccgtcgccgtcgtcgtctccatcctcatcttcaggaaccccgtcacggtcgtgggcatgctgggctacggggtcacggtcgctggcgtcgtcttgtacggcgaggccaagaagaggagcaagtgaagcgacggacaggctcctgtacctgtacatttgctgtccggccttggaatgcaacgccggcggtgatagctagggagaagacaagcaagcaaagcgacagctggggtggtttgttcgtcgcatcgtttcagaaggaggtgaaccatacaatacaagaactcgtgtcgtagcacagagagagagagtgtgtgtcgtttagcatttgaacgagcttgccgtccaaagcctacgattttaatccggcctggagaagaagaaaaaaaacgaagctagctaattatcaaaccaacacctagcatctgaacatatgtgcagcaatccaactgggtttccatattttaatgttgtcgatgaattggtccttcctaaacaacatttccgtttgaacaaaaaaaaaaaaaaa

SEQ ID NO: 4820 - protein, 339 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: 7tm_1; PFam Description: 7 transmembrane receptor
  misc_feature: PFam Name: Pkinase; PFam Description: Protein kinase domain
  misc_feature: GI Number: 50920603; NR Description: Putative phosphate/phosphoenolpyruvate translocator protein [Oryza sativa (japonica cultivar-group)] >gi|27476065|gb|AAO16996.1| Putative phosphate/phosphoenolpyruvate translocator protein [Oryza sativa
  misc_feature: GI Number: 53828521; NR Description: At3g11320 [Arabidopsis
  misc_feature: GI Number: 61651608; NR Description: plastidic phosphate
  misc_feature: GI Number: 52421287; NR Description: At5g05820 [Arabidopsis thaliana] >gi|50198793|gb|AAT70430.1| At5g05820 [Arabidopsis thaliana] >gi|30681126|ref|NP_196201.2| phosphate
  misc_feature: GI Number: 9759107; NR Description: phosphate/phosphoenolpyruvate translocator protein-like
MGQQEGHSNPHPDEAALPTTTAAPSPSPSPSPSPSSSRLYTAWLVASWYASNIGVLLLNKYLLSVYGFRFPLLLTACHMSACAVLSTLAQHASPRPRSSSSPRSHRQLARVALLGAVFCASVVAGNVSLRHLPVSFNQAVGATTPFFTALLAYAVAARREACATYAALVPVVAGVAIATGGEPSFHLFGFVMCVAATVGRALKTVLQGILLSSEEEKMDSMDLLRYMAPVAVLLLVPATLAMERDAFGVVAGLAREDPSFLWLLLCNSCLAYFVNLTNFLVTKHTSPLTLQVLGNAKGAVAVVVSILIFRNPVTVVGMLGYGVTVAGVVLYGEAKKRSK

SEQ ID NO: 4821 - DNA, 855 bp, Zea mays
  misc_feature (1)..(855): Ceres cDNA ID no. 21995996
  misc_feature (1)..(855): Ceres CLONE  ID no. 986233
  misc_feature (1)..(855): Also known as  Ceres CDNA ID no. 23833056
cttaaatacagcaccgcgctagtcctctcctctctcgcgccgcacacactgaccaacagcaagctcagctgcacgcactgcacctcccgggccagccgccagccgccggccagcatggaggcggtggtagagtgcgccaagtgcgagtgctgcggcctggtggaggactgcacccgggactacatcctgggcgtgcgcgcggccttcggcgggcggtggctctgcggcctctgctccgaggcggtgcgggacgaggcggccaggggcacgacggcgagaggccccgccgccgccgccgcggggctggaggacgcgctccgggaccacatggccttctgcggcaagtgcaggcggagccccgcgttccgggtcgccgacggcatgcgccagatgctgcgcaggtgctccaagtgactgctggcgccggccgcgtcggcgtcggcgtcggcgttgcacggcgaaaaatcggcagtgcgacccacccgcgtcgtctagcgagcctttgggcatggacaagcaagacaagacaaaggcgaccacgccggccattgctgtgtcgtctccgcgcaatgagctgcttggcaacatcatgtatgtgcaaggaaatggctcggcacggcagtcggcagtattattagggtgtttagtttggtgatctctgagaacccagagactcgtaggtgctgtaaaggtgaagctagaactagaacgccgctacatcagtcagtgccattaggcttggtacattcttcaggctacagctgtttcgtcaataaggaaactacgtgtataatctgcggacggcaggcgaaaatagcacgtagtacaattccattcctaaaaaaaaaaaaaaaa

SEQ ID NO: 4822 - protein, 99 aa, Zea mays
  misc_feature: GI Number: 34903640; NR Description: B1015E06.3 [Oryza sativa (japonica cultivar-group)] >gi|20804510|dbj|BAB92204.1| B1015E06.3
  misc_feature: GI Number: 21555605; NR Description: unknown [Arabidopsis thaliana]
  misc_feature: GI Number: 34909436; NR Description: OSJNBa0014K08.12 [Oryza sativa (japonica cultivar-group)] >gi|21902038|dbj|BAC05587.1|
MEAVVECAKCECCGLVEDCTRDYILGVRAAFGGRWLCGLCSEAVRDEAARGTTARGPAAAAAGLEDALRDHMAFCGKCRRSPAFRVADGMRQMLRRCSK

SEQ ID NO: 4823 - DNA, 1131 bp, Zea mays
  misc_feature (1)..(1131): Ceres cDNA ID no. 21995998
  misc_feature (1)..(1131): Ceres CLONE  ID no. 993306
  misc_feature (1)..(1131): Also known as  Ceres CDNA ID no. 24396496
ccttcgacgccgccctccctcagctcattccctgccgccgctcatctgctggccttgtctcactgccgcccaaccattttcctccctcaagctagcacgcagcctcaactcctctcccacctcacgcacgtctctcccagccgttccttcatttctctggctcgtccttctccatgaggtcgcgccctgctgcgccgtcgtgctggtcgccggctgagcccccttcagtgcctgacgccgcatctccctggtgctcacctctgtttccccctgcgttggacgacctcgcactccctccctgctccagatttctccatggtcgcccctttccttgccccgggtggcgagctcgcccctcattcctgctcgcctaatctccacttccctgttgcagccacctcccatggacgccagccctcagccatggatgccgaaccccctctctttagtgcctttctttacagcccctgcgtcgccgtgcgtgtaaggtgtttgtataaatgctcaagaggagtgacgtgtcatggccaacccttttggcgtcgtcggatgtttgatgttttgtgcatcccgtctacgacgccgtcgaccatcggtgaggattcgttcttgctttgtcatttcatcgatcgacgtctatttgctaatatgaattgtgtttatgtgcctatgtgtgttgaggagcgaaatccgtgaaatctaggtgaagaagagacggagcacgtcgtcgtcatggttgcagctttgcttttgtcgtcgtggagcctccaccagcgccgtgtagcattcaggaacaatggaaccaaaatacaggacattttcctacttcacgtctggatgccatccaattaatatcttctctgcgatattgcaatggaaggtgtagatagatgcaagtatacattcaatgttcttatgatagaggaaaggcatagctgcagatgggtttgatgttttatcttttcattcatgcatttcatcccatgcgcataaacaatttccaagtagcttgtgtatccaaacttggttcttttgttcactcagccaggttgtactgtttcattcagaattcggatttttcagccattaacccgcattttctattggatcgttttaaaaaaaaaaaaaaaa

SEQ ID NO: 4824 - protein, 126 aa, Zea mays
MVAPFLAPGGELAPHSCSPNLHFPVAATSHGRQPSAMDAEPPLFSAFLYSPCVAVRVRCLYKCSRGVTCHGQPFWRRRMFDVLCIPSTTPSTIGEDSFLLCHFIDRRLFANMNCVYVPMCVEERNP

SEQ ID NO: 4825 - DNA, 740 bp, Zea mays
  misc_feature (1)..(740): Ceres cDNA ID no. 21996001
  misc_feature (1)..(740): Ceres CLONE  ID no. 998198
  misc_feature (1)..(740): Also known as  Ceres CDNA ID no. 24373642
aaacactggccgagcgcaaaatttgaaaaccaaccctcaacgtcagtcggggtgccggcgtccgatgaaggcgacggcccatccccattccccacccggcaccggcagtcggcactccccacaccccaagacatcagaaagtcagaagagtcggaagaagaagcgggcgatggaagacggcgacgagagcgccgcggcggcggtggcggcggcgctggggctgagcccgcagcttttcgtcaacgaggtccacggcatcattgccgacatcagcgccgaggccttcgagtactgcctccaggcagcagccgcgccaggtgtcgtcggcgccgccacggctgcggagaaggccacggatctccagcggggattaaatgctattcaccatgttgttaaggatcgactggataagagaatggccaactgggagaaattctgctttcgacattgcttcgatgtacctgaaggttttgtggccgctgatgatgtgcgtgcctcatcctaatgttaaggatttgaatccagcatgcttaagttacattcatactgtggagaagtttcatttgtgttcatgaagattcataatttcgaaatctggtgcttctttattgatgtaaacagtaaacatttagttacagatgcccacacactcttgtacaggcataaaaacgaagattttgttatcgtaatgtaaatgactatgtatataatcttttttttcttcaaaaaaaaaaaaaaaa

SEQ ID NO: 4826 - protein, 146 aa, Zea mays
  misc_feature: PFam Name: Mis12; PFam Description: Mis12 protein
MKATAHPHSPPGTGSRHSPHPKTSESQKSRKKKRAMEDGDESAAAAVAAALGLSPQLFVNEVHGIIADISAEAFEYCLQAAAAPGVVGAATAAEKATDLQRGLNAIHHVVKDRLDKRMANWEKFCFRHCFDVPEGFVAADDVRASS

SEQ ID NO: 4827 - DNA, 1298 bp, Triticum aestivum
  misc_feature (1)..(1298): Ceres cDNA ID no. 21996002
  misc_feature (1)..(1298): Ceres CLONE  ID no. 1000720
  misc_feature (1)..(1298): Also known as  Ceres CDNA ID no. 24369440
cggccgcatgtacctttgcgttgacacggtgcaattaacgcgcgtgcaggctacggcgagatggtgacgtgctccaagtcgctcagcgcggacctgttcgacgcggtgctgggcgggctcggccagttcggcgtgatcgtgcgcgcccggatcgcgctcgagccagcgccgacgcgggcgcggtgggcgcggctcgtctacaccgacttcgccgccttctccgccgaccaggagcggctcgccgcgcccgggcccgacggcgcgttcgggccgatgagctacctcgagggcgcggtctacgtgaaccacagcctggccgccgggctgaggaactcgggcgggttcttcaccgacgccgacgtcgccaggatcgtcgccgtcgccgcggcgaggaacgccaccaccgtgtacgtgatcgaggcgacgctcaactacgacgacgccacggccgcgtccgtggagcaggagctcagctcggtgctggcgacgctgaggcacgaggaggggctcgcgttcgtgcgggacgcgtcgtacctcgagttcctggaccgggtgcacggcgaggaggtggcgctggacaagatcgggctgtggcgcgtcccgcacccctggctcaacgtgctcgtgccccgctcccgcatcgccgacttcgacagcggcgtcttcaagggcatcctccaggacaccgacatcgccgggcctctcgtcgtctacccgctcaacaaatccaagtgggacgacggcatgtcggcggtgacgccggcggaggaggtgttctacgcggtgtcgctgctcttctcgtcggtggccgacgacctgaagcggctggaggcgcagaaccagaagatactgcggttctgcgacctcgccgggatagggtacaaggagtacctggcgcactacacggcccacggcgactgggtccgacacttcggcggcaagtggaaccgcttcgtggagatgaaggacaagtacgaccccaagaggctgctctcccctggccaagacatcttcaacctggtcctttgagtagatgcaattactactagttgttactacttgtggattaactcgtgtggacagtaacacatcagtttaactttaatttttcgattttactcatgcaatagcaaatttgatagtaggtggtacggtaataatatgctctgtcgagcttgaatctccacatgtatccgttactaaatagcagtagtactgtaagcaaaagtgtgaagaaagctccaccgatgtacacttgccaaataaatgtttcattgagcacaaaaaaaaaaaaaaaa

SEQ ID NO: 4828 - protein, 322 aa, Triticum aestivum
  misc_feature: PFam Name: FAD_binding_4; PFam Description: FAD binding domain
  misc_feature: GI Number: 52696250; NR Description: Chain A, Plant Cytokinin Dehydrogenase In Complex With Benzylaminopurine >gi|52696249|pdb|1W1R|A Chain A, Plant Cytokinin Dehydrogenase In Complex With Trans-Zeatin >gi|52696248|pdb|1W1Q|A Chain A, Plant
  misc_feature: GI Number: 3341978; NR Description: cytokinin oxidase [Zea
  misc_feature: GI Number: 3882018; NR Description: cytokinin oxidase [Zea mays] >gi|20138062|sp|Q9T0N8|CKX1_MAIZE Cytokinin dehydrogenase 1 precursor (Cytokinin oxidase 1) (CKO 1) >gi|25458952|pir||T51929
  misc_feature: GI Number: 50906393; NR Description: putative cytokinin dehydrogenase 1 precursor [Oryza sativa (japonica cultivar-group)] >gi|46805863|dbj|BAD17197.1| putative cytokinin dehydrogenase 1
  misc_feature: GI Number: 50906391; NR Description: putative cytokinin dehydrogenase 1 precursor [Oryza sativa (japonica cultivar-group)] >gi|46805862|dbj|BAD17196.1| putative cytokinin dehydrogenase 1
MVTCSKSLSADLFDAVLGGLGQFGVIVRARIALEPAPTRARWARLVYTDFAAFSADQERLAAPGPDGAFGPMSYLEGAVYVNHSLAAGLRNSGGFFTDADVARIVAVAAARNATTVYVIEATLNYDDATAASVEQELSSVLATLRHEEGLAFVRDASYLEFLDRVHGEEVALDKIGLWRVPHPWLNVLVPRSRIADFDSGVFKGILQDTDIAGPLVVYPLNKSKWDDGMSAVTPAEEVFYAVSLLFSSVADDLKRLEAQNQKILRFCDLAGIGYKEYLAHYTAHGDWVRHFGGKWNRFVEMKDKYDPKRLLSPGQDIFNLVL

SEQ ID NO: 4829 - DNA, 1495 bp, Triticum aestivum
  misc_feature (1)..(1495): Ceres cDNA ID no. 21996003
  misc_feature (1)..(1495): Ceres CLONE  ID no. 1002604
  misc_feature (1)..(1495): Also known as  Ceres CDNA ID no. 24411937
aatcgaccccccgcaggcgcgcccgcctccctcccacagcccacaggcataaacgcccgcctcccctcgtctcccgcccgcctcgcccgccgccaaccccccaatcgctttcaaatcgcgcggccgcccgatcggcggcggcgatggaggtgggcgacctgcacaaggtgtgggagatccgggcgctcaagcggaagcccgaggagcccaccgcgcgcgcgctcctcgaccgcgtcgccaagcaggtccagcccatcatgcgccgccgcaagtggcgcgtcaaggtcctctccgagttctcgccgaagaacccgaggctgctggggctcaacgtcaaccggggcgccgaggtgaagctgcggctccggcgcgacggccgcgacctcgacttcatcccctacgaggaggtgctcgacaccatgctccacgagctcgcgcacaacgcgcgcgggccccacgacgcgcagttctacaagctctgggacgaactccgcaaggagtgtgaagaacttgttgcaaagggtatcacggggccaggacaagggtttgatggtacaggcaggcgattaggtggattttcaatacatccaccaccaccatctctccgacaagctacactaactgcagcacagaaacgggcaaggaatggggctctattgccgtccggcccaagaaagttgggtggaaataatgccatcatgagtgctcttagtccagtacaagctgctgccatggctgctgaaaggaggatgcaggatgacttgtggtgcggatcacataatgattctggtatcgatgattcagaagatgttgttattcttgagcaaccacctaacttgacaacaagggatggaaaaaacacaaagcgtgcaaaaaacacaagttctatgtgggagtgtagtgcttgcactcttcttaatcagcctctggcaccaatttgtgaagtttgtgggacagcgaaacctaaaattgcaaaagccaagtacgcatcttggtcctgtaagttctgcactctggagaactgcactaagcttgataaatgttcggcatgcgatcaatggaggtactcatatggaccacctgtagccacatatggtccaagctacgattgacttacattgaaggctccaagaatacgtttacaattttgggggaggcggctgctgcaatgtttaaaattgcctcaccagcagcggttgcctctgcagccacctaccaagtaccactgcatgccaactcaaacccgtggagtcgcaggaagatttagcatccagatctgggcacctgtcggcctgccaatggctcccaattcctctctgggagcactgaatcctgtatgccttggtgacttccgcgcgtggttgctgatttaaagaacgtggtcggtcttgtcatcttgtgcaaggatgcctacatgtttgcaaattgcagcagttgctatcactgccttgttcgtctcatatacagtagtggctcaccaaaaaaaaaaaaaaaa

SEQ ID NO: 4830 - protein, 322 aa, Triticum aestivum
  misc_feature: PFam Name: zf-RanBP; PFam Description: Zn-finger in Ran
  misc_feature: GI Number: 8778309; NR Description: F14J16.17 [Arabidopsis
  misc_feature: GI Number: 66847652; NR Description: zinc metallopeptidase,
  misc_feature: GI Number: 9957265; NR Description: ORF556 [Trypanosoma brucei]
  misc_feature: GI Number: 19075821; NR Description: putative Zn-protease [Schizosaccharomyces pombe] >gi|7493180|pir||T40972 probable zinc metalloproteinase - fission yeast (Schizosaccharomyces pombe) >gi|3790252|emb|CAA21441.1| SPCC1442.07c [Schizosaccharomyces
MEVGDLHKVWEIRALKRKPEEPTARALLDRVAKQVQPIMRRRKWRVKVLSEFSPKNPRLLGLNVNRGAEVKLRLRRDGRDLDFIPYEEVLDTMLHELAHNARGPHDAQFYKLWDELRKECEELVAKGITGPGQGFDGTGRRLGGFSIHPPPPSLRQATLTAAQKRARNGALLPSGPRKLGGNNAIMSALSPVQAAAMAAERRMQDDLWCGSHNDSGIDDSEDVVILEQPPNLTTRDGKNTKRAKNTSSMWECSACTLLNQPLAPICEVCGTAKPKIAKAKYASWSCKFCTLENCTKLDKCSACDQWRYSYGPPVATYGPSYD

SEQ ID NO: 4831 - DNA, 1144 bp, Triticum aestivum
  misc_feature (1)..(1144): Ceres cDNA ID no. 21996004
  misc_feature (1)..(1144): Ceres CLONE  ID no. 1016990
  misc_feature (1)..(1144): Also known as  Ceres CDNA ID no. 24411989
atttttttcctttcgcccacgcttccatcgccgcaggcaacccacccctcctcctcgtccatctcgctctcctctcctctcctcctcaccacgtccacgccctacccatctcgccgccgccgccgccgcagccgccagggcctgagcggctgcgggggctagggttgcgggcgcgacgtcgcccccggccatggtgatctcggcggagccgccgcccgcggctctgccgtcggatcccaccgcggaaggcggcgccggggaggcgggcggcgcggacgcggaggcggtgattacgccgtcgagcgcgcgccgcggggccctgtcgtcgctcccgtcgatgctcaagacgtgggggagccaccggatgctgcgctgcgcccccgtcaaccgcgccggcgacgccatcgccccggccaggcggtcctcctcgcagcagctcgacgaggtcagcgagaggctcctcctcggcctccgggaggcggcggcggcggcgcccggcgggggcggcagcgccgcggacgacgacgagtccccgggggccggcgaggcggcctctccgcggccgtcgaaggcgcgcacccgacgacgccgccgcgccctgatgccgccgtccccggcgcccgccgcgagcgcctcgccccaggcgtcggagcgcgagcggaggctggtccgcgccgacgcgctcggccgggcgcgtttctccgcgacgctctctgccgaggagatcgaggaggacgtgtacgcgctgaccggcgcgcgcccgcgccgccgcccccggcgccgccggccccgcgccgtgcagaagcagctcgatatgctgcttcccggcgcgtggctatcggagatcaccgccgagttctaccgggtgccggacgatcgctgacccgctcccgcccaacccaacaggtcgggctgattgatatgaatcccagcagcattcaactagtagttgtagcagtagtgctctaagcagcgtcagtgagtgattctccagcagtggtggttgtggctcgtagtatcatcagcggattgggaggacgcaatgtggtgtacacctcgatggtccagtcagtacaatcgttaacatctatctctgttgcggtgcggtctcaatgcttcttctgtgccaaaaaaaaaaaaaaaa

SEQ ID NO: 4832 - protein, 230 aa, Triticum aestivum
  misc_feature: PFam Name: Cupin_1; PFam Description: Cupin
  misc_feature: PFam Name: MARCKS; PFam Description: MARCKS family
  misc_feature: GI Number: 34911320; NR Description: P0519D04.29 [Oryza sativa (japonica cultivar-group)] >gi|18844901|dbj|BAB85370.1|
  misc_feature: GI Number: 34911314; NR Description: P0519D04.26 [Oryza sativa (japonica cultivar-group)] >gi|18844898|dbj|BAB85367.1|
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 66778264; NR Description: LigA [Anaeromyxobacter dehalogenans 2CP-C] >gi|66856061|ref|ZP_00400131.1| LigA
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MVISAEPPPAALPSDPTAEGGAGEAGGADAEAVITPSSARRGALSSLPSMLKTWGSHRMLRCAPVNRAGDAIAPARRSSSQQLDEVSERLLLGLREAAAAAPGGGGSAADDDESPGAGEAASPRPSKARTRRRRRALMPPSPAPAASASPQASERERRLVRADALGRARFSATLSAEEIEEDVYALTGARPRRRPRRRRPRAVQKQLDMLLPGAWLSEITAEFYRVPDDR

SEQ ID NO: 4833 - DNA, 1379 bp, Glycine max
  misc_feature (1)..(1379): Ceres cDNA ID no. 21996005
  misc_feature (1)..(1379): Ceres CLONE  ID no. 1027561
  misc_feature (1)..(1379): Also known as  Ceres CDNA ID no. 24399174
gatgtgatagaaaaaggaggaacgcagaccgaggcgtttccagttcgaaagggaaatgaaagtgtctttgttggtgaagggtaggtgagagaaacgaaaggggtgtgtgttgggttgaataggtatagataggatcaatgagcaacaacaacgcaggaaaggtggtgtgtgtgacgggtgcttctggtttcatagcttcatggatcgtcaaattccttctccaacgtggttacactgtcagggccaccgttcgctacccaagtaatctgaaaaaggtagatcacttggttaaacttgagggcgcaaaagagaggttgcagctgtttaaggcagatctgttggaagaaggttcctttgactctgttgtggaaggctgtcatggtgtttttcatactgcttcacctgtccgttttgttgtcaacgacccacaggctgaattgcttgatcctgcagtgaagggaactcttaatgttctcaaatcatgtgcaaaatcaccatctgtcaaacgggttgttttaacttcttctatttctgcagttgcatttaatcgaagacctaaaactcctcaagtggtagttgatgagacatggttttcagatccagatgtctgtagggaattagagttgtggtacacactttcaaagactttggctgaggatgctgcctggaaatttgtaaatgaaaacagcattgacatgatttctattaacccaactatggtggcaggacctctcttacaaccagagattaatgaaagtgttgagccaattttaaacctaataaatggtaaaccatttccaaataaatcttttggatgggtcgatgtgaaagatgttgctaatgctcatattctggcctatgaaattgcttcagctagtggaagatattgtttggttgagagagtcatacactactctgaacttgctacgattttacgtggtctgtaccccacattacaaattccagataagtgtgaggtagatgagccgtatatcccaacataccagatttccacagaaaaggcaaaaaaggacttgggaatagagtttactcctttggaagtgagtctcagggagactgtggaaagctttagagaaaagaagattgtcaactttaatccgtgatctatcctaaataaataaatgtcgatgatctcaaccacgttcaatttgtgactatgataaatgtcaggcttcagaaggaattatcactgtaaaatatggattgcaaacaggttaacattgtttgatgaaggaccgaatataaaaggataaattgtatataaattcctgaactttgggcgaattatgctttgtccttttttatgaatttcaactgtacaatgttcgagtccaaaaaaaaaaaaaaaaaaaaaaaaa

SEQ ID NO: 4834 - protein, 328 aa, Glycine max
  misc_feature: PFam Name: SRP14; PFam Description: Signal recognition
  misc_feature: GI Number: 21618107; NR Description: putative 14kD signal recognition particle protein ATSRP14 [Arabidopsis thaliana] >gi|27765064|gb|AAO23653.1| At2g43640 [Arabidopsis thaliana]
  misc_feature: GI Number: 2208946; NR Description: signal recognition particle subunit 14 [Arabidopsis thaliana] >gi|6175053|sp|O04421|SR14_ARATH Signal recognition particle 14 kDa
  misc_feature: GI Number: 5107800; NR Description: Signal Recognition
  misc_feature: GI Number: 27731985; NR Description: similar to signal recognition particle 14K chain - mouse [Rattus norvegicus] >gi|18204546|gb|AAH21537.1| Signal recognition particle 14 [Mus musculus] >gi|134881|sp|P16254|SR14_MOUSE Signal signal
  misc_feature: GI Number: 50604187; NR Description: Srp14-prov protein
MSNNNAGKVVCVTGASGFIASWIVKFLLQRGYTVRATVRYPSNLKKVDHLVKLEGAKERLQLFKADLLEEGSFDSVVEGCHGVFHTASPVRFVVNDPQAELLDPAVKGTLNVLKSCAKSPSVKRVVLTSSISAVAFNRRPKTPQVVVDETWFSDPDVCRELELWYTLSKTLAEDAAWKFVNENSIDMISINPTMVAGPLLQPEINESVEPILNLINGKPFPNKSFGWVDVKDVANAHILAYEIASASGRYCLVERVIHYSELATILRGLYPTLQIPDKCEVDEPYIPTYQISTEKAKKDLGIEFTPLEVSLRETVESFREKKIVNFNP

SEQ ID NO: 4835 - DNA, 1410 bp, Glycine max
  misc_feature (1)..(1410): Ceres cDNA ID no. 21996008
  misc_feature (1)..(1410): Ceres CLONE  ID no. 1045399
  misc_feature (1)..(1410): Also known as  Ceres CDNA ID no. 24372850
acaacacaacacaacacaacacaaaccattcaatttctccttcatggctctcctcacatcccaacctaaaaaccccattctccatcgcttcaccacccttcactgccctcttccacgcttacatagaaccgttcttggtcttggctccttctctcacaacagtgctctctccactaaaaaacttaactttaacccaacgcaaaccaaaatttcccttcaaaacaacccctttacctataatttggcagtgacagccaaagccaatgccaatgctgcatttggagaaggtttcaaggaggaaggggcatcgaaacacagaaagattttgttgtcagaggttgaggtgaagagagagaggagagttttctttggcagaaaatggaactctttggattttggcactgctggaattgtgttggcaatgcatctcctttgcgtctttgctccattccatttcaattggccagctttttgggtggctgtggctctctatattgtcactggcctttttggtatcactctttctttccataggaacctttctcacaggagtttcaagcttcccaaatggcttgaatacttctttgcctattgtggggtcctggctcttcaggggaatccgattgattgggtgagcacacataggtaccatcaccagttttgtgattctgagagagaccctcatagcccaactgaaggattctggttcagtcatatgagttggctatttgataccaattctgtcctagaaaggtgtggagaggcaaacaatgttggtgatttggagaaacaatccttctatagatttctccgaagcacttaccttgcccacccttttgctttgggagcccttttatatgccgcaggaggatttcctttccttgtttggggaatgggagtgaggattgtttgggtttatcacataacctggtttgtaaactcagcttgccatgtctgggggaatcaagcatggaacaccagggacttgtccagaaataattggtgggtggcgttgcttgcatttggtgagtgttggcacaataaccaccatgcttttgagtactcagctagacatggacttgagtggtggcaaatagatatgacttggtacgttgtgagatttctccaagctattgggttggccactgacgtcaagttacccacagagagtcagaagcagaaaatggcattcaatagtgattcaattgccacatgaaacacaataaatgataaaaaaaaatgaaaataaaaaggattttagaggtactcgttgatggcacaaaagttttggtagggaaattgttcttttttgggtcttactttcagccatcatcgatgctggatttgaccatgtatatgggactagaaaataatgttactatatattgacacacaaaaaaaaaaaaaaaa

SEQ ID NO: 4836 - protein, 390 aa, Glycine max
  misc_feature: PFam Name: FA_desaturase; PFam Description: Fatty acid desaturase
  misc_feature: GI Number: 24030393; NR Description: putative delta 9 desaturase [Arabidopsis thaliana] >gi|11994357|dbj|BAB02316.1| delta 9 desaturase-like protein [Arabidopsis thaliana] >gi|48927606|dbj|BAD23903.1|
  misc_feature: GI Number: 15292809; NR Description: putative delta 9
  misc_feature: GI Number: 21554352; NR Description: putative delta 9
  misc_feature: GI Number: 20142325; NR Description: desaturase delta 9
  misc_feature: GI Number: 12083274; NR Description: putative delta 9 desaturase [Arabidopsis thaliana] >gi|8810470|gb|AAF80131.1| Contains a very strong similarity to delta 9 desaturase mRNA from Arabidopsis thaliana gb|D88536 and contains a fatty acid desaturase
MALLTSQPKNPILHRFTTLHCPLPRLHRTVLGLGSFSHNSALSTKKLNFNPTQTKISLQNNPFTYNLAVTAKANANAAFGEGFKEEGASKHRKILLSEVEVKRERRVFFGRKWNSLDFGTAGIVLAMHLLCVFAPFHFNWPAFWVAVALYIVTGLFGITLSFHRNLSHRSFKLPKWLEYFFAYCGVLALQGNPIDWVSTHRYHHQFCDSERDPHSPTEGFWFSHMSWLFDTNSVLERCGEANNVGDLEKQSFYRFLRSTYLAHPFALGALLYAAGGFPFLVWGMGVRIVWVYHITWFVNSACHVWGNQAWNTRDLSRNNWWVALLAFGECWHNNHHAFEYSARHGLEWWQIDMTWYVVRFLQAIGLATDVKLPTESQKQKMAFNSDSIAT

SEQ ID NO: 4837 - DNA, 694 bp, Triticum aestivum
  misc_feature (1)..(694): Ceres cDNA ID no. 21996010
  misc_feature (1)..(694): Ceres CLONE  ID no. 1047990
  misc_feature (1)..(694): Also known as  Ceres CDNA ID no. 23484576
acacaacacacaatccaagttaaagaaaccgttacaaaaagaaaagaaaaactacgttgtttcttgaaaatggagattcttaagttcgctgtcatttttgtactttgctccatctcgtcgtctaacgccgcaactacaccgccgagcggcggagcaggagatgctcactcaatgccatgtatacaaaaactgatgccgtgtcagccgtatcttcgctcagtcactccgccgcctccagcgtcgtgttgtatgccgctgaaggagatcgtcgagaccgacgtgaactgtctttgctccgtcttcaacaacgtagatatgcttaaatcgcttaaccttactaaagaaaacgctcttgttctccccaaagcttgtggcgccaacgctgatgtgtcgcagtgcaaagccagcaccggtactacgacgccttcgacgtcaccaggaactactaaaactcctccggcagctcccgctgaaagcggatctacgggaggttcagcttcttcaacggccaaaccatcagactcggctccggccatcattttttctggaattagcttcgcctccgctttcgtggcattggcaacaatctttttctgatatcctactaattagtcacgtctttattcagcttagttggtttaaaatgttggaaactactattatcagacaatattcggtaaaaaaaaaaaaaaaa

SEQ ID NO: 4838 - protein, 175 aa, Triticum aestivum
  misc_feature: PFam Name: Tryp_alpha_amyl; PFam Description: Protease
  misc_feature: GI Number: 18410388; NR Description: protease inhibitor/seed storage/lipid transfer protein (LTP) family protein [Arabidopsis
  misc_feature: GI Number: 21593596; NR Description: lipid transfer protein,
  misc_feature: GI Number: 7484433; NR Description: lipid transfer protein - Norway spruce >gi|2627141|dbj|BAA23548.1| lipid transfer protein
  misc_feature: GI Number: 42563102; NR Description: receptor
MEILKFAVIFVLCSISSSNAATTPPSGGAGDAHSMPCIQKLMPCQPYLRSVTPPPPASCCMPLKEIVETDVNCLCSVFNNVDMLKSLNLTKENALVLPKACGANADVSQCKASTGTTTPSTSPGTTKTPPAAPAESGSTGGSASSTAKPSDSAPAIIFSGISFASAFVALATIFF

SEQ ID NO: 4839 - DNA, 671 bp, Glycine max
  misc_feature (1)..(671): Ceres cDNA ID no. 21996013
  misc_feature (1)..(671): Ceres CLONE  ID no. 1053999
  misc_feature (1)..(671): Also known as  Ceres CDNA ID no. 23708442
attttgttggtgttctcgtctcactgccgtacaattattccatttcattccttctcgatggctactactcaaggacaagtcattacatgcaaattaaagccgcggtggcctgggaacccaacaagccattgtccatcgaggacgttcaggtggcgccaccgcagaatggcgaggtccgtatccaaattctctacactgctttctgtcacaccgacgcttacacttggagcggatccagaaggtcttttccatgtatacttgatcatgaggctgcagggattgtggaaagtgttggagaaggtgttactgcagttcagcccggtgatcatgtcatcccttgttaccaggctgagtgtgaagagtgcaagttttgcatattaggcaaaaccaatccgtgtggcaaagttcgagccgccactggggtaggggtcatgctgagcaatcactagagtcgcttctctgtcaatggaaaacccctctatcattttatgggaaccttcacatttggtcaatacactgttgttcatgacgttagtgtagctaagattgatcccaaagccccttttgacaaagattgatctcaatactgaataaccgtatgctctccattaattgcacaccactccagctgttttgattaataagataataaaagaaaaaaaaaaaaaaaa

SEQ ID NO: 4840 - protein, 120 aa, Glycine max
  misc_feature: PFam Name: ADH_zinc_N; PFam Description: Zinc-binding
  misc_feature: GI Number: 3023271; NR Description: ALCOHOL DEHYDROGENASE CLASS III (GLUTATHIONE-DEPENDENT FORMALDEHYDE DEHYDROGENASE) (FDH) (FALDH) (GSH-FDH) >gi|7430933|pir||T04164 formaldehyde dehydrogenase (glutathione) (EC 1.2.1.1) - rice
  misc_feature: GI Number: 1498024; NR Description: glutathione-dependent
  misc_feature: GI Number: 33589744; NR Description: At5g43940/MRH10_4 [Arabidopsis thaliana] >gi|21592856|gb|AAM64806.1| alcohol dehydrogenase (EC 1.1.1.1) class III [Arabidopsis thaliana] >gi|9758553|dbj|BAB09054.1| alcohol dehydrogenase (EC 1.1.1.1)
  misc_feature: GI Number: 1143388; NR Description: class III ADH, glutathione-dependent formaldehyde dehydrogenase. [Arabidopsis thaliana] >gi|2129562|pir||S71244 alcohol dehydrogenase (EC
  misc_feature: GI Number: 50915842; NR Description: alcohol dehydrogenase class III [Oryza sativa (japonica cultivar-group)] >gi|47847883|dbj|BAD21676.1| alcohol dehydrogenase class III [Oryza sativa (japonica cultivar-group)]
MQIKAAVAWEPNKPLSIEDVQVAPPQNGEVRIQILYTAFCHTDAYTWSGSRRSFPCILDHEAAGIVESVGEGVTAVQPGDHVIPCYQAECEECKFCILGKTNPCGKVRAATGVGVMLSNH

SEQ ID NO: 4841 - DNA, 934 bp, Glycine max
  misc_feature (1)..(934): Ceres cDNA ID no. 21996014
  misc_feature (1)..(934): Ceres CLONE  ID no. 1058104
  misc_feature (1)..(934): Also known as  Ceres CDNA ID no. 23478739
gcagttcccaaggcagagagagacgaaacagttagagagaagttgagagagagagagagagagtgcttccatggaatccgaacccacggttggtgtctctgcatcagcaccaccaccaccagccaccgatgatctccaatcgagcaacgcatcgtctccagccgacgccgccgcgcgtttgatccacgccgtggagcagcgccaacagcatcttctcgacaagacggtgcctcacgttctctaccgatggatcgcctgcctcgtcgtcgtgttgatctacttcgttcgcgtctacttggtggaaggcttctacatcatcacctacgcaatcggaatctaccttctcaacctcatcatcgctttcctctcccctcaagaagatcccgaggcttcgctcagcggcgggacgcttcctactcgtagatccgatgagtatcgaccgttcgttcgccgtctccccgagttcaaattctggttatcgatcattagggcatttgtcatcggttttatgatgacgttctttgaggtctttgacgtacctgttttctggccaatacttcttttctactgggtgatgctttttatcctcaccatgaggaaacagatacaacatatgatcaaatacagatatgttcctttctctttcggcaaacagaaatatggaaagaaacctgctccagcagagagcagtgaatgatcaaatcaaccgttctgttcagcaggtcttttcttttcttttgattgcctgaaactttgttagggatgaaatagaagaaacaatcaagcaggtagactctcgtagcctgtctcagacaagttttttttactcttttatcatcctgactatgtactggtttcacccgaagacaatgtatcttattattccagttttttgtcagtgagaataatgttttttgtaaaaaaaaaaaaaaaa

SEQ ID NO: 4842 - protein, 208 aa, Glycine max
  misc_feature: PFam Name: Rer1; PFam Description: Rer1 family
  misc_feature: GI Number: 30682033; NR Description: RER1C protein
  misc_feature: GI Number: 7488292; NR Description: probable integral
  misc_feature: GI Number: 50508264; NR Description: putative AtRer1A [Oryza sativa (japonica cultivar-group)] >gi|50508077|dbj|BAD32077.1|
  misc_feature: GI Number: 21617987; NR Description: AtRer1B [Arabidopsis thaliana] >gi|2865177|dbj|BAA24804.1| AtRer1B [Arabidopsis thaliana] >gi|11281669|pir||T51628 endoplasmatic reticulum
  misc_feature: GI Number: 50943925; NR Description: putative endoplasmatic reticulum retrieval protein Rer1B [Oryza sativa (japonica
MESEPTVGVSASAPPPPATDDLQSSNASSPADAAARLIHAVEQRQQHLLDKTVPHVLYRWIACLVVVLIYFVRVYLVEGFYIITYAIGIYLLNLIIAFLSPQEDPEASLSGGTLPTRRSDEYRPFVRRLPEFKFWLSIIRAFVIGFMMTFFEVFDVPVFWPILLFYWVMLFILTMRKQIQHMIKYRYVPFSFGKQKYGKKPAPAESSE

SEQ ID NO: 4843 - DNA, 1549 bp, Zea mays
  misc_feature (1)..(1549): Ceres cDNA ID no. 21996015
  misc_feature (1)..(1549): Ceres CLONE  ID no. 1061661
  misc_feature (1)..(1549): Also known as  Ceres CDNA ID no. 23828281
atcgcattcacgtccaaccgttcgcttgcgccctccgcaacaacgcaacgcatcgtgacgccgccgctttttgcttttccgactgctgtttccgccttttgagtaggcgttgggcgagcttcggtttcgacggacgtagccgtcaccgcctcaccggcccggccatgggcgccgccgccgcctgttctcttcgcctctgccacacgtcaccatccgctgcgacggtagggccgcgatgactccggcggttcgggtggggaaccctcgcgatcccggtccgggcgccgcggtggtggaggacgaggaggaggcggcggtcgcgtggcgggagctgcgcggcaaggccgcggaggtcgcggctgcgggcgaggaaagggcggtcctggcccgccgcatcgaggccgcgctccaggtaaggagggaggcgctgcggcaggcggaggagctggacgagttgacgcggatggtggacctccagcaagcgcgtttggaggcggccgtcgtcggcaggaggcgggcgctcgaggccgtggagcgggggaagaagcggctgcaggagcagatcgaccgggtgctgccgctgtcgaggtccctcaccgccgcgcaccatcgagtgcaggaagcgaaggaggcgttatccggagacaaattcagactcaaggatctgcagaggctgcttcggacgaggcagcagcgcatggttagccaggttgctggtttgtaccctgtgagagtcttccatgatcttccaagacatgcagaaaacccctgtgccgatactaatggggagcatgtgacacttccagaggaaaacagaacattttcaggtggagatggaacacatttacccaccattatcaaatctccagaagcacgtggctggacattttttggttgggacattatgaagcataaaatgaagcaaaaaagttacaggaacaaggtgctacagaggtccgcagctgttctgggatatgcagcgcatgcagtcttgttcatagcttgctatctagatattcccctccgatatcccttgcgctttggagggtcccgatcttatgtgagtgatcgcttgccttcagctgatacagcatcatcggctgctttagcaagtaccaggaacaccgaatcagaactaacagaataccctcttttcctggaatgccaagacgatgactccactagtgcctcctatgccatttatttattgcacaaggatacggagcagcttctgaactatgttggagctgagagttgtggaaggcacgtgtttggtaacctacgagaacttcttaggatcgtgcagtctgataagtttgtgtacagatgatggttccaatccatgtggttttggagtgcttatgctgtagatgtattatagagatgtaagtaggtgtttttcttttctcttcttattctttcgtgtgattcattccctctttccctgcgctaggttttttatatgtgcaggaaataggcaattgtgtttttctagagaaatgaaatgtactcacacgtatggcttttttcgagaaaaaaaaaaaaaaaa

SEQ ID NO: 4844 - protein, 364 aa, Zea mays
  misc_feature: PFam Name: GRP; PFam Description: Glycine rich protein family
  misc_feature: PFam Name: Secretin_N; PFam Description: Bacterial type
  misc_feature: PFam Name: S-antigen; PFam Description: S-antigen protein
  misc_feature: PFam Name: eIF-3c_C; PFam Description: Eukaryotic
  misc_feature: PFam Name: Bindin; PFam Description: Bindin
  misc_feature: GI Number: 929566; NR Description: fibrillarin [Drosophila
  misc_feature: GI Number: 66771909; NR Description: IP13040p [Drosophila
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 320926; NR Description: antigen 5401 - Eimeria
  misc_feature: GI Number: 51090846; NR Description: putative glycine-rich cell wall structural protein [Oryza sativa (japonica
MTPAVRVGNPRDPGPGAAVVEDEEEAAVAWRELRGKAAEVAAAGEERAVLARRIEAALQVRREALRQAEELDELTRMVDLQQARLEAAVVGRRRALEAVERGKKRLQEQIDRVLPLSRSLTAAHHRVQEAKEALSGDKFRLKDLQRLLRTRQQRMVSQVAGLYPVRVFHDLPRHAENPCADTNGEHVTLPEENRTFSGGDGTHLPTIIKSPEARGWTFFGWDIMKHKMKQKSYRNKVLQRSAAVLGYAAHAVLFIACYLDIPLRYPLRFGGSRSYVSDRLPSADTASSAALASTRNTESELTEYPLFLECQDDDSTSASYAIYLLHKDTEQLLNYVGAESCGRHVFGNLRELLRIVQSDKFVYR

SEQ ID NO: 4845 - DNA, 1077 bp, Glycine max
  misc_feature (1)..(1077): Ceres cDNA ID no. 21996018
  misc_feature (1)..(1077): Ceres CLONE  ID no. 1063209
  misc_feature (1)..(1077): Also known as  Ceres CDNA ID no. 23473024
acttttgaactaatcgatcctacacgaccatcagccggagacgaccgccggcgttttttccgctttaatggaagcgttacttacttcaagggttgttccagttcaagttccttgtagaaagctctcatctttatctgctgatttgtcttgccttgagttaaggagatatcctgttagaagaggaagtgtctcgatcatgagctattccagattggtccgtccagtgactgcttctgtgcagccgcagagggtgtcggctttggggaatgaaggcaacactgttccttctaaagagattctcgatctttggagaggtgttgaagctgtatgcttcgatgtggatagcacggtatgtgtggatgaaggcattgatgaacttgcagagttctgtggagctggaaaggctgttgctgaatggactgccagagcaatgggtggatctgttccatttgaagaagctctagccgcaagactttctttgttcaagccttctctttccaaagttgatgaatatctccaaaagacacccccgaggctatcccctggcattgaagagttggtcaagaagctcagagccaataaaatcgatgtctatttgatatctggaggttttcgacagatgatcaatcctgtagcatcggttcttggcatccctcgagagaatatattcgccaacaatcttctatttggaaattctggtgagtttgtggggtttgatgagaaggaacctacttcaagaagtggaggcaaagccaaggcagtgcaacatatacgaaagggtcgtagctacaagacgatggccatgattggagacggagctactgatctagaagcacgtagacctggtggcgcggacttgttcatatgttatgctggagttcagcttcgtgaagctgttgcagcacaagcagactggcttatcttcaattttgaacctctcattaactccttggactaaaagcctcttctctatactgattagttccattgagagctcaactcattattcaactctcaaattttgtactctcctttttgaatgtgtgaaattccactgaaccaaaaaaaaaaaaaaaa

SEQ ID NO: 4846 - protein, 296 aa, Glycine max
  misc_feature: PFam Name: Hydrolase; PFam Description: haloacid
  misc_feature: GI Number: 9795592; NR Description: 3-phosphoserine phosphatase [Arabidopsis thaliana] >gi|21592986|gb|AAM64935.1| 3-phosphoserine phosphatase [Arabidopsis thaliana] >gi|20465705|gb|AAM20321.1| putative 3-phosphoserine phosphatase
  misc_feature: GI Number: 11358621; NR Description: phosphoserine phosphatase (EC 3.1.3.3) precursor, chloroplast [validated] - Arabidopsis thaliana >gi|3759177|dbj|BAA33806.1| 3-phosphoserine phosphatase [Arabidopsis thaliana] >gi|3759179|dbj|BAA33807.1|
  misc_feature: GI Number: 50758156; NR Description: PREDICTED: similar to phosphoserine phosphatase; L-3-phosphoserine phosphatase;
  misc_feature: GI Number: 61859070; NR Description: PREDICTED: similar to
  misc_feature: GI Number: 34872053; NR Description: similar to expressed
MEALLTSRVVPVQVPCRKLSSLSADLSCLELRRYPVRRGSVSIMSYSRLVRPVTASVQPQRVSALGNEGNTVPSKEILDLWRGVEAVCFDVDSTVCVDEGIDELAEFCGAGKAVAEWTARAMGGSVPFEEALAARLSLFKPSLSKVDEYLQKTPPRLSPGIEELVKKLRANKIDVYLISGGFRQMINPVASVLGIPRENIFANNLLFGNSGEFVGFDEKEPTSRSGGKAKAVQHIRKGRSYKTMAMIGDGATDLEARRPGGADLFICYAGVQLREAVAAQADWLIFNFEPLINSLD

SEQ ID NO: 4847 - DNA, 1441 bp, Zea mays
  misc_feature (1)..(1441): Ceres cDNA ID no. 21996021
  misc_feature (1)..(1441): Ceres CLONE  ID no. 1066007
  misc_feature (1)..(1441): Also known as  Ceres CDNA ID no. 25087620
acagtcacagactcacagcacacgcagccaccgaggactgcattgctagcatccatcgccatcagtcgccatatcgatctgcatggatcgggtgccgccgccggtctccatgcaggtggctgcgatgcagcgacatcagcagcagcagcagttcgtccaccacctgcagcaggtccaccagcaaggtacgcagcacgagcaaccgccgccaccgcaccagaacggcagcagcagcagcggcaggaccggcggcggccgcaagtgctgcccgctgcggcggtcgcgcaaggggtgcatgaagggcaagggcgggccggacaaccagcagtgccccttccgcggcgtccggcagcgcacctggggcaagtgggtggccgagatccgcgagcccaaccgcggcgcgcgcctctggctcggcaccttcggcagcgcgctcgaggccgcgcgcgcctacgacgccgcggccaggacgctctacggcgactgcgctcgcctaaacctgcagctagtgcctccgtcggcggctgcggcagccgccggaggaggaggaccggcggtcgtcgcgtctccgtcccctgacaccgtggctggccctgctgctgctggtggtggtggtggacacaactgccatcaccagtacctgcagcagcagcacgccatggcggcgcctatgatgatgatgcactcctcctgctgctccgccgacgggtcgtcgtcaaactccgattccatttccaactcctgctcgtcaccggtgaccacggcggcctcgccagcctacagccaccaccagacgacgttccaggcacctgcaccgccgccgtcatgcggcgcaatgacgatggcggccgctgcgccgcatgtgcagggcttccacgtcggcgacgacgacactaccaccgcgatggcgatgcaccgtcatcagcagatgatgcgcgagctggcggaggcgcctctgcaccaggaggcagacgacttcgaggacttcgtgacgcggctgcccaaggcggaggacttcggcctgcagggcttccaggaggtggccctcgaggtgttcgacgacgccgccggcatctgggaccacgcggccgcctgggagccccccaccatgatgatcgactctggcgcccagccccagcagcagctcgtcgtccctctttgactcgctcgtcgatgacgccgcgcgccctgcaccagctactgcttcgttcccagctgcatcgaactggccggtgtacgtggcggagtgatacgacgcgcgcgccatgcatgacaccactgcacaggtggttcctgcatgtgttgcttacgcctcgagacgtacgtacataataccagtatgtatgtaccggatggttactctgatatgactgtatttctcctagttattcgtgagtttcatttggataatgtttcaggttttgtaaaaaaaaaaaaaaaa

SEQ ID NO: 4848 - protein, 359 aa, Zea mays
  misc_feature: PFam Name: AP2; PFam Description: AP2 domain
  misc_feature: GI Number: 33440018; NR Description: Ap22 [Oryza sativa (japonica cultivar-group)] >gi|50948607|ref|XP_483831.1| AP2-domain DNA-binding protein-like [Oryza sativa (japonica cultivar-group)]
  misc_feature: GI Number: 8346773; NR Description: AP2-domain DNA-binding
  misc_feature: GI Number: 25992100; NR Description: dehydration responsive
  misc_feature: GI Number: 45385108; NR Description: putative DRE-binding
  misc_feature: GI Number: 66710521; NR Description: putative DREB2A protein
MDRVPPPVSMQVAAMQRHQQQQQFVHHLQQVHQQGTQHEQPPPPHQNGSSSSGRTGGGRKCCPLRRSRKGCMKGKGGPDNQQCPFRGVRQRTWGKWVAEIREPNRGARLWLGTFGSALEAARAYDAAARTLYGDCARLNLQLVPPSAAAAAAGGGGPAVVASPSPDTVAGPAAAGGGGGHNCHHQYLQQQHAMAAPMMMMHSSCCSADGSSSNSDSISNSCSSPVTTAASPAYSHHQTTFQAPAPPPSCGAMTMAAAAPHVQGFHVGDDDTTTAMAMHRHQQMMRELAEAPLHQEADDFEDFVTRLPKAEDFGLQGFQEVALEVFDDAAGIWDHAAAWEPPTMMIDSGAQPQQQLVVPL

SEQ ID NO: 4849 - DNA, 1843 bp, Glycine max
  misc_feature (1)..(1843): Ceres cDNA ID no. 21996022
  misc_feature (1)..(1843): Ceres CLONE  ID no. 1120668
  misc_feature (1)..(1843): Also known as  Ceres CDNA ID no. 23426292
aaagatttattgttaagtccaaagagtgtctttagttttctgtcccatgtacatatatatatatatattagccacccttatcggtggtactatgtgcaagctcaaaactttaccaaatctataatcttccccttctctctcctctccccatctccctgatggggttctcatgaattcaagtagtgaaatcaagctatgatcaagccttttggggcttcgatttaccatctttttgtgctaattaaacacttgaaaattaccaccatgtccaccatgaagaacaatttcaaagaccaagaccatctctactcttcatggagcttctcaaagctcatggctttcttcttcctcttaatctccatctcctacctcttctactccctaaggttcgttagccactccttcgattgtgatcaaacccctcacattcccaccatcactcatcatatttcttccaacaccccatctgaagaagagtccacacccccctttgaagaagttaccaacatttcccacatagtctttggcataggagcctcagcaaagctttggaagcagagaaaagagtacatcaagctatggtggaggcctaatgagatgcgtggggttgtgtggttggagcaaaaggtgaaaactgagcctcaagatgagaatttcttgcccccgttgaggatctctagtgacacttcaaggttcaagtataagaacccaaaggggcatagatcagctattagaatctcacgcatagtgtctgagacacttaggcttgggatggaggatgtgaggtggtttgtgatgggggatgatgacacggtttttgtggcagaaaatttggtgaaagtgttgcaaaaatatgaccacaatcagttttattacattgggagttcctcggagagtcacttgcaaaacatttatttttcttataatatggcttatgggggtggtggttttgccattagttatcccttggctgtggcattggagaagatgcaagataggtgcattcagaggtatccagggttgtatggctctgatgataggattcaggcttgtatggcagaattgggagttccactcaccaaggaaaaagggttccatcagtttgatgtgtacggcaatctccttgggcttctggcggcccatccagttacgccactggtatccctccatcacttggacgtggtagagcccatatttccaaacgtgagccgggtccaggccctgaagaggctgaaagggcccatgaaacttgacccagccgggctcatccaacaatccatttgctacgacaaagcccggacctggaccatatccgtttcatggggctatgcggttcaaattttccggggcaccttttctgcccgggaaatggagatgccggcgaggacattcctgaactggtacaagcgagccgattacacggcgtatccgttcaacacgcgccctgtcagccgccatgtttgtcagaaaccatttgtttattacttgtctaaggcagtgtatgatgagggtgctaatgaaactgcaagtcaatatgtacgggttcagcaaaacccggattgcaaatggaaaatggaggatccgacccagatcaaagtggtggaggtttataagaaacccgacccgcatttgtgggacaaggctccaagaagaaattgttgtagggttagacgcacaaagaagaaaggaactatggtgattgatgttggggaatgcagggaagatgaagttgttgaattgtagttagaggtccaacacatcaattgataattcttaactcatgcctttgctatatgtattttcttcttctatacatatatgatttaccaaaaaaaaaaaaaaa

SEQ ID NO: 4850 - protein, 515 aa, Glycine max
  misc_feature: PFam Name: Fringe; PFam Description: Fringe-like
  misc_feature: PFam Name: Galactosyl_T; PFam Description: Galactosyltransferase
  misc_feature: GI Number: 15529153; NR Description: AT4g23490/F16G20_190
  misc_feature: GI Number: 25090374; NR Description: At4g23490/F16G20_190 [Arabidopsis thaliana] >gi|18416156|ref|NP_567683.1| fringe-related
  misc_feature: GI Number: 15223433; NR Description: fringe-related protein
  misc_feature: GI Number: 50253142; NR Description: fringe-related
  misc_feature: GI Number: 30683185; NR Description: fringe-related protein
MIKPFGASIYHLFVLIKHLKITTMSTMKNNFKDQDHLYSSWSFSKLMAFFFLLISISYLFYSLRFVSHSFDCDQTPHIPTITHHISSNTPSEEESTPPFEEVTNISHIVFGIGASAKLWKQRKEYIKLWWRPNEMRGVVWLEQKVKTEPQDENFLPPLRISSDTSRFKYKNPKGHRSAIRISRIVSETLRLGMEDVRWFVMGDDDTVFVAENLVKVLQKYDHNQFYYIGSSSESHLQNIYFSYNMAYGGGGFAISYPLAVALEKMQDRCIQRYPGLYGSDDRIQACMAELGVPLTKEKGFHQFDVYGNLLGLLAAHPVTPLVSLHHLDVVEPIFPNVSRVQALKRLKGPMKLDPAGLIQQSICYDKARTWTISVSWGYAVQIFRGTFSAREMEMPARTFLNWYKRADYTAYPFNTRPVSRHVCQKPFVYYLSKAVYDEGANETASQYVRVQQNPDCKWKMEDPTQIKVVEVYKKPDPHLWDKAPRRNCCRVRRTKKKGTMVIDVGECREDEVVEL

SEQ ID NO: 4851 - DNA, 2137 bp, Zea mays
  misc_feature (1)..(2137): Ceres cDNA ID no. 21996024
  misc_feature (1)..(2137): Ceres CLONE  ID no. 1157957
  misc_feature (1)..(2137): Also known as  Ceres CDNA ID no. 24390532
acgatcccccagtcccctcccctcacggctgcatgcccgcatccggattccggtccatccggcagccagacgctgccgccgtaaattccccttccgcgtctgtctggccggtggccgctgtggttttgtaggctagtgcgtgccgtcctcggacctctcctctcgtcctccaccaccatgactgaggcccagtctccactatccgccaccatggcgaaggaggcccagtcgtcgccgtccgccaccgtagcgcaggcgacggctctgccgcagctcgtattattcaactccttgacgaagagggaggagcccttccagccccgggtggaggggaaggtagggatgtacgtctgtggcgtcactccctacgactttagccacatcggccacgcgcgtgcctacgtcgccttcgacgtcctctacaggtacctgaaattcttggggtatgaagttgaatatgtccgtaatttcacggatatcgacgacaagattattaagcgtgcaaatgaacgcggtgaaacagttacaagtttgagtagccggtttatcaatgaatttcttcttgatatgactgagctccagtgtttacctcctacctgtgagccacgtgtaacagagcacattgagcatattatagagttgataaccaagataatggagaatgacaaagcctatgctatggaaggagatgtttacttttcagtcgaaagttttcctgaatatctcagtttatctggaagaaaattcgatcaaaatcaggcaggggcacgggttgcttttgatacacgaaagcgtaatcctgcagactttgcactctggaaggctgcaaaggagggcgaacctttttgggatagcccttggggccgtggaagaccgggatggcatattgaatgcagcgcaatgagtgctcactatttaggacatctattcgatattcatggtggggggaaagatttgatttttcctcatcatgagaatgagcttgcacaaagccgagctgcttatcctgagagtgaggtgaagtgctggatgcataatggctttgttaacaaggatgataaaaaaatggcaaaatcagataataactttttcacgattagagatatcactgctctttaccatccattggctttaagatttttcttgatgcgcactcattatagatcagatgtgaaccattctgatcaagcacttgagattgcatctgatcgtgtctattacatttttcagactctatatgactgcgaggaagtattagctacatatcgtgaagagggtatttctctctcagtgccgttcgaggagcaaaatctgattgataagcaccattcagaattcttgaaatatatgtcgaatgatcttaaaaccacagatgttctggatcgttgcttcatggagctgctgaaggccataaacagcagtttgaatgatttgaagaaactgcaacagaaaatagaacagcaaaagaagaaacagcaacagcagaagaagcagcaacagaagcaacagcaattgcaaaaacagccagaacattatattcaagctctgattgcactggaaatagaacttaaaaataaactgtctatacttggtctgatgccatcttcatctttggcagaggtactgaagcaattgaaggacaaagcactaaagagagcggggctgactgaagaaaaattgcaagagcagattgagcagagaaacgttgcaaggaagaataaacagtttgagatatctgatggaatcaggaaaaaccttgctaccaagggcatcgccctgatggatgaaccttctggtacagtgtggagaccatgcgaaccagaggggccgcacccactcaacaaatgatggtaaaatgagatttttgcctgagggcagctacacattttgaactaacaaaatcaccatctctggatgcagtattcttcactcaggggtagggggtccaggttgactcgccagtcgccagttgaaacttgcatttctggttgtgtaagaagcaatggaccccatatatatactttactccttgcgaggtttgagttttggttttggatataagacttggcaattccatttcaatgaaacagatgaaattttgcttggtaaaaaaaaaaaaaaaaaaaaaaaaaaaaaa

SEQ ID NO: 4852 - protein, 2137 aa, Zea mays
  misc_feature: PFam Name: tRNA-synt_1e; PFam Description: tRNA synthetases
  misc_feature: PFam Name: tRNA-synt_1; PFam Description: tRNA synthetases
  misc_feature: GI Number: 15293251; NR Description: putative cysteinyl-tRNA synthetase [Arabidopsis thaliana] >gi|13877761|gb|AAK43958.1| putative cysteinyl-tRNA synthetase [Arabidopsis thaliana] >gi|20197896|gb|AAD20662.2| putative cysteinyl-tRNA synthetase
  misc_feature: GI Number: 42569504; NR Description: tRNA synthetase class I (C) family protein [Arabidopsis thaliana] >gi|25293240|pir||D84717 probable cysteinyl-tRNA synthetase [imported] - Arabidopsis
  misc_feature: GI Number: 15241557; NR Description: tRNA synthetase class I
  misc_feature: GI Number: 7572928; NR Description: cysteine-tRNA ligase [Arabidopsis thaliana] >gi|15228880|ref|NP_191189.1| tRNA synthetase class I (C) family protein [Arabidopsis thaliana] >gi|11271629|pir||T47747 cysteine-tRNA ligase - Arabidopsis
  misc_feature: GI Number: 9758060; NR Description: cysteine-tRNA ligase
ACGATCCCCCAGTCCCCTCCCCTCACGGCTGCATGCCCGCATCCGGATTCCGGTCCATCCGGCAGCCAGACGCTGCCGCCGTAAATTCCCCTTCCGCGTCTGTCTGGCCGGTGGCCGCTGTGGTTTTGTAGGCTAGTGCGTGCCGTCCTCGGACCTCTCCTCTCGTCCTCCACCACCATGACTGAGGCCCAGTCTCCACTATCCGCCACCATGGCGAAGGAGGCCCAGTCGTCGCCGTCCGCCACCGTAGCGCAGGCGACGGCTCTGCCGCAGCTCGTATTATTCAACTCCTTGACGAAGAGGGAGGAGCCCTTCCAGCCCCGGGTGGAGGGGAAGGTAGGGATGTACGTCTGTGGCGTCACTCCCTACGACTTTAGCCACATCGGCCACGCGCGTGCCTACGTCGCCTTCGACGTCCTCTACAGGTACCTGAAATTCTTGGGGTATGAAGTTGAATATGTCCGTAATTTCACGGATATCGACGACAAGATTATTAAGCGTGCAAATGAACGCGGTGAAACAGTTACAAGTTTGAGTAGCCGGTTTATCAATGAATTTCTTCTTGATATGACTGAGCTCCAGTGTTTACCTCCTACCTGTGAGCCACGTGTAACAGAGCACATTGAGCATATTATAGAGTTGATAACCAAGATAATGGAGAATGACAAAGCCTATGCTATGGAAGGAGATGTTTACTTTTCAGTCGAAAGTTTTCCTGAATATCTCAGTTTATCTGGAAGAAAATTCGATCAAAATCAGGCAGGGGCACGGGTTGCTTTTGATACACGAAAGCGTAATCCTGCAGACTTTGCACTCTGGAAGGCTGCAAAGGAGGGCGAACCTTTTTGGGATAGCCCTTGGGGCCGTGGAAGACCGGGATGGCATATTGAATGCAGCGCAATGAGTGCTCACTATTTAGGACATCTATTCGATATTCATGGTGGGGGGAAAGATTTGATTTTTCCTCATCATGAGAATGAGCTTGCACAAAGCCGAGCTGCTTATCCTGAGAGTGAGGTGAAGTGCTGGATGCATAATGGCTTTGTTAACAAGGATGATAAAAAAATGGCAAAATCAGATAATAACTTTTTCACGATTAGAGATATCACTGCTCTTTACCATCCATTGGCTTTAAGATTTTTCTTGATGCGCACTCATTATAGATCAGATGTGAACCATTCTGATCAAGCACTTGAGATTGCATCTGATCGTGTCTATTACATTTTTCAGACTCTATATGACTGCGAGGAAGTATTAGCTACATATCGTGAAGAGGGTATTTCTCTCTCAGTGCCGTTCGAGGAGCAAAATCTGATTGATAAGCACCATTCAGAATTCTTGAAATATATGTCGAATGATCTTAAAACCACAGATGTTCTGGATCGTTGCTTCATGGAGCTGCTGAAGGCCATAAACAGCAGTTTGAATGATTTGAAGAAACTGCAACAGAAAATAGAACAGCAAAAGAAGAAACAGCAACAGCAGAAGAAGCAGCAACAGAAGCAACAGCAATTGCAAAAACAGCCAGAACATTATATTCAAGCTCTGATTGCACTGGAAATAGAACTTAAAAATAAACTGTCTATACTTGGTCTGATGCCATCTTCATCTTTGGCAGAGGTACTGAAGCAATTGAAGGACAAAGCACTAAAGAGAGCGGGGCTGACTGAAGAAAAATTGCAAGAGCAGATTGAGCAGAGAAACGTTGCAAGGAAGAATAAACAGTTTGAGATATCTGATGGAATCAGGAAAAACCTTGCTACCAAGGGCATCGCCCTGATGGATGAACCTTCTGGTACAGTGTGGAGACCATGCGAACCAGAGGGGCCGCACCCACTCAACAAATGATGGTAAAATGAGATTTTTGCCTGAGGGCAGCTACACATTTTGAACTAACAAAATCACCATCTCTGGATGCAGTATTCTTCACTCAGGGGTAGGGGGTCCAGGTTGACTCGCCAGTCGCCAGTTGAAACTTGCATTTCTGGTTGTGTAAGAAGCAATGGACCCCATATATATACTTTACTCCTTGCGAGGTTTGAGTTTTGGTTTTGGATATAAGACTTGGCAATTCCATTTCAATGAAACAGATGAAATTTTGCTTGGTAAAAAAAAAAAAAAAAAAAAAAAAAAAAAA

SEQ ID NO: 4853 - DNA, 2244 bp, Zea mays
  misc_feature (1)..(2244): Ceres cDNA ID no. 21996026
  misc_feature (1)..(2244): Ceres CLONE  ID no. 1219446
  misc_feature (1)..(2244): Also known as  Ceres CDNA ID no. 24441193
tcagtctctcagtgctgatacttctctccactctcctctttctttccctgtcccgacagagttcgaggaagctggggtgggcctgatgcttctccttctcttgcagtctagcgtccattccacttcgcaagggcttttctttctgttttaagtaaaacggatccagcaacgcaccagttcctgaaacagaaacgtgatgatggattcagtaagcatgaagctgttagcttttgtgttccttctgttgcgatgccagcgggcatcgcttgctcttgctgtcgacttccaagtcgaagcattggttgaaatgaggacgcaacttggtgacaaacgtggtgtccttagtgattggaaggataatcaaatgagcccctgctactgggccaatgttaattgccaagataacaaagtcacaacaataattttgagctcgtcagggttaacaggatccttatcacccagcattgcaaagctaacaactttacagcagctgatactggataacaacaacattactggagggattcctccggagtttggaaacctatcaggtttgacaattctaaaccttggaagaaataatttaaatgggtcaataccggactcccttggacaactttctaaactccaaaatctggatctaagccataattatttgaccggaaatatcccaagctctttctcaaatcttctgtcattgagtgatattaatctggcatataataatataagaggtgcaatcccacaacatctacttcaggtggcccaatacaactatgcaggcaaccacttgaattgtggccaaaatttatctgcatgtgaacgaggcagcacattgacaggtggatccaaaaatttcaagctaaacgtggttattggaagcattgctggagcagtcacattttctgtaactgtagttctagttttgctatggtggcaaagaatgcgttaccggcctgaaatcttcattgacgtgtcaggtcagaatgatcatatgcttgagtttgggcaaataaagcggttctcatggcgggagcttcagattgcaaccagcaatttcagtgaacagaatgttcttggcaagggtggttttggtaaggtgtataaaggagttcttccaggtccaaacagtataaagattgcagtgaaacgactactgaacgtggacagtcgtgatggggaaatggctttcctcagagaagttgaattgataagcattgctgtacacaagaacatattaaggttgataggattctgtacaacaccaacagagaggcttttggtctaccctttcatggagaatcttagtgttgcttcccgtttaagagatataaaactaaacgaaccagcattagattggtctacaagaatgcgaattgctcttggcgctgcctgtggtttggagtaccttcatgagcactgcaatcccaagatcatccaccgtgatgtcaaggctgcaaatgtcctgcttgatgggaactttgaagcagtggtaggagattttgggctggcgaagatggtagacatagggaggaatacagtaacaacaggggttcgtggaactatgggccacgtagctcctgagtacataaagacaggaaggccatcagtgaagacagatatctttggttatggtgtcatgctgttagagattgtgacaggagagcgtgcaattgcattccatcctgaccgtatagaagaagcaggcgagatcctgctcactgatcaggtcaagctatggatggaagaagggcgactactcgacctagtggatcgcaatctaggtggcgtctacaaccttgaagagctggagaaggttacccagatagcacttctctgcactcacatggatcctgaacaacgccctacaatgtctgaggtggtgcagatgctggaaggagagattgtcccagcagagcggtgggaggagtggcagctggctgagctccaacgacgacaacagcatgagatgaggcaacagggcaaactattcaacttcagtgaagagtctcaaaacatccaggaagccattgagttgtcagctggcagatgagctgtcataagaaagtgacatgattttcacttgttccttaaatagaaaggctataagagaaatattgactattaggaatagtctataaggtcctggactcctggtgtaatatcttgcacaagtaactccgtccatatgctgttaatacaacgataggaccacacctagctcaaaaaaaaaaaaaaaaaaaa

SEQ ID NO: 4854 - protein, 618 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50881479; NR Description: kinase domain containing
  misc_feature: GI Number: 22326703; NR Description: leucine-rich repeat family protein / protein kinase family protein [Arabidopsis
  misc_feature: GI Number: 20260260; NR Description: protein serine/threonine
  misc_feature: GI Number: 8953410; NR Description: protein serine/threonine kinase-like protein [Arabidopsis thaliana] >gi|11358729|pir||T50817
  misc_feature: GI Number: 50906955; NR Description: putative SERK2 protein [Oryza sativa (japonica cultivar-group)] >gi|47848336|dbj|BAD22198.1| putative SERK2 protein [Oryza sativa
MMDSVSMKLLAFVFLLLRCQRASLALAVDFQVEALVEMRTQLGDKRGVLSDWKDNQMSPCYWANVNCQDNKVTTIILSSSGLTGSLSPSIAKLTTLQQLILDNNNITGGIPPEFGNLSGLTILNLGRNNLNGSIPDSLGQLSKLQNLDLSHNYLTGNIPSSFSNLLSLSDINLAYNNIRGAIPQHLLQVAQYNYAGNHLNCGQNLSACERGSTLTGGSKNFKLNVVIGSIAGAVTFSVTVVLVLLWWQRMRYRPEIFIDVSGQNDHMLEFGQIKRFSWRELQIATSNFSEQNVLGKGGFGKVYKGVLPGPNSIKIAVKRLLNVDSRDGEMAFLREVELISIAVHKNILRLIGFCTTPTERLLVYPFMENLSVASRLRDIKLNEPALDWSTRMRIALGAACGLEYLHEHCNPKIIHRDVKAANVLLDGNFEAVVGDFGLAKMVDIGRNTVTTGVRGTMGHVAPEYIKTGRPSVKTDIFGYGVMLLEIVTGERAIAFHPDRIEEAGEILLTDQVKLWMEEGRLLDLVDRNLGGVYNLEELEKVTQIALLCTHMDPEQRPTMSEVVQMLEGEIVPAERWEEWQLAELQRRQQHEMRQQGKLFNFSEESQNIQEAIELSAGR

SEQ ID NO: 4855 - DNA, 1654 bp, Glycine max
  misc_feature (1)..(1654): Ceres cDNA ID no. 21996027
  misc_feature (1)..(1654): Ceres CLONE  ID no. 1238406
  misc_feature (1)..(1654): Also known as  Ceres CDNA ID no. 23708862
agaaaaaacgagtaatgttcactgcgaagaaaatatcaaaataatactactagccatttacaaaggcagcagctgcaggaggtgcgtgcatcgagcggagccatgatctcgcaattcttcgttctgtcacagcgtggcgataacatcgtttttcgagattatcgtggtgaagtgcagaagggaagtgcggagatatttttccgcaaagtaaagttttgggaagatgggggactgctggaggcaccacctgtctttaatgtggatggagtaaattactttcatgtgaaagttgttggcttattgtttgttgcaactacaagggttaatacatcaccttcttttgtcttggagcttttacaaagaattgctcgagttattaaggattaccttgggattctcaatgaagactcattacggaaaaactttgtgcttgtgtacgagttacttgatgaagttattgattttggttatgttcaaacaacatctactgaattgttgaagtcctatgttttcaatgagccgcttgtaattgatgctgcacgtctgccacctcttggacctgctgcaatttttacgcaaggaacaaaaagaatgccagggatagctgtcacaaaatctgttgttgctacagagcctgggggtagaaagagggaagagatttttgtagacataattgagaaaatcagcatcactttcagctccagtggatatatactgacttctgagattgatggcaccatacaaatgaagagctatctttctggcaatcctgaaattcgattagcacttaatgatgacctctccattggaagaagccagggatcagctttcggttataggagctcatctggctcaggaacagttatattagatgactgtaatttccatgaatctgttcgtcttgatagttttgatatagacagaactctatccctggtaccaccggatggtgaatttccagtcatgaactaccgtttgacacaggaatttagtcctccttttcgtattaatgctttgattgaagaagcagggtcacttaaggcagaagtaattcttaaagtaagtgccgagtttccctcaagtgtaacagctaacactatcaaagtgcagatgccactaccaaaatgtacctccagagttagttttgagctggaacctggagctgtaggacaaacaactgattttaaggaagcaaataagaggctagaatggagtttaagaaagatcgtcgggggatcggagcacactctacatgcaaaactaaccttttctcaggaatctcacgttaatataacaaaagaatcaggacctgtgagcatgacatttactataccaatgcataacgtttcacggcttcaggtaaagtatttgcagatagcaaagaaatctgcaacgcatgaaccataccggtgggttagatatgttacacaggcgaattcctacgtcgctcgtatatgatgccgttaagaacactgtcccctcccccgctctttgtttttctattttgttttcctgctcttattgctctttacacacatgctttgtttatttacttattctttatttgtaaattacactctaagtttacattctaagtcgaatatagatgacgttttcagtttgcctgatttatcattcaaaaaaaaaaaaaaaa

SEQ ID NO: 4856 - protein, 451 aa, Glycine max
  misc_feature: PFam Name: Adap_comp_sub; PFam Description: Adaptor
  misc_feature: GI Number: 51979034; NR Description: PREDICTED P0594D10.112 gene product [Oryza sativa (japonica cultivar-group)] >gi|51963560|ref|XP_506477.1| PREDICTED P0594D10.112 gene product [Oryza sativa (japonica cultivar-group)] chain apm 4 [Oryza
  misc_feature: GI Number: 30686572; NR Description: clathrin adaptor
  misc_feature: GI Number: 18176154; NR Description: putative clathrin coat assembly protein [Arabidopsis thaliana] >gi|7269305|emb|CAB79365.1| clathrin coat assembly like protein [Arabidopsis thaliana] >gi|4220535|emb|CAA23008.1| clathrin coat
  misc_feature: GI Number: 23508393; NR Description: clathrin coat assembly protein, putative [Plasmodium falciparum 3D7] >gi|23496125|gb|AAN35786.1| clathrin coat assembly protein,
  misc_feature: GI Number: 46228798; NR Description: clathrin coat assembly
MISQFFVLSQRGDNIVFRDYRGEVQKGSAEIFFRKVKFWEDGGLLEAPPVFNVDGVNYFHVKVVGLLFVATTRVNTSPSFVLELLQRIARVIKDYLGILNEDSLRKNFVLVYELLDEVIDFGYVQTTSTELLKSYVFNEPLVIDAARLPPLGPAAIFTQGTKRMPGIAVTKSVVATEPGGRKREEIFVDIIEKISITFSSSGYILTSEIDGTIQMKSYLSGNPEIRLALNDDLSIGRSQGSAFGYRSSSGSGTVILDDCNFHESVRLDSFDIDRTLSLVPPDGEFPVMNYRLTQEFSPPFRINALIEEAGSLKAEVILKVSAEFPSSVTANTIKVQMPLPKCTSRVSFELEPGAVGQTTDFKEANKRLEWSLRKIVGGSEHTLHAKLTFSQESHVNITKESGPVSMTFTIPMHNVSRLQVKYLQIAKKSATHEPYRWVRYVTQANSYVARI

SEQ ID NO: 4857 - DNA, 700 bp, Zea mays
  misc_feature (1)..(700): Ceres cDNA ID no. 21996031
  misc_feature (1)..(700): Ceres CLONE  ID no. 1287132
  misc_feature (1)..(700): Also known as  Ceres CDNA ID no. 23832916
ataatccgacgccggacgccccatgatttcgctctcttcttcccgtcgagacccaaccataccagcggcgccgcaggctgacgaggaggcggagtagagtggccggactacctcgacacctccactgcaaccatgggtatctcacgtgattcgatgcacaagcgccgggccaccggtggaaagcagaagacgtggcgcaagaagcgaaagtatgagcttggccgccagcctgctaacaccaaactgtctagcaataagacagtgaggagggtccgtgtacgtggaggcaacgtgaagtggagggctctccgattggatacaggtaactactcgtggggaagtgaggctcttacccgcaagacccgcatcctggatgtggtctatactctctgcctgttcgctacgccctacgcatctgtgctcgacgcctacccgcatgtgaaggcctggtggtctggtctgatggagaggccgtctgtccagaaggtcgctgccttgatgaagccatctgcttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagaccttgaattgttcggaaatgagcattcctgtgctcttcttaaaaaaaaaaaaaaaa

SEQ ID NO: 4858 - protein, 127 aa, Zea mays
  misc_feature: PFam Name: Ribosomal_S8e; PFam Description: Ribosomal protein S8e
  misc_feature: PFam Name: GST_C; PFam Description: Glutathione
  misc_feature: GI Number: 7440236; NR Description: probable ribosomal protein S8 - rice >gi|968902|dbj|BAA07207.1| ribosomal protein S8 [Oryza sativa (japonica cultivar-group)]
  misc_feature: GI Number: 32489919; NR Description: OSJNBa0038P21.4 [Oryza
  misc_feature: GI Number: 3355616; NR Description: ribosomal protein S8 [Hordeum vulgare subsp. vulgare] >gi|7440238|pir||T05908 probable
  misc_feature: GI Number: 3264759; NR Description: 40S ribosomal protein S8 [Prunus armeniaca] >gi|17367479|sp|O81361|RS8_PRUAR 40S ribosomal
  misc_feature: GI Number: 60417164; NR Description: 40S ribosomal protein S8
MGISRDSMHKRRATGGKQKTWRKKRKYELGRQPANTKLSSNKTVRRVRVRGGNVKWRALRLDTGNYSWGSEALTRKTRILDVVYTLCLFATPYASVLDAYPHVKAWWSGLMERPSVQKVAALMKPSA

SEQ ID NO: 4859 - DNA, 1741 bp, Zea mays
  misc_feature (1)..(1741): Ceres cDNA ID no. 21996033
  misc_feature (1)..(1741): Ceres CLONE  ID no. 1291522
  misc_feature (1)..(1741): Also known as  Ceres CDNA ID no. 24373253
atacctcacgcacctgtccctgtcgcctcctcacgtttcatcgcctcgcgaacccacccggccacccccaacagccaagtacagtagtgtgctgtctgcaatccgcatccgcccttggatgcgcctcgccgcagccggtcatggcctccgccgtcgctagcaacgtgcacgcgggacccgccgccgcggccatgacgttcggctggctcggcccgggcctgccgttcggcgcccgggacgccgctgcggaggcggaggagcccgccgcggcggccaaggcggagccggcggcgatctgcaaggacttaatcgacttcgagttcagcctcggcgggtccgccaccatgctccccgcggacgagctcttcgcggacgggaagctgctcccgctccgcccgcaggctaccgcagggaaggcggaggccgagcgggagcgggagagagtgctgcggcgggacaccgcgcttgtggcggaggccacgccgggcccggtccgggcgctgcaccccgccgcggccgaggcggcgctggacccgtacgtgttctctcccaaggcgcccacgtgctccagccgctggcgggagctgctccggctgaggaaggtccagacgccgcacaagccgaccccgtccccgtcgccgtccgcgtccgcgtcgcccgcggtgaccccgtcgagggcgtccagctcctcggcggccaggtcgctgaagctgctcctcctccagcggaacggcggccgcgcgtcggacctccccgccgcgccgctcctgcgcgacagctccgactccgagacgtcgctgtccctcgcgtcctcccgcttctcgctctcgtcgtcgtcgtcctcgtccggccacgaccacgacgacttcccgcgccactccctcgactccgtcgacctcaccccacgcccccgcatccgcctcgtccgctcccaccaccaccagccgccgcagccgcagccgcagccacacccgcccgccgccgcccccgctccagtgcgcgcagcccacagccccgcccgccgccgccagtctcagtctccgtcgcccccgccgccgccgagcgtggtctccgtggactccccccgcatgaacgcgtcaggcaagatcgtgttccagggcctggagcgcagctccagctcccccgccggcagcgcgcactcgtccatgcggtcccggtcgcggtcccgcgtcatggaccggtcctactcggccggcgtccgcgccacgcccgtcgtgctcaacgtcccggtgtgctcgcgcccggtgttcgggttcttcaaggagaagaaagaggccgcggccagggacgccgcctcggcgcgggcgcggtcggcgctgggccggaagacggctgcgcgcaccgccccgccagccggcgtagcgagcgccagagatcttggcagtggtaactgacatccgtcattttggtggaccaagcggtctagtatcattagcactagaagtagacggcatttggagttcttcagtccgaaaaaaaaagaaaatagatcgaaaaaacagtttgggaagtagcctgcgtttggagtttggaacacgattgggtgggaggatagtttggtgagctgatttcgcttcgtgaggccagagagttttttttgcgatcaacaaacccgtccgctttggtcctgtaaattctgtccgcccccgtgggtttttttttttttttgctccgaattaatccagtgtactggcacatttgttgaaaaaaaaaaaaaaaa

SEQ ID NO: 4860 - protein, 424 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: Drf_FH1; PFam Description: Formin Homology Region 1
  misc_feature: PFam Name: Atrophin-1; PFam Description: Atrophin-1 family
  misc_feature: PFam Name: GATase_2; PFam Description: Glutamine
  misc_feature: GI Number: 34872074; NR Description: similar to Ser/Arg-related nuclear matrix protein; plenty-of-prolines-101;
  misc_feature: GI Number: 7949115; NR Description: Ser/Arg-related nuclear matrix protein; plenty-of-prolines-101; serine/arginine repetitive matrix protein 1 [Mus musculus] >gi|3153821|gb|AAC17422.1|
  misc_feature: GI Number: 62948087; NR Description: Unknown (protein for
  misc_feature: GI Number: 55665385; NR Description: serine\/arginine repetitive matrix 1 [Homo sapiens] gi|55959944|emb|CAI14683.1|
  misc_feature: GI Number: 6523547; NR Description: hydroxyproline-rich
MASAVASNVHAGPAAAAMTFGWLGPGLPFGARDAAAEAEEPAAAAKAEPAAICKDLIDFEFSLGGSATMLPADELFADGKLLPLRPQATAGKAEAERERERVLRRDTALVAEATPGPVRALHPAAAEAALDPYVFSPKAPTCSSRWRELLRLRKVQTPHKPTPSPSPSASASPAVTPSRASSSSAARSLKLLLLQRNGGRASDLPAAPLLRDSSDSETSLSLASSRFSLSSSSSSSGHDHDDFPRHSLDSVDLTPRPRIRLVRSHHHQPPQPQPQPHPPAAAPAPVRAAHSPARRRQSQSPSPPPPPSVVSVDSPRMNASGKIVFQGLERSSSSPAGSAHSSMRSRSRSRVMDRSYSAGVRATPVVLNVPVCSRPVFGFFKEKKEAAARDAASARARSALGRKTAARTAPPAGVASARDLGSGN

SEQ ID NO: 4861 - DNA, 1338 bp, Zea mays
  misc_feature (1)..(1338): Ceres cDNA ID no. 21996036
  misc_feature (1)..(1338): Ceres CLONE  ID no. 1395613
  misc_feature (1)..(1338): Also known as  Ceres CDNA ID no. 23851371
acaagacagcagaggcactagttatcacatccaccataacatgaccatggctaccgcctcagcttcgctagctctcatgttcgcctgcagccttctccttgcaggcacggcgttcagtgatgataccatagccatacccttgttggagcggttcaaagcctggcaggctgaatacaaccgcacctatgcgaccccagaggaattccagcaacgcttcatgatctacagcgagaacgtccggttcatcaagaccatgaaccagctgtcgaccgggagctcatatgagctcggtgagaaccagttcaccgacctcaccgaggaggagttcaaggacacatatcttatgaagctcgacgagcagccccctgcagctgaggccatgggaccgaccgtcggcaccatgagcacagcaggcatgtccaacggcaacaacaccggcgaggctcccaacagtgtggactggaggaccaagggagcagtgacgcgggtcaaggaccagcaacaatgtggctcttgctgggcgtttgcaacggtggcgtccatcgaaggtgtgcaccagataaagacaggtcgtctggtgtcgctgtcggagcaagagatcgtggactgcgaccgtgggggcaacgacaacggctgtcgtggcggttcccctagatccgccatggagtgggtcacccgcaacggcggcctgaccacggagtcggactacccgtacgtgggcagccagagacaatgcatgagcggcaagcttggtcaccacgcggccaggatccgtggctaccaggcggtgcagcgcaataacgaggccgagctggagcgcgccgtggcggaacggccggtcgccgtgttcatcgacgcgagcagggccttccagttctacaagagcggggtcttctcgggcccctgcgacaccaccaccgtcaatcacgtcgtcacggtggtcgggtacggatcaaccggcagcgacagcggcggacgcaagtactggatcgtcaagaactcgtggggtcagggatggggagagaatggctacgtgcggatggcgaggcgtgtcagggctcgggagggcatgtgcgccatcgccatagagccctactacccggtgatgtgatctctccgtactagttaccggctgcctcctgatcctaaacaagctagtatgcttggagaatgatgcatgcatatgatgcatggaattaaataaactacaactcaacgagacggtgtgtgtgctgcgctgcgctatgccgatcgatgttatcgtttgtttgctaatgtaacatctaatctaaagtcttaaaaggcgctcggttttgaggctgaaaaaaaaaaaaaaaa

SEQ ID NO: 4862 - protein, 356 aa, Zea mays
  misc_feature: PFam Name: Peptidase_C1; PFam Description: Papain family
  misc_feature: GI Number: 13491750; NR Description: cysteine protease
  misc_feature: GI Number: 24285904; NR Description: cysteine proteinase
  misc_feature: GI Number: 34329348; NR Description: putative cysteine
  misc_feature: GI Number: 37780045; NR Description: cysteine protease 5
  misc_feature: GI Number: 51963766; NR Description: PREDICTED P0027G10.55
MTMATASASLALMFACSLLLAGTAFSDDTIAIPLLERFKAWQAEYNRTYATPEEFQQRFMIYSENVRFIKTMNQLSTGSSYELGENQFTDLTEEEFKDTYLMKLDEQPPAAEAMGPTVGTMSTAGMSNGNNTGEAPNSVDWRTKGAVTRVKDQQQCGSCWAFATVASIEGVHQIKTGRLVSLSEQEIVDCDRGGNDNGCRGGSPRSAMEWVTRNGGLTTESDYPYVGSQRQCMSGKLGHHAARIRGYQAVQRNNEAELERAVAERPVAVFIDASRAFQFYKSGVFSGPCDTTTVNHVVTVVGYGSTGSDSGGRKYWIVKNSWGQGWGENGYVRMARRVRAREGMCAIAIEPYYPVM

SEQ ID NO: 4863 - DNA, 688 bp, Zea mays
  misc_feature (1)..(688): Ceres cDNA ID no. 21996037
  misc_feature (1)..(688): Ceres CLONE  ID no. 1448662
  misc_feature (1)..(688): Also known as  Ceres CDNA ID no. 23859385
taaatcttatgtttctattagttcgaattatcctgtgaatggttgatcgaggagcgattaaatttgctgcgcttatttcacataatacttgcaaggttgacaagtctgaggatcatgacacctatcgacagaggtattgaatgtgtgctaactatgcatttgagacaacgattgttcagcgccggatgaatttaatggtgagaatagtcttttaatatgttaacaatttgaagactcgagagatgcatgttttctttgtctactaatcattgcatgttttgtagactccaccgttttgtgattttcagcagtggattgacacagaaatatcacagaaagacaagaagtggttggagaatcttaaaaagtgggatgcagaggacaaagagaggatggagaaaagacgagaggagcttgctgccgagcaacaacgggaagacgagtaagaaatgaggcgtgttgctgaatgcagagaatagaagaagaagtttgagcgtgcatgtcgtgcaaaggaagcaatggaggagaaccctggtgcatttcgcaagggcaaatggccccgttgcactcagtagtttaggtgcttatttcatgttatgtagtaataaacttcttattctgtattatttagtgtcgaacaatgttatttggtaataaactactttaaaattgaaaaaaaaaaaaaaaa

SEQ ID NO: 4864 - protein, 68 aa, Zea mays
MFSLSTNHCMFCRLHRFVIFSSGLTQKYHRKTRSGWRILKSGMQRTKRGWRKDERSLLPSNNGKTSKK

SEQ ID NO: 4865 - DNA, 599 bp, Zea mays
  misc_feature (1)..(599): Ceres cDNA ID no. 21996040
  misc_feature (1)..(599): Ceres CLONE  ID no. 1465913
  misc_feature (1)..(599): Also known as  Ceres CDNA ID no. 24390604
gccttagttctgagttcagtggagttttctccctgccctcgagtctgacctgtgttcatcgcttgaggaacatagctcttgagttcaagtcggtgtaaacccacttcacagccacccagcatgatgtattttgtgcatcgcgtgccaatggcgaccacagcagcagttctcaccctcaccgtggacatgattcctcggaggttgtctcggccgtgtggtgcttgttccttactcctcgcaggtcaatgaagagtaccaagaagaagatcctaaagagaagtctactcagtgctattgatccagtggtggattccatctaactgcttatcgtgttagaagatctcagatctcctcctgtaataaggagaagttttattcccttatcttttggttagttacttcatgtggaggccttgaagcttagaatgttatgtgtatctcttatggaaaggcttcacccttccaattattaaaataagttatgcactttgggtactatcaggacttgtaataattaccattctttttatgttgtaaaacttgagctttggaaatgtaaaatatgttttgtaaaaaaaaaaaaaaaaaaaaaaaaaaaa

SEQ ID NO: 4866 - protein, 42 aa, Zea mays
MMYFVHRVPMATTAAVLTLTVDMIPRRLSRPCGACSLLLAGQ

SEQ ID NO: 4867 - DNA, 482 bp, Zea mays
  misc_feature (1)..(482): Ceres cDNA ID no. 21996041
  misc_feature (1)..(482): Ceres CLONE  ID no. 1468737
  misc_feature (1)..(482): Also known as  Ceres CDNA ID no. 25088187
aaaaaaaaaaaaaaaaaaaaaatatcatttttctttctaccagatttgggtcttacagtgtgaaagtcacatatggtctatatgtgcatgaactcatctatatcagttatctctaatgtcatcattaggtagtgtggccggtcataacaaaacctcaccattttttggtcgatcccagcctaggaatggattgagacaacaaaggaaattggcatttcattctcaacgttttctgtttcaatccaaccatcaagaaatctcacaagcctcctcaagacagcaagaaaatgttcaccctccttatgtttccaagtactggttgctaaacaccacagcaaagaaaagtaagggcagatctaacgctaccttcagattcaatatagagtttaaagcaactttcttaaaaacatcagcctttacctggataggataaacaaggagagatagtatgagttggaagcatagaaaaaaaaaaaaaaaaa

SEQ ID NO: 4868 - protein, 105 aa, Zea mays
MSSLGSVAGHNKTSPFFGRSQPRNGLRQQRKLAFHSQRFLFQSNHQEISQASSRQQENVHPPYVSKYWLLNTTAKKSKGRSNATFRFNIEFKATFLKTSAFTWIG

SEQ ID NO: 4869 - DNA, 770 bp, Glycine max
  misc_feature (1)..(770): Ceres cDNA ID no. 21996043
  misc_feature (1)..(770): Ceres CLONE  ID no. 1470356
  misc_feature (1)..(770): Also known as  Ceres CDNA ID no. 0
atttttctagtaaaatgtcagagatattttcccgtcctactagtacgtactagtgttggttttctgatgtgtgctatgctaatgggtatatgtgcgtgacaccgacgcagatcaagtgcacgaagcacaaggcgtgctccgggcggcaggagacggtggtgatcacggacatgaactactaccccgtggcgccctaccacttcgacctcagcggcaccgccttcggcaagctcgccaagcccggccgcaacgacgagctccgccacgccggcatcatcgacatccagttcaccagggtgccttgcgagttcccggggctcaaggtgggcttccacgtggaggaggggtccaacgccgtgtacatggccatcctggtggagtacgagaacggcgacggcgacgtggtgcaggtggacctcatggagtccggccgcggccggcggggaggcggcggcgggcggtggacgcggatgcgcgagtcgtggggctccatctggcgcctcgactccaaccaccgcctccaggcgcccttctccctccgcatccgcaacgagtccggcaagacgctcgtcgcccgcaacgtcatccccaagaactggaggcccaacaccttctaccgctccatcgtccagtacagctagaccaccattgacggaggaacgagtccgttgcagagctctgttttggcgggagttgatgcatgctgttttggcgggagttttaattaattaattaattaatattctcaaaaaacaaaaaaaaaaaaaaaa

SEQ ID NO: 4870 - protein, 183 aa, Glycine max
MCVTPTQIKCTKHKACSGRQETVVITDMNYYPVAPYHFDLSGTAFGKLAKPGRNDELRHAGIIDIQFTRVPCEFPGLKVGFHVEEGSNAVYMAILVEYENGDGDVVQVDLMESGRGRRGGGGGRWTRMRESWGSIWRLDSNHRLQAPFSLRIRNESGKTLVARNVIPKNWRPNTFYRSIVQYS

SEQ ID NO: 4871 - DNA, 505 bp, Zea mays
  misc_feature (1)..(505): Ceres cDNA ID no. 21996046
  misc_feature (1)..(505): Ceres CLONE  ID no. 1480311
  misc_feature (1)..(505): Also known as  Ceres CDNA ID no. 24390983
aatctctatttgaaagctgcttgatgagtttgtgcacagttggtctctcctactcggctattctcctgctctactctccgggaaccatggctgttgtggagctgaaggttggaatgcactgtgagaggtgcatcaaggccatcaagaaggcaatcaaaactattgacgacatggagagctatcgccttgagacggagataaacaaggtcacggtgacggggagcgttaccccagaggaagtcgtcaaggctctccacaagatcgggaagacggcgacatgctggacccaagattgaggagggcctggttgattcggacgtccctgagaacgaggttttgttggctgtgggttggattggatggagctggagcctgcctgggcaggcaactttttcagaccatcagatgtataggaaataaccacggacagatgctgtgacttgtactatatgtgaggtaaccactgctgttaaaaaaaaaaaaaaaaaaaaaaaaaaaaaaaaaa

SEQ ID NO: 4872 - protein, 505 aa, Zea mays
  misc_feature: PFam Name: HMA; PFam Description: Heavy-metal-associated domain
  misc_feature: GI Number: 34907900; NR Description: P0439E11.14 [Oryza sativa (japonica cultivar-group)] >gi|14587363|dbj|BAB61264.1| P0439E11.14 [Oryza sativa (japonica cultivar-group)] >gi|18250912|emb|CAC83657.1| ATX protein [Oryza sativa (japonica
  misc_feature: GI Number: 47176684; NR Description: copper chaperone
  misc_feature: GI Number: 30039180; NR Description: copper chaperone
  misc_feature: GI Number: 50942155; NR Description: putative copper chaperone [Oryza sativa (japonica cultivar-group)] >gi|40253404|dbj|BAD05334.1| putative copper chaperone [Oryza sativa (japonica cultivar-group)] >gi|42761303|dbj|BAD11546.1|
  misc_feature: GI Number: 53748477; NR Description: copper chaperone
AATCTCTATTTGAAAGCTGCTTGATGAGTTTGTGCACAGTTGGTCTCTCCTACTCGGCTATTCTCCTGCTCTACTCTCCGGGAACCATGGCTGTTGTGGAGCTGAAGGTTGGAATGCACTGTGAGAGGTGCATCAAGGCCATCAAGAAGGCAATCAAAACTATTGACGACATGGAGAGCTATCGCCTTGAGACGGAGATAAACAAGGTCACGGTGACGGGGAGCGTTACCCCAGAGGAAGTCGTCAAGGCTCTCCACAAGATCGGGAAGACGGCGACATGCTGGACCCAAGATTGAGGAGGGCCTGGTTGATTCGGACGTCCCTGAGAACGAGGTTTTGTTGGCTGTGGGTTGGATTGGATGGAGCTGGAGCCTGCCTGGGCAGGCAACTTTTTCAGACCATCAGATGTATAGGAAATAACCACGGACAGATGCTGTGACTTGTACTATATGTGAGGTAACCACTGCTGTTAAAAAAAAAAAAAAAAAAAAAAAAAAAAAAAAAA

SEQ ID NO: 4873 - DNA, 1208 bp, Glycine max
  misc_feature (1)..(1208): Ceres cDNA ID no. 21996047
  misc_feature (1)..(1208): Ceres CLONE  ID no. 1485366
  misc_feature (1)..(1208): Also known as  Ceres CDNA ID no. 0
cctgaccacctccctaggagaattccgaggtttgttggtcctatttggagttgaattttcatcgagggttgacttgactggtggtatacccggtgccggagatgggcaagggcggcggctgcgtccccagcaagaagcgccagccgccggccaccaccgtcgccgccgcgccctcgtcgtcgtcagccaccgcggtcccgcgggacgcgcccgaggaggccctggacgcacccaccggggagtcgaggcggacgctgcggctgtacatcgtgttctactcgatgtacgggcacgtggaggcgctggcgcgtcacgcggcagcgggagcgggtgcggtggagggggtggaggtcgtcctgcggcgggtgccggagactctctcgccggaggtgctggagaagatgcaggcgccatccaaggaccccaccgtcccggtcatctcagcgccggccgacctggaggaagccgacggggtgctgttcgggttcccgaccaggtacggcgccatggccgcgcagatgaaggcattctttgactccacaggctccctctgggagaagcagaggctcgccgggaagcccgccggattcttcgtcagcaccggcacccagggcggcggccaggagaccactgcttggacggcaatcacccagctggtgcaccacgggatgctgtttgttcccatcggctacacctttggcttgggcatgtttaacatggacgacatcagagggggcagcccctatggagctggagttcttgctggtgacggtagcaggcagcccagcgaggcggaacttgccctcgccgagcaccagggcaagtacatggccgccttcgtcaagaagctcggccaggcctgattctgagccagcagatgaaccgtcctttcaacccgtaagcagccagtcagcgaccatccattatactgttgatcagccattgtttcctcttcagcaccgcctgttcctattgtccctacatgtgcacagcttttgctcttagattgattgttggaatagtcatataatcacgtcgaggtttctttgtacatttgttgacataaatgatgtgtattgtccatttgtaaaataagcccccatctggaacccgtgagcttttctggattgctgtgagcaatgaactgtttgatgtaaagattcatgcatttcaatcagatgctacaccgaataaaaaaaaaaaaaaaa

SEQ ID NO: 4874 - protein, 253 aa, Glycine max
MGKGGGCVPSKKRQPPATTVAAAPSSSSATAVPRDAPEEALDAPTGESRRTLRLYIVFYSMYGHVEALARHAAAGAGAVEGVEVVLRRVPETLSPEVLEKMQAPSKDPTVPVISAPADLEEADGVLFGFPTRYGAMAAQMKAFFDSTGSLWEKQRLAGKPAGFFVSTGTQGGGQETTAWTAITQLVHHGMLFVPIGYTFGLGMFNMDDIRGGSPYGAGVLAGDGSRQPSEAELALAEHQGKYMAAFVKKLGQA

SEQ ID NO: 4875 - DNA, 786 bp, Zea mays
  misc_feature (1)..(786): Ceres cDNA ID no. 21996055
  misc_feature (1)..(786): Ceres CLONE  ID no. 1515907
  misc_feature (1)..(786): Also known as  Ceres CDNA ID no. 23841224
agcaagcagcatcgactcaagtttggttctcctctcctagctagccagcacctgcagatctgctcgttgccttggtaatttcataatgtagtacgtagcatcagctagtatttatctcaagtatatatgcattttgcatgtgtcgtcgcagtagtactttcctttatctctatacacactacacgcatacataccaataccatctgtcttaactcttaatcatgcatgtacaccggtgtgtgtgttctggggtgaaaagaaaacttaatgcacgtacgtacagggctacagattttgtggaacgaagcgatggctcgcagcggcgccatggtttcctgcatgctgctcctggtagtggcggcgcaactgctcatggtgatggccacgcagacagcggcggcggcgggcgacgaccaacgcggagcagcacgccggctgctgtggcaggtgacctgccactacagcaactgtaactgccgcacttgcccgatatatggctgggcgtgctgcagcacttgctgctagctagctagctagtgtgagttcttccgcgcgcgcgcgcagcctttgcataccacccctcttgcttagctcatgcatgcgctcgtcgtcgtcgtcggcgacgtcatctctggtggttctcatcagcgacttctaataatggcgcgcgctcgatctttccttcagtcctttttatttataataagaagccaattgatctttcctgcagtcctttttgtttgatatatataataaaagtcttcgttgcaaaaaaaaaaaaaaaaa

SEQ ID NO: 4876 - protein, 85 aa, Zea mays
  misc_feature: GI Number: 46486627; NR Description: unknown [Cynodon dactylon]
MHVRTGLQILWNEAMARSGAMVSCMLLLVVAAQLLMVMATQTAAAAGDDQRGAARRLLWQVTCHYSNCNCRTCPIYGWACCSTCC

SEQ ID NO: 4877 - DNA, 965 bp, Zea mays
  misc_feature (1)..(965): Ceres cDNA ID no. 21996057
  misc_feature (1)..(965): Ceres CLONE  ID no. 1534004
  misc_feature (1)..(965): Also known as  Ceres CDNA ID no. 24371014
acttattcccaagcaagttggggtaggctagagttgaaacccaacaagatgtcaccaaaaagagaaagcgagagaaacgggaggggaaaaagcttttaagagcactaaaagggaaaaagcctaatcacggttcgggcacgtggatagcttttttctaagcacttctatccaaacataactctattgggatatttcattccttcaagtcccttttgattgtcttctctcatgtcaagtttggccgtcctctacctcacttcacattattgttgcctattgggatattctattccttcaagtcccttttgaattgcccaattatgcaatgctacaaaattaaatttgaaagttattatgctgcatgtagatgatcagacaaaagatgtcctttgttgtagacattagaccaacttctaattaactggctcttatgtggacatgttttaccggcattctgcaacagttatgttttcatggaacttatgtttcatgcaggatgccactataagtaatgcctcagcagacggcaccatggatgaaagcagaactaggaggactattatcttcagtccaaagatatgtaacaatgtagatcttctggttggaaacataattcatatcttcccaccatggaaggaagttaaaatacaagaagagcatgtgattatttgcacctacttctcgcaccaccaccggacttgatactcggagatatttctgtgctagctgcaaagctagaggcagaccgccagcataaccgttgctgacagtttaatgttgatgtactcgcagggtctattctgtttgttttgtaatcacaagtgtactggctgcaaagctataggcagaccgcaagcataaccgttcctgatagcctaatgctgatgtacttgcagtctctcttctgttttacaatcacaagttactgaggcctagttcggattctctaaaaaaaaaaaaaaaaa

SEQ ID NO: 4878 - protein, 965 aa, Zea mays
ACTTATTCCCAAGCAAGTTGGGGTAGGCTAGAGTTGAAACCCAACAAGATGTCACCAAAAAGAGAAAGCGAGAGAAACGGGAGGGGAAAAAGCTTTTAAGAGCACTAAAAGGGAAAAAGCCTAATCACGGTTCGGGCACGTGGATAGCTTTTTTCTAAGCACTTCTATCCAAACATAACTCTATTGGGATATTTCATTCCTTCAAGTCCCTTTTGATTGTCTTCTCTCATGTCAAGTTTGGCCGTCCTCTACCTCACTTCACATTATTGTTGCCTATTGGGATATTCTATTCCTTCAAGTCCCTTTTGAATTGCCCAATTATGCAATGCTACAAAATTAAATTTGAAAGTTATTATGCTGCATGTAGATGATCAGACAAAAGATGTCCTTTGTTGTAGACATTAGACCAACTTCTAATTAACTGGCTCTTATGTGGACATGTTTTACCGGCATTCTGCAACAGTTATGTTTTCATGGAACTTATGTTTCATGCAGGATGCCACTATAAGTAATGCCTCAGCAGACGGCACCATGGATGAAAGCAGAACTAGGAGGACTATTATCTTCAGTCCAAAGATATGTAACAATGTAGATCTTCTGGTTGGAAACATAATTCATATCTTCCCACCATGGAAGGAAGTTAAAATACAAGAAGAGCATGTGATTATTTGCACCTACTTCTCGCACCACCACCGGACTTGATACTCGGAGATATTTCTGTGCTAGCTGCAAAGCTAGAGGCAGACCGCCAGCATAACCGTTGCTGACAGTTTAATGTTGATGTACTCGCAGGGTCTATTCTGTTTGTTTTGTAATCACAAGTGTACTGGCTGCAAAGCTATAGGCAGACCGCAAGCATAACCGTTCCTGATAGCCTAATGCTGATGTACTTGCAGTCTCTCTTCTGTTTTACAATCACAAGTTACTGAGGCCTAGTTCGGATTCTCTAAAAAAAAAAAAAAAAA

SEQ ID NO: 4879 - DNA, 944 bp, Zea mays
  misc_feature (1)..(944): Ceres cDNA ID no. 21996059
  misc_feature (1)..(944): Ceres CLONE  ID no. 1551032
  misc_feature (1)..(944): Also known as  Ceres CDNA ID no. 24363774
agtcgcctcgattcgcttccgccccatcctccttcccgacgcctcacatggcaacggccgtgcccgccgcctgcctccgcgcgccgtgctcctctccagcggccgtcgcacgccgacttggggccggtggcccgtcgctgcgcaagcggcattgcgccgtcgcgcccgtcgctgccgcctgcggccccgcgccgccgcggctgcttgacaacgaggaggcggtctgctccgtacggcggcgtgtgctggttgccggtgccgccgcgttcctctcccggcctaatccggcggcattcgcagcagaggctaagaaagggttcctgcccgtcgtcgacaagaaggctggctactctttcctctacccgttcggatgggaggaagtggctgtgcaagggcaagacaaggtgtacaaagatgtgatagagcctctcgagagtgtgagcgtcaactctattccaactagcaaggaggatatccgtgatcttggtcctccggataaggttgccgaggctctgattaaaaaggttttggcaccatcaacacagaagacaaagttaattgaggcgaaagagaatgatgttgatgggagggcttactacacttttgagttcacagctcaggctccaaactacaccagacatgcacttggtgctattgtaattgcaaatggcaaattttacacattgaccactggagcaaacgagaggaggtgggaaaagatgaaggataggctgcatactgttgtggattccttcaaaatcgaaaatagaatatgagtgcctgaattgctgtgttgtttttccttcgttgattcgctttttcttacataactgcagtgctgagatttttcagtagtaaataccgggattgtggattatgctgatcagtttcatttcgaaatgtttgttaccagacttgagcaaaaataaaaaaaaaaaaaaaaa

SEQ ID NO: 4880 - protein, 242 aa, Zea mays
  misc_feature: PFam Name: PsbP; PFam Description: PsbP
  misc_feature: GI Number: 50944591; NR Description: oxygen evolving complex protein-like [Oryza sativa (japonica cultivar-group)] >gi|38636895|dbj|BAD03159.1| oxygen evolving complex protein-like
  misc_feature: GI Number: 37927457; NR Description: putative oxygen evolving
  misc_feature: GI Number: 22299618; NR Description: photosystem II oxygen-evolving complex 23K protein PsbP homolog [Thermosynechococcus elongatus BP-1] >gi|22295802|dbj|BAC09627.1|
  misc_feature: GI Number: 33863349; NR Description: PsbP [Prochlorococcus marinus str. MIT 9313] >gi|33640798|emb|CAE21253.1| PsbP
  misc_feature: GI Number: 50935799; NR Description: putative Thylakoid lumenal 21.5 kDa protein, chloroplast precursor [Oryza sativa (japonica cultivar-group)] >gi|34394134|dbj|BAC84394.1| putative Thylakoid lumenal 21.5 kDa protein, chloroplast precursor [Oryza
MATAVPAACLRAPCSSPAAVARRLGAGGPSLRKRHCAVAPVAAACGPAPPRLLDNEEAVCSVRRRVLVAGAAAFLSRPNPAAFAAEAKKGFLPVVDKKAGYSFLYPFGWEEVAVQGQDKVYKDVIEPLESVSVNSIPTSKEDIRDLGPPDKVAEALIKKVLAPSTQKTKLIEAKENDVDGRAYYTFEFTAQAPNYTRHALGAIVIANGKFYTLTTGANERRWEKMKDRLHTVVDSFKIENRI

SEQ ID NO: 4881 - DNA, 1109 bp, Zea mays
  misc_feature (1)..(1109): Ceres cDNA ID no. 21996060
  misc_feature (1)..(1109): Ceres CLONE  ID no. 1554842
  misc_feature (1)..(1109): Also known as  Ceres CDNA ID no. 24392281
gggagcccattgacatctataccgaaaacccagacaaagcccgagctacgcacgccccgctgcctcctttctgccgtcccaacgccgccggagtctgtcgccaccgtcgctgctctcccgccttcaccgcgcccaactctcctccttgcctcccctgcgcgcttcagccgcttcactccccatcgttttcgcctggccaggatctactgggaccatggatcaagaaaaaaaactagaagtatctaataccagccatacttacaagcatcattgtagcgttggagttgacgtccacgagatcttttttaagaggagcagattgcgggttgttctgtcatacattggcattattttccttcttgtgaatgcctgccaaccattgctgacaaaggagagcctatctcttggatctgtttggaatattacgtttgctgttctggtcgccaaatgtttgcaatacaaacctgtgaagagagaatcagtagtgataatgccagcttttggagttcagctagaaatacatttttggagtggaagagttgatcatcgttttgtgcccattggcaagattctcaagccaatgataaatgagtgcgtgacaccggtgacctgttactggagcttggcgctgcttctgcgtgatgaagaggaactcctgctcgttttccagagatctcgtcctcctgtcaaaatgttggttccaatatggaaagctctctgcacgttgacaaactctcaacacccaagcccttctcaaattcctaaccatgacccttgaggaacatgagtcagctggggcgttgtgtagatgtacgtatcatcagaagaggcacctgcagttgagccagattcagataggatagtaactgttgatgccagtgctaggggcatttgattgttagggagtgatttcggctggaagtgtatacggataaacactagtaatttgtgacactgaatactctcctttacttgcatgcttcattttgttggatatctgaatgaggtgccgaatataagcaaattcaagtgaaactttggtatgtacgtaaagatgcaaacttttgttaaacaatatcttgtctcgtgtgccacaaaaaaaaaaaaaa

SEQ ID NO: 4882 - protein, 187 aa, Zea mays
MDQEKKLEVSNTSHTYKHHCSVGVDVHEIFFKRSRLRVVLSYIGIIFLLVNACQPLLTKESLSLGSVWNITFAVLVAKCLQYKPVKRESVVIMPAFGVQLEIHFWSGRVDHRFVPIGKILKPMINECVTPVTCYWSLALLLRDEEELLLVFQRSRPPVKMLVPIWKALCTLTNSQHPSPSQIPNHDP

SEQ ID NO: 4883 - DNA, 1562 bp, Zea mays
  misc_feature (1)..(1562): Ceres cDNA ID no. 21996062
  misc_feature (1)..(1562): Ceres CLONE  ID no. 1557469
  misc_feature (1)..(1562): Also known as  Ceres CDNA ID no. 24386411
agagaagcatcccagacagcaaggaaaccttggagcctgccggcaagtctaacgacgacgatggcagaaggggacggtccaactccagcccgcggcgctcgcgtcgtgctgttcccactgccgtcccagggccacctcagcccgatgctgcacctcgccagcgcgctccacgcgcgggggctcgcagtcaccgtgctccacacggcgtacaacgcgccggaccccgcgcaccacccggggctagccttcgtcgccgtgcccgacgtcatcccggaggccgtggcggcgacgacgaatggcatcgcgaagatcctcgccctgaacgccgccatggaggcgtcggggcacgtccgcggcgcgctcgcgtcgctcctcgcggaggaggcgggcggacagcggctggcgtgcctcatcttcgactccaccctcttcgccgcgcagaaggccgcggctggcctcgggctgcccacgctcgtgctgcacaccggcagtgccgccggcttccgtctgttcaggtccgacacctacgacatgctccacgacaggggctatctgccagccacagagtccaacctacacatgccggtaaaggagctgccgcctctgcaagtgagggacctgttcgacccaagcaagctccccaacaaggaaatcgtgcagaagatcttgggtcgcgccacggagagcacgacgaactcgtccggcgcaatcctcaacacgtttgaggctctcgagtcccgcgagctcgagatgatccgggacgaacttgccgacagaggtatcccacccttcgccgtcggcccgcttcacaagctcaccgccgccccctccaacgatggcgccgacgagactagtctactcagccaggaccgcgtctgcatcgagtggctagacgcacgggcccctggatccgtgctgtacgtgagcttcggcagtgttgttcatgtcaccccggacgagttggtggagatcgcgtggggcttggcgaacagcggcgtgccgttcctgttggtggtccggcgtggcattgtgctcggagtggacaagcaggagctcccggacgggttcatggcggccgtggagggcaggggcaaggtgatcgagtgggcgccgcagcaggaggtgctagctcacccggcagtcggaggcttctggactcacaacggatggaactccacgctggagagtatctatgagggggtgcctatgctgtcgaggcccatctttggagaccagttgccaacggcaaggtacgtgtgcgacgtgtggagaattggagttttgctggagggtgtgctggagcggcgggaggtggagaaggccatcaagaagctgatggaagaagacgagggagttggtatcaggggaagagccaaggatttcaaggagaaagtgcggatgtgccttgagagcaatgggtcttctcaacttgccgtcgataagttggtggatcacatactttctctttgagttttttttttatcacacaacactgttatgtctgttcatggtttgaactcaataaattaataactgctggtttataaaaaaaaaaaaaaaaa

SEQ ID NO: 4884 - protein, 469 aa, Zea mays
  misc_feature: PFam Name: UDPGT; PFam Description: UDP-glucoronosyl and
  misc_feature: GI Number: 34900682; NR Description: putative UDP-glucosyltransferase [Oryza sativa (japonica cultivar-group)] >gi|22831219|dbj|BAC16077.1| putative UDP-glucosyltransferase
  misc_feature: GI Number: 50935389; NR Description: putative UDP-glucosyltransferase [Oryza sativa (japonica cultivar-group)] >gi|33146633|dbj|BAC79921.1| putative UDP-glucosyltransferase
  misc_feature: GI Number: 34897378; NR Description: putative UDP-glucosyltransferase [Oryza sativa (japonica cultivar-group)] >gi|27545030|gb|AAO18436.1| putative UDP-glucosyltransferase [Oryza
  misc_feature: GI Number: 50935391; NR Description: putative UDP-glucosyltransferase [Oryza sativa (japonica cultivar-group)] >gi|33146634|dbj|BAC79922.1| putative UDP-glucosyltransferase
  misc_feature: GI Number: 18033228; NR Description: UDP-glucosyltransferase
MAEGDGPTPARGARVVLFPLPSQGHLSPMLHLASALHARGLAVTVLHTAYNAPDPAHHPGLAFVAVPDVIPEAVAATTNGIAKILALNAAMEASGHVRGALASLLAEEAGGQRLACLIFDSTLFAAQKAAAGLGLPTLVLHTGSAAGFRLFRSDTYDMLHDRGYLPATESNLHMPVKELPPLQVRDLFDPSKLPNKEIVQKILGRATESTTNSSGAILNTFEALESRELEMIRDELADRGIPPFAVGPLHKLTAAPSNDGADETSLLSQDRVCIEWLDARAPGSVLYVSFGSVVHVTPDELVEIAWGLANSGVPFLLVVRRGIVLGVDKQELPDGFMAAVEGRGKVIEWAPQQEVLAHPAVGGFWTHNGWNSTLESIYEGVPMLSRPIFGDQLPTARYVCDVWRIGVLLEGVLERREVEKAIKKLMEEDEGVGIRGRAKDFKEKVRMCLESNGSSQLAVDKLVDHILSL

SEQ ID NO: 4885 - DNA, 1506 bp, Zea mays
  misc_feature (1)..(1506): Ceres cDNA ID no. 21996063
  misc_feature (1)..(1506): Ceres CLONE  ID no. 1558043
  misc_feature (1)..(1506): Also known as  Ceres CDNA ID no. 24392445
agtcaagctagcgccatggattcccgagacctgggaaccgttggcctcctgctcgtctcctgtttcctcctcgctgccggaggcgtccgtgccggcggcgcccagaggttcgaggccatgttcaacttcggggactcgctgggcgacacgggcaacctctgcgtcaacaagtcggcggcgaaccagctcctgctcaccttcgcgcagccgccctacggcatgacgtatttcggccaccccacctgccgctgctccgacggccgcctcgtcgtcgacttcctcgctcaggagctggggctgccgctcctcccgccgtcgaagcagcaggacggcgcggacttccgcagggatgcgagcatggccatcgtcggcgccacggccctcgacttcgagttcctcaagtccatcggcctcggctacccgatctggaacaacggcgccatgaacgtccagatccagtggttcagggacctgctgccgtccatctgcggcgccgcgccgccggcggcggaagggcaagactgcaaggactacctggccagatccctgttcgtcttcggccccttcggagggaacgactacaatgccatgctcttcttcgggctcaccgtggatcaggcaaggaactacacgcccaagatcgtcgacaccgtcgccagcggcgtcgagcaactcatccagctgggcgcagtggacatcgtcgtcccgggagcgctgcccgtggggtgcttcgccatctacctcacgtttctcccgagcgacgacccggcggactacgacgggcacgggtgcctgagggcgctcaacgagctgtccgtctaccagaactccctgctccagagcaggctcgccgccctccaggcaaggtatccctcggcgaggatcgtgtacgccgactactacacccacatcgaccggctggtgcgcagcccggcgcgcttcggcttcacaactggcgccgtcccggcgtgctgcggcgccggtggcggcaagtacaacttcgagctcgacgcgcggtgcggcatgaagggcgccaccgcgtgccgggacccgtcgaggcacgagtcctgggacggcgtccacctgacggaggccgtgaacaggctcatcgccgagggatggctcagaggcccgtactgccatcctcccattgcgactcagtcgatagcgtaggtcaccccggcccatgcggggttgcggccatggtaagactgacacgggccttccctgacatacagtggcatgatggcgtagtgttgtaccgtatttacgaagtgaaaaatctaaaagcttaaatcataaaaaaaactccctaaactccgatttagtacgttgctaatacatattaggaataaaatccactttagtctccaacagtttccaataaataattttaaattatgctaactcggattttctagttattacttacaactttaaacttggtttcatttgtacaataaagtttaataattattgttcttctcattaaaaaaaaaaaaaaaa

SEQ ID NO: 4886 - protein, 385 aa, Zea mays
  misc_feature: PFam Name: Lipase_GDSL; PFam Description: GDSL-like
  misc_feature: PFam Name: Cupin_1; PFam Description: Cupin
  misc_feature: GI Number: 55297458; NR Description: putative lipase [Oryza sativa (japonica cultivar-group)] gi|55296703|dbj|BAD69421.1|
  misc_feature: GI Number: 55297457; NR Description: putative lipase [Oryza sativa (japonica cultivar-group)] gi|55296702|dbj|BAD69420.1|
  misc_feature: GI Number: 53793018; NR Description: putative lipase [Oryza
  misc_feature: GI Number: 53791965; NR Description: putative lipase [Oryza
  misc_feature: GI Number: 55296706; NR Description: putative lipase [Oryza
MDSRDLGTVGLLLVSCFLLAAGGVRAGGAQRFEAMFNFGDSLGDTGNLCVNKSAANQLLLTFAQPPYGMTYFGHPTCRCSDGRLVVDFLAQELGLPLLPPSKQQDGADFRRDASMAIVGATALDFEFLKSIGLGYPIWNNGAMNVQIQWFRDLLPSICGAAPPAAEGQDCKDYLARSLFVFGPFGGNDYNAMLFFGLTVDQARNYTPKIVDTVASGVEQLIQLGAVDIVVPGALPVGCFAIYLTFLPSDDPADYDGHGCLRALNELSVYQNSLLQSRLAALQARYPSARIVYADYYTHIDRLVRSPARFGFTTGAVPACCGAGGGKYNFELDARCGMKGATACRDPSRHESWDGVHLTEAVNRLIAEGWLRGPYCHPPIATQSIA

SEQ ID NO: 4887 - DNA, 1264 bp, Zea mays
  misc_feature (1)..(1264): Ceres cDNA ID no. 21996064
  misc_feature (1)..(1264): Ceres CLONE  ID no. 1558487
  misc_feature (1)..(1264): Also known as  Ceres CDNA ID no. 24390649
aacggagctcgagcagccagcgacgacaacccacgcgcacaccaaccaacaagccacaccggcccacaggccacagctcaccagctaggctagcaaccacctcgatcgcagaggcagaggccgccggaagctcagccgtgaattcggcaggaaggaaaggaaaaagtcttgggtggtttcaacaagagatagaagatggagaaggcagggcagcacgagcatgtgatcggcatccccgtgaacaacagggcgttcggtatcgaggagccagatttccccagcaatggccccgccaagaacgcagccgccggcgccgggggacggcgccgggtgaccggggacagggtcgcccaaggcctgaaagagcacgtgacgctgggcccgaagctgtacgagaccgtgaagggcaagctgtcgctgggggcgaggatcctgcgggcgggcggcgtggggaaggtgttccggcgctggttctcctcccccgtcggcgggggcggcgagcggctgctcagggcgtcgcagtgctacctgtcgaccacggccggcccgatcgccggcatgctgttcgtgtccaccgagagggtcgcgttccggagcgaccgctcgctggcgctgccgctgacgtctccggccggcggcggcagcggcagcggcacgacgacggtgctgcgggtgccgtacaaggtgtccatcccgctgcgcagggtcgcggcggccaggccgggccagaacagggaccggccggagcacaagtacgtgcaggtcgtcacgcgcgacggcttcgacttctggttcatgggcttcgtcaggtaccaggcgtccctgcaggagctggagaaggccgtcgcgcagtcgcagtcgcaatgacctcaggcgatccgccggccggcccggcgattgttgtgctcctgtgtggtctgcttcatctgtgtgcatatgtagtagggtttcggttttcttgatgatggattattgcttggcgtttttggcattggagcaagtccggtatacattatacaggaggaaaaaatgggatattagattgattgcgtaatcggtgatgctgagtaaatcttctacggcgccagcgtaaaagtgtctcggatgaggtttacatgtaacatgtgtcatgaaaaccacaaatgcttgtgcgacgaactagattgtgtgaactgaactctgttcccatcttttacatcgaggcaaccgcgcgtactgatgaatgctatactatttcttattgtaaaaaaaaaaaaaaaaaaaa

SEQ ID NO: 4888 - protein, 223 aa, Zea mays
  misc_feature: PFam Name: GRAM; PFam Description: GRAM domain
  misc_feature: GI Number: 50911012; NR Description: ABA-responsive protein-like [Oryza sativa (japonica cultivar-group)] >gi|49387971|dbj|BAD25079.1| ABA-responsive protein-like [Oryza sativa (japonica cultivar-group)] >gi|49388696|dbj|BAD25877.1|
  misc_feature: GI Number: 50911010; NR Description: ABA-responsive protein-like [Oryza sativa (japonica cultivar-group)] >gi|49387970|dbj|BAD25078.1| ABA-responsive protein-like [Oryza sativa (japonica cultivar-group)] >gi|49388695|dbj|BAD25876.1|
  misc_feature: GI Number: 50900286; NR Description: FH protein interacting protein FIP1-like [Oryza sativa (japonica cultivar-group)] >gi|46806322|dbj|BAD17514.1| FH protein interacting protein
  misc_feature: GI Number: 51972114; NR Description: At4g01600 [Arabidopsis thaliana] >gi|50897220|gb|AAT85749.1| At4g01600 [Arabidopsis
  misc_feature: GI Number: 7268203; NR Description: putative ABA-repsonsive protein [Arabidopsis thaliana] >gi|25407118|pir||G85020 probable ABA-repsonsive protein [imported] - Arabidopsis thaliana >gi|15234255|ref|NP_192070.1| GRAM domain-containing protein /
MEKAGQHEHVIGIPVNNRAFGIEEPDFPSNGPAKNAAAGAGGRRRVTGDRVAQGLKEHVTLGPKLYETVKGKLSLGARILRAGGVGKVFRRWFSSPVGGGGERLLRASQCYLSTTAGPIAGMLFVSTERVAFRSDRSLALPLTSPAGGGSGSGTTTVLRVPYKVSIPLRRVAAARPGQNRDRPEHKYVQVVTRDGFDFWFMGFVRYQASLQELEKAVAQSQSQ

SEQ ID NO: 4889 - DNA, 1340 bp, Zea mays
  misc_feature (1)..(1340): Ceres cDNA ID no. 21996066
  misc_feature (1)..(1340): Ceres CLONE  ID no. 1560286
  misc_feature (1)..(1340): Also known as  Ceres CDNA ID no. 24391106
aacccgcgacaaccactgagccgagcgggggtggatatggcagcgctcgccgcccaccaccacctccacccctcctccgtcgctgcccgaactccaacacttggccgacgccaccgtttctcgtcgcttcctctcgccgcgcggccctcctcccaaggccgtttcagctcccgagccgcgacccgtgtcctcacgcgcgccggaagcactggcgccagcagcgccgcctcgcccgccgcgacgacggcgtcgtcgttgtcgctggaggagctgcgcgggggctgcgccacctggacgtggcgagggatgcgcgtgaactacctcgccagaggacaggggccgcccgtactgctcgtccacggcttcggcgcctccgtcgcgcactggcgcaggaacattggggtgttgtctgaatcctataccgtctacgcgatcgatttgctggggtttggcgcgtcggacaagcctcctgggttttcttacacgatggagacatgggccgagctgatactggatttcttggaggaggtggtcaggaggcccacggtgctcgtcgggaactcggttggaagcctcgcgtgcgtcattgctgcatcagagtccagcagagaagccgtccgggggcttgtcctgctgaactgcgccggtggcatgaacaacaaggcgatcgtcgatgactggcggatcaagctgctcctgccactgctctggctgatcgacttccttctgaaacagcggccgatagcatcagcgctctttaaccgcgtgaaaaacagggacaatctgaaggacatcttgctctctgtttatgggaacaaagatgctatggacgatgaattggttgagatcatacgcggaccggctgacacggagggcgccctggacgcgttcgtgtcgacggtgaccggcccgccggggccaagcccgataggcctgatgccgcggctggccgacctgcccgtgctagtgctgtggggcgaccgggaccccttcaccccgatcgacgggcccgtggggaagttcttctcgaagctgccgtcggagctcccgaacgtgacgctctacatgctggagggcgtggggcactgcccgcacgacgaccggccggacctcgtccacgacaagctgctgccgtggcttgaagcgctcccgccgcccgccgccggcgcggtgacgacgacgacggttgtctaaggctaataataatacgccttattgctgactggagcttcgaagtctagctggactcttcatttttaagtctagctggactctttatttttaactctctgtttatctctttataaaaattaaattctatttaaaaaaaaaaaaaaaaa

SEQ ID NO: 4890 - protein, 385 aa, Zea mays
  misc_feature: PFam Name: Abhydrolase_1; PFam Description: alpha/beta
  misc_feature: GI Number: 21592307; NR Description: unknown [Arabidopsis thaliana]
  misc_feature: GI Number: 53735176; NR Description: COG0596: Predicted hydrolases or acyltransferases (alpha/beta hydrolase superfamily)
  misc_feature: GI Number: 46129642; NR Description: COG0596: Predicted hydrolases or acyltransferases (alpha/beta hydrolase superfamily)
  misc_feature: GI Number: 23126428; NR Description: COG0596: Predicted hydrolases or acyltransferases (alpha/beta hydrolase superfamily)
  misc_feature: GI Number: 53765399; NR Description: COG0596: Predicted hydrolases or acyltransferases (alpha/beta hydrolase superfamily)
MAALAAHHHLHPSSVAARTPTLGRRHRFSSLPLAARPSSQGRFSSRAATRVLTRAGSTGASSAASPAATTASSLSLEELRGGCATWTWRGMRVNYLARGQGPPVLLVHGFGASVAHWRRNIGVLSESYTVYAIDLLGFGASDKPPGFSYTMETWAELILDFLEEVVRRPTVLVGNSVGSLACVIAASESSREAVRGLVLLNCAGGMNNKAIVDDWRIKLLLPLLWLIDFLLKQRPIASALFNRVKNRDNLKDILLSVYGNKDAMDDELVEIIRGPADTEGALDAFVSTVTGPPGPSPIGLMPRLADLPVLVLWGDRDPFTPIDGPVGKFFSKLPSELPNVTLYMLEGVGHCPHDDRPDLVHDKLLPWLEALPPPAAGAVTTTTVV

SEQ ID NO: 4891 - DNA, 1452 bp, Zea mays
  misc_feature (1)..(1452): Ceres cDNA ID no. 21996067
  misc_feature (1)..(1452): Ceres CLONE  ID no. 1561377
  misc_feature (1)..(1452): Also known as  Ceres CDNA ID no. 23841535
agctgtggcttgtggccgctcgcccgctccagtccggccgagccgaacgggcgtgcgccatgcgcatgcgaccctgacgagcaacgacaaccacagagcccaaccggaaggaggatcggtaccagctcacggcggcgccagcaccacacgccgccgccgccgccgcccacccccctcccgacaggcacgcttcttgcgcctcttgtgggatgctactacggataacgtacgcccaacccacgccttcggcggcggcccagttgaggctccctgggccgcgtttacgccgacgccgcgtcgctgcctccgcagcggacggcgccggcaattcaagctccccgctccactgtgacccttcgccccacgcctacctcctggtcctgggtccggacgtcgaacccagcggctcacgctcactgagtacatctccaattacagagaagggaaagctgaggtcttgggtcggtccaagtgggcagtactaccgtgagctgccttgccccagctgtaggggtagaggttacactccatgcaaggagtgtggaatagatagatcaagtttggactgccctatgtgcaatggcaaggggattcaaacgtgtttacaatgtagcggagagtgtgtgatatggcaggaatctgttgatgaacagccatgggagaaagttcggtcaagttctcccttgaaagtaaaagaagatgacgaagttgacaagttagagataaatatcaacaaccccaaaagatcaaagcgtacttatgcatctacttcaccagaagttgccaagaagattagccggtctttaagaagtctaaatgctcaaacaggattgtttactaagcacatgaagattatacaccaagacccagaattgcgtgctcaaagagttgctgcaatcaagagaacaaaaggaagtgatgttgcaagaaagcgtgcttctgaaattcagaaggcattcttcagtgatcctgagaaccggctcaagagaagcattgccatgaaaggggtgaaattttactgcagcaaatgtgggcaagaaggacatagaagcttttattgccctacagtgagggaaggttcaaccagggtgcggttcaggtgccggttgtgtggcagagaagggcataatagtcgaacatgtggaaaaccaaagtccgagaaggagcacaaacaacgacctcaccactgcagccgatgcggtgaaaagggacataaccggcgcaactgccccacatgcactgatttgggtagtgatgcttcaggctatgtggttaacaaagttaatggctctaattcagctgtttatcaatgtagtatatgcttagaaaaggggcataacagacgaacatgcccgaaaagaaaggctaccttactaaaatgaaaagtgtgagtaaaattaaaagaaaggctatcttttatgcctgtgtttttcctaaaaaaaaaaaaaaaaa

SEQ ID NO: 4892 - protein, 390 aa, Zea mays
  misc_feature: PFam Name: zf-CCHC; PFam Description: Zinc knuckle
  misc_feature: GI Number: 34910574; NR Description: putative zinc finger protein [Oryza sativa (japonica cultivar-group)] >gi|21104765|dbj|BAB93353.1| putative zinc finger protein [Oryza
  misc_feature: GI Number: 21553596; NR Description: zinc finger protein
  misc_feature: GI Number: 18420148; NR Description: zinc knuckle (CCHC-type)
  misc_feature: GI Number: 1078700; NR Description: hexamer-binding protein HEXBP - Leishmania major >gi|729704|sp|Q04832|HEXP_LEIMA DNA-binding protein HEXBP (Hexamer-binding protein)
  misc_feature: GI Number: 7494472; NR Description: cnjB protein - Tetrahymena thermophila >gi|161752|gb|AAC37171.1| cnjB [Tetrahymena
MLLRITYAQPTPSAAAQLRLPGPRLRRRRVAASAADGAGNSSSPLHCDPSPHAYLLVLGPDVEPSGSRSLSTSPITEKGKLRSWVGPSGQYYRELPCPSCRGRGYTPCKECGIDRSSLDCPMCNGKGIQTCLQCSGECVIWQESVDEQPWEKVRSSSPLKVKEDDEVDKLEININNPKRSKRTYASTSPEVAKKISRSLRSLNAQTGLFTKHMKIIHQDPELRAQRVAAIKRTKGSDVARKRASEIQKAFFSDPENRLKRSIAMKGVKFYCSKCGQEGHRSFYCPTVREGSTRVRFRCRLCGREGHNSRTCGKPKSEKEHKQRPHHCSRCGEKGHNRRNCPTCTDLGSDASGYVVNKVNGSNSAVYQCSICLEKGHNRRTCPKRKATLLK

SEQ ID NO: 4893 - DNA, 1713 bp, Zea mays
  misc_feature (1)..(1713): Ceres cDNA ID no. 21996070
  misc_feature (1)..(1713): Ceres CLONE  ID no. 1561988
  misc_feature (1)..(1713): Also known as  Ceres CDNA ID no. 24391225
agtggcgcggccctaatttcgccgcgtgtgctctgcaccgtcgcgctttcctgggccacattgcttatcttctcgctgctattattcctttcccttccaaatttgggtcgtgttaattcctccgttgtcgttagtttcccctccatttacgccgctgaattgcgaggcggaatcgcagttttttttgataattcagttgttgcgttgctatgaatcgtaggagatgatggaatcgtcgtacatccgcacgtacctgcagcagatggcagcgtcggtctccacggcgagctgcgacccgtctagcggcgccgatgaggtggagtgccgcgacgaggcggcggcgctgaggcttatgatggtgttcgtcgtggccatactcgtcgcaggcgcgaccggcgtcgcgatcccgctcgtcggccgccgctgccacgggcatggagcctcctcctcctcctccaccggtggggcgttcgtgctcgtaaaggcgttcgcggccggggtgatcctggccacgggcttcgtccacatgctgcacgacgcggacgaggcgctcacggacccttgtctccccgccgcgccgtggcgccgcttcccgttcccagggttcgtcgccatgctcgcggcgctcgggacgctcgtcttcgacttcgtcggcacgcatatgtacgagcgcaagaagcaccacgccgatgcggaggaagccgccgtcgtcgttggcaatgccagtgccagtgccaatgcgagcggccacgacgtgatcgttgcgctgctacaggacggcgcgctcgtggcgagcactggcagcagcattgggagagacgggggaggccacaaggaccccatgcacatcgtggggatgcacgcgcatgccgcagcacataggcatagccacgcccacgggcacggcccatgtgatgactgtcacgatgggcatgatgaggagccgtcccaagctcgtcatgtggtcgtctcccagattcttgagcttgggattgtatcgcactcagtgatcatcgggctatctttgggcgtctcacagaatccttgcaccatcaaacctctaggtgctgctctctccttccaccagttttttgagggctttgcattgggcggctgcatttccgaggctcagttcaagagtttctctgcactccttatggctttcttcttcgctatcacaacacctgctgggattaccgtggggtctggtatcgcgtcgttctacaatcccaacagccctagggcacttgtggtagagggaattctggattccatttcggctggtattctgatctacatggccttggtggacctcatcgcagctgattttctcagcaagaggatgagctgtaacttgaggcttcaagtcggctcatacattgccttgttccttggtgccatggccatggcatctctagccatctgggcttagcaagtagaatggaagtaaggcaaagatttgagagtgctgcctaattgcctttgatagcaggaggttctctccagcagctagttggttgcaattcttgatgagaatgggaggcattttttattttcttatattcttctgtttgtctattggttctcttcatgttggtggtggacagtaagatttagttcttgtgccctgtttggtagagctgttgttgttggaaaagtaacttatctaagaagctagtgaaaaaaacttttgtttaaaaaaaaaaaaaaaaa

SEQ ID NO: 4894 - protein, 1713 aa, Zea mays
  misc_feature: PFam Name: Zip; PFam Description: ZIP Zinc transporter
  misc_feature: GI Number: 53793317; NR Description: putative ZIP-like zinc transporter [Oryza sativa (japonica cultivar-group)] >gi|53793274|dbj|BAD54497.1| putative ZIP-like zinc transporter
  misc_feature: GI Number: 60592737; NR Description: ZIP family metal
  misc_feature: GI Number: 37090139; NR Description: Zinc transporter 4, chloroplast precursor (ZRT/IRT-like protein 4) >gi|25347103|pir||F86243 ZIP4, probable zinc transporter, 61460-62785 [imported] - Arabidopsis thaliana
  misc_feature: GI Number: 30682009; NR Description: metal transporter,
  misc_feature: GI Number: 42493205; NR Description: Zn and Cd transporter
AGTGGCGCGGCCCTAATTTCGCCGCGTGTGCTCTGCACCGTCGCGCTTTCCTGGGCCACATTGCTTATCTTCTCGCTGCTATTATTCCTTTCCCTTCCAAATTTGGGTCGTGTTAATTCCTCCGTTGTCGTTAGTTTCCCCTCCATTTACGCCGCTGAATTGCGAGGCGGAATCGCAGTTTTTTTTGATAATTCAGTTGTTGCGTTGCTATGAATCGTAGGAGATGATGGAATCGTCGTACATCCGCACGTACCTGCAGCAGATGGCAGCGTCGGTCTCCACGGCGAGCTGCGACCCGTCTAGCGGCGCCGATGAGGTGGAGTGCCGCGACGAGGCGGCGGCGCTGAGGCTTATGATGGTGTTCGTCGTGGCCATACTCGTCGCAGGCGCGACCGGCGTCGCGATCCCGCTCGTCGGCCGCCGCTGCCACGGGCATGGAGCCTCCTCCTCCTCCTCCACCGGTGGGGCGTTCGTGCTCGTAAAGGCGTTCGCGGCCGGGGTGATCCTGGCCACGGGCTTCGTCCACATGCTGCACGACGCGGACGAGGCGCTCACGGACCCTTGTCTCCCCGCCGCGCCGTGGCGCCGCTTCCCGTTCCCAGGGTTCGTCGCCATGCTCGCGGCGCTCGGGACGCTCGTCTTCGACTTCGTCGGCACGCATATGTACGAGCGCAAGAAGCACCACGCCGATGCGGAGGAAGCCGCCGTCGTCGTTGGCAATGCCAGTGCCAGTGCCAATGCGAGCGGCCACGACGTGATCGTTGCGCTGCTACAGGACGGCGCGCTCGTGGCGAGCACTGGCAGCAGCATTGGGAGAGACGGGGGAGGCCACAAGGACCCCATGCACATCGTGGGGATGCACGCGCATGCCGCAGCACATAGGCATAGCCACGCCCACGGGCACGGCCCATGTGATGACTGTCACGATGGGCATGATGAGGAGCCGTCCCAAGCTCGTCATGTGGTCGTCTCCCAGATTCTTGAGCTTGGGATTGTATCGCACTCAGTGATCATCGGGCTATCTTTGGGCGTCTCACAGAATCCTTGCACCATCAAACCTCTAGGTGCTGCTCTCTCCTTCCACCAGTTTTTTGAGGGCTTTGCATTGGGCGGCTGCATTTCCGAGGCTCAGTTCAAGAGTTTCTCTGCACTCCTTATGGCTTTCTTCTTCGCTATCACAACACCTGCTGGGATTACCGTGGGGTCTGGTATCGCGTCGTTCTACAATCCCAACAGCCCTAGGGCACTTGTGGTAGAGGGAATTCTGGATTCCATTTCGGCTGGTATTCTGATCTACATGGCCTTGGTGGACCTCATCGCAGCTGATTTTCTCAGCAAGAGGATGAGCTGTAACTTGAGGCTTCAAGTCGGCTCATACATTGCCTTGTTCCTTGGTGCCATGGCCATGGCATCTCTAGCCATCTGGGCTTAGCAAGTAGAATGGAAGTAAGGCAAAGATTTGAGAGTGCTGCCTAATTGCCTTTGATAGCAGGAGGTTCTCTCCAGCAGCTAGTTGGTTGCAATTCTTGATGAGAATGGGAGGCATTTTTTATTTTCTTATATTCTTCTGTTTGTCTATTGGTTCTCTTCATGTTGGTGGTGGACAGTAAGATTTAGTTCTTGTGCCCTGTTTGGTAGAGCTGTTGTTGTTGGAAAAGTAACTTATCTAAGAAGCTAGTGAAAAAAACTTTTGTTTAAAAAAAAAAAAAAAAA

SEQ ID NO: 4895 - DNA, 1623 bp, Zea mays
  misc_feature (1)..(1623): Ceres cDNA ID no. 21996071
  misc_feature (1)..(1623): Ceres CLONE  ID no. 1562821
  misc_feature (1)..(1623): Also known as  Ceres CDNA ID no. 24386419
aacaacagccacccgcgaccccaagtcccgatcggccgccgatcccgatcccgaatccctccctggctccacagcacccctgctccacacacacggccgccagcaagccgccggccctaggccctaccgtcgcagcgtcgtctgcttgactatctgcctccagccctccagcaagacttcagtcgcctgccccagcctggctgccgccgccctccagcaaggcagcaaacgccggcctccggccgcccgtccctaggccagaggccacccctaggccgctaggcttccaccgccgacgcccacagaaaccgtaggcgccaccgggccaccacgagatccctgccgtgacggagaatggaggccgccgcggccgtcctccccacgctggtgccctccgggagcgcggtggtggtgctcctcgcctacctcgggtatctcgccgccgctggagccatcctcccagggaagctcgtcgacggagccctactcccggactcctctcgcctccactatcgctgcaacggtttgctctcgctcctgctgctgctgggactctcggcgttcggtgtctacatggggtggatgtctcccacggttgtagctgacatgggactcgaacttctgtcggtgacctttatttttagtgtcattgtctcttttgcactctacattgccggcatcaagtccggccacaaaagttcttctttgagaccacatgttagtgggagcttcatgcaagattggtggtttggagtgcaacttaatcctcattttatggaagttgacctcaaattcttctttgtgagggcaggaatgatggcatggttatttattaacctctctttgtttgcaaagagctactttgctggttcagccaatctttcggtcattctctaccaatttttttgtgcgtggtatatcattgattacttcgtccatgaagaattcatgacctcaacgtgggacattattgctgaaagactgggtttcatgctggtgtttggtgatctagttttcatccctttcaccttcactattcaggggtggtggcttttgaagaacaaagtagagctgtcccttttgtctggtctagctaacttatgcatctttcttattggctacctagtgttccgaggagctaacaagcaaaaacatgtgttcaagaaggaccccaaagctcctatatggggaaaacctcccaaagttgtcgggggaaagctactagcatctggttactggggcatcgcaaggcactgcaattatctcggagacctgctgctagcactttcgttcagcttgccctgtggagtgagttccgtggtcccatacttctaccccacgtacctgctcattctactggtcttgagggaaaggcgcgatgaggcgaggtgctcgcagaagtacagggagatctgggcagagtactgcaagctcgtgccgtggaggatcctgccttatgtgtactgaagagacggtagaaaccaaggcagctcatggccctgggccagctgtaaaccttattttgtttgcccttaaccagttggtgaatgttgatgtagcactcggtaaactgtgaccgtgcaaacttttgttattgttggtccataaaaaaaaaaaaaaaaa

SEQ ID NO: 4896 - protein, 370 aa, Zea mays
  misc_feature: PFam Name: ERG4_ERG24; PFam Description: Ergosterol
  misc_feature: PFam Name: FH2; PFam Description: Formin Homology 2 Domain
  misc_feature: PFam Name: Drf_FH1; PFam Description: Formin Homology Region 1
  misc_feature: PFam Name: Pyr_redox_2; PFam Description: Pyridine
  misc_feature: PFam Name: Extensin_2; PFam Description: Extensin-like region
  misc_feature: GI Number: 22137270; NR Description: AT3g52940/F8J2_111 [Arabidopsis thaliana] >gi|17473516|gb|AAL38381.1| AT3g52940/F8J2_111 [Arabidopsis thaliana] >gi|18409727|ref|NP_566975.1| C-14 sterol reductase /
  misc_feature: GI Number: 52076142; NR Description: putative C-14 sterol
  misc_feature: GI Number: 9714052; NR Description: sterol C-14 reductase (FACKEL) [Arabidopsis thaliana] >gi|8917585|gb|AAF81279.1| C-14
  misc_feature: GI Number: 42572649; NR Description: C-14 sterol reductase /
  misc_feature: GI Number: 11358585; NR Description: nuclear envelope
MEAAAAVLPTLVPSGSAVVVLLAYLGYLAAAGAILPGKLVDGALLPDSSRLHYRCNGLLSLLLLLGLSAFGVYMGWMSPTVVADMGLELLSVTFIFSVIVSFALYIAGIKSGHKSSSLRPHVSGSFMQDWWFGVQLNPHFMEVDLKFFFVRAGMMAWLFINLSLFAKSYFAGSANLSVILYQFFCAWYIIDYFVHEEFMTSTWDIIAERLGFMLVFGDLVFIPFTFTIQGWWLLKNKVELSLLSGLANLCIFLIGYLVFRGANKQKHVFKKDPKAPIWGKPPKVVGGKLLASGYWGIARHCNYLGDLLLALSFSLPCGVSSVVPYFYPTYLLILLVLRERRDEARCSQKYREIWAEYCKLVPWRILPYVY

SEQ ID NO: 4897 - DNA, 1007 bp, Zea mays
  misc_feature (1)..(1007): Ceres cDNA ID no. 21996072
  misc_feature (1)..(1007): Ceres CLONE  ID no. 1563123
  misc_feature (1)..(1007): Also known as  Ceres CDNA ID no. 24391347
agacttgtccaccatatcctctccagctttccgctccgcccttgtcgctcgtccagccaccgtgcccgtgcccgtgccgccgagaattctatccagaagcaagcaacaagagcccacccccgcttcgcgcgctctttcgtgccaggcaaacacagagcacagctatctgctcgtgtcccggtccgtccaactcgctcgctcgctcaatccactgatgatggggatcccgctggtgtgctactgcctcgccgtgcccaagccggtcatcgccttctgcaggctgctcagcgccgtcagggacgccgccctgctgatgctggccgtggtggggctgtgccgcttcccgcccgacggcgcggtggacgccggccaccagcccggcgaggtgaaggcccggctccccgccgtggagtacggccagctcctggccgagcacgacgagcagcagcagtccggcgaccacgactgcgacggggacgccgcgtcgtcggattgcatcgtgtgcctcgagacgctggaggcggcggacgaggtgcggcggctgggcaactgcgcgcacgccttccaccgcgcctgcatcgaccgctggatcgacctcggccgcgcgacctgcccgctctgccgctccgacctcctgccgcgcgcgccgggctgggccagccggctcggcctgggccggctcacgcgcgttcggtgaggaggaccgtcttccagggcagttttgtctattggatgatggggcgcggacaggttagcgacggcgatcgcccgggtggtataacaacagctgctctgcctgccatcagccaaccgctaatctacggggggcttcattagtacgtaaaaggcgcctcacacttggtatacgtaaaagatatactagttattaatacgttaaaggattgagtatacggcacctagatgtttcatttgtacacgattttcattctcttctcgaccatatattaatagtaattaaattagttcgttaaaaaaaaaaaaaaaaa

SEQ ID NO: 4898 - protein, 1007 aa, Zea mays
  misc_feature: PFam Name: zf-C3HC4; PFam Description: Zinc finger, C3HC4
  misc_feature: GI Number: 66778264; NR Description: LigA [Anaeromyxobacter dehalogenans 2CP-C] >gi|66856061|ref|ZP_00400131.1| LigA
  misc_feature: GI Number: 50253143; NR Description: putative BRH1 RING
  misc_feature: GI Number: 53792029; NR Description: EL5-like [Oryza sativa
  misc_feature: GI Number: 50947165; NR Description: zinc finger protein family-like [Oryza sativa (japonica cultivar-group)] >gi|42408776|dbj|BAD10011.1| zinc finger protein family-like [Oryza
  misc_feature: GI Number: 4689366; NR Description: BRH1 RING finger protein [Arabidopsis thaliana] >gi|21554590|gb|AAM63625.1| RING finger protein [Arabidopsis thaliana] >gi|21436189|gb|AAM51382.1| putative RING finger protein [Arabidopsis thaliana]
AGACTTGTCCACCATATCCTCTCCAGCTTTCCGCTCCGCCCTTGTCGCTCGTCCAGCCACCGTGCCCGTGCCCGTGCCGCCGAGAATTCTATCCAGAAGCAAGCAACAAGAGCCCACCCCCGCTTCGCGCGCTCTTTCGTGCCAGGCAAACACAGAGCACAGCTATCTGCTCGTGTCCCGGTCCGTCCAACTCGCTCGCTCGCTCAATCCACTGATGATGGGGATCCCGCTGGTGTGCTACTGCCTCGCCGTGCCCAAGCCGGTCATCGCCTTCTGCAGGCTGCTCAGCGCCGTCAGGGACGCCGCCCTGCTGATGCTGGCCGTGGTGGGGCTGTGCCGCTTCCCGCCCGACGGCGCGGTGGACGCCGGCCACCAGCCCGGCGAGGTGAAGGCCCGGCTCCCCGCCGTGGAGTACGGCCAGCTCCTGGCCGAGCACGACGAGCAGCAGCAGTCCGGCGACCACGACTGCGACGGGGACGCCGCGTCGTCGGATTGCATCGTGTGCCTCGAGACGCTGGAGGCGGCGGACGAGGTGCGGCGGCTGGGCAACTGCGCGCACGCCTTCCACCGCGCCTGCATCGACCGCTGGATCGACCTCGGCCGCGCGACCTGCCCGCTCTGCCGCTCCGACCTCCTGCCGCGCGCGCCGGGCTGGGCCAGCCGGCTCGGCCTGGGCCGGCTCACGCGCGTTCGGTGAGGAGGACCGTCTTCCAGGGCAGTTTTGTCTATTGGATGATGGGGCGCGGACAGGTTAGCGACGGCGATCGCCCGGGTGGTATAACAACAGCTGCTCTGCCTGCCATCAGCCAACCGCTAATCTACGGGGGGCTTCATTAGTACGTAAAAGGCGCCTCACACTTGGTATACGTAAAAGATATACTAGTTATTAATACGTTAAAGGATTGAGTATACGGCACCTAGATGTTTCATTTGTACACGATTTTCATTCTCTTCTCGACCATATATTAATAGTAATTAAATTAGTTCGTTAAAAAAAAAAAAAAAAA

SEQ ID NO: 4899 - DNA, 1363 bp, Zea mays
  misc_feature (1)..(1363): Ceres cDNA ID no. 21996073
  misc_feature (1)..(1363): Ceres CLONE  ID no. 1564668
  misc_feature (1)..(1363): Also known as  Ceres CDNA ID no. 24386973
agcgaatgaaccacaccacacggctcactggctcaggtcggccacaccagaaaagcatgcgaactgaaatggcgccatgttcgcctctcctcctggccgtggcgctcctatgcgccgccgccgccgccgccgcggcaggcggattcggtggccccacggcgcggtacgatcgcgtattcagctttggcgactcgctcactgacaccgggaacgcgctgcacctcgcagcaaccgccggcgggcccgcgagccggccaccgtacggcgagaccttcttccgtcgcgccaccggccgcgcgtccgacggccgcctcgtcatcgacttcatcgtcgaggcgctggccgtgccgcagccgacgccgtacctcgctggcgcgacggcgacgggggcggatttccgccgcggcgtgaacttcgcgttcggcggggccacagcgctcgacctgcacttcttcgtgagcaggggactggggtcgttcgtgccggtttcgcttaggaaccagaccgtctggttccacaatgttctacgacttcttggctcagctcgcgagcagaggaagaccatggccacctccctcttcctcgtcggagagatcggagtcaacgactacttcatcggcctcaacgagaaccgcaccgtgggcgaggtgcggaccttcgtgccccacgtcgtcggtgccatccgttcggtcatcactgacgtgatctccgccggagcaggcacggtggtggtgccggggatgataccgctgggctgcgagccgcagctgctcacgctctacagaggcagcgtcgacgccgccgggtatgacccggagtccggctgcatcacgcgtctcaacgacctcgcccagctgcacaaccgcgagctgcgccgcatgctcgccggcctccgacgagcccaccccggcacggccatcgtatacgccgacctctaccgagcagtcaccgacatcgtcgtgtcgccccgcgcatacggtttcaggcacatgccgctggacgcgtgctgcggcggcggcggcgcatacaactacgacgacgcatcgttctgcggcgcggcggggacggcgccgtgcgcagacccgtcggagtatgtctcctgggacggggtgcactacacggaggccgccaacaggctcatcgcttgcagcgtgctcgagggatctcactctcacgccgccgacgcgcccacgctgtcgaattcatcggccacaacggaggattggcttcacaggatcggctgcgtctagcagctagcattttgtgtctagagtctagactggacgaccagagtcgagagacatttcagtcgggccacggccatattttagttctttatttaaaagaaaaaaaaaaaaaaaaa

SEQ ID NO: 4900 - protein, 1363 aa, Zea mays
  misc_feature: PFam Name: Lipase_GDSL; PFam Description: GDSL-like
  misc_feature: GI Number: 50939553; NR Description: lipase-like protein [Oryza sativa (japonica cultivar-group)] >gi|23237906|dbj|BAC16480.1| lipase-like protein [Oryza sativa (japonica cultivar-group)] >gi|50509928|dbj|BAD30249.1| lipase-like
  misc_feature: GI Number: 15451642; NR Description: Putative lipase [Oryza sativa]
  misc_feature: GI Number: 54290849; NR Description: lanatoside 15'-O-acetylesterase-like [Oryza sativa (japonica cultivar-group)] gi|54290275|dbj|BAD61220.1| lanatoside 15'-O-acetylesterase-like
  misc_feature: GI Number: 34911800; NR Description: lipase-like protein [Oryza sativa (japonica cultivar-group)] >gi|20146410|dbj|BAB89190.1| lipase-like protein [Oryza sativa
  misc_feature: GI Number: 10764858; NR Description: F1K23.17 [Arabidopsis
AGCGAATGAACCACACCACACGGCTCACTGGCTCAGGTCGGCCACACCAGAAAAGCATGCGAACTGAAATGGCGCCATGTTCGCCTCTCCTCCTGGCCGTGGCGCTCCTATGCGCCGCCGCCGCCGCCGCCGCGGCAGGCGGATTCGGTGGCCCCACGGCGCGGTACGATCGCGTATTCAGCTTTGGCGACTCGCTCACTGACACCGGGAACGCGCTGCACCTCGCAGCAACCGCCGGCGGGCCCGCGAGCCGGCCACCGTACGGCGAGACCTTCTTCCGTCGCGCCACCGGCCGCGCGTCCGACGGCCGCCTCGTCATCGACTTCATCGTCGAGGCGCTGGCCGTGCCGCAGCCGACGCCGTACCTCGCTGGCGCGACGGCGACGGGGGCGGATTTCCGCCGCGGCGTGAACTTCGCGTTCGGCGGGGCCACAGCGCTCGACCTGCACTTCTTCGTGAGCAGGGGACTGGGGTCGTTCGTGCCGGTTTCGCTTAGGAACCAGACCGTCTGGTTCCACAATGTTCTACGACTTCTTGGCTCAGCTCGCGAGCAGAGGAAGACCATGGCCACCTCCCTCTTCCTCGTCGGAGAGATCGGAGTCAACGACTACTTCATCGGCCTCAACGAGAACCGCACCGTGGGCGAGGTGCGGACCTTCGTGCCCCACGTCGTCGGTGCCATCCGTTCGGTCATCACTGACGTGATCTCCGCCGGAGCAGGCACGGTGGTGGTGCCGGGGATGATACCGCTGGGCTGCGAGCCGCAGCTGCTCACGCTCTACAGAGGCAGCGTCGACGCCGCCGGGTATGACCCGGAGTCCGGCTGCATCACGCGTCTCAACGACCTCGCCCAGCTGCACAACCGCGAGCTGCGCCGCATGCTCGCCGGCCTCCGACGAGCCCACCCCGGCACGGCCATCGTATACGCCGACCTCTACCGAGCAGTCACCGACATCGTCGTGTCGCCCCGCGCATACGGTTTCAGGCACATGCCGCTGGACGCGTGCTGCGGCGGCGGCGGCGCATACAACTACGACGACGCATCGTTCTGCGGCGCGGCGGGGACGGCGCCGTGCGCAGACCCGTCGGAGTATGTCTCCTGGGACGGGGTGCACTACACGGAGGCCGCCAACAGGCTCATCGCTTGCAGCGTGCTCGAGGGATCTCACTCTCACGCCGCCGACGCGCCCACGCTGTCGAATTCATCGGCCACAACGGAGGATTGGCTTCACAGGATCGGCTGCGTCTAGCAGCTAGCATTTTGTGTCTAGAGTCTAGACTGGACGACCAGAGTCGAGAGACATTTCAGTCGGGCCACGGCCATATTTTAGTTCTTTATTTAAAAGAAAAAAAAAAAAAAAAA

SEQ ID NO: 4901 - DNA, 1255 bp, Zea mays
  misc_feature (1)..(1255): Ceres cDNA ID no. 21996074
  misc_feature (1)..(1255): Ceres CLONE  ID no. 1565807
  misc_feature (1)..(1255): Also known as  Ceres CDNA ID no. 24386852
aaccagggaaaaaaagttaagagataaacggatagaacaggcgtggagcgcgcgaccccgtgcgtctccaccgctgcacgaactccctcccccctccccggcggcccgcgcgcccaccaaccatggcagtcgcagccgccgcccaccacctgcccgttgtgccgcaccgccttgtcccggtccggcacaccagtagcagcccgccgccgcatccgaccgcccgctgctccgccgcggggaagccgcccgtccagctccacgcggcgcaagcgagggcgtctgggttcgccgcgcgcgtcgcgttcaacccttccgggaactacgacctgtccctctccatgggcgaagacgagaccccgcaggtccagcctccgccgccgcctacccaagggcgcttcgaaatcgttatcaacaacgacaacatccgaacgctcgacctatcgccagtcgaagcagcactcggcgacttgagctccttgacaccagctgcttcaagaaccctgctggaccagaccgtcgggttcaccatcagctacgagagggaggacgagtacgacacgcgggagctgtcggagttccccgacatacggctgtggttcgtgaggctcgacgccgcgtacccttggttcccggtcgtgctcgactggagagccggcgagcttgccagatacgccgcgatgctcgtccctcaccagatgagcatgcggatgggcgtcgtcttcaacccggaggcgctggagctgttcgtgatgaagaaggtgttcgccgtcgacgcttggctgaagcagcagagccatcccaagccgaggctgaagacggcggacatggcaaggatgctcggcttcggcgtcggagacgagctgttcgatctgatcgagaagtaccctgcccatcgttcgtgataaaaaaaataaacaacaaagctgagaatagggatccgatcccacacacagaagaatcagtcgtctggtcggtgctgctgcgcctgctgctcataccatacccacacccttgaagtatacacacagtagaaactaattaaggcacgtttgctttgctccaggagaccaggagcgctctgatgttgtcgtgttcctcgcggcatggccttctcggcctgttgtactcagtagcgccgcagagtctctctagcatgagacgacctcgaggagtctatgttgtcgtctatggatggaacagtcagcatagaccaaggccgtgacctttcctccggtgctaaaaaaaaaaaaaaaaa

SEQ ID NO: 4902 - protein, 259 aa, Zea mays
  misc_feature: GI Number: 51964720; NR Description: PREDICTED P0462E11.7 gene product [Oryza sativa (japonica cultivar-group)] >gi|50941465|ref|XP_480260.1| putative ubiquinone oxidoreductase subunit 1 [Oryza sativa (japonica cultivar-group)] subunit 1
  misc_feature: GI Number: 45508016; NR Description: COG5474: Uncharacterized
  misc_feature: GI Number: 23129308; NR Description: COG5474: Uncharacterized
  misc_feature: GI Number: 48890943; NR Description: COG5474: Uncharacterized
  misc_feature: GI Number: 45527013; NR Description: COG5474: Uncharacterized
MAVAAAAHHLPVVPHRLVPVRHTSSSPPPHPTARCSAAGKPPVQLHAAQARASGFAARVAFNPSGNYDLSLSMGEDETPQVQPPPPPTQGRFEIVINNDNIRTLDLSPVEAALGDLSSLTPAASRTLLDQTVGFTISYEREDEYDTRELSEFPDIRLWFVRLDAAYPWFPVVLDWRAGELARYAAMLVPHQMSMRMGVVFNPEALELFVMKKVFAVDAWLKQQSHPKPRLKTADMARMLGFGVGDELFDLIEKYPAHRS

SEQ ID NO: 4903 - DNA, 2194 bp, Zea mays
  misc_feature (1)..(2194): Ceres cDNA ID no. 21996075
  misc_feature (1)..(2194): Ceres CLONE  ID no. 1567510
  misc_feature (1)..(2194): Also known as  Ceres CDNA ID no. 25401130
attctgctccccttcgcctcccttcccttcctcgacttcacctcaccaccatctccagctccatccgcacgcagccgtccaccaaccgacgcagcgaggagatgaacgcgtcgcagttcatggacaagcagatcctcggcctggctgcctccgcctccccctccggcggcggcgcggggggcggtgggggtgtggatctcagcgatctgatgataccgatcccccaggacgacggcgagaaccgcctcggtcgccggcgtagcagcaccagcgtcaacggaaccgcaggcgacatgctacccagttatgacttccagcccatccgcactagtgacggcgccgtggccgccgccgcgcctcaggcctcgtgggggtcgctcgactccaaggcaccctccgcctcttacaacctcaagagtgctggtatattggagccgcatgtgctgaagaaagttagtcatgaggaagacaagagtaactttcctacagttactattgcggatattgatcgaaccatgaagaagtactctgataaccttttgcatgcactggaaggtgtaagctcaaggctttcacagatggagggtagaacacaccaactcgaaaactgtgttgatgagttgaagttaacaatcggtaactataatggtagcactgatggaaaactgaggaaccttgagaacatgctcagggaggtccaagcaggtgtgcagattttgcgagacaagcaggaaattgtcgagacacagctccaccttgcgaagctccagacaaacaaaaccgatggccaatcatcagaaaatagtgggtctggacaggctgacttacagcagcagccggtggttcctccacaagcagccattcagccacaacaagtcctaaccccttcgcaaccacctgcacttcctgcccttcctgctccaaatgcaccacctccacctccaacgcttcaaaaccaatcatcattacagtttccaagtcatttacaacattcacaggtaccatctgtgccttctgttgcactggcacccacagttccagctttaccaagggatgcttactatgccccatctgctcagccgactgagaccatgcaccagcagtatcaagctccgccagttccacagccacaggcacctcctgcaccacctcagcagtaccaatcccaaacccagttccctcaatatgcacagccacctcagcctgcaaatgttaacccttcaactccccatgtgccccatgcaccccagcaaccagaggaaactatgccttatgcaccagcacagagctatccacctaatgcaatcccaccaccttatatgcaaccacctagtggacctgctcctctttactatgggcagcaaaaccctagcatgtatgaacctcctgcaggccgggctaaccctgggccaccatcatcctacggttctgctgggtacgggccacagggtggaggtagtttctctgaatcttatggctatactggatctccttcccaccgtggcaatgctggaatgaagcagtcttcaccttttgctcaatcctctggaggaagcggcagctatggcagtggcaagctccccactgcccagatgcttccacaagcagtgccgatcagctcctccagcaccagcggttcttctggcaatagagtgccacttgacgatgtagtggagaaggttgctacgatgggattctcaagagagcaggtgagagcaaccgtgcggaggctgactgaaaacgggcagaacgtggacctgaatgtggtgctcgacaagctgatgaacggatgataagttgagcaatactgtcatttcacagtcccgcacagtactatggaaacttggaaagtgtcagctcatcagctgaaacgatttttctgtctgcaacgttgcatacctgattgtgcctggagaacaataatggccgaacagccgctcatcctgattgccggtcacggttgcttcatctggaatggaaacagctcagtgtgccttcagtgaattacagtatcacaatctgaatacgttgtccattttatgtatatgtggcgatgagacattctaaaacatatactgtggtttcttgtgatatgttaataagcagctttactctgtttttaggcagtgtttcagcttgctggaaagtgctttcgctacataaaagcggaacatcaatcaaaaaaaaaaaaaaa

SEQ ID NO: 4904 - protein, 563 aa, Zea mays
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: GATase_2; PFam Description: Glutamine
  misc_feature: PFam Name: LMBR1; PFam Description: LMBR1-like membrane protein
  misc_feature: GI Number: 34896194; NR Description: OJ1276_B06.30 [Oryza
  misc_feature: GI Number: 50933045; NR Description: putative proline-rich protein [Oryza sativa (japonica cultivar-group)] gi|53982471|gb|AAV25450.1| putative proline-rich protein [Oryza
  misc_feature: GI Number: 55770555; NR Description: vegetative cell wall protein gp1 -like [Oryza sativa (japonica cultivar-group)] gi|55297517|dbj|BAD68319.1| vegetative cell wall protein gp1 -like
  misc_feature: GI Number: 42567849; NR Description: proline-rich family
  misc_feature: GI Number: 30678370; NR Description: proline-rich family
MNASQFMDKQILGLAASASPSGGGAGGGGGVDLSDLMIPIPQDDGENRLGRRRSSTSVNGTAGDMLPSYDFQPIRTSDGAVAAAAPQASWGSLDSKAPSASYNLKSAGILEPHVLKKVSHEEDKSNFPTVTIADIDRTMKKYSDNLLHALEGVSSRLSQMEGRTHQLENCVDELKLTIGNYNGSTDGKLRNLENMLREVQAGVQILRDKQEIVETQLHLAKLQTNKTDGQSSENSGSGQADLQQQPVVPPQAAIQPQQVLTPSQPPALPALPAPNAPPPPPTLQNQSSLQFPSHLQHSQVPSVPSVALAPTVPALPRDAYYAPSAQPTETMHQQYQAPPVPQPQAPPAPPQQYQSQTQFPQYAQPPQPANVNPSTPHVPHAPQQPEETMPYAPAQSYPPNAIPPPYMQPPSGPAPLYYGQQNPSMYEPPAGRANPGPPSSYGSAGYGPQGGGSFSESYGYTGSPSHRGNAGMKQSSPFAQSSGGSGSYGSGKLPTAQMLPQAVPISSSSTSGSSGNRVPLDDVVEKVATMGFSREQVRATVRRLTENGQNVDLNVVLDKLMNG

SEQ ID NO: 4905 - DNA, 2145 bp, Zea mays
  misc_feature (1)..(2145): Ceres cDNA ID no. 21996076
  misc_feature (1)..(2145): Ceres CLONE  ID no. 1571336
  misc_feature (1)..(2145): Also known as  Ceres CDNA ID no. 24391902
agccgcgtgcctgccattctcctcccgagccttcttccttcacgcctctttgccgcagcgcgggtgggtcgtcgtttgctgtttgttccgagatcaccggagccagccagccagccacagccagccagagtcagagatgaggtggtcggcgttcctgtgggaggccacgtccggccgccgcccgggggtttccaacctcctcctcgtcgtcgcagccgccagtagcggaggtctcgtcgcgtacgccgactccggatcagatgctgctgtccagcagccgcagcttcctccgaggaagaaggtcgtggtgcttgggactggttggggcggcacgacgttcctgaggaacctcgatagccgactgtatgatgtgcaggttatatctcctcggaactacttcgcgttcacgccgctgctcccgagtgtcacttctggaacagttgagcctaggagcattgtggagccaatccgtagggttttggagaagaaaggtggagaaatcaaattttgggaagcagagtgtttcaagattgatccacaaagcaagaaaatccattgtcgctcgaatgttgggacaaaccttgaggggaatggcgagttcttggttgactatgactatctcgtggtagcagttggggctaggacaaatacattcaatactcctggtgtggtagagaattgccacttcttgaaggaagtagaggatgctcaaaagatcagacggagtgtgatggactgctttgagagagcaagcctcccctttcttaatgaagaagagaggaagaagaatcttcattttgttgttgtgggtggtggacctactggagtggaatttgcagcatctttgcatgattttgttaccgaagatttatccaagctttacccttcgattcagcaccttgtcaagatatcgttgattgaagctgcagatcatatactgaccatgtttgacaagaggataacaaattttgctgaggataagtttggaagggatggtattgatgtgaaaactggatataaagttgtgaaggtttctaaggatgatattaccatgcaaaatcctgccaccggggatatttcagtcccttatgggatggctgtctggtcgactggtattggaactcgtccattcgttgtggaatttatgaaacaaattggccaggccaatcgccgtgtcttggctactgatgaatggctaagggtccgtgaatgtgatggtgtctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggtacccgcaagtacagctctaccttaagagcaagcagatgaacggcatcgctgatctagtgaggagcgccaaaggagacgctgagaaggaatccgtggaactgaacatcgaggaattcaagaaggctctttcgctcgtggattcacaagtcaaattcttacctgcgaccgctcaggtcgcatcgcagcagggccaatatcttgctaggtgctttaacaagatgaaggatgctgaagaaaaccctgaaggcccaatccgcatcaggggagaaggccgccatcgcttccgccccttcaggtaccggcatctgggccaattcgccccactaggaggggagcaaactgctgcacagcttcccggggactggatctccattggccacagctcccagtggctctggtactccgtgtacgcaaccaaacaaatcagctggcgcacgaggatgctggtggtatcagactggacacgccgattcatcttcggaagagactcgagttgcatatgatcaagagggaaaagattttgctgtgacatatattcagatgaacggggccagtacagcctcttcccactttttttagtccgatttcacataaatgttccccttttgttgttagggaagaatctgacttcccctgcactttgtatagtgcaccacgaagaaattcctttgtacctaccttttctttttgagagagttgcactgcacttttgcggtctgagtaagctcagaattcttttaatagctattttttctaccactaaaaaaaaaaaaaaaaa

SEQ ID NO: 4906 - protein, 577 aa, Zea mays
  misc_feature: PFam Name: Pyr_redox; PFam Description: Pyridine
  misc_feature: PFam Name: Pyr_redox_2; PFam Description: Pyridine
  misc_feature: PFam Name: efhand; PFam Description: EF hand
  misc_feature: GI Number: 7267261; NR Description: AT4g05020 [Arabidopsis thaliana] >gi|5732076|gb|AAD48975.1| contains similarity to Pfam family PF00070 - Pyridine nucleotide-disulphide oxidoreductase class-I; score=26.1, E=0.0008, protein AT4g05020 [imported] -
  misc_feature: GI Number: 3080393; NR Description: NADH dehydrogenase like protein [Arabidopsis thaliana] >gi|7268946|emb|CAB81256.1| NADH dehydrogenase like protein [Arabidopsis thaliana]
  misc_feature: GI Number: 18417151; NR Description: NADH
  misc_feature: GI Number: 5734587; NR Description: external
  misc_feature: GI Number: 21554177; NR Description: putative NADH
MRWSAFLWEATSGRRPGVSNLLLVVAAASSGGLVAYADSGSDAAVQQPQLPPRKKVVVLGTGWGGTTFLRNLDSRLYDVQVISPRNYFAFTPLLPSVTSGTVEPRSIVEPIRRVLEKKGGEIKFWEAECFKIDPQSKKIHCRSNVGTNLEGNGEFLVDYDYLVVAVGARTNTFNTPGVVENCHFLKEVEDAQKIRRSVMDCFERASLPFLNEEERKKNLHFVVVGGGPTGVEFAASLHDFVTEDLSKLYPSIQHLVKISLIEAADHILTMFDKRITNFAEDKFGRDGIDVKTGYKVVKVSKDDITMQNPATGDISVPYGMAVWSTGIGTRPFVVEFMKQIGQANRRVLATDEWLRVRECDGVYAIGDCATINQRKVMEDISEIFRVADKDKSGTLTVKEIQDILDDIYVRYPQVQLYLKSKQMNGIADLVRSAKGDAEKESVELNIEEFKKALSLVDSQVKFLPATAQVASQQGQYLARCFNKMKDAEENPEGPIRIRGEGRHRFRPFRYRHLGQFAPLGGEQTAAQLPGDWISIGHSSQWLWYSVYATKQISWRTRMLVVSDWTRRFIFGRDSSCI

SEQ ID NO: 4907 - DNA, 1941 bp, Zea mays
  misc_feature (1)..(1941): Ceres cDNA ID no. 21996077
  misc_feature (1)..(1941): Ceres CLONE  ID no. 1584283
  misc_feature (1)..(1941): Also known as  Ceres CDNA ID no. 24391237
agttcccaatcctcacactgattgtggccttccagttcttgtggtctctcaaccagcatctgatacccaattcctcgcacaaacctgccacacgcaatgtccaagaccgagagcaggaagctgtcggacgactatgaggtcgcggaggtcctcggccgaggcggattctcgatcgtgaggcggggagtgagcaagtcagaggggaaggcggctcaacaggtcgccataaagaccctgcgaaggctgggcccggccaccacgaccggcgggagcacgctgccgccgcagcaaggctcaaataagggcggcggcctggttccgacgtggaagcaggtgtcgtccatctccgacgcgctgctcaccaacgagatcctcgtgatgcggcggatcgtggaggccgtggcgccgcaccccaacgtcatcgcgctgcacgacgtgtacgaggacgcgcgcggcgtgcacctggtcctggagctctgctcgggcggcgagctgttcgaccggatcgtggggcgcgaccgccactactcggagttcgacgcggcgggcgtcgtccgccagatcgcgcgcgggctgcaggcgctccacggcgcgggcgtcgtgcaccgggacctcaagcccgagaactgcctcttcgccgacaggggcgaggcctccacgctcaagatcatggatttcggcctcagctccgtcgaggacttcagcgaccccgtcgtcaccctgttcggctcgatcgactacgtctcgccggaggccctctcgaggcaggatgtctcggctgccagcgacatgtggtctgttggggtgattctgtatatcctcttgtccggatgcccgccgttccatgcaccaactaatcgagagaagcagcagaggatactgcagggagagttcagtttccaggaccatacatggaagacaatctcttcatcagccaaagaactgatctccagtcttctctctgttgagccttacaagaggccaacagcaagtgacctgctggggcatccttgggtgataggggactgcgcgaagcaggacctcatggacgcggaggtcgtgacgaagctgcagaggttcaacgccagaaggaagctgcgggcggcggcgatcgccagcgtgctcagcagcaaggtggcgctgcggacgaagcggctgcggaacctgctgggacggcatgacctgagctccgaggagctcgacaacctgcgggctcactttgcacggatatgcgccgacggcgagaacgcgacgctggcggagttcgagcaggtgctgagggcgatgaggctggaggcgctggtcccgctggcgccgcgcgtgttcgacctgttcgacaacaaccgcgacggcacggtggacatgagggagatcctgtgcgggctgtccagcctccgcaactcccgcggcgacgacgcgctccggctctgcttccagatgtacgacgccgaccgctccgggtgcataagcaaggacgagctggcgtcgatgctgcgagcgctgcccgaggagtgccttccgggcgacatcacggagcccgggaagctggacgaggtgttcgacgagatggacgccaacggcgacggcaaggtgagcttcgaggagttcaaggcggccatgcagaaggacagcgccctccaggacgtcgtcctctcgtccctccggccgccgccgccgccatagctagacggggagagagattccaactcgttcaacttcattcccacgagaacgcaccattgattacagtaccgttcgaatcatttaatcagtctccggcatgtgccgttgtccgatccggccggctagctgttggaaactacgggtcgtgggaaagcctcgatggatcctgctagatatggctgtgctgttatgtgtttctggatcctgctagattagctggctgtgttgttaaaaaaaaaaaaaaaaaaaaaaaaaaaa

SEQ ID NO: 4908 - protein, 528 aa, Zea mays
  misc_feature: PFam Name: Pkinase; PFam Description: Protein kinase domain
  misc_feature: GI Number: 45184321; NR Description: Ca2+ and
  misc_feature: GI Number: 45184325; NR Description: Ca2+ and calmodulin-dependent protein kinase [Pisum sativum] >gi|45184323|gb|AAS55543.1| Ca2+ and calmodulin-dependent protein
  misc_feature: GI Number: 45655431; NR Description: calcium-dependent protein kinase [Medicago truncatula] >gi|45184319|gb|AAS55541.1|
  misc_feature: GI Number: 860676; NR Description: calcium/calmodulin-dependent protein kinase
  misc_feature: GI Number: 5814095; NR Description: calcium/calmodulin-dependent protein kinase [Nicotiana tabacum] >gi|4741991|gb|AAD28791.1| calcium/calmodulin-dependent protein
MSKTESRKLSDDYEVAEVLGRGGFSIVRRGVSKSEGKAAQQVAIKTLRRLGPATTTGGSTLPPQQGSNKGGGLVPTWKQVSSISDALLTNEILVMRRIVEAVAPHPNVIALHDVYEDARGVHLVLELCSGGELFDRIVGRDRHYSEFDAAGVVRQIARGLQALHGAGVVHRDLKPENCLFADRGEASTLKIMDFGLSSVEDFSDPVVTLFGSIDYVSPEALSRQDVSAASDMWSVGVILYILLSGCPPFHAPTNREKQQRILQGEFSFQDHTWKTISSSAKELISSLLSVEPYKRPTASDLLGHPWVIGDCAKQDLMDAEVVTKLQRFNARRKLRAAAIASVLSSKVALRTKRLRNLLGRHDLSSEELDNLRAHFARICADGENATLAEFEQVLRAMRLEALVPLAPRVFDLFDNNRDGTVDMREILCGLSSLRNSRGDDALRLCFQMYDADRSGCISKDELASMLRALPEECLPGDITEPGKLDEVFDEMDANGDGKVSFEEFKAAMQKDSALQDVVLSSLRPPPPP

SEQ ID NO: 4909 - DNA, 1991 bp, Zea mays
  misc_feature (1)..(1991): Ceres cDNA ID no. 21996078
  misc_feature (1)..(1991): Ceres CLONE  ID no. 1584995
  misc_feature (1)..(1991): Also known as  Ceres CDNA ID no. 24391276
aatctgccccatccggccgtccgtcatccaacttcgccccactcttctcggacctccacctgcggcggcggtagaggtcacgtagccctcgtcgctcgtcggagcgtcttggatccttccttgaccctactcatctcagattccggtcagatggaaggcggcgagggatccggattcgatggggcacacatgaagaagcggcggagcagcgcggtgaggcggccgaggccggagggcggccctgccgcggtgcagcgggacaacggctcccctccgccgctgtcggtgacatccaggagcggcccgaggagtctgctgttgacttcggacgagaacgccaccggccccgacgggggcaaccgtaggcgtgagttcctcctgaacgctccgtcgccggagcgcgcgaccaaggggagcatccggctgcgttccgagggcgcagccggtggctccaggaagagcgacggtagcagccatgcccctgaggggaatcgtgagaagctggggaaggtgaagctcaagattcgtaatgtgctaccgaaaccgaaccctgatacgtcgcctgtgaagcccccacggcctgtagattcgcggcaccagcaaaagcatggccatctgaaggaaggcacaaaagattctgacaggccaacctcttcacgagacaagaaagccagaaaggagaggtcgattcaagaaacaatggcacatgagcaagcagacaaatttcagagagaacctacttcagatcctgtacggaagagtaggaggcttgctaagaaatctgtggacaatgaatttgacgaggactttggtacaagcaatcttggaactcctgaagattgggatggtactcgtgagtctaagagcaaaggaagtggctctaagaagagtgcctcaaggaaagggaaaaataggagcaaggtgtatggggctgataacgattttgttacttcccgatctggcaagaaaagatctagagaatcagctgatgatgataatactgaagaagaaccaacctcagacagtgaacctgacgttgaagacactgaacagaaaacaacggcgactgaatcacctgtcaatattagaagtgaacctctcacgacacgtcgccgcgcccttcaatcatggatggatggcagcagcatcagtactgtcgagttccctgatgggctacctccagctccttcgagaagcaagaaggacaagctttctgaagaggaaatgcttgcgaagaaggctgaagctgctcagaggcgcaggatgcaagtggaaaaggccactaaagaaagtgaggcggaagctataaggaaaatattgggcatcgactctgagaagaagaaagaagagaggaagcagaaggagcgaggagagaaggagcgagctagcagagcacaaaacatggcggcaaactcgatccgctgggtcatggggcccaccggaacagttatttcgtttccacacgcagtaggcctccccagcatcttcgactccaagccacacagctatcctcctccacgggagaaatgcgctgggccatcgtgcacgaacgattacaagtacaggcactccaatccccctctggatcggtgtaaccgaacaagccctgatagggctcagggaacataatggtggggactggggagtttgtgctgtctccattggcatgccatctatggctggaaataaggcatgaggatgatgtgcatcgatggtgggagttctaaaggatgcaatgcaataagggtctgcctgcaaatgtatagaaatggatatctatctacatgtagatttgtggggtagagatgtagaagatctttttgctgaacctgtgattagagatgccggatgttattgctatcccacaatacgcatcctgtttttagttcttttcagaaaaaaagatgtttttgttgtatatactgcacgtacgtttatatgtacaataaagagcagaataagtttttttgtaataaaaaaaaaaaaaaaaa

SEQ ID NO: 4910 - protein, 492 aa, Zea mays
  misc_feature: PFam Name: PAPA-1; PFam Description: PAPA-1-like conserved region
  misc_feature: PFam Name: eIF-3c_N; PFam Description: Eukaryotic
  misc_feature: PFam Name: zf-HIT; PFam Description: HIT zinc finger
  misc_feature: GI Number: 42571267; NR Description: PAPA-1-like family protein / zinc finger (HIT type) family protein [Arabidopsis
  misc_feature: GI Number: 28279891; NR Description: Zgc:66215 protein [Danio
MEGGEGSGFDGAHMKKRRSSAVRRPRPEGGPAAVQRDNGSPPPLSVTSRSGPRSLLLTSDENATGPDGGNRRREFLLNAPSPERATKGSIRLRSEGAAGGSRKSDGSSHAPEGNREKLGKVKLKIRNVLPKPNPDTSPVKPPRPVDSRHQQKHGHLKEGTKDSDRPTSSRDKKARKERSIQETMAHEQADKFQREPTSDPVRKSRRLAKKSVDNEFDEDFGTSNLGTPEDWDGTRESKSKGSGSKKSASRKGKNRSKVYGADNDFVTSRSGKKRSRESADDDNTEEEPTSDSEPDVEDTEQKTTATESPVNIRSEPLTTRRRALQSWMDGSSISTVEFPDGLPPAPSRSKKDKLSEEEMLAKKAEAAQRRRMQVEKATKESEAEAIRKILGIDSEKKKEERKQKERGEKERASRAQNMAANSIRWVMGPTGTVISFPHAVGLPSIFDSKPHSYPPPREKCAGPSCTNDYKYRHSNPPLDRCNRTSPDRAQGT

SEQ ID NO: 4911 - DNA, 846 bp, Zea mays
  misc_feature (1)..(846): Ceres cDNA ID no. 22005454
  misc_feature (1)..(846): Ceres CLONE  ID no. 218360
  misc_feature (1)..(846): Also known as  Ceres CDNA ID no. 24390220
gtttatatgtgagcgttcctcgcaattaatagagagatctatctatctatcgatcgagctttcgttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaatctgcgagcatccagcagcagcaacgataccaacaccagcattatttaattggtagcctcctctagctacgcacgcatttttagtcccctacacgtccttggattctgcgtggctctgttaatcatctctcatccttcgtctgccatttctcccctgcccgtcgccgatcaccagagatttttgttccttgttggtaccatgcattttggcaaataattttgtgattccatccccaaattaaagtttggttgtcgtatggtttgtaaacccagaacaatatatatatatgtgtgtgtgtgatcgaaaaaaaaaaaaaaaaaa

SEQ ID NO: 4912 - protein, 131 aa, Zea mays
  misc_feature: PFam Name: Profilin; PFam Description: Profilin
  misc_feature: GI Number: 313142; NR Description: profilin 3 [Zea mays] >gi|422033|pir||S35798 profilin 3 - maize
  misc_feature: GI Number: 313140; NR Description: profilin 2 [Zea mays]
  misc_feature: GI Number: 548597; NR Description: PROFILIN 2 (ZMPRO2)
  misc_feature: GI Number: 2154730; NR Description: profilin 1 [Cynodon dactylon] >gi|2154728|emb|CAA69669.1| profilin 2 [Cynodon dactylon] >gi|3914422|sp|O04725|PROF_CYNDA Profilin (Pollen allergen Cyn d
  misc_feature: GI Number: 313138; NR Description: profilin 1 [Zea mays] >gi|422031|pir||S35796 profilin 1 - maize
MSWQTYVDEHLMCEIEGHHLTSAAIVGHDGAVWAQSTAFPQFKTEEMTNIMKDFDEPGFLAPTGLFLGPTKYMVIQGEPGAVIRGKKGSGGITVKKTGQAMVVGIYDEPMTPGQCNMVVERLGDYLVEQGL

SEQ ID NO: 4913 - DNA, 1015 bp, Zea mays
  misc_feature (1)..(1015): Ceres cDNA ID no. 22005455
  misc_feature (1)..(1015): Ceres CLONE  ID no. 229210
  misc_feature (1)..(1015): Also known as  Ceres CDNA ID no. 23837171
atatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaagaatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctctgcaagtaccgtgaggccaagaagatcgacaagcacatgtatcatgacatgtacatgaaggtcaagggtaatatgtttaagaacaagagggtgcttatggagagtatccacaagtccaaggctgagaaggccagagagaagacactttctgatcagtttgaggccaagcgtgcaaagagcaaggcaagccgtgagaggaagattgctaggagggaggagaggctggcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgttatatagtttcgtgtctcaaatattctgagtcttgtatgtattctgcctgcgtttcagattcagattttttttttattttggacccaatcaaccctgcactgccttgtcgaggaccgtggtccgtggatggcaatggttcttacttcttactggttatattatatatgctgcaagattgctagaaaaaaaaaaaaaaaaaaaaaaaaaaaaaaaaaaa

SEQ ID NO: 4914 - protein, 207 aa, Zea mays
  misc_feature: PFam Name: Ribosomal_L19e; PFam Description: Ribosomal
  misc_feature: PFam Name: Arv1; PFam Description: Arv1-like family
  misc_feature: PFam Name: Ras; PFam Description: Ras family
  misc_feature: PFam Name: Nsp1_C; PFam Description: Nsp1-like C-terminal region
  misc_feature: GI Number: 29837764; NR Description: putative ribosomal protein L19 [Oryza sativa (japonica cultivar-group)] >gi|50399976|gb|AAT76364.1| putative ribosomal protein L19 [Oryza
  misc_feature: GI Number: 32401377; NR Description: ribosomal protein L19
  misc_feature: GI Number: 33589762; NR Description: At1g02780/T14P4_3 [Arabidopsis thaliana] >gi|6056425|gb|AAF02889.1| Putative ribosomal protein L19 [Arabidopsis thaliana] >gi|15983412|gb|AAL11574.1| At1g02780/T14P4_3 [Arabidopsis
  misc_feature: GI Number: 47026900; NR Description: ribosomal protein L19
  misc_feature: GI Number: 40287526; NR Description: 60S ribosomal protein
MVSLKLQKRLAASVLKCGKGKVWLDPNEVSEISMANSRQNIRKLVKNGFIIRKPQKVHSRSRARRAHEAKQKGRHSGYGKRRGTREARLPTKILWMRRMRVLRRLLCKYREAKKIDKHMYHDMYMKVKGNMFKNKRVLMESIHKSKAEKAREKTLSDQFEAKRAKSKASRERKIARREERLAQGPREPTAPVAAPAPSTGVPKKAKK

SEQ ID NO: 4915 - DNA, 1350 bp, Zea mays
  misc_feature (1)..(1350): Ceres cDNA ID no. 22005456
  misc_feature (1)..(1350): Ceres CLONE  ID no. 262334
  misc_feature (1)..(1350): Also known as  Ceres CDNA ID no. 22005456
aatcccattttcggtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtcggttaaagattctcggtgtaactgttacaagcagagagtctgtgaccaggtctgaaggttcttgcacatcagaagttatgcgggtgcttccatatcttaaaaaggcatatggaaatgccatgcaaaaggttctccatgtaggccctgatagttgtacagtagtttctaatttgttgaaagaaggaaaggttgaagcttggggagtggagccttatgatttggaagatactgacagtacttgcaaaagcctcgtgcgcaagggctttgtccgtatgtctgatattaagttcccccttccgtaccgtccagattcttttaatcttgttgtggtgtcagatgctttagattatctgaccccaaggtatctgaacaaaacacttccagatttagcaagggtttccacagatggccttgttatttttgctggcaacccaggtcagcagaaagctaaggtctcagaactaccaaaatttggaagaccggcaaagttgcggagttcttcatggtggacacggtactttgtccagaccggcttgacagagaacgaagggccgctgaagaaattcgaagaggctacatccaagaacaaatacaaaccaggttgtcagatcttccacctgagttcgccaaggtgatgcgcatccatagcaccttgaattgttgtcacaccccctgccctcctccggttggcttgctcattgttcgtgtggaggaaatcgtcgcaaaaaaagccatcaggaataggttagcttatgtagagaggctccgacacttgttgctagaaattcactctggaaattaaattgtgtccccaatgattgcaaactggagccccgctgggatatatatgttagaactttcacgctgttgtaccgctgtgctatccatgtattgagcagtttgaaatgtaaagctcttgatgatcaaaaaaaaaaaaaaaaaa

SEQ ID NO: 4916 - protein, 266 aa, Zea mays
MSRRSLNPSRRVADGGLPTVGGLFHPKSRSPPVLTIALVVLGVILLVAYFNSGSGRLKILGVTVTSRESVTRSEGSCTSEVMRVLPYLKKAYGNAMQKVLHVGPDSCTVVSNLLKEGKVEAWGVEPYDLEDTDSTCKSLVRKGFVRMSDIKFPLPYRPDSFNLVVVSDALDYLTPRYLNKTLPDLARVSTDGLVIFAGNPGQQKAKVSELPKFGRPAKLRSSSWWTRYFVQTGLTENEGPLKKFEEATSKNKYKPGCQIFHLSSPR

SEQ ID NO: 4917 - DNA, 1397 bp, Zea mays
  misc_feature (1)..(1397): Ceres cDNA ID no. 22005457
  misc_feature (1)..(1397): Ceres CLONE  ID no. 274846
  misc_feature (1)..(1397): Also known as  Ceres CDNA ID no. 24395358
ctctttagtcccacatcccactccgccgctgccgcaccgcgcctatgtcgctcgacggagtcttctccacgaccgaggccctcgcgcggctactagcccgctgcccgacgctccactccgacccgcgtctccacgagcttgcctcgtcgccggccgccgcgccccccgctcgcgacgacgtcaccgccgcgctcgccgagccactgctgcatccgcgctacaccatccccgtgctgggctgcttcctcccgcttgcgccggcccttatcaaccaggccgtcgcgctgctccgcgccagactgcacgcgtgcaacgatgacgctcgcgccaggctgcaggcgtggaatgatgacgccgcccacctggaggatgaggccggggagagggacgtccgcgtcattgagttctacctctccaggcgtaggctcctgcggctgcacgagatcgcgtgcctcgcgctagcgcgcgccctcgacctcgcaccctacttgctcagatctgtattgaactactacaagttttcaccaccaccattccaaaggcttctatgtgcaagtttgacatcacaagttccttccaaggaactgcatttgtttcttgttgctgcacaagtatcttaccggtttctagaattggagcccagagtattttgtgaacaatgggattggtcttgctttttagaccttgtacatagtaccactgactatagtttagttgactcctcactttatactgttggattggacttgaaatggtgcacgatacatattcttatggtggttttaaaagcaagcgatatggctattgaaagttttggcctgcgagcagatgaagcatttaaatgttttctgaggtggaaggagttttgcatggacacttccttagagaaagcatctttatatcttcagaatgacaatgaaaattcaaaaagtagtatagatggtctcgctactttgcctgaatgtttgttggattggccagatgttgtaacagtaggaaatcatagcatgggaagcccgttcgtgcttacagctactttaagaaagagttacgaggtagctttgatggcagttggccagaagtggcctgtacttctctatgggcctgttggtgcaggaaaaactgcacttattaacaagttggcacaaatagttggaaatcgaggtatttatgatatatgtttatgaagatttattcatgttaaaaagtgtctgaaggctgtccaacggattgatatggtttgattcttgtcccaacaagaatgcacattccattttttgaggagttaagtttttttaagtttgactggatttatataaaatagtatcaacatttgtatctctaaatctatttattatgaaaaactattccactattagtcaaaaaaaaaaaaaaaa

SEQ ID NO: 4918 - protein, 380 aa, Zea mays
  misc_feature: GI Number: 42563009; NR Description: midasin-related
MSLDGVFSTTEALARLLARCPTLHSDPRLHELASSPAAAPPARDDVTAALAEPLLHPRYTIPVLGCFLPLAPALINQAVALLRARLHACNDDARARLQAWNDDAAHLEDEAGERDVRVIEFYLSRRRLLRLHEIACLALARALDLAPYLLRSVLNYYKFSPPPFQRLLCASLTSQVPSKELHLFLVAAQVSYRFLELEPRVFCEQWDWSCFLDLVHSTTDYSLVDSSLYTVGLDLKWCTIHILMVVLKASDMAIESFGLRADEAFKCFLRWKEFCMDTSLEKASLYLQNDNENSKSSIDGLATLPECLLDWPDVVTVGNHSMGSPFVLTATLRKSYEVALMAVGQKWPVLLYGPVGAGKTALINKLAQIVGNRGIYDICL

SEQ ID NO: 4919 - DNA, 1067 bp, Zea mays
  misc_feature (1)..(1067): Ceres cDNA ID no. 22005458
  misc_feature (1)..(1067): Ceres CLONE  ID no. 278070
  misc_feature (1)..(1067): Also known as  Ceres CDNA ID no. 23757954
agcctccgcctcgtctcgacgccttacacccagtgccaaccgccgtgccctcaccctctctatctgcgccgtctctcactctctaccgccgccgccgccgccctacgccacgcaaaaagcgccacaagattcgcccctgctgaaaacgcactcgatggcgtccgcgacgggggtttcctcctcggagatggcggtggaccacgcgacggggccgggcgccgtggacaagccgcggttcgatgctctgacgccgaatgagatgagcggcgggaggccccagttccggaaagtgcccgtcccgcagcaccggttcgcgccgctcaagcgatgctggatggaaatctacacacccgtatacgagcatatgaagatcgatatacgcatgaatctcaaggcaaggagggtggagctaaagacaaggcaagacacaccggacgtgagcaaccttcagaaatgtgcggactttgtgcatgcttttatgcttgggttcgacattgctgatgccgtcgccttgctgcgtcttgatgacctgtatgtggactccttcgaaatcaaggacgtgaagaccctgcgaggggagcatctgtcgcgtgctatcggccgcctatcagggaaaggaggcaagaccaagtacgctattgagaactctaccaggacccgcatcgttatcgctgatacaaagatccatatacttggatcctttgttaacatcaaggtcgcgcgggattcgctttgcagtctcatcttgggttcacctgctggcaaagtgtattctaagctaagggctgtatcagctaggttggcggaaaggtattaaattagattggttttgcttgtaccgtgtaacggttgcagttttgatcacagtatgttttactagcggatttgtgtgctcggggatgctgggagatttaaattggtgtgtacatgtgctcttgtgccaccacaatccatgtggtggggttgattttgatgaaaattagttattttcttatcctaacccactataaatcgataatatatgtattgaggtgggtatgagtgtagccaaaaaaaaaaaaaaaaaa

SEQ ID NO: 4920 - protein, 220 aa, Zea mays
  misc_feature: PFam Name: KH_1; PFam Description: KH domain
  misc_feature: GI Number: 34908792; NR Description: P0415A04.33 [Oryza sativa (japonica cultivar-group)] >gi|20161192|dbj|BAB90119.1| putative partner of Nob1 [Oryza sativa (japonica cultivar-group)] >gi|20160828|dbj|BAB89768.1| P0557A01.6 [Oryza sativa (japonica
  misc_feature: GI Number: 33669476; NR Description: partner of Nob1 [Sorghum
  misc_feature: GI Number: 50418445; NR Description: MGC89796 protein [Xenopus tropicalis] >gi|52346172|ref|NP_001005132.1| MGC89796
  misc_feature: GI Number: 27503881; NR Description: MGC53417 protein [Xenopus laevis] >gi|33638119|gb|AAQ24169.1| NOB1 protein [Xenopus
  misc_feature: GI Number: 34873957; NR Description: similar to RIKEN cDNA
MASATGVSSSEMAVDHATGPGAVDKPRFDALTPNEMSGGRPQFRKVPVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 4921 - DNA, 1583 bp, Zea mays
  misc_feature (1)..(1583): Ceres cDNA ID no. 22005459
  misc_feature (1)..(1583): Ceres CLONE  ID no. 281876
  misc_feature (1)..(1583): Also known as  Ceres CDNA ID no. 23758547
aatccctcctcctccataagagacaagaacgaggtcgtctcgccatcgccgccactcctatttaagagctgccggaggtgggggcagatccggcgagccgttcccgctgtccagattcaggaactagactcctccggtccggtcctccccctcccgccccgtctcgctccagcggctccacgccaccgtttgccattcactgccagaatggcgctcaacaaggagtacacgtacgcggagctggagaaggagccgtactggccgttcgagaagctgcgggtctccatcaccggggccggcgggttcatcgcctcccacatcgcgcgccgcctcaagggcgagggccactacgtcgtcgcctccgactggaagaggaacgagcacatgcccgaggacatgttctgccacgagttccacctcgtggacctgagggtcatggacaactgcctcaaggtcaccacgggggttgaccacgtgttcaacctcgcggctgacatgggtgggatggggttcatccagtccaaccactccgtcatcatgtacaacaacaccatgatcagctttaacgtgcttgaggctgctagaattaacggcgtcaagaggttcttctatgcatcaagtgcctgcatctaccctgagttcaagcagctggaaactgtagttagcttgaaggagtccgatgcttggcctgccgagcctcaagatgcctatggcctggaaaaactcgcgactgaggagctgtgcaagcactatacaaaggattttggcatcgagtgccggattggtcgctttcacaacatatatggtcccttcggcacatggaaaggtggaagggagaaggcgcctgctgctttctgcaggaaggctctgacctccacagggcgctttgagatgtggggtgatggcctgcaaaccagatccttcacatttattgatgaatgtgttgaaggtgtccttaggttaacaaagtccgatttccgtgagcctgtaaacattggaagcgacgaaatggtgagcatgaacgagatggcggaaatagtcctgagctttgagaacaagcagctgcccatccaccacatccccgggccggagggcgtgcgtgggcgcaactcagacaacacgctcatcaaggagaagcttggctgggctccgactatgaggctgaaggacgggctgaggatcacgtactcctggatcaaggagcagcttgagaaggagaaggccgagggcatggatctgtcggtctacggatcatccaaggtcgtgcagacacaggccccggttcagctcggctccctccgcgccgctgatggcaaggagtgaactttggctgcgccggtcagttgcagggcatgatataccagtaatacacagctgtttcagtttccatgatttgtagtcaccatttcttgattcacatttgactccacaagagaagaccatttggacgatggatgttttgtcacaagttacgggattcagttcaaatttgaactgaatacaaaatatcctgacacgatatctgtcgtccaaacacttataataatttccacgctgttttttttccaaaaaaaaaaaaaaaa

SEQ ID NO: 4922 - protein, 371 aa, Zea mays
  misc_feature: PFam Name: Epimerase; PFam Description: NAD dependent
  misc_feature: GI Number: 21436019; NR Description: AT5g28840/F7P1_20 [Arabidopsis thaliana] >gi|16323180|gb|AAL15324.1| AT5g28840/F7P1_20 [Arabidopsis thaliana] >gi|16323113|gb|AAL15291.1| AT5g28840/F7P1_20 [Arabidopsis
  misc_feature: GI Number: 28170704; NR Description: Ata17 protein
  misc_feature: GI Number: 9937230; NR Description: sugar epimerase BlmG
  misc_feature: GI Number: 48853513; NR Description: COG0451:
  misc_feature: GI Number: 46192376; NR Description: COG0451: Nucleoside-diphosphate-sugar epimerases [Rhodobacter sphaeroides
MALNKEYTYAELEKEPYWPFEKLRVSITGAGGFIASHIARRLKGEGHYVVASDWKRNEHMPEDMFCHEFHLVDLRVMDNCLKVTTGVDHVFNLAADMGGMGFIQSNHSVIMYNNTMISFNVLEAARINGVKRFFYASSACIYPEFKQLETVVSLKESDAWPAEPQDAYGLEKLATEELCKHYTKDFGIECRIGRFHNIYGPFGTWKGGREKAPAAFCRKALTSTGRFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYSWIKEQLEKEKAEGMDLSVYGSSKVVQTQAPVQLGSLRAADGKE

SEQ ID NO: 4923 - DNA, 849 bp, Zea mays
  misc_feature (1)..(849): Ceres cDNA ID no. 22005460
  misc_feature (1)..(849): Ceres CLONE  ID no. 283974
  misc_feature (1)..(849): Also known as  Ceres CDNA ID no. 23775750
aaaaagtgaacgagctctcagtctctcagactctcacacactctagctgctgctctctcccactgtctcgccgtcttgctcaaacgcagtgcccggtggtctggtcggtcgctctctcgacccatgggagttggccggggttcctgctccagccactgaagacgcggcggcggctcctgctcatggcaggagctcaatgcgccacagggccgcgcgccgcgccgctcctcctcgtcctcgtcctcgtcctgtgcggcttccttgtgctgctcgtgcctacgtctcggcgcggggacgacgacgagacagaggagttccccgtcgcgtcttccgcttcgtcgtcgtcgtggcactggcacgccgctgatgggcgccgccgtgccctgccgcggccggccgccgcgacgtggccgtggcgccccgcccagccccgggcgcgcgggaggtggaactccgcggggcaggacggcaagcacgaggtccccagtggccccaacccggactccaatcggtagccgtagccagagaggtgggtggtcgtgaactccgatccgccgtctgtgtttgtttcggcgaacggcgaccaagctccctccctgtcccctgctcctgctcctggaggccggtcgtctagctaggcctggccgtcgtatcgctcctccatgcttcttgctgctccgtgctggagccagtacgtgcgtcgtttgcttgctgtgttgtatcttcttcttcgccgttctcttcgttagagaatgaacatgaccatcatctgacgcatgcattgctcaattctcgtccaaccgacgattgattggtgacctggaatcaggagcaaaaaaaaaaaaaaaa

SEQ ID NO: 4924 - protein, 110 aa, Zea mays
MAGAQCATGPRAAPLLLVLVLVLCGFLVLLVPTSRRGDDDETEEFPVASSASSSSWHWHAADGRRRALPRPAAATWPWRPAQPRARGRWNSAGQDGKHEVPSGPNPDSNR

SEQ ID NO: 4925 - DNA, 1264 bp, Zea mays
  misc_feature (1)..(1264): Ceres cDNA ID no. 22005461
  misc_feature (1)..(1264): Ceres CLONE  ID no. 284038
  misc_feature (1)..(1264): Also known as  Ceres CDNA ID no. 24395370
ataatacaatcaattattgggctcaacgtttgagggcacgtttgagatgtgcgtctttttgtagaacccatcaccatcagaccagactgctgttcctgtcccagaaagccagctatgtcgtcgtcggcgccgcagacggagccgcacgtggtggaggactgccgcggcgtgctgcagctgatgagcgacggcacggtgcggcgcagcgcggagcctccggcgctgttctcggcggtggacgtctcggaagacgagtgcggcgtggagtggaaggacgtgacgtgggacccggcgcacggcctgaacgcgcgcctgtaccggccgcggcacctgggcgcggccaacgacgcgcggatccccgtggtggcctacttccacggcggcggcttctgcatcgggtccgggcggtggcccaacttccacgcctggtgcctccgcctgtgctccgagctccccgccgtggtgctctccttcgactaccgcctggcgcccgagcaccggctcccggccgcccaggaggacggcgccagggccatgtcctggctgcgctccgccgccgccggcggcggcgacccctggctcgccgacgcggccgacttcgcgcgcgtcttcgtggcgggcgactcggcgggcggcaacatcgcccaccacgtcgcggtcgggctcggcagggccggcctgggacccggcgtccggatccgcggcgcgctcctcctggcgccggccatggccggcgacgcccgcacgcgcgcggagcagctggagtgcccgcgcgacgcgttcctcaccaccgagatgtgcgacaggtacgcgcggctggcgctgcccgagggcgccagcagggacgactcggtgctcagcccggcggggccgcgggcgcccgggctggaggccgtggagatggcccccgtgctggtggtggccggcgggcgcgacgtgctgagggaccggaacgcgcagtacgcgcggcggatgaaggaggagtggggcaaggaggtggagtacgtggaggtcgccggcgccgaccacggcttcttcgtggtggacccctggtcggagcgcgccgacgagctcgtccgcatcgtgcgccggttcgtcgtggaccacatggacacggagtaggacgggtgacctgatgatgaccaggctgccggtgccggtgccggtgccggaggggccatcatggtttgttgccacgcttggatcatgaataattgaatggctttgcttttcttctttaaaaaaaaaaaaaaaaaaaaaaaaa

SEQ ID NO: 4926 - protein, 335 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: Peptidase_S8; PFam Description: Subtilase family
  misc_feature: PFam Name: Pkinase; PFam Description: Protein kinase domain
  misc_feature: GI Number: 34899924; NR Description: putative cell death associated protein [Oryza sativa (japonica cultivar-group)] >gi|22831101|dbj|BAC15963.1| putative cell death associated protein [Oryza sativa (japonica cultivar-group)] [Oryza sativa
  misc_feature: GI Number: 34899936; NR Description: putative cell death associated protein [Oryza sativa (japonica cultivar-group)] >gi|23617085|dbj|BAC20768.1| putative cell death associated protein
  misc_feature: GI Number: 34895916; NR Description: P0030H07.24 [Oryza sativa (japonica cultivar-group)] >gi|13872954|dbj|BAB44059.1|
  misc_feature: GI Number: 34895938; NR Description: P0030H07.40 [Oryza sativa (japonica cultivar-group)] >gi|13872965|dbj|BAB44070.1| P0030H07.40 [Oryza sativa (japonica cultivar-group)] >gi|15528618|dbj|BAB64639.1| P0011G08.10 [Oryza sativa (japonica
  misc_feature: GI Number: 50919067; NR Description: putative esterase [Oryza sativa (japonica cultivar-group)] >gi|27819508|gb|AAO24912.1|
MSSSAPQTEPHVVEDCRGVLQLMSDGTVRRSAEPPALFSAVDVSEDECGVEWKDVTWDPAHGLNARLYRPRHLGAANDARIPVVAYFHGGGFCIGSGRWPNFHAWCLRLCSELPAVVLSFDYRLAPEHRLPAAQEDGARAMSWLRSAAAGGGDPWLADAADFARVFVAGDSAGGNIAHHVAVGLGRAGLGPGVRIRGALLLAPAMAGDARTRAEQLECPRDAFLTTEMCDRYARLALPEGASRDDSVLSPAGPRAPGLEAVEMAPVLVVAGGRDVLRDRNAQYARRMKEEWGKEVEYVEVAGADHGFFVVDPWSERADELVRIVRRFVVDHMDTE

SEQ ID NO: 4927 - DNA, 1802 bp, Zea mays
  misc_feature (1)..(1802): Ceres cDNA ID no. 22005462
  misc_feature (1)..(1802): Ceres CLONE  ID no. 285233
  misc_feature (1)..(1802): Also known as  Ceres CDNA ID no. 25087982
atcagtgggtgggtgggtggttcgcctcctcatcctctcctccccgcacgtccacggcgatggcgcccgcgcccccgcactgctgacccacccccgccgcgcactctcatgaccgtggtttggtaggtggggcggaggttggtaggccgggacgtgccggcaggcggttacgggaggcgcggccgcgatcccgggccggatctggacgccgcgatggaggacgccgttgccgctgagaatgggatcgagggggagggctacgtcgtcgtcaaggcggcggcggccgcggaggcggagggggactccggcgccagcgatcgtggggatctcgccgcccccgctgaggacgcggcgccggccggatctgaggacgccccggccccggcggtgacgccggacgagaccgcggcacctgccaaggcgccggccaagaagggtggatccggggacgccgccggggtccggaaggcgaggccgcagaacggcagggtgcccgccgccgccgccaccgccgcgccgagggtgaagaagcccggggtcctctcgcagagcgcctccttcccggcgcggggtgccgccgccaagaaggcctcggcggttgctactcccaagcaggccaagggcgtcgtgaccaatggatcagaggcggcagcaggccgggcagccgagaagaaggcgaattcagcgcggacacctgtcgctcgccggtcgatgcctgtcaagtctggatcagcggatgcggccgccccaaatgacgcaattcccgctgtccaagagccacatgaaaacaccgacaagccattgaaacaaatgcagccagggaaaacagaggatgatgtgcgctccaccacatcaagtaccaatactccgcgtgcagcagctcgcaagagtgctgctgttgctgctggttttagtttcagattggaggagcgtgctgagaagagaaaggagttcttccaaaagcttgaagagaaaatccacgcaaaggagctggaaaaaacaaatctgcaggagaaatctaaggagagccaagaggctgagatcaaactgctgaggaagagcctaacatttaaagccacacctatgccaagcttttacaaggagcagccacccaaagttgagttgaaaaagattcccccaacacgcgctaggtcgccaaagctcggccggcacaagccagccaattctgccactgctgcttctgcggatggttctgtatcatgtgagagcccacggagcactgcaaattcgggcaaggtaaatgaagcgatggaaaacaacaaacctcatgcccctgctagaaaacctgttcagaggccagtcatgaaagctccatcacaggcgtctgccaccacaaaggctgaagcaagacccgtggtcacaaggccaaagatctcaaactcgaaacctaaggcttcaagggcgaaggttgcgcgagcgcaagaaaccccaggctgaagcccctccttcagaacctgctgctccagaagatttcacggttgaacatggcattggagacgccacaggtcctgatctgaccgcgcaattggttgcttcgaacgaagtcccagtccatggttgatcagctgagcattttgcatatttattcccttcttgcagttctgtgaatagcgagggtgtgtgcttcattggaagttgaatcgctcgaagtgtcatggtttatcgtttccggagtagacatccattttgtttttcagcttgtcattgggcatgccatgtatattgcttggtattgtgttcttgtttaaaattcccagtcttgtgcaaaaaaaaaaaaaaaa

SEQ ID NO: 4928 - protein, 414 aa, Zea mays
  misc_feature: PFam Name: TPX2; PFam Description: Targeting protein for
  misc_feature: PFam Name: BASP1; PFam Description: Brain acid soluble
  misc_feature: PFam Name: TolA; PFam Description: TolA protein
  misc_feature: PFam Name: Peptidase_S8; PFam Description: Subtilase family
  misc_feature: PFam Name: MARCKS; PFam Description: MARCKS family
  misc_feature: GI Number: 51091378; NR Description: putative BRI1-KD
  misc_feature: GI Number: 42733498; NR Description: BRI1-KD interacting
  misc_feature: GI Number: 50906049; NR Description: putative BRI1-KD interacting protein [Oryza sativa (japonica cultivar-group)] >gi|46390384|dbj|BAD15848.1| putative BRI1-KD interacting protein
  misc_feature: GI Number: 42733494; NR Description: BRI1-KD interacting
  misc_feature: GI Number: 50934761; NR Description: putative seed specific protein [Oryza sativa (japonica cultivar-group)] >gi|34393229|dbj|BAC83008.1| putative seed specific protein [Oryza
MEDAVAAENGIEGEGYVVVKAAAAAEAEGDSGASDRGDLAAPAEDAAPAGSEDAPAPAVTPDETAAPAKAPAKKGGSGDAAGVRKARPQNGRVPAAAATAAPRVKKPGVLSQSASFPARGAAAKKASAVATPKQAKGVVTNGSEAAAGRAAEKKANSARTPVARRSMPVKSGSADAAAPNDAIPAVQEPHENTDKPLKQMQPGKTEDDVRSTTSSTNTPRAAARKSAAVAAGFSFRLEERAEKRKEFFQKLEEKIHAKELEKTNLQEKSKESQEAEIKLLRKSLTFKATPMPSFYKEQPPKVELKKIPPTRARSPKLGRHKPANSATAASADGSVSCESPRSTANSGKVNEAMENNKPHAPARKPVQRPVMKAPSQASATTKAEARPVVTRPKISNSKPKASRAKVARAQETPG

SEQ ID NO: 4929 - DNA, 1565 bp, Zea mays
  misc_feature (1)..(1565): Ceres cDNA ID no. 22005463
  misc_feature (1)..(1565): Ceres CLONE  ID no. 293829
  misc_feature (1)..(1565): Also known as  Ceres CDNA ID no. 24446309
attttcccccctcttctccagcgtggcacagagctagggtttctcccacccgccgcctccggcgactgcacccgccgtcgtccacggccgatcgctccagctcccgctgcgcgcgctcccgccgcaggccgctccagctcttgcacgcattcccggccgccgtcgcgcctgcacgccgctcctctgcggccgctccagcttgcccgcgcgtgctcccctcgactgctctagcttctgcacgcgtgcccggccgccgccgcgcctgcacgccgtcggtcaccaatcgtcacctactacgacccgtccttcaagcggcagcttcatccgcgacgtccgtgtcgccgtcttgcgccacgacctcactcgagcgctctgcctactcccgaagccctcctccgcggcgcccgccccagcagttcctcctccgcagcgcccgccccatcagttcctcctccgcggtgcccgtcgacccgccgagcaccagcagcagcgtcgccggtggtggagctccaccgcctttgccgcgctccatctcttcaggaagtgccctgctccaccgcccacctaacagaaaacgtggggggtgggaatggtttctcgatggtaaccacagtttggccaatggtttggtacatttcaggttccagctgaagtaacattaaaatccggagtgcaaatccgtcagcattggactgttttactcatctataggatctgattttgggtgggcgcagttgcggagatgcagaggctgggggatttcaggctccctcccttcttcaactacccgccttacttcactttacagcctgtgcgtgagacgcgggaaaagcaagtgcagttatggaaggatctgatacttgattactgtagaagtcaaaagatacatacaatatctctagaagaagatttccccttgttctccaatgcaaagattgagagatctcttagctacgaagcaaaggaagtgttcctcgcagctctcgtcagtgaaggtcgtgcagaatggatggacaaaggtcacaagaagtgcctaattctttggctaaggatacaggattgggcaaatttcatattgaactttgtaaaggataacgggttggaagtaatgactatcgaagaaatacgctctggaattgatacacgtggaactgaactcgagggaattgatcgtggtgttctcatgcgggctctgcggcagttggagcaaaagggaaaggcagctatcttcaaaggcacctctgctgatgacgaaggcgtaaagttttcggtgtaattcttttgcgatccttaaactggcagactaataatctcgttcagccggtgcccttgaacatggcatgagacacccatagcctcgatcattcagtgccctttgaaaatggcatgacacatccttgtaaaaagcagtagggctgatcacattcttcccgagtagtatcctcttcagtgctgcggtaaaatttcccaactcatcttttgttgtagtgaaaaatcggccaagcctgattaaacattgtggagtggttggtaagaagaaaaaaaaaaaaaaaaaaaaaaaaaaa

SEQ ID NO: 4930 - protein, 177 aa, Zea mays
  misc_feature: GI Number: 50927462; NR Description: MGC86224 protein
  misc_feature: GI Number: 62859513; NR Description: LOC548832 [Xenopus tropicalis]
  misc_feature: GI Number: 45709514; NR Description: LOC407684 protein [Danio
  misc_feature: GI Number: 34911986; NR Description: P0694A04.26 [Oryza sativa (japonica cultivar-group)] >gi|15290047|dbj|BAB63741.1| P0694A04.26 [Oryza sativa (japonica cultivar-group)] >gi|18844786|dbj|BAB85256.1| P0684E06.1 [Oryza sativa (japonica
  misc_feature: GI Number: 32527717; NR Description: Ac2-059 [Rattus norvegicus]
MQRLGDFRLPPFFNYPPYFTLQPVRETREKQVQLWKDLILDYCRSQKIHTISLEEDFPLFSNAKIERSLSYEAKEVFLAALVSEGRAEWMDKGHKKCLILWLRIQDWANFILNFVKDNGLEVMTIEEIRSGIDTRGTELEGIDRGVLMRALRQLEQKGKAAIFKGTSADDEGVKFSV

SEQ ID NO: 4931 - DNA, 965 bp, Zea mays
  misc_feature (1)..(965): Ceres cDNA ID no. 22005465
  misc_feature (1)..(965): Ceres CLONE  ID no. 313208
  misc_feature (1)..(965): Also known as  Ceres CDNA ID no. 23752205
agcgaccagccagtgatcgaccgaggcagagactgactactaggagcagagagcagcggagatggtgaagattccgagccccaggaggctgttcaggagccggtccaggagcaccaccatcatcggcggcggcggcgcggacatctgcgccatggtcgccgagcacgagaggatcgagtgggaggtgcggcccggcgggatgctggtgcagaagcggcgctcgacggaggacgacgcggcggcggccgtggagtacatcctggtgagagtctccaccaccgggtggcagtggcacgacgtctccatcgacgccaccgcaaccttcggcgacctgaaggtgatgctgtcgctggcgaccgggctgtggcccagggagcagaggctgctgtacaggggcaaggagagggacgactgcgagcacctgcacatggtgggggtccaggacaaggacaaggtgctgctcctggaggacccggccgtcaaggagaggaagctcaggtcaaccaccttggcgcagctcatgggcgtgccctgccactccttcatccaagtgtagagagaaacccccggggaatttcttgccatttttctcccgtctctcgtcgtcgttctccagcttgcctgcgtgagcgaagggtttcagtccagtctaaccgcgtttgttcagagcctgctgagttccatctcagggcttgaattcggccaatcgaatcaagacagtcgcaaacgataggatataaagatgatgaatacatggcgtaaattactgtgaacgggtacgtaatgtcatcccagtgccagtgtgtgtgagccagtagttctttggttccttgctctgtatatattctctttttttccttcctgagatcagcaaaacagttcggaattccatagatgctgctgtaaatcccttgtcttttttccacggaatgcagcccccttttctagtaaaaaaaaaaaaaaaa

SEQ ID NO: 4932 - protein, 164 aa, Zea mays
  misc_feature: PFam Name: ubiquitin; PFam Description: Ubiquitin family
  misc_feature: GI Number: 50902288; NR Description: P0497A05.5 [Oryza sativa (japonica cultivar-group)] >gi|20804881|dbj|BAB92562.1| P0497A05.5
  misc_feature: GI Number: 56785103; NR Description: ubiquitin-like [Oryza
  misc_feature: GI Number: 50910119; NR Description: ubiquitin-like protein [Oryza sativa (japonica cultivar-group)] >gi|47847633|dbj|BAD22119.1| ubiquitin-like protein [Oryza sativa
  misc_feature: GI Number: 50948201; NR Description: putative BAG domain containing protein [Oryza sativa (japonica cultivar-group)] >gi|42408090|dbj|BAD09231.1| putative BAG domain containing protein
  misc_feature: GI Number: 56785178; NR Description: BAG domain containing
MVKIPSPRRLFRSRSRSTTIIGGGGADICAMVAEHERIEWEVRPGGMLVQKRRSTEDDAAAAVEYILVRVSTTGWQWHDVSIDATATFGDLKVMLSLATGLWPREQRLLYRGKERDDCEHLHMVGVQDKDKVLLLEDPAVKERKLRSTTLAQLMGVPCHSFIQV

SEQ ID NO: 4933 - DNA, 1273 bp, Zea mays
  misc_feature (1)..(1273): Ceres cDNA ID no. 22005466
  misc_feature (1)..(1273): Ceres CLONE  ID no. 318649
  misc_feature (1)..(1273): Also known as  Ceres CDNA ID no. 24362750
accagccatgactcctccgcttctcctctccctcctgctggtggcggcgaggtgctgccgctgctgccatggctggtcgtcgtttcagaagccggcggtgactgcggtgatcgctttcggagactccattgtggacccggggaacaacaacgggctgcatacggtgatcaaggccaaccatccgccctacggcaaggacttgttcaaccacgaggccaccggacgctactccaacggcctcattccaaccgacctaattgcccaggagctgggtgtgaagctgctgcttcctgcctacttgggcgtggatctgagcccggaggacctgctcaccggcgtcagcttcgcgtccggcgccaccgggttcgacccgctgactcccctcgtagtgagcgtcatctcgctggagcagcagctcgcctacttcgacgagtaccgcggcaagctggtggatatcgccggcgaggatgagacggcgaggatcatcgacggtgcgctgttcgtggtgtgcgcgggcaccgacgacgtggccaacacctacttcacgacgccgttccgcagcgcggagtacgacatcccgagctacgtggagctgctggtgggcggcgccgaggagttcctccgcaacgtcagctccaggggcgccaggaagatcggcttcgtggggatgccgcccgtggggtgcgtgccgtcgcagcggacgctgggcggtggcctcgccagggcgtgcgagcccaagcggaacgaggcggcgcagctgtacaacgccaggatccaggagatggtcgccgacgccgaccgagacttggcgacgaccatggtggtgttcctggacatctaccgcgtcctggacgacctgatggagcgcggggacaagtacggcttctctgagaccaccaggggatgctgcggcaccggcaccatcgaggtcacggggctctgcgactcccgcttcgtctccgtctgcgacaacgtctcgcagcacgtgttcttcgacagctaccaccccaccgagagagcctacaggatcatcgtcaaggacatctttgacaactacggacaagtgctcatcggatgatatatatctaccttgcttgagcgatcgagcatgcatgttcatcttcttcatctttatgtacgttcggctagctggcccaaagcctcaaggaggcccatttatcttcttcttactcctcctcgccccaagaataattaattgtaagcatgatctgcggaatcagacggggatggtctggtaaaaaaaaaaaaaaaa

SEQ ID NO: 4934 - protein, 356 aa, Zea mays
  misc_feature: PFam Name: Lipase_GDSL; PFam Description: GDSL-like
  misc_feature: GI Number: 50904579; NR Description: putative family II extracellular lipase 3 (EXL3) [Oryza sativa (japonica cultivar-group)] >gi|41052892|dbj|BAD07804.1| putative family II extracellular lipase 3 (EXL3) [Oryza sativa (japonica
  misc_feature: GI Number: 52076061; NR Description: putative Anter-specific proline-rich protein APG precursor [Oryza sativa (japonica
  misc_feature: GI Number: 37534726; NR Description: putative anter-specific proline-rich protein [Oryza sativa (japonica cultivar-group)] >gi|31432302|gb|AAP53952.1| putative anter-specific proline-rich
  misc_feature: GI Number: 15054386; NR Description: family II lipase EXL3 [Arabidopsis thaliana] >gi|15222901|ref|NP_177718.1| family II
  misc_feature: GI Number: 26449364; NR Description: putative family II
MTPPLLLSLLLVAARCCRCCHGWSSFQKPAVTAVIAFGDSIVDPGNNNGLHTVIKANHPPYGKDLFNHEATGRYSNGLIPTDLIAQELGVKLLLPAYLGVDLSPEDLLTGVSFASGATGFDPLTPLVVSVISLEQQLAYFDEYRGKLVDIAGEDETARIIDGALFVVCAGTDDVANTYFTTPFRSAEYDIPSYVELLVGGAEEFLRNVSSRGARKIGFVGMPPVGCVPSQRTLGGGLARACEPKRNEAAQLYNARIQEMVADADRDLATTMVVFLDIYRVLDDLMERGDKYGFSETTRGCCGTGTIEVTGLCDSRFVSVCDNVSQHVFFDSYHPTERAYRIIVKDIFDNYGQVLIG

SEQ ID NO: 4935 - DNA, 1330 bp, Zea mays
  misc_feature (1)..(1330): Ceres cDNA ID no. 22005467
  misc_feature (1)..(1330): Ceres CLONE  ID no. 325848
  misc_feature (1)..(1330): Also known as  Ceres CDNA ID no. 24396001
aaaatccccgcatcgaatccggcggatcgggagcgggagagaccactcccaaatcgcgtcgcgtcgcgtcgagagcgagagcggaagaggtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggccaccgtcgccaagtgctacatgctgtccgccaggaagctgaccatcatatggggcgatacgccgcagtactggcactggatccccctcaccgactccaggttctcagaatgcgcagaactccagcacgtttgctggctggaaatccgcggcaagataccctgcgacatgctgtcccggaacaccacttacgccgcctacatggtgttcaagatgtccgacgaatcctatgggctggactatccgctccaggaggctgaagttagcatcggggcaaccaggtccactcgtcaggtctgcctagggtacgtcgacgatgacgaggacggggaagaggtgcctcagaactaccggtcgttcggggcggtgggaaatgtatttagaccaagggtcgggaggcggaaccgtcgccagcctcctggagtgcacgtcctgcaccctcagacaagagccggcggctggatggagatggagatgggtgagttcaggaacgaggaaggtgaagatggcgaggtgtccgtcagcctcatggagaccaggggcggcaactggaagagaggtcttactgtgcagggcattgagatcagggtcaagaagtaaggatgtgaaggttgtggggatcgggctttgcgcatcaaaacaaataaaaggatcttagatagatttgtagtgcgtgttctactgcagcacttgcgtatgtgtgtgtcttgcctatgcccagcaaaaaaaaaaaaaaaagttcttgaggcaagcaaaagaactgcagttttgtacacaatattgttgtgtcccagatcactcggtgctcgccatgtttgcttttgaaagtgtaaactaggtgtgcttgttacgatcacacaaatcaccaatggagaacaccaattctcgcaaaaaaaaaaaaaaaa

SEQ ID NO: 4936 - protein, 302 aa, Zea mays
  misc_feature: PFam Name: F-box; PFam Description: F-box domain
  misc_feature: GI Number: 50915782; NR Description: F-box family protein-like [Oryza sativa (japonica cultivar-group)] >gi|47848533|dbj|BAD22385.1| F-box family protein-like [Oryza
  misc_feature: GI Number: 50915780; NR Description: phloem-specific lectin-like [Oryza sativa (japonica cultivar-group)] >gi|47848218|dbj|BAD22044.1| phloem-specific lectin-like [Oryza sativa (japonica cultivar-group)] >gi|47848532|dbj|BAD22384.1|
  misc_feature: GI Number: 38454184; NR Description: At2g02230 [Arabidopsis
  misc_feature: GI Number: 3894158; NR Description: putative phloem-specific lectin [Arabidopsis thaliana] >gi|25366259|pir||E84434 probable phloem-specific lectin [imported] - Arabidopsis thaliana
  misc_feature: GI Number: 10177856; NR Description: phloem-specific lectin-like protein [Arabidopsis thaliana] >gi|15238574|ref|NP_197844.1| F-box family protein / SKP1
MEPTAAPAACEIARLPDDLLSAALGRTGPLDACRAAAVSPAFRAAADADAVWSSFLPPDLPPLADGELPADATATKKQLFMRLSDPARPVLLADGLTSMWLDRATVAKCYMLSARKLTIIWGDTPQYWHWIPLTDSRFSECAELQHVCWLEIRGKIPCDMLSRNTTYAAYMVFKMSDESYGLDYPLQEAEVSIGATRSTRQVCLGYVDDDEDGEEVPQNYRSFGAVGNVFRPRVGRRNRRQPPGVHVLHPQTRAGGWMEMEMGEFRNEEGEDGEVSVSLMETRGGNWKRGLTVQGIEIRVKK

SEQ ID NO: 4937 - DNA, 1448 bp, Zea mays
  misc_feature (1)..(1448): Ceres cDNA ID no. 22005468
  misc_feature (1)..(1448): Ceres CLONE  ID no. 332432
  misc_feature (1)..(1448): Also known as  Ceres CDNA ID no. 24360921
aagtggcaaggaaatagaaaacgcagcgtccgtgcgctgtaggtgtgtgtgcgccaagttcctgtgtccattgtcttgtgtacagctactgttcatctctgtctatctctgttcttggcgttccatcgagtgtgtagcgctagtagattccaacatttggtatcagaggcagtttatgcccaagatcctgcgctactacctcgagtccgaagctatggcgatggttccgcacggcgccggggggagttcggtctccatgtcgtacccggtgctgtcgccggcgagctacacggcgtgggcgatcaaggtggagtcgatcctcgacgcgcaaggtctctgggaggccgtgtctccaccagatggtggcgaggtgaacgcggtgaagaacaagacggcgcgggcacaacttctccaagctctgcccgatgacatcttgatgcaggtctccaccaagaaaacggcggcggaggtgtgggcgagtctcaagactcgtttcgtcggggcggatcgggtcaagacggcgcgcctagccacgctcaagggggagttcgacaagctgtacatggaggacggggaggcattggacgactacgccggcaaaatcagcggtatggcggcgcgttacgccgggcttggcgcgacactcgacgacgctgccatggtaaaaaagctcctcgacaccgtcccggatcggctcttccccgtcgtcgcgggcatcgagcagttctgcgacgttgagacgatgccatttgaggaggcgctcggacgtctcaaggcgttcgatgagcgttctcggcggcgtactcatgccggcggcgaacgacgcgacgaccaactcctcctcacggaggccgagtggaaagctcgaaaaaagaagaagtcgacgatcggcaagtgcttcaactgcggtaaccgcggccacttcgcgcgggattgccgtaagaagaaggaggaggaggcgctgctagccagggccgatgaagaagcgacgctcctgtgagtgcgggacgcggcgctaggattagggagagtttgttagaataatcccagcgcatgtgtgtacgagtcatggcagttgtgcatgtgtgtgcatgcagtgcaactgctagctccgtgggtgtgtgcgcatggtgctggtcactagctagttgagtggtgtagtgcgtgcgttagttgcgtgcgtgcttgcatgctggaaggagtggccgagaagctagcgcctagtgacttgttcgtgtgtgtgaggaggttgcttgcatgcaaagcaacatgagttatgtggctcatggcgtgaaggctgggtagtggactagtggagttcgtagctctctgtatattcagtctataaaggcacatgtactgctcagttaaaaagtgtggcaaggaaatagaaaacgcagcgtccatgcgctgtaggtgtgtgtgcgcgaacaaaaaaaaaaaaaaaa

SEQ ID NO: 4938 - protein, 274 aa, Zea mays
  misc_feature: PFam Name: Retrotrans_gag; PFam Description: Retrotransposon
  misc_feature: GI Number: 34907386; NR Description: P0471B04.27 [Oryza sativa (japonica cultivar-group)] >gi|21952802|dbj|BAC06218.1| P0018C10.19 [Oryza sativa (japonica cultivar-group)] >gi|22202685|dbj|BAC07343.1| P0471B04.27 [Oryza sativa (japonica
  misc_feature: GI Number: 34910624; NR Description: putative copia-type polyprotein [Oryza sativa (japonica cultivar-group)] >gi|15623989|dbj|BAB68043.1| putative copia-type polyprotein [Oryza sativa (japonica cultivar-group)]
  misc_feature: GI Number: 51964644; NR Description: PREDICTED OJ1499_A07.20
  misc_feature: GI Number: 50921055; NR Description: putative gag-pol polyprotein [Oryza sativa (japonica cultivar-group)] >gi|30017513|gb|AAP12935.1| putative gag-pol polyprotein [Oryza
  misc_feature: GI Number: 50917767; NR Description: gag-pol polyprotein [Oryza sativa (japonica cultivar-group)] >gi|29150404|gb|AAO72413.1| gag-pol polyprotein [Oryza sativa
MPKILRYYLESEAMAMVPHGAGGSSVSMSYPVLSPASYTAWAIKVESILDAQGLWEAVSPPDGGEVNAVKNKTARAQLLQALPDDILMQVSTKKTAAEVWASLKTRFVGADRVKTARLATLKGEFDKLYMEDGEALDDYAGKISGMAARYAGLGATLDDAAMVKKLLDTVPDRLFPVVAGIEQFCDVETMPFEEALGRLKAFDERSRRRTHAGGERRDDQLLLTEAEWKARKKKKSTIGKCFNCGNRGHFARDCRKKKEEEALLARADEEATLL

SEQ ID NO: 4939 - DNA, 1215 bp, Zea mays
  misc_feature (1)..(1215): Ceres cDNA ID no. 22005469
  misc_feature (1)..(1215): Ceres CLONE  ID no. 335640
  misc_feature (1)..(1215): Also known as  Ceres CDNA ID no. 23842110
gaactcatcactcccgcttccagcttcccgcagcgagcatcaaaaagagaagagggagagagagcagcaggcatggaaatgggcgacagcttcgagtactactgggagatgcagcagtacctggagtcagaggagctcagcctctacatgggcacccaggacgatgccctgtcctgctacgactccagctcgcctgatggctccatctccaactcgtcctgggcgccggcgggcgtggcggccacggcgtccgagaagcgtgagggccccggcggcgcggcggccgcgaacaagaacatcctcatggagcgcgaccgccggcgcaagctcaacgagaagctctacgcgctgcgcagcgtcgtgcccaacatcacaaagatggacaaggcgtcgatcatcaaggacgcgatcgagtacatcgagcagctgcaggcggaggagcggcgggcgctgcaggcgctcgaggccggcgagggggcgcgctgcggcggccacgggcacggcgaggaggcgcgcgtgctcctgcagcagcccgccgccgccgccgccgcaccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcatgagccggcctagctactgtggccgaccggtactgttccgtgtgctgctctctctttttttctttccccgacgccctgtgcgcgtatataggaactaggaagaagtgggtgctttgtttgctatatatgaggcactaggtcagggggttttgtgatgggggtttatgcaactttgatgtaatggaccgaaaacgacagattgagtgttggcggctagctcccatatgtttagagtctagggaaggaataaataatcgaggcaaaccttatccatgtatttttgtagagaggtatttgaaacaagaagttcaacaaaaaaaaaaaaaaaa

SEQ ID NO: 4940 - protein, 261 aa, Zea mays
  misc_feature: PFam Name: HLH; PFam Description: Helix-loop-helix
  misc_feature: GI Number: 29466635; NR Description: Transcription Factor
  misc_feature: GI Number: 18423944; NR Description: basic helix-loop-helix
  misc_feature: GI Number: 21554896; NR Description: unknown [Arabidopsis thaliana]
  misc_feature: GI Number: 32492114; NR Description: OSJNBb0013O03.10 [Oryza
  misc_feature: GI Number: 57834070; NR Description: OSJNBb0013O03.11 [Oryza
MEMGDSFEYYWEMQQYLESEELSLYMGTQDDALSCYDSSSPDGSISNSSWAPAGVAATASEKREGPGGAAAANKNILMERDRRRKLNEKLYALRSVVPNITKMDKASIIKDAIEYIEQLQAEERRALQALEAGEGARCGGHGHGEEARVLLQQPAAAAAAPAPVEVLELRVSEVGDRVLVVNVTCSKGRDAMARVCRAVEELRLRVITASVTSVAGCLMHTIFVEVDSDQTNRIQIKHMIEAALAQLDDASASPPSVMSYY

SEQ ID NO: 4941 - DNA, 735 bp, Zea mays
  misc_feature (1)..(735): Ceres cDNA ID no. 22005470
  misc_feature (1)..(735): Ceres CLONE  ID no. 336648
  misc_feature (1)..(735): Also known as  Ceres CDNA ID no. 24360885
agaatcccattccgattcctccctccccgtcccgtctcccctctcgccctaggggccggggggctagggttcgcttcaccgccggcctccccctccgacgcggcaccggcccccgcgcaccgggcccggatgctatgctgctgagctgcaggaccctctccacctgggtgcgccgcctcgtcgcttgcatgggaggttgctttggatgttgtgctaagccaactccaataatagcagtagacgagccttccaagcggttgaggatccaggggcgatcagtaaggaaggctagcctctcggaggacttttggagcacgagtgcgcatgagatggagaacagcgggatccaatcgcagaggagcatgtcttcgatcagcacgttggctggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcgctgttgtcgtcgtcgtcgtcgtggtgtacctcgtacgtgacatgccgtagcacgtacgctagcagagcagcacctcaatgtccttgggtttgctttgctggctctctgttttcgtctcgtgttgcttttaatctggcacaggtttctaaattataataatgaatacttttttgtcctaaaaaaagaaaaaaaaaaaaaaaa

SEQ ID NO: 4942 - protein, 735 aa, Zea mays
AGAATCCCATTCCGATTCCTCCCTCCCCGTCCCGTCTCCCCTCTCGCCCTAGGGGCCGGGGGGCTAGGGTTCGCTTCACCGCCGGCCTCCCCCTCCGACGCGGCACCGGCCCCCGCGCACCGGGCCCGGATGCTATGCTGCTGAGCTGCAGGACCCTCTCCACCTGGGTGCGCCGCCTCGTCGCTTGCATGGGAGGTTGCTTTGGATGTTGTGCTAAGCCAACTCCAATAATAGCAGTAGACGAGCCTTCCAAGCGGTTGAGGATCCAGGGGCGATCAGTAAGGAAGGCTAGCCTCTCGGAGGACTTTTGGAGCACGAGTGCGCATGAGATGGAGAACAGCGGGATCCAATCGCAGAGGAGCATGTCTTCGATCAGCACGTTGGCTGGCAGCGTACGTGGCCATCAGCAGCATGCAGTCGTCGTCGTAGCAGAGATGTCCTAGCTACGTGTGTGTCATGCATCAGACTGGCACATAATAAAGAAGTAGATCATGCACCCACTAGTGATCACTTCGTCTAGTGTCCCTCCGTTCGCTGTTGTCGTCGTCGTCGTCGTGGTGTACCTCGTACGTGACATGCCGTAGCACGTACGCTAGCAGAGCAGCACCTCAATGTCCTTGGGTTTGCTTTGCTGGCTCTCTGTTTTCGTCTCGTGTTGCTTTTAATCTGGCACAGGTTTCTAAATTATAATAATGAATACTTTTTTGTCCTAAAAAAAGAAAAAAAAAAAAAAAA

SEQ ID NO: 4943 - DNA, 821 bp, Zea mays
  misc_feature (1)..(821): Ceres cDNA ID no. 22005471
  misc_feature (1)..(821): Ceres CLONE  ID no. 346293
  misc_feature (1)..(821): Also known as  Ceres CDNA ID no. 23788171
atcctaatcgaaaactcgagtctggtcccccacccctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttcctcttcctgaggagttcttcaaggcactagatgctgtcaaatctgatcctgctcttcaaggcgatgctcctcctcaagtgaaggcgtaaggatggctgttcctggctaacgtcatttcacattttgccgcggtgggtagggactggtttcttgtgtcatttgccagcaatgcgcttgctctgagcagaataaatttctggtgagtaccatcaaagtgtgaatttgaacttagtgattcggcacagtaaacttgttgcccatgaaatactcgatgccctgaacatcgtttgttttgacgttataatcgatgttgacaaaaaaaaaaaaaaaaaa

SEQ ID NO: 4944 - protein, 173 aa, Zea mays
  misc_feature: PFam Name: ETC_C1_NDUFA5; PFam Description: ETC complex I
  misc_feature: GI Number: 16930745; NR Description: NADH-ubiquinone
  misc_feature: GI Number: 28829489; NR Description: similar to NADH-ubiquinone oxidoreductase 13 KD-B subunit [Caenorhabditis
  misc_feature: GI Number: 50728132; NR Description: PREDICTED: similar to
  misc_feature: GI Number: 31213375; NR Description: ENSANGP00000017869 [Anopheles gambiae] >gi|30175722|gb|EAA11832.2| ENSANGP00000017869
  misc_feature: GI Number: 233598; NR Description: 13 kDa-B polypeptide of iron-sulfur protein fraction of NADH:ubiquinone oxidoreductase
MFLRRILTGGGGLAALRAARAVKETTGIVGLEVVPNAREVLVGLYERTLKEIKAVPEDEGYRKAVESFTGHRLQICQEEEDWKRIEDRIGCGQVEELIEEAEDELKLIAKMIEWDPWGVPDDYECEVIEDDTPIPKHVPQHRPVPLPEEFFKALDAVKSDPALQGDAPPQVKA

SEQ ID NO: 4945 - DNA, 801 bp, Zea mays
  misc_feature (1)..(801): Ceres cDNA ID no. 22005472
  misc_feature (1)..(801): Ceres CLONE  ID no. 347683
  misc_feature (1)..(801): Also known as  Ceres CDNA ID no. 24364608
aaaccctaatgaacctagcgccgcttcctccctcccaaacccatggcttcccaccttgacttccgctgcctggatgagggcctcggcggcgaacgcggcaagcgcaagcgccgcgaggatgcctcggcggcggccgcggactccatggacctcgatgctgacgccccccggctgtctaagctccgcgccatgccttccctctccgacccctcgaagccggcctccttcggccagcccacctacgacggcgtcatcgcagggcggttgtcggggcgccggtggaaggagccccgcacccggcggtcgtcggccgtggcggtgtcgcggaagccgatcccgctggaacagcgcgtccgggagaagtctctgaagcgcgcgtaccaggcccgcaaggcggagctcaaggaggagatccggcagaacaaggttgcgaagcggaaggcccgcgaggagcgggagaagcggaagcaggagaacgtgctccgcacgggcaccaagctgcagcgggtcaccaacccgaagacgatccagaagatcgccaagtccaagaagcgcaagcagctcaaggtcgtccccgacgagttcttcggcggcaagaagtcggaggccagccggcgcatgcaggtgcctggacttgagaattgaatctcaattctcaatctctgtttctggggtcgcgttgagttcatagtggttaattcgacgacgattttctacttgcttatggtagtttgaagtatgatcagattaagtgattacaatggtacgcaagttatcaagttctgaaaaaaaaaaaaaaaa

SEQ ID NO: 4946 - protein, 200 aa, Zea mays
  misc_feature: PFam Name: Cgr1; PFam Description: Cgr1 family
  misc_feature: GI Number: 5821151; NR Description: RNA binding protein [Homo
  misc_feature: GI Number: 6634015; NR Description: KIAA0324 protein [Homo sapiens]
  misc_feature: GI Number: 6649242; NR Description: splicing coactivator
  misc_feature: GI Number: 19923466; NR Description: splicing coactivator subunit SRm300; RNA binding protein; AT-rich element binding factor [Homo sapiens] >gi|5821153|dbj|BAA83718.1| RNA binding protein
  misc_feature: GI Number: 5821145; NR Description: RNA binding protein [Homo
MASHLDFRCLDEGLGGERGKRKRREDASAAAADSMDLDADAPRLSKLRAMPSLSDPSKPASFGQPTYDGVIAGRLSGRRWKEPRTRRSSAVAVSRKPIPLEQRVREKSLKRAYQARKAELKEEIRQNKVAKRKAREEREKRKQENVLRTGTKLQRVTNPKTIQKIAKSKKRKQLKVVPDEFFGGKKSEASRRMQVPGLEN

SEQ ID NO: 4947 - DNA, 1008 bp, Zea mays
  misc_feature (1)..(1008): Ceres cDNA ID no. 22005473
  misc_feature (1)..(1008): Ceres CLONE  ID no. 353402
  misc_feature (1)..(1008): Also known as  Ceres CDNA ID no. 23795822
gccttccctctgaaaactcttcattctcctctcctccgccgcgccgccaacttcccctcccgtcaactccggctcccgcgcgagatcgagctagcgtttggggttctcgagaccggctgccatggcgacagagcaagaggcggagaactacacggtggaggaccttgtggccctgaatccgtacaaccccgacatcctcaacgaccttgagaagttcgtcaacgagcaagttgcgtctcaaacatataacttggatgcaaatctcagccttcttcgcctgtaccagtttgagccaggaaggatgagcatacatattgtggcccacatactgatcaaggctctcatggcaatgccggcccctgacttcagtctttgcttattcttaattcctgaacatgtgcaaatggaagagcaattcaaggcattgatagttctttctcactatctagagactgctaggttcaggcagttttgggatgacgcagcaaacaaccgccacatattggaagcagttccaggttttgagcaggcaatccaatcctatgcaattcatgtactttccttgacataccagaaagttccaaggcatattcttgcagaggcaatcaacattgaaggtctcgctttggacaagtttcttgagtaccatgctgcgaactcaggttgggtaattgagaagggtgggcagtctcaagtgattgttcttccacgcaatgagttcaatcacccccagctcaagaagaacacagctgataccgttccatttgagcacctaacacgcatattccctgttcttagctgattcaggcgtagtgagagatatacaatagaactcagagcgagtgaagcttctctaagcaattgtatcatctcctttgtggtataccgtattttaagatctcggtatacctgttcttttttatggctgaattggtacctgcaacttggttattactataacgaaatgaccagttatgagattggtcggccccaaaaaaaaaaaaaaaa

SEQ ID NO: 4948 - protein, 226 aa, Zea mays
  misc_feature: PFam Name: eIF-3_p25; PFam Description: Eukaryotic
  misc_feature: GI Number: 27730981; NR Description: similar to RIKEN cDNA
  misc_feature: GI Number: 5114051; NR Description: HSPC029 [Homo sapiens]
  misc_feature: GI Number: 55669683; NR Description: Chain A, Crystal
  misc_feature: GI Number: 62202422; NR Description: Unknown (protein for
  misc_feature: GI Number: 57870640; NR Description: Unknown (protein for
MATEQEAENYTVEDLVALNPYNPDILNDLEKFVNEQVASQTYNLDANLSLLRLYQFEPGRMSIHIVAHILIKALMAMPAPDFSLCLFLIPEHVQMEEQFKALIVLSHYLETARFRQFWDDAANNRHILEAVPGFEQAIQSYAIHVLSLTYQKVPRHILAEAINIEGLALDKFLEYHAANSGWVIEKGGQSQVIVLPRNEFNHPQLKKNTADTVPFEHLTRIFPVLS

SEQ ID NO: 4949 - DNA, 2168 bp, Zea mays
  misc_feature (1)..(2168): Ceres cDNA ID no. 22005474
  misc_feature (1)..(2168): Ceres CLONE  ID no. 356681
  misc_feature (1)..(2168): Also known as  Ceres CDNA ID no. 23847740
ctcgtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggcctttcaaagtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcaccgtcccggcctacttcaacgactcccagcgccaggccaccaaggacgccggcgtcatctccggcctcaacgtcatgcgcatcatcaacgagcccaccgccgcggccatcgcatacgggctcgacaagaagtcgagcagcgacggcgagaagaacgtcctcatcttcgacctcggcggcggtacctttgacgtctcgctcctcaccatcgaggagggcatctttgaggtcaaggccaccgccggcgacacccacctgggaggcgaggacttcgacaaccggctcgtgaaccacttcgtccaggagttcaagaggaagaacaagaaggacatcactggcaaccccagggcgctccggcgactgaggaccgcctgcgagagggctaagaggacgctctcctccaccgcccaaaccaccatcgagatcgactcgctctatgagggcatcgacttctacacgaccatcacccgtgcccggttcgaggagctcaacatggacctcttccgcaagtgcatggagcccgtggagaagtgcctccgcgacgccaagatggacaagagcagcgtgcacgacgtcgttctcgtgggcggctccactcgcatcccccgcgtgcagcagctgctccaggacttcttcaacggcaaggagttgtgcaagagcatcaacccagacgaggctgtcgcgtacggagcggccgtccaggccgccatcctcactggcgagggcaatgagaaggttcaggatctgctcctgctcgacgtctcgccgctctcgctcggcctggagacggccggaggcgtcatgactgtgctcatccccaggaacaccaccatcccgacaaagaaggagcaggtcttctccacttactccgacaaccagcccggcgtgctcatccaggtgtacgaaggtgagagggccaggaccaaagacaacaatctgctcggcaagttcgagctctctggcatccctccggcgcccaggggcgtcccccagatcaccgtgtgtttcgacatggacgcgaacggcatcctcaacgtgtcagcggaggacaagaccaccggacagaagaataagatcacgatcaccaacgataagggacggctaagtaaggaggagatcgagaagatggtgcaggaggcagagaagtacaaagccgaggacgaggaacaccagaagaaggtgaacgccaagaacacgctcgagaactatgcctacaatatgcgcaacaccatcagagacgacaagatcgcctccaagctaccggtggacgacaagaaaaagatcgatgacgccgtcgagggggccatcaattggctcgacaacaaccagctcgccgaggttgatgagtttgaggacaagatgaaggagctggagggcatttgcaaccccatcatcgcgaagatgtatcagggcgccgctggtcctgacatggccggtggcatggatcgggatgcttcgccggctggtggcagcggtgctggacccaagatcgaagaagtcgactaaatgaggaaattcttatatatgtagttttgcttaaataattgcgtcaattacaaagtggatcttattattatttttatgcgaaaaaaaaaaaaaaaa

SEQ ID NO: 4950 - protein, 649 aa, Zea mays
  misc_feature: PFam Name: HSP70; PFam Description: Hsp70 protein
  misc_feature: GI Number: 32405376; NR Description: 78 KDA GLUCOSE-REGULATED PROTEIN HOMOLOG PRECURSOR (GRP 78) (IMMUNOGLOBULIN HEAVY CHAIN BINDING PROTEIN HOMOLOG) (BIP) [Neurospora crassa] >gi|45645170|sp|P78695|GR78_NEUCR 78 kDa glucose-regulated
  misc_feature: GI Number: 2827002; NR Description: HSP70 [Triticum aestivum]
  misc_feature: GI Number: 21263753; NR Description: Heat shock cognate 71 kDa protein (Hsc70.1) >gi|4589737|dbj|BAA76887.1| heat shock
  misc_feature: GI Number: 762844; NR Description: Hsc70 >gi|2119719|pir||JC4786 dnaK-type molecular chaperone hsc70-3 -
  misc_feature: GI Number: 629875; NR Description: dnaK-type molecular
MAGKGDGPAIGIDLGTTYSCVGVWQHDRVEIIANDQGNRTTPSYVAFTDSERLVGDAAKNQVAMNPINTVFDAKRLIGRRFSDTSVQSDAKLWPFKVIPGSGDKPMIGVQFRGEEKQFSAEEISSMILNKMKETAEAYLGTTIKNAVVTVPAYFNDSQRQATKDAGVISGLNVMRIINEPTAAAIAYGLDKKSSSDGEKNVLIFDLGGGTFDVSLLTIEEGIFEVKATAGDTHLGGEDFDNRLVNHFVQEFKRKNKKDITGNPRALRRLRTACERAKRTLSSTAQTTIEIDSLYEGIDFYTTITRARFEELNMDLFRKCMEPVEKCLRDAKMDKSSVHDVVLVGGSTRIPRVQQLLQDFFNGKELCKSINPDEAVAYGAAVQAAILTGEGNEKVQDLLLLDVSPLSLGLETAGGVMTVLIPRNTTIPTKKEQVFSTYSDNQPGVLIQVYEGERARTKDNNLLGKFELSGIPPAPRGVPQITVCFDMDANGILNVSAEDKTTGQKNKITITNDKGRLSKEEIEKMVQEAEKYKAEDEEHQKKVNAKNTLENYAYNMRNTIRDDKIASKLPVDDKKKIDDAVEGAINWLDNNQLAEVDEFEDKMKELEGICNPIIAKMYQGAAGPDMAGGMDRDASPAGGSGAGPKIEEVD

SEQ ID NO: 4951 - DNA, 820 bp, Zea mays
  misc_feature (1)..(820): Ceres cDNA ID no. 22005475
  misc_feature (1)..(820): Ceres CLONE  ID no. 369822
  misc_feature (1)..(820): Also known as  Ceres CDNA ID no. 24363883
atatttgcatccatcggccactgctagggttccaagaaattgggtgtgctgtggcgaccgggctttccctacgggctggtcatcattttcgggagcgtcgtggctacctccggtgctgcggctagcgcgactaggccagatcgacccagcgcgatgacggctgtgtgcggcgtcctcggacatcgctccgccagctcaaatctccaagcgctcgagctcgaaactcctccaaccggtcatccgctgccagcaatcgacctccatccgcagagcactcaccgaaaggtggctctggatatctcctgctctaacagctccacaaaaattgcattcaacacttgggatgagtgaccgaccgagaagttttctcgggtgcacacgagtgaagtcaaagtacgcacaaaagactcgtgttagtctgtggggatgatatatgatcgtagagggttgctgggagtaagtatcgcatagcggctcgatgcagtagatggtcggggtcggggagggggcgtggagtggcacgtgaccacggtctcgacggcgcgctgctccaacaagtggaacgtgttcatttcttgatgaggacacgtttggagcagcagagatctttagccaatcttattagtttgaacattaaaaaaacaaaaaaaaggggcattccgagaatcgaactcgggacctcttgcacccaaagcaagaatcataccactagaccaaatgccctgttatgttttactttctttagtataagtatatgacaaaaacactgtttcgcaattgtctggaaattctaagaatcgtatcaaaaaaaaaaaaaaaa

SEQ ID NO: 4952 - protein, 65 aa, Zea mays
MTAVCGVLGHRSASSNLQALELETPPTGHPLPAIDLHPQSTHRKVALDISCSNSSTKIAFNTWDE

SEQ ID NO: 4953 - DNA, 957 bp, Zea mays
  misc_feature (1)..(957): Ceres cDNA ID no. 22005476
  misc_feature (1)..(957): Ceres CLONE  ID no. 373697
  misc_feature (1)..(957): Also known as  Ceres CDNA ID no. 23792575
ataaatagtctcgctccgctggccggcaactggcaccagcaccgaggcaggagcggcgatccattccacacaaccaccactgctcttgccccagcccgcctcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctctggagggagcagagccttgccggcaagcctgccggcgtcttcttctgcactggatcccagggtggtggccatgagacgacagcgttgacagcgatcacccagttgacgcaccacggcatggtgttcgtgcctgtgggctacaccttcggcgccaagctgttcggcatggaccaggttcagggcggcagcccctacggcgccggcacgttcgccgccgacggctcgaggtggccgagcgaggtggagctggagcacgccttccaccaggggaagtacttcgcaggcatcgccaagaagctcaagggttcagcctgatctacacatatacccttgtcggatatcataaaaaacacttattacagattcgtctaacccatcaatagatcggtctgttctctcgtggtgtctggatgttgtgtggctcagtggaactttcatgctacggtgactttgttgtaatctggagttggaatatcgttgtttcgcacaaaaaaaaaaaaaaaa

SEQ ID NO: 4954 - protein, 203 aa, Zea mays
  misc_feature: PFam Name: Flavodoxin_1; PFam Description: Flavodoxin
  misc_feature: PFam Name: FMN_red; PFam Description: NADPH-dependent FMN
  misc_feature: GI Number: 58500257; NR Description: quinone reductase 2
  misc_feature: GI Number: 34910128; NR Description: putative 1,4-benzoquinone reductase [Oryza sativa (japonica cultivar-group)] >gi|20804903|dbj|BAB92583.1| putative 1,4-benzoquinone reductase
  misc_feature: GI Number: 53749369; NR Description: 'putative 1,4-benzoquinone reductase' [Oryza sativa (japonica
  misc_feature: GI Number: 5031275; NR Description: unknown [Prunus armeniaca]
  misc_feature: GI Number: 21068664; NR Description: putative quinone
MAVKVYVVYYSMYGHVGKLAEEIQKGASSVEGVEAKTWLVPETLPEEVLGKMGAPPKPDVPVITPQELAEADGILFGFPTRFGMMAAQMKAFFDATGGLWREQSLAGKPAGVFFCTGSQGGGHETTALTAITQLTHHGMVFVPVGYTFGAKLFGMDQVQGGSPYGAGTFAADGSRWPSEVELEHAFHQGKYFAGIAKKLKGSA

SEQ ID NO: 4955 - DNA, 687 bp, Zea mays
  misc_feature (1)..(687): Ceres cDNA ID no. 22005477
  misc_feature (1)..(687): Ceres CLONE  ID no. 380048
  misc_feature (1)..(687): Also known as  Ceres CDNA ID no. 23842018
acgttgcttgctcccaagatcaagcgcctcccgcctccagcactctaactcaggggacacgatcgccatggccgccacatcgaccgccgccgccgtgctgtccccgccgtccgtggccgggctccgcctggcgccgtctcccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcggtcgtcgaggatgtattctacagacagccgtgtgcgtgcgtgtgtgcttgtcatgtatccgatcaaagtttggttaatttggacaagtagtgcaactgcagaataattggtatttgtatagtgcaccatgccaacatgaatttgatctgtctctgtcttcactaaaaaaaaaaaaaaaa

SEQ ID NO: 4956 - protein, 145 aa, Zea mays
  misc_feature: PFam Name: PSI_PSAK; PFam Description: Photosystem I psaG / psaK
  misc_feature: GI Number: 19091; NR Description: photosystem I polypeptide PSI-G precursor [Hordeum vulgare] >gi|131192|sp|Q00327|PSAG_HORVU Photosystem I reaction center subunit V, chloroplast precursor
  misc_feature: GI Number: 52001191; NR Description: chloroplast photosystem
  misc_feature: GI Number: 12642864; NR Description: putative photosystem I subunit V precursor [Arabidopsis thaliana] >gi|11908046|gb|AAG41452.1| putative photosystem I subunit V precursor [Arabidopsis thaliana] >gi|5734520|emb|CAB52748.1|
  misc_feature: GI Number: 37776921; NR Description: putative photosystem I
  misc_feature: GI Number: 18188; NR Description: polypeptide 35 precursor [Chlamydomonas reinhardtii] >gi|81246|pir||S06683 photosystem I chain V precursor - Chlamydomonas reinhardtii >gi|131191|sp|P14224|PSAG_CHLRE Photosystem I reaction center
MAATSTAAAVLSPPSVAGLRLAPSPGRARVSFRAAPAPARRSVAARAELSSALVISLSTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 4957 - DNA, 1079 bp, Zea mays
  misc_feature (1)..(1079): Ceres cDNA ID no. 22005478
  misc_feature (1)..(1079): Ceres CLONE  ID no. 385771
  misc_feature (1)..(1079): Also known as  Ceres CDNA ID no. 23808950
gggtcgtcctgaccaattgatggttctgcttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatatcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcaatgcaagaaccccatggaattgtttgtacaaaaaaaaaaaaaaaaa

SEQ ID NO: 4958 - protein, 1079 aa, Zea mays
  misc_feature: PFam Name: Cyclin_N; PFam Description: Cyclin, N-terminal domain
  misc_feature: PFam Name: Cyclin_C; PFam Description: Cyclin, C-terminal domain
  misc_feature: GI Number: 10177354; NR Description: cyclin C-like protein
  misc_feature: GI Number: 21554107; NR Description: cyclin C-like protein [Arabidopsis thaliana] >gi|10177353|dbj|BAB10696.1| cyclin C-like protein [Arabidopsis thaliana] >gi|15239664|ref|NP_199674.1| cyclin
  misc_feature: GI Number: 42568400; NR Description: cyclin family protein
  misc_feature: GI Number: 28828497; NR Description: similar to Mus musculus (Mouse). 16 days neonate thymus cDNA, RIKEN full-length enriched library, clone:A130067E11 product:cyclin C, full insert sequence
  misc_feature: GI Number: 62898055; NR Description: cyclin C variant [Homo
GGGTCGTCCTGACCAATTGATGGTTCTGCTTCTGCTTTACCACTCAATCTGGTTGAGAGTCGCCGGCGCCGGCGATTCCTCCTCCACCGATTCGCCCGGCGGGAGTCTCCGCAGGGCTCACCGGGACCGCGGGTCCACGATGGCCGCCAACTTCTGGACGTCGTCGCACTGCAAGCAGCTGCTGGACCCCGAGGACGTGGACCTGGTGCCGGCGGCGGACCGGGAGCGAGGCATCACGCCGGAAGAGTTCCGCCTCATCAAGATCCATATGTCGTTCCATATCTGGAGGCTAGCACAGCAGGTTAAAGTTAGGCAAAGAGTTGTAGCTACAGCAATATCTTACTTCAGGCGTGTGTATACAAGGAAGAGCATGTCAGACTATGATCCTCGTTTGGTTGCACCTACTTGTTTGTATTTGGCATCTAAGGTGGAGGAGAGTACAGTGCAAGCCCGACTTCTTGTATTTTATATAAAAAAGATGTGTGGTTCCGATGATAAGTATCGGTTTGAAATTAAGGATATTCTTGAAATGGAAATGAAGCTCCTGGAAGCTCTCGACTATTATTTGGTTGTTTTCCATCCATATCGTCCTCTCTTACAGTTGTTGCAGGATGCTGGCATAACAGACCTGACACAATTTGCCTGGGGCCTTGTTAATGATACATACAAGATGGACCTTATCCTCATATACCCTCCCTACATGATTGCACTGGCCTGCATATACATAGCGAGTGTTTTGAAAGATAAGGACACCACAGCATGGTTTGAAGAGCTCCGTGTTGACATGAACATAGTTAAGAATATCTCTATGGAAATATTAGACTTCTATGACACCTACAAGATTGATCCTCAAAGGGGCATCCCTGAGGATAAGATAAGCCCCGTGATGAACAAGTTGCCGGCAAAGGCTTAACTCAGATTTGGCGAGCTTAGGAGTTGTAAACTAGTAGTAAACTACATCATACTTCCACCATGTGTGTACTCAGCCTGCACTGTCGCTTGTGACGTGTTGATGAACTACTTGATAGATTCAATGCAAGAACCCCATGGAATTGTTTGTACAAAAAAAAAAAAAAAAA

SEQ ID NO: 4959 - DNA, 1804 bp, Zea mays
  misc_feature (1)..(1804): Ceres cDNA ID no. 22005479
  misc_feature (1)..(1804): Ceres CLONE  ID no. 390613
  misc_feature (1)..(1804): Also known as  Ceres CDNA ID no. 23810966
acctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgttggagcctggggagaacgtgtgggtcgacgtcgacgtgctcatgacgcacgacgtctgcgggcccggcgccttcgacatcttcaagaaggagttcggggaggacgccagggtctgggaccgcgagaagctcgtcgtcatcccggaccactacatcttcaccagcgacgaccgcgccaaccgcaacgtcgacatcctcagggacttctgtgcggagcagaacatcaagtacttctatgacatcaaggacctcagcgatttcagggctaatccggactacaaaggcgtctgccacatcgcacttgctcaggaaggccactgccgaccaggcgaggttctcttgggcactgattctcacacatgcaatgctggagcttttggtcagtttgcaactggaatcggaaacactgacgcaggttttgtgttgggcactggaaaggctcttctcaaggtgccacctactatcaggtttatattagatggagagatgccgccttatttacttgcaaaggatctgattttgcaaattattggtgagatttcagtatctggtgcaacctacaaatcaatggagtttgttggatcaactgtagaaagtctaaccatggaagagcgtatgacactgtgcaacatggttattgaagctggtggaaagaacggtgttgtgcctgctgatgaaactacatttaaataccttgagggtaagacatcagtcgattatgaacctgtctacagtgatgctcaagccagattttttagcgactaccggtttgatgtatcaaaactggagccagtagttgccaagccacattcgcctgacaaccgtgctccagcaagagaatgcaaagatgtgaagatcgaccgagtctatattggttcttgcactggtggtaagaccgaggatttccttgctgctgcaaagttgttcttagcctcgggaaagaaggttaaagttcccacatttcttgtccctgccacgcaaaaggtgtggttggacgtatatagcctccctgtaccaggatctggtggcaaaacttgctcccagatatttgaggaggctggttgtgacacaccagcaagtcctaattgtggtgcttgtttgggtggccctcgtgatacatatgcacggatgaatgaacctactgtctgcgtgtccaccacgaacaggaactttccgggcaggatggggcacaaggaagggcaaatctacctggcgtctccctacactgcggctgcctcagccctgacggggtacgttacggacccaagggacttcctcatgtaacgtcttgaaacaacaacagatttcatgatgtaacagagtggctgtactgctgtttttcgtgctgaacttttgtctaggcatgtccttcgttgagaaataaactgcactagaataagcagcgacttctcgggcgccatagcagatgtgacctcatatttatttgtgcaactttttttgtttttggctctgtaaaaaaaaaaaaaaaa

SEQ ID NO: 4960 - protein, 504 aa, Zea mays
  misc_feature: PFam Name: Aconitase; PFam Description: Aconitase family
  misc_feature: GI Number: 21673449; NR Description: 3-isopropylmalate dehydratase, large subunit, putative [Chlorobium tepidum TLS] >gi|21646552|gb|AAM71856.1| 3-isopropylmalate dehydratase, large
  misc_feature: GI Number: 48890833; NR Description: COG0065: 3-isopropylmalate dehydratase large subunit [Trichodesmium
  misc_feature: GI Number: 50904927; NR Description: putative 3-isopropylmalate dehydratase large subunit [Oryza sativa (japonica cultivar-group)] >gi|41053038|dbj|BAD07969.1| putative 3-isopropylmalate dehydratase large subunit [Oryza sativa
  misc_feature: GI Number: 51209876; NR Description: 3-isopropylmalate dehydratase large subunit [Gracilaria tenuistipitata var. liui] >gi|50657630|gb|AAT79615.1| 3-isopropylmalate dehydratase large
  misc_feature: GI Number: 20094876; NR Description: 3-isopropylmalate dehydratase large subunit [Methanopyrus kandleri AV19] >gi|19888106|gb|AAM02653.1| 3-isopropylmalate dehydratase large subunit [Methanopyrus kandleri AV19]
MASSVSAAAKAAAAFAHKVQKELAAPAQRRAGLTRRTKPCSVRAVASPARALSSTGSVKSAMTMTEKILARASERAALEPGENVWVDVDVLMTHDVCGPGAFDIFKKEFGEDARVWDREKLVVIPDHYIFTSDDRANRNVDILRDFCAEQNIKYFYDIKDLSDFRANPDYKGVCHIALAQEGHCRPGEVLLGTDSHTCNAGAFGQFATGIGNTDAGFVLGTGKALLKVPPTIRFILDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRAPARECKDVKIDRVYIGSCTGGKTEDFLAAAKLFLASGKKVKVPTFLVPATQKVWLDVYSLPVPGSGGKTCSQIFEEAGCDTPASPNCGACLGGPRDTYARMNEPTVCVSTTNRNFPGRMGHKEGQIYLASPYTAAASALTGYVTDPRDFLM

SEQ ID NO: 4961 - DNA, 1482 bp, Zea mays
  misc_feature (1)..(1482): Ceres cDNA ID no. 22005480
  misc_feature (1)..(1482): Ceres CLONE  ID no. 390915
  misc_feature (1)..(1482): Also known as  Ceres CDNA ID no. 24373819
tcttttgatttgattttgcaggatccatccgagaacgagcagccacttctccgatgccgtcctcaatggccaaatccctcctcctccctccccagttcgtctccgtctcaccccgccacccccaccgcgccggattccccgtcctcaagccccgccgcgcctcgctgctggccttcaccggcggagacgtcacgcccccgccggacgccgacagcggctccaacaccaaccctctcgtcgatgtgccccgcgcgctctggcgccgcaccctgcagcctctcggcgactatggcttcggcaagcgcagcgtctgggagggcggcgtcggtctcttcatggtctccggggccgccctcctcgccctcgccctcgcatggcttaggggattccagctccgctcccgcttccgcaagtacaacaccgtcttcgagttcacgcaggcgtgtggcatctgcgtcggcacgcccgtccggatacgaggggtcaccgtcggctccgtcgtccgcgtcgactcctccctcaggagcatcgatgccaccgttgaggttggagatgataagatcatcataccacggaattcagtggtcgaggtgaatcagtcgggtcttctaatggagacgctcattgatatcacacccaaggatccactccctgcaccttcagtagggccacttgacccaaactgcatcaaagaaggtttgattctctgtgacaaagagaggatgaaaggacagcaaggtgtaagcttagatgcattggtgggaatatttacccgactaggtagagacatggaggagattggcgttagcaaaagctataagttggctgaaaaagttgcatctataatggaagaggcacaacctcttcttacacggattgaggatttagctgaagaaatgcaacctttgctctctgaagtcggtgatagtgatctgctgaaggatgtggagactatagctaaaggcctggccgacgcgtctgttgacctaagaaggctgaagtcgtccatgctcaccccagagaacacggatcttattaagcagtctattttcacccttatatttaccctgaagaacattgagagtatcagctcggacatctctgggttcacgggggatgagacgacaaggcagaacatcaagcttctgatcaagtctctcagcaggctattatgattgtttttcaatgtgcagaacagaatgatggattgctttgctttgctttgtttgagacaggaaatgatgctggtagagtagggtgactgtgtgtgtgtctcggtggcacagaggtgtaggaagagtagcagttaattaatgttccacaaggttttggttattctggtaataagtttctttttttttcttttttctttttaaaaaaactcagatcagtattgagctgttgtaggtcatatagtaggcccatttttcatcagttgatggatcgcccttgttggctgcctgaacaaaaaaaaaaaaaaaa

SEQ ID NO: 4962 - protein, 373 aa, Zea mays
  misc_feature: PFam Name: MCE; PFam Description: mce related protein
  misc_feature: PFam Name: Pyr_redox_2; PFam Description: Pyridine
  misc_feature: PFam Name: Atrophin-1; PFam Description: Atrophin-1 family
  misc_feature: GI Number: 57899922; NR Description: ABC-type transport system-like [Oryza sativa (japonica cultivar-group)] gi|57899704|dbj|BAD87424.1| ABC-type transport system-like [Oryza
  misc_feature: GI Number: 34906054; NR Description: P0698H10.22 [Oryza sativa (japonica cultivar-group)] >gi|15290130|dbj|BAB63821.1| P0459B04.4 [Oryza sativa (japonica cultivar-group)] >gi|20160939|dbj|BAB89875.1| P0698H10.22 [Oryza sativa (japonica
  misc_feature: GI Number: 21553847; NR Description: unknown [Arabidopsis thaliana]
  misc_feature: GI Number: 42572499; NR Description: mce-related family
  misc_feature: GI Number: 53688472; NR Description: COG1463: ABC-type transport system involved in resistance to organic solvents,
MPSSMAKSLLLPPQFVSVSPRHPHRAGFPVLKPRRASLLAFTGGDVTPPPDADSGSNTNPLVDVPRALWRRTLQPLGDYGFGKRSVWEGGVGLFMVSGAALLALALAWLRGFQLRSRFRKYNTVFEFTQACGICVGTPVRIRGVTVGSVVRVDSSLRSIDATVEVGDDKIIIPRNSVVEVNQSGLLMETLIDITPKDPLPAPSVGPLDPNCIKEGLILCDKERMKGQQGVSLDALVGIFTRLGRDMEEIGVSKSYKLAEKVASIMEEAQPLLTRIEDLAEEMQPLLSEVGDSDLLKDVETIAKGLADASVDLRRLKSSMLTPENTDLIKQSIFTLIFTLKNIESISSDISGFTGDETTRQNIKLLIKSLSRLL

SEQ ID NO: 4963 - DNA, 1164 bp, Zea mays
  misc_feature (1)..(1164): Ceres cDNA ID no. 22005481
  misc_feature (1)..(1164): Ceres CLONE  ID no. 392275
  misc_feature (1)..(1164): Also known as  Ceres CDNA ID no. 0
acacaataggctggcagagaggcaggcaaccagctcgggcgtgtccttcctcctccgtctccatcttggcccaaccgagcccaaacctctccccttttctccgtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaggtcctcgagcgcctccccgacggcggcgccgacagccacgtctcctacacgcaggaccgctacgtcttccacgccaagcgcaccgacggcatcaccgcgctctgcatggccgacgacgccgccggaagacggattccctttgcatttttggaggatattcatggaaggtttgtcaagacatatggccgggctgcactaaccgctcttgcatatgcaatgaatgatgaattctcaagggtcttgagccagcaaatggactactattcaaatgaccctagtgcagatagaataaaccgcatgagaggtgaaatcaatcaggtccgtagtgttatgattgataacattgataaggttcttgaaagaggtgatcgtttggaactgctggttgacaagactgcaaatatgcaaggaaatacagttcgattcaagagacaagctcggcggttcagaaacactgtttggtggagaaatgtcaaactcacggccgcattgatacttctcctcctggtaataatatatgtcgttctagtcttcgtgtgccatggtttcaccctaccaacttgcataaggtaaggcatgatgtgcacaaagtgctttttgctgtgcatgtttgtgcctgtcaccggggggcagcagccgttgcaattgtttcttgtgtagaggaaagctacatattatgatgtgattgtgagaactcaattaaagatgtgaacttaacataaaaagtgcttcttgtgggtttggctatgaccttgtagctctatgagaattgggtgtttggattggtgtttatttgtggctattcttgtgtctgtacatgaattcagttacgacgagtattttatggctatgctaatgtaatattcttgaaaaaaaaaaaaaaaa

SEQ ID NO: 4964 - protein, 221 aa, Zea mays
MAILYALVARGTVVLAEHSAAATNAGAIARQVLERLPDGGADSHVSYTQDRYVFHAKRTDGITALCMADDAAGRRIPFAFLEDIHGRFVKTYGRAALTALAYAMNDEFSRVLSQQMDYYSNDPSADRINRMRGEINQVRSVMIDNIDKVLERGDRLELLVDKTANMQGNTVRFKRQARRFRNTVWWRNVKLTAALILLLLVIIYVVLVFVCHGFTLPTCIR

SEQ ID NO: 4965 - DNA, 720 bp, Zea mays
  misc_feature (1)..(720): Ceres cDNA ID no. 22005482
  misc_feature (1)..(720): Ceres CLONE  ID no. 394486
  misc_feature (1)..(720): Also known as  Ceres CDNA ID no. 23819197
agttttacaatcatgtctcattctcatgatgtgcatatgcagtgaaaaacttcaacccaagaatggcgatgtcttggacaagagggttaaatcatggtgttgttccgaggcatgccgctcaattggtagagagcagaagccttgcaattgcaagcaaggcgaagaagggtggaaaggctgatgctggcaaaactcctgctctcagccaagagctcaagagtacaacagtgttcggggcaaacatcttcaaggagggttctgatccgaaaatccaaccagactctgagtatcctgactggctgtggcacttgctcgacaatcgtcctgtactaagtgagctgcggaggaaagatcccaagacactctcttatgaagacctgaagcgttttgtcaagttggacaaccgatccaggatcaagataaggaatgacctcaatgctaagaactgacctggagtcttggacgaaacaggacctgctctactgttctttttattattaatataatactagacgacatgaataatttttctggagtttttggcaaaacatagcgacttgggatgttaaaatgttaagatgtgcttggtttgttactcttttaggcagcttacgacactgtcatgctttttgttcttccatcttgggaaagatgcagctttgtgcccagtacttagcaaattatcaagttccatggttctgcataaaaaaaaaaaaaaaa

SEQ ID NO: 4966 - protein, 720 aa, Zea mays
  misc_feature: GI Number: 48138358; NR Description: similar to CG9353-PA
AGTTTTACAATCATGTCTCATTCTCATGATGTGCATATGCAGTGAAAAACTTCAACCCAAGAATGGCGATGTCTTGGACAAGAGGGTTAAATCATGGTGTTGTTCCGAGGCATGCCGCTCAATTGGTAGAGAGCAGAAGCCTTGCAATTGCAAGCAAGGCGAAGAAGGGTGGAAAGGCTGATGCTGGCAAAACTCCTGCTCTCAGCCAAGAGCTCAAGAGTACAACAGTGTTCGGGGCAAACATCTTCAAGGAGGGTTCTGATCCGAAAATCCAACCAGACTCTGAGTATCCTGACTGGCTGTGGCACTTGCTCGACAATCGTCCTGTACTAAGTGAGCTGCGGAGGAAAGATCCCAAGACACTCTCTTATGAAGACCTGAAGCGTTTTGTCAAGTTGGACAACCGATCCAGGATCAAGATAAGGAATGACCTCAATGCTAAGAACTGACCTGGAGTCTTGGACGAAACAGGACCTGCTCTACTGTTCTTTTTATTATTAATATAATACTAGACGACATGAATAATTTTTCTGGAGTTTTTGGCAAAACATAGCGACTTGGGATGTTAAAATGTTAAGATGTGCTTGGTTTGTTACTCTTTTAGGCAGCTTACGACACTGTCATGCTTTTTGTTCTTCCATCTTGGGAAAGATGCAGCTTTGTGCCCAGTACTTAGCAAATTATCAAGTTCCATGGTTCTGCATAAAAAAAAAAAAAAAA

SEQ ID NO: 4967 - DNA, 536 bp, Zea mays
  misc_feature (1)..(536): Ceres cDNA ID no. 22005484
  misc_feature (1)..(536): Ceres CLONE  ID no. 420480
  misc_feature (1)..(536): Also known as  Ceres CDNA ID no. 23800309
ctggctccctgcgttgcgtcttgggggagagagagaagtgggagacccgcgagaggctgccgtgtagggactagggaccgtagagtaagcgacagcgaaggagggagagggggatggccgggatcgggccgatcagacaggactgggagccggtggttgtgcggaagaaggcacccaccgccgctgccaagaaggatgagaaggccgtcaacgccgcgcgccgctccggcgcggagatcgagaccatgaagaagtacaacgctggtatgaacaaggcggcgtccagcggcacatccctcaacaccaagcgcctcgacgatgacacagagaacctcgcccgtgagcaatcatctgtctcgggccatttttcccatgaacaatctgatcgacgtttttttgtgcctaggatcccagtagataaattcgggcacttgtccaccgttgatgtgataaatgatttatatatgttcatgttcacatctgtcgctgttgatgatgttttcttttaagatggattctgaaaaaaaaaaaaaaaa

SEQ ID NO: 4968 - protein, 131 aa, Zea mays
  misc_feature: GI Number: 50944921; NR Description: putative ethylene-responsive transcriptional coactivator [Oryza sativa (japonica cultivar-group)] >gi|38637102|dbj|BAD03357.1| putative ethylene-responsive transcriptional coactivator [Oryza sativa
  misc_feature: GI Number: 12642936; NR Description: putative transcriptional coactivator protein [Arabidopsis thaliana] >gi|11908124|gb|AAG41491.1| putative transcriptional coactivator protein [Arabidopsis thaliana] >gi|21536830|gb|AAM61162.1|
  misc_feature: GI Number: 8895787; NR Description: multiprotein bridging
  misc_feature: GI Number: 20086364; NR Description: putative multiprotein
  misc_feature: GI Number: 50725389; NR Description: putative ethylene-responsive transcriptional coactivator [Oryza sativa
MAGIGPIRQDWEPVVVRKKAPTAAAKKDEKAVNAARRSGAEIETMKKYNAGMNKAASSGTSLNTKRLDDDTENLAREQSSVSGHFSHEQSDRRFFVPRIPVDKFGHLSTVDVINDLYMFMFTSVAVDDVFF

SEQ ID NO: 4969 - DNA, 525 bp, Zea mays
  misc_feature (1)..(525): Ceres cDNA ID no. 22005485
  misc_feature (1)..(525): Ceres CLONE  ID no. 424817
  misc_feature (1)..(525): Also known as  Ceres CDNA ID no. 24396088
gcacccaggccgcggccgcatcctctccccatcggcagtcttcccccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgctagtgctactgctaactgctaagaagaggcatcgaaaaacgcaaatctcctcatcttcttcttcttcttcctctttcatttcggtttgcagttcgtcgcctgtaaaacaggggagccaaatgagcttgcagtttcttcctctcttcttgttgcagcttgcagctcttcccgcaaatatgatgtaaccctacgtattacactgtcgtaccaaactgagtaactgacgatgcacccagcattccaaaaaaaaaaaaaaaa

SEQ ID NO: 4970 - protein, 109 aa, Zea mays
  misc_feature: GI Number: 50920807; NR Description: putative ripening regulated protein [Oryza sativa (japonica cultivar-group)] >gi|40882701|gb|AAR96242.1| putative ripening regulated protein
  misc_feature: GI Number: 11934654; NR Description: p23 [Brassica napus]
  misc_feature: GI Number: 12231292; NR Description: ripening regulated
  misc_feature: GI Number: 23308253; NR Description: At4g02450/T14P8_5 [Arabidopsis thaliana] >gi|22022536|gb|AAM83226.1| AT4g02450/T14P8_5 [Arabidopsis thaliana] >gi|30679149|ref|NP_192154.2| glycine-rich protein [Arabidopsis
  misc_feature: GI Number: 11229591; NR Description: p23 co-chaperone
MSRHPITKWAQRSDRVFLTIELPDAQDVKLNLKPEGHFNFSAKGSDDLLVLLLTAKKRHRKTQISSSSSSSSSFISVCSSSPVKQGSQMSLQFLPLFLLQLAALPANMM

SEQ ID NO: 4971 - DNA, 1394 bp, Zea mays
  misc_feature (1)..(1394): Ceres cDNA ID no. 22005487
  misc_feature (1)..(1394): Ceres CLONE  ID no. 439222
  misc_feature (1)..(1394): Also known as  Ceres CDNA ID no. 24365239
ctctttctcttccaaggagaacaaccaccgtctctctctcccccgtctatctcttcttggagcctggagaagaggaaggatcagggaacgggggaagaggttgctgccacagctcaggtctcaagtttggattcagacaagtagacaaacaccagttggttaagatggcagctggtttccagatcggtgtgatcgggtcacttgcactctctgttgcatcttcagtttccattgtcctctgcaacaaagctctcatcagcacacttggttttccattcgctacaacattaacaagctggcatctgatggtgaccttctgcaccctccatgtggcacagcgcttacgtttcttcgagcccaaggcaattgatggacagacagtcatactctttgggttgctgaatggcacgtcaattggtcttctcaatctgagtttaggattcaactccattggattctaccagatgacaaaattggcgatcatacctttcactgtgctattggagactatcttcttgaagaaaagattcagcgagagtatcaagctttctcttctggtcttacttcttggagtaggaattgcttcagttactgatctcaagctaaatctgcttgggtccatcctttctggcctcgccattgccaccacctgtgttggccaaattctcacaaatacaatacagaagaggttgaaggtctcctcaacgcaacttctgtaccaatctgcgccttaccaggcggcaattctgtttgcatctgggccttttgtagatcaactccttactaaccggagtgtctttgcacacaaatactctgctacagttctgggtttcgttgtcctctcttgcttgattgcggtgtctgtgaacttcagtacatttcttgtgattggaacaacatccccagtgacgtaccaggtgcttggtcaccttaagacatgtctggttctatcatttggctacactctattacatgatcctttcactctaaggaacatattgggcattctaattgccatatttgggatggcactatactcctatttctctgtaagagagggcaagaagaagtcagcaaatgatgccctgccagtttcacagatgccagataaggaggttgaaccgcttttggcaactaaagacagcaatgacaccaagaaagcaaatggtttatctcacgactgctagggcttttcttgtagtttaggtctagtatgaactgcccttagaatttaatggacttggaaagccattcttttcattcttgatttcctttttaggaaaggaagattttaaaatttgtagataatgtgtattttgacgttaaagttattgtttgattgtattctacacacagcagttccatctgaagttttactaaaaaaaaaaaaaaaa

SEQ ID NO: 4972 - protein, 340 aa, Zea mays
  misc_feature: GI Number: 50910741; NR Description: phosphate translocator-like [Oryza sativa (japonica cultivar-group)] >gi|48717036|dbj|BAD23725.1| phosphate translocator-like [Oryza
  misc_feature: GI Number: 13384378; NR Description: putative phosphate
  misc_feature: GI Number: 30984584; NR Description: At2g30460 [Arabidopsis thaliana] >gi|27311731|gb|AAO00831.1| putative integral membrane protein [Arabidopsis thaliana] >gi|51970690|dbj|BAD44037.1| integral membrane protein -like [Arabidopsis thaliana]
  misc_feature: GI Number: 13699188; NR Description: putative
  misc_feature: GI Number: 42570326; NR Description: transporter-related
MAAGFQIGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKKRFSESIKLSLLVLLLGVGIASVTDLKLNLLGSILSGLAIATTCVGQILTNTIQKRLKVSSTQLLYQSAPYQAAILFASGPFVDQLLTNRSVFAHKYSATVLGFVVLSCLIAVSVNFSTFLVIGTTSPVTYQVLGHLKTCLVLSFGYTLLHDPFTLRNILGILIAIFGMALYSYFSVREGKKKSANDALPVSQMPDKEVEPLLATKDSNDTKKANGLSHDC

SEQ ID NO: 4973 - DNA, 1641 bp, Zea mays
  misc_feature (1)..(1641): Ceres cDNA ID no. 22005489
  misc_feature (1)..(1641): Ceres CLONE  ID no. 443874
  misc_feature (1)..(1641): Also known as  Ceres CDNA ID no. 23809561
gaaacaatcggtctctatctttctcatgaatctcagcctagcttaccatcttgacctgccccacacgtcccaccggccaccaccgggtttcgtcgctgccgccgcccgcacctgcagccgccatgtggaggggcggctctacagccgcctccgccgcgagggctctccgctcgcgcctcctcctcgaccccatccaccacccggccacgtcgctcgctccaatcgcttcggcgcgtacctcctcctcttccaccccgtccaccgccgcggcgaacaccatcgtggaagaagcggcggcagcggtatccgtttctcagcataccggatccatctccgactcgctgcggcactacgggaagtgctactgggagctctcgaaagcccgcctcagtgctcttgttgtggcaacttcgggggctggctatgtgcttggtagtggcaacatcgtggacattgccggcctttgttgcacatgtgccggtacaatgatggttacagcatctgcaaataccctcaaccaggtgtttgagataaaaaatgatgctaaaatgaaaaggacaatgcgacggcccctgccatctggtcgcattagtcctgcacatgctgcgatgtgggctacaagtgttggagttgcaggaacagctttgctggcctggaaggctaatggcttggcagctgggcttgcagcttctaatcttgttctgtatgcatttgtgtatacgccgttgaagcaaatacaccctgttaatacatgggttggggcagtcgttggtgccatcccaccacttctggggtgggcagcagcttcaactgaactgtcactaaacgcgatgatactccctgccgcattgtacttttggcaaatacctcattttatggctctcgcgtacttatgtcgaaatgattaccttgctggagggtatcgaatgttttcttttgctgaccctaccggtagaagaactgcatgggtgtcgctaagaaattgtctgtacatgctacctttggggttatttgcgtacaactgggggctcacatccgagtggttcagttttgaagcttcactcctaacattaggccttaccatcggagctctatcattcgtcctagaaccaagcccgaagactgcgaggagaatgttctatggtagcctgctgtatctccctgccttcatgtccggacttctgttacatcggctaccaagtgaacaaaaggcgcacaacctggctgagaacaatgagctggacggagttctgtacggggctgatctgcaggacgaagaacgagcaagacagaaacgccaagacacgaaaccttctcgtgtgcaatcactccctccagtttcctatgcttctgtggctccattccctttcctaccggtacccatatacgagtcatgaaaagttgaaaacctcctctggttcttcctgcagccgtggggtagttggagcaatgtattcatgcatttttggcttacatgagttttccgccatcaagaagagtccttggtatggtgcgtctgttgttaaaattatagaatacgtttttgtgtgtgtggattgagccttttgcggctcacctacaaatgtaaaaagtgatgttgatgttcattctgatgattcgatcgcaaaaaaaaaaaaaaaa

SEQ ID NO: 4974 - protein, 424 aa, Zea mays
  misc_feature: PFam Name: UbiA; PFam Description: UbiA prenyltransferase family
  misc_feature: GI Number: 34913400; NR Description: putative heme A farnesyltransferase homolog [Oryza sativa (japonica cultivar-group)] >gi|20161193|dbj|BAB90120.1| putative heme A farnesyltransferase homolog [Oryza sativa (japonica
  misc_feature: GI Number: 21280973; NR Description: putative heme A [Arabidopsis thaliana] >gi|15028299|gb|AAK76626.1| putative heme A:farnesyltransferase [Arabidopsis thaliana] >gi|20197183|gb|AAM14960.1| putative heme A:farnesyltransferase
  misc_feature: GI Number: 7485006; NR Description: heme A farnesyltransferase homolog F16B22.1 - Arabidopsis thaliana
  misc_feature: GI Number: 25408912; NR Description: probable heme A
  misc_feature: GI Number: 30410008; NR Description: COX10 homolog, cytochrome c oxidase assembly protein, heme A: farnesyltransferase [Mus musculus] >gi|23959172|gb|AAH38046.1| COX10 homolog, cytochrome c oxidase assembly protein, heme A: farnesyltransferase
MWRGGSTAASAARALRSRLLLDPIHHPATSLAPIASARTSSSSTPSTAAANTIVEEAAAAVSVSQHTGSISDSLRHYGKCYWELSKARLSALVVATSGAGYVLGSGNIVDIAGLCCTCAGTMMVTASANTLNQVFEIKNDAKMKRTMRRPLPSGRISPAHAAMWATSVGVAGTALLAWKANGLAAGLAASNLVLYAFVYTPLKQIHPVNTWVGAVVGAIPPLLGWAAASTELSLNAMILPAALYFWQIPHFMALAYLCRNDYLAGGYRMFSFADPTGRRTAWVSLRNCLYMLPLGLFAYNWGLTSEWFSFEASLLTLGLTIGALSFVLEPSPKTARRMFYGSLLYLPAFMSGLLLHRLPSEQKAHNLAENNELDGVLYGADLQDEERARQKRQDTKPSRVQSLPPVSYASVAPFPFLPVPIYES

SEQ ID NO: 4975 - DNA, 1654 bp, Zea mays
  misc_feature (1)..(1654): Ceres cDNA ID no. 22005490
  misc_feature (1)..(1654): Ceres CLONE  ID no. 444785
  misc_feature (1)..(1654): Also known as  Ceres CDNA ID no. 24365089
gctgcgctcctcgattcgacccccgcttccctccaactcgcctccgcgctcggcagtcgccacccacccctcctcctcctcctctctgccggcaacaggacgcaggcgcataaaaaatagcaccgccaccaccacgctccacacgctgcagtttctggaaggccaccccctctgtccgctttaaggcgccgtccgcaccggtcgcctccctcccccactagcgctgccgcggccctcgcccatatacagcgcggccgcgcccaatcgttcgttccgttccgttccgccacagcggctccgctccaaatacaggcgtgtccaccgcgctcgccccctgctggtctgcgctgctctcgtcttgctcgccctcttattccctcccctccccgctccgaactccccaaagcctccaaccgaggaggaggcctgccaggttcgttgccggccgtgtgtttgttcgcccgaccggccggcccgaccgaggggaagctgcagcctgctcgctcgatcgaactcttgcgtaggccgttgacgatgtcatgtggcccctgtgcgtcatctccgagaagctcttcaggatggcgggcgacgacggcgcgcagggggcggcgggctcgccgtaccccgacgggcggatttcactagcacgccgatcgtactacgtcgatgttccgcatgtgcagcaggccttcacctgggactgcggcctcgcttgcgtgctcatggtgctcaggacgctagggattgattgctgcgacggcattgccgatctcgagaggctctgccgcaccacgagcatttggacggttgacttagcatatctgttaaacaagttttcagtcagcttttctttctgtaccgtgacccttggagcaaatccacaatattctgctgaatccttttatagggagcaattgcaagaagacatcgatcgagtggatgagctatttgggaaggcgctcgatgctggaattagcattcaatgcaggtccatcaccgcatacgacattgcttttctactgttatccgggcactgcattgctattgctttagtggacaaatcaaagctaaatttgccctgcatgagtgatcatgatgtacaacagcacaacgatgagcctgactacatgggacactatgtcgtaatatgtgggtatgatgctgatgattgtgaatttgagataagagatccagccagttccaggaaacacgaacgggtgacgatgaagagcttggacgaggcccggaaatcctttgggacagacgaggacattctcttggtttctctaacaggtaagagtgggatgaagctgtcgcgtaagctacttgcctgctccatgtagataaataaataggtcactagcaaccttgtgaatacgctgtacatgtccctgtagtagttatgactgtcgagtgccagccctgtacgtaggcgagaacgttctcgcagttacagctgatagcagcagtgtggtagtgagctaagtaggcaccctgtatgttggccgcgcaaaggggttcagcggcagcaaaaggctctgctgaccttgtaaacgagcaagtgttctatgtacgattgttaactgaacgtgtacagatctccggaaataagaattaaaatcgtgctcctctctgcaaaaaaaaaaaaaaaaaa

SEQ ID NO: 4976 - protein, 267 aa, Zea mays
  misc_feature: GI Number: 21436487; NR Description: putative guanylate cyclase [Arabidopsis thaliana] >gi|18415044|ref|NP_568159.1|
  misc_feature: GI Number: 21537032; NR Description: unknown [Arabidopsis thaliana]
  misc_feature: GI Number: 42573281; NR Description: guanylyl cyclase-related
  misc_feature: GI Number: 27695043; NR Description: 1110038D17Rik protein
  misc_feature: GI Number: 51828202; NR Description: similar to 1110038D17Rik protein [Mus musculus] >gi|51765708|ref|XP_483920.1| RIKEN cDNA
MWPLCVISEKLFRMAGDDGAQGAAGSPYPDGRISLARRSYYVDVPHVQQAFTWDCGLACVLMVLRTLGIDCCDGIADLERLCRTTSIWTVDLAYLLNKFSVSFSFCTVTLGANPQYSAESFYREQLQEDIDRVDELFGKALDAGISIQCRSITAYDIAFLLLSGHCIAIALVDKSKLNLPCMSDHDVQQHNDEPDYMGHYVVICGYDADDCEFEIRDPASSRKHERVTMKSLDEARKSFGTDEDILLVSLTGKSGMKLSRKLLACSM

SEQ ID NO: 4977 - DNA, 1606 bp, Zea mays
  misc_feature (1)..(1606): Ceres cDNA ID no. 22005491
  misc_feature (1)..(1606): Ceres CLONE  ID no. 446617
  misc_feature (1)..(1606): Also known as  Ceres CDNA ID no. 24396363
aaaaactttgcggatccgtcgccgctgcccttgccgccgatggtcgatgtggccgcgctcacggacgacgtcctggcggagatactcctccgggtgccgtcgccgcgggacctcgctcgcgcctctgtgtcgtgctcctccttccgtcgcgtcatctcaaacccccacttcttccgccggttcgtcgccctccacgcggcgcctccgctcggcgtcttctgctgctaccccgccttgggcggcggggttggtggatcccagttccagccagcgctgccgtcgcacccctcggcgcccctcgctcgcgcgctcgccagttcagcagacttctgcttcaacttcctcccgccgcccgccagcgactggctcgtccgcgacagccgtgacggccgctttctactcgaccgcgtgcgggacggctccaccgctttcacggaggttgcaatctgcgaccccctattccggaggtaccggctgctccctcccatccccaacgatctcgccgcctcggtggaaaacccctacttccagcgcggtggcgatggtcaattgcagtcacgcagcagtgaaatcttcctggtttctcgtagtaatgacagtgtcagtgagaacgatacgacgttcaccgtgatctggatggcatgctgtcgagggaagctggtagcattcttctactcttcagagtcacagcaatggtgtgcactttcaccgcctgaacactatgctttgagcaccagaagagtcatgggcgttcgactaggacagcgcaaccatgctcatgggtgcttctactggatgttagccctcacacataggtggcttgtgttggacacacacaaaatggacttctccatcgtggacatctcacctatcctgacaggccgtgcgatgatgttcagtaatcagattaccactctggagtcaagcaatggctggactaccattgtggtctctgatgttttccgttcagatagaagatgcattctgtatttttatgcattcttgaatttcagcgaccggtggcagcttctgaacagaatcaccttgcctgatgaatgggggtatcgatttagaggcataataggtgctgccgacggatacttatttataaagctagatgatcctaaggagaacctgaatgatcagattgagcgatatgttgaatatttttcgcttgatgtcaagacaatgcagcttgggagtttctgtcggacgaccctttttactgtgactgaatcctacctttattgtggttttcccccatcattgtcgatgccttctatatgatttgtattagaaggaaaaagaatggcaccacagaatgtcttttggggctagtagaaggaaaaagaatggcaccacataatttgtcattttcttgaactgctacgaggctgcatcaggaaccaagaagactactcggactggcaccttacttgcgattttgttaaaatatatactcctacactgggtttctccgtctctattatgaaaactattgggtaatatgaccatattgtatttcataatttgggtcaaactcacaactctggttattaagattcaaatggagtcatctttcttgattgcaaaaaaaaaaaaaaaa

SEQ ID NO: 4978 - protein, 1606 aa, Zea mays
  misc_feature: PFam Name: F-box; PFam Description: F-box domain
  misc_feature: GI Number: 34914940; NR Description: B1096D03.37 [Oryza sativa (japonica cultivar-group)] >gi|18461279|dbj|BAB84475.1| similar to Oryza sativa chromosome 1, P0455H0310.25 [Oryza sativa (japonica cultivar-group)] >gi|22535626|dbj|BAC10800.1|
  misc_feature: GI Number: 34914580; NR Description: P0455H0310.25 [Oryza sativa (japonica cultivar-group)] >gi|15623977|dbj|BAB68032.1| P0455H0310.25 [Oryza sativa (japonica cultivar-group)] >gi|20804484|dbj|BAB92179.1| P0520B06.2 [Oryza sativa (japonica
AAAAACTTTGCGGATCCGTCGCCGCTGCCCTTGCCGCCGATGGTCGATGTGGCCGCGCTCACGGACGACGTCCTGGCGGAGATACTCCTCCGGGTGCCGTCGCCGCGGGACCTCGCTCGCGCCTCTGTGTCGTGCTCCTCCTTCCGTCGCGTCATCTCAAACCCCCACTTCTTCCGCCGGTTCGTCGCCCTCCACGCGGCGCCTCCGCTCGGCGTCTTCTGCTGCTACCCCGCCTTGGGCGGCGGGGTTGGTGGATCCCAGTTCCAGCCAGCGCTGCCGTCGCACCCCTCGGCGCCCCTCGCTCGCGCGCTCGCCAGTTCAGCAGACTTCTGCTTCAACTTCCTCCCGCCGCCCGCCAGCGACTGGCTCGTCCGCGACAGCCGTGACGGCCGCTTTCTACTCGACCGCGTGCGGGACGGCTCCACCGCTTTCACGGAGGTTGCAATCTGCGACCCCCTATTCCGGAGGTACCGGCTGCTCCCTCCCATCCCCAACGATCTCGCCGCCTCGGTGGAAAACCCCTACTTCCAGCGCGGTGGCGATGGTCAATTGCAGTCACGCAGCAGTGAAATCTTCCTGGTTTCTCGTAGTAATGACAGTGTCAGTGAGAACGATACGACGTTCACCGTGATCTGGATGGCATGCTGTCGAGGGAAGCTGGTAGCATTCTTCTACTCTTCAGAGTCACAGCAATGGTGTGCACTTTCACCGCCTGAACACTATGCTTTGAGCACCAGAAGAGTCATGGGCGTTCGACTAGGACAGCGCAACCATGCTCATGGGTGCTTCTACTGGATGTTAGCCCTCACACATAGGTGGCTTGTGTTGGACACACACAAAATGGACTTCTCCATCGTGGACATCTCACCTATCCTGACAGGCCGTGCGATGATGTTCAGTAATCAGATTACCACTCTGGAGTCAAGCAATGGCTGGACTACCATTGTGGTCTCTGATGTTTTCCGTTCAGATAGAAGATGCATTCTGTATTTTTATGCATTCTTGAATTTCAGCGACCGGTGGCAGCTTCTGAACAGAATCACCTTGCCTGATGAATGGGGGTATCGATTTAGAGGCATAATAGGTGCTGCCGACGGATACTTATTTATAAAGCTAGATGATCCTAAGGAGAACCTGAATGATCAGATTGAGCGATATGTTGAATATTTTTCGCTTGATGTCAAGACAATGCAGCTTGGGAGTTTCTGTCGGACGACCCTTTTTACTGTGACTGAATCCTACCTTTATTGTGGTTTTCCCCCATCATTGTCGATGCCTTCTATATGATTTGTATTAGAAGGAAAAAGAATGGCACCACAGAATGTCTTTTGGGGCTAGTAGAAGGAAAAAGAATGGCACCACATAATTTGTCATTTTCTTGAACTGCTACGAGGCTGCATCAGGAACCAAGAAGACTACTCGGACTGGCACCTTACTTGCGATTTTGTTAAAATATATACTCCTACACTGGGTTTCTCCGTCTCTATTATGAAAACTATTGGGTAATATGACCATATTGTATTTCATAATTTGGGTCAAACTCACAACTCTGGTTATTAAGATTCAAATGGAGTCATCTTTCTTGATTGCAAAAAAAAAAAAAAAA

SEQ ID NO: 4979 - DNA, 1883 bp, Zea mays
  misc_feature (1)..(1883): Ceres cDNA ID no. 22005493
  misc_feature (1)..(1883): Ceres CLONE  ID no. 446838
  misc_feature (1)..(1883): Also known as  Ceres CDNA ID no. 25087990
ctcctttctctcccagctcccaaaattccctctccgtcgccgccgctcccaaaatcccctctccgtcgccgcctctcgccaggtcgtttccaagccccgttgggggcctcgccggcgccggcattggatataacctcgcccgctacctccgtccgaatgcagggccttgatatttaatgggctggaggtggtacatgcatgttcgcagtgacaagaacacattgaaacgttggtttttcattgacaagaggcttgttaaagcatttttggtgcactaaccttttgttgtctgtaattggtttcacaacaagtttcttggggggttgtgtcctgttgatggatttgaagacaggcctcaattcacctgttattgctgaccatctccctacgttagcattgcctgctgctgtcatgactttcacaacacctactagctttccctctccggggctttgcttgaacactacaaagaagatacctctgcctggtaagattgaagaagttcgtgctgctggatggcttgatctcatgaaggcctcatcacctacccgcaaaaggcagatcaaggatgtcatctgtgatgctcaatctgatcttgatttgcaatactgcaactggacagtgaactatccttctgctttgatctcatttgaggcaattagtgatcttgctgggagtaaaaggttggcattgtttcttgactatgacggaacactttcaccgattgtggacaatcctgaaaatgcattaatgtctgatgagatgcgtgctgcagtgaggcatgcggcatcacttttcccaactgcaatcattagcggaagatctcgtgataaggtttttgactttgtgaagctaaatgaattgtactacgctggaagccatggaatggacataatgggccctgttaggaagactactgactccaatggcgtggaatgtattcggtcaactgatgtgcatggtaaagaagtcaacctgttccaacctgctagtgagtttttacctatgatcactgaggtgtatgaaaaacttggtgagagtgttaaggacattgatggtgcaaggatggaagacaacaagttctgtgtatctgtgcattaccgtaatgtggcggaagatgactataaaaaggttttccatcgtgtaactgctgttttggaaggttacccttgcctaagactaacccatgggaggaaggtttttgaggtccgtcctgttattgattggaacaaaggtaaagctgtggagtttttacttgaatcgcttgggctcagcgagagtgaagatgttctccctatctatgttggagatgacagaacagatgaagatgcattcaaagttctgaaggcaagcaaccgtggctttggaatattggtgtcgtctatacccaaagagagtgacgccttctactccttgagggatccagctgaggtgatggaatttctgagaatgttggcagcatggaaggagcagtccacctgatatcagttttgctgggtctgagaatgtgggcagtccacaagattataaatattagcaagatatataatatataatgctaatcaaataaatcggctattaggaggactcgagccatttttttgatttggcattttataagaggctaccacatttccatactttttcagtcccactttgttcttgtgttaaatgggttttcaaacagttcaattctttcattatttaggttccttaagtatatatgcaaatattcttaaaagggattttttggttccttctagtgtttcactgtgttgcgatttttgtattctgcaatctgtaaagaaccggttcttcgtataaacagcatttgacaatgcctcatggaaagtcaagttatgagcaaaaaaaaaaaaaaaaaa

SEQ ID NO: 4980 - protein, 381 aa, Zea mays
  misc_feature: PFam Name: Trehalose_PPase; PFam Description:
  misc_feature: GI Number: 37536726; NR Description: putative trehalose-6-phosphate phosphatase [Oryza sativa (japonica cultivar-group)] >gi|10140642|gb|AAG13478.1| putative trehalose-6-phosphate phosphatase [Oryza sativa (japonica
  misc_feature: GI Number: 7269105; NR Description: trehalose-6-phosphate phosphatase-like protein [Arabidopsis thaliana] >gi|3892714|emb|CAA22164.1| trehalose-6-phosphate phosphatase-like protein [Arabidopsis thaliana]
  misc_feature: GI Number: 4725942; NR Description: putative trehalose-6-phosphate phosphatase (AtTPPA) [Arabidopsis thaliana] >gi|7267945|emb|CAB78286.1| putative trehalose-6-phosphate phosphatase (AtTPPA) [Arabidopsis thaliana]
  misc_feature: GI Number: 30725608; NR Description: At5g51460 [Arabidopsis thaliana] >gi|20260496|gb|AAM13146.1| trehalose-6-phosphate phosphatase [Arabidopsis thaliana] >gi|30696058|ref|NP_199959.2|
  misc_feature: GI Number: 9758188; NR Description: trehalose-6-phosphate phosphatase [Arabidopsis thaliana] >gi|25763511|pir||T52057 trehalose-phosphatase (EC 3.1.3.12) A [validated] - Arabidopsis thaliana >gi|2944178|gb|AAC39369.1| trehalose-6-phosphate
MDLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVYEKLGESVKDIDGARMEDNKFCVSVHYRNVAEDDYKKVFHRVTAVLEGYPCLRLTHGRKVFEVRPVIDWNKGKAVEFLLESLGLSESEDVLPIYVGDDRTDEDAFKVLKASNRGFGILVSSIPKESDAFYSLRDPAEVMEFLRMLAAWKEQST

SEQ ID NO: 4981 - DNA, 1016 bp, Zea mays
  misc_feature (1)..(1016): Ceres cDNA ID no. 22005494
  misc_feature (1)..(1016): Ceres CLONE  ID no. 447737
  misc_feature (1)..(1016): Also known as  Ceres CDNA ID no. 24364743
attcccgctcgctacggccccagtcgcgctcctcaccggccggcaccaccccgcccgccctcgccttttgcctgcccagatttaggcctggcattctagcaatgcagaagaagtgatcttataatcataaaagataacaatggggatatccaaggtgaccggcattgctgcgacagcttttcttgtcacatctgttggtctgtaccagctcggcatgagaattgttgtgcttcctttcctagccaccagtattgttgcttctgttgtcaccgttgcatcccatgatgccatcaacctaccgtggatcctggggaagaactcagtgggaaggtttcctctttggtcagttatactgtttggtcctttcttgacgcttgctcggacatatgcaatggttaagagatacatgaggaaagagtccgtgtatgacaagattgtggaagacctatatcttggaggatggccctttctcttgaaacatttaccccctggaaacccatctgtcatagactgcacttgtgagcttccaagaagttccttcgttccagcagacgagtatctttgtcttgcaacttgggataccagagctccaacaccataccaaattgaaaaagctgcacgttgggcttgtggaaagagatctgaggggaagccggtttatgtccattgcgcatttggtcatggaagaagtgcttgtgttgtgtgtgcaattctagtagcgctgggcattgctgagaactggaaagatgctgagaacatcatccgtgaaagaagaaagataaaaatgaacgcccttcacaggaaaaccttagatgagtggtccaaacaacgagattctcagaaaaaggataagtagttgactagttgtaagtgtaacattttccttagtgatgaacttgtttgtggtgttaaagcctgtttgaaacatcaatggcatatctacttaagacaagtgtaatgtctgtgaaattattatttaaattattaaaaaaaaaaaaaaaaaaaaaaaaaaaaaa

SEQ ID NO: 4982 - protein, 238 aa, Zea mays
  misc_feature: PFam Name: DSPc; PFam Description: Dual specificity
  misc_feature: GI Number: 34908470; NR Description: P0489B03.9 [Oryza sativa (japonica cultivar-group)] >gi|20161641|dbj|BAB90560.1| P0489B03.9 [Oryza sativa (japonica cultivar-group)] >gi|20521237|dbj|BAB91753.1| P0679C12.2 [Oryza sativa (japonica
  misc_feature: GI Number: 48864307; NR Description: COG1597: Sphingosine kinase and enzymes related to eukaryotic diacylglycerol kinase
MGISKVTGIAATAFLVTSVGLYQLGMRIVVLPFLATSIVASVVTVASHDAINLPWILGKNSVGRFPLWSVILFGPFLTLARTYAMVKRYMRKESVYDKIVEDLYLGGWPFLLKHLPPGNPSVIDCTCELPRSSFVPADEYLCLATWDTRAPTPYQIEKAARWACGKRSEGKPVYVHCAFGHGRSACVVCAILVALGIAENWKDAENIIRERRKIKMNALHRKTLDEWSKQRDSQKKDK

SEQ ID NO: 4983 - DNA, 643 bp, Zea mays
  misc_feature (1)..(643): Ceres cDNA ID no. 22005495
  misc_feature (1)..(643): Ceres CLONE  ID no. 455149
  misc_feature (1)..(643): Also known as  Ceres CDNA ID no. 23816932
attgcagtttcaggattcctggctggcagcgtggcacctcgttcgctccgagtccgcgactctttcactgagatacatacaccccgactcgctagcgagcaggtaggcagaatggagcgccacgccgagaagcagctcctcgtgctgccctcctgccttctcctcctcctactcgccccgctcgtctccgccgtccccacgccaagaagcctgcgcctggggaggcggcagcagcagcatccgccggctctgaagctcgattcttctcaggagacgacggcgatcgcggcggcgatgatgaacacgggcaggccgacggcgaggatggacgtggaggtgaacgactaccaaccgtcgggtcccaacaaccgccacgacccacccaagggtcctggaagaacttgaacggggctcagctggacgacgtacgcgcgcccccaataatccttctccttcgtcgtcgtcgtcttcaccggtagtacaaagtgcgttgcttgtgctagctcatgtgtatatatataccggccgcgcgtgtggtatggccgtgtgcaagcacatcggtgggtcgttaagttgtgttggttgctgttcgtcagaaagaactgcactgcatgcagatcgatttcgtaaaaaaaaaaaaaaa

SEQ ID NO: 4984 - protein, 97 aa, Zea mays
MERHAEKQLLVLPSCLLLLLLAPLVSAVPTPRSLRLGRRQQQHPPALKLDSSQETTAIAAAMMNTGRPTARMDVEVNDYQPSGPNNRHDPPKGPGRT

SEQ ID NO: 4985 - DNA, 803 bp, Zea mays
  misc_feature (1)..(803): Ceres cDNA ID no. 22005496
  misc_feature (1)..(803): Ceres CLONE  ID no. 455487
  misc_feature (1)..(803): Also known as  Ceres CDNA ID no. 24396263
attcgtctccctccccttcgttggttcgtttgattgatttgggagcaacaactcccaccacccgcaaccgccgcaatctcccctcgccaactccgtctcggccgcaacccattcgccattgccgaggaggaggaggaggcccggtcgtctattctggatctcgaatggcgtcggccaagtcgtcgcggtcgcggcccgcgggccactcgggggtgttcccggtgggcagcgccgccgcggtggggagcgggggcggcggtggcgacggcggggtgcagctcaccgacaagctcaagatcttcaaaaccgacaacttcgatcccgacgcctacgtgcagtccaagtgccagaccatgaacgagaaggaaataagacatttgtgttcttatctccaagacctaaagaaggcttcagctgaagaaatgcgtagaagtgtttacgcaaattatgctgcattcatcagtgtccttccggccgacgattggttcatggatgtctcccaagaagttgtcagcatgatcagtggaaggggtagagttgctaatggtgacagggaagtaaacagcccaacggcctcagtttcagcgcactccatttcttcgttcaaatcccatggcagctcctagtttgcaagtcggtggtattctttgtaggcaggtcattgtataataatcaatagtatattctttaaacctattcctccactcatttgttttttcttttctttttcagaacttttgtgctagtactagtatagatggataattgcttgacctaggaaaagaaaaaaaaaaaaaaaaaaa

SEQ ID NO: 4986 - protein, 153 aa, Zea mays
  misc_feature: GI Number: 4914342; NR Description: F14N23.28 [Arabidopsis
MASAKSSRSRPAGHSGVFPVGSAAAVGSGGGGGDGGVQLTDKLKIFKTDNFDPDAYVQSKCQTMNEKEIRHLCSYLQDLKKASAEEMRRSVYANYAAFISVLPADDWFMDVSQEVVSMISGRGRVANGDREVNSPTASVSAHSISSFKSHGSS

SEQ ID NO: 4987 - DNA, 752 bp, Zea mays
  misc_feature (1)..(752): Ceres cDNA ID no. 22005497
  misc_feature (1)..(752): Ceres CLONE  ID no. 457567
  misc_feature (1)..(752): Also known as  Ceres CDNA ID no. 23840353
aaccaaacaagcgtcgtcattcatttcctcactcagcgaggcgaggcaagctggccgtcaagctcaggccgtcaggcgctacaagcctacaactacaagcctacccctccgccgcctagagagagaggccagcgatggcgaagacgttgccgccggcgtttgtataccggatcagcacggccgacgagtgggcggagtttcagcgcacgggcgccacccttggaggcttcctcgacagctccagcggctgcatccatctcagcgacctaaaccaggtgaagatgactttaaaaaactttttcctgggaaggaatgatctgtacctactgcaaattgatactttcaagcttgcagatgggttaatttatgagttaagtgatggtgataagtatttccctcatttctatggccctggtcggagctttgcacctcttcaactagatactgttgtgaaggcagacaaaataaagtttgcagacaatgaatttacctgtggtctacttgatggaagtgatctcccaagctgatctgtagagtctcaccttcatcttagcaatgctcatttgagttctctgccaaagttatgagataaatgatgacattcgcgagctgtccgggatgacatcgaagagaaattcgggtctgtgatgtacggacactgacctagtagtgtattatataagataggtcagtgcccatgcattgcacctagttgtgaatgaactggaactgagtgaaaaaaaaaaaaaaaa

SEQ ID NO: 4988 - protein, 130 aa, Zea mays
MAKTLPPAFVYRISTADEWAEFQRTGATLGGFLDSSSGCIHLSDLNQVKMTLKNFFLGRNDLYLLQIDTFKLADGLIYELSDGDKYFPHFYGPGRSFAPLQLDTVVKADKIKFADNEFTCGLLDGSDLPS

SEQ ID NO: 4989 - DNA, 2611 bp, Zea mays
  misc_feature (1)..(2611): Ceres cDNA ID no. 22005498
  misc_feature (1)..(2611): Ceres CLONE  ID no. 458816
  misc_feature (1)..(2611): Also known as  Ceres CDNA ID no. 25891865
aaactcaaatttcgcagcagctgagccgagttccatgccttctcgggaaacaaagcagtagatggatgaggcacatcgcgtcagcggcaaccgcctgcggtacgcgccataaataataattaggggatcctgataagtgttggcacaagtagcttgccagcacccaactccaagcaagccataactgcaagaaagcaacggcagcaagaaaccttgtaaacatcggagcatagatcgcggcggtgatggcggccaaggggaggacggagctggacgtgggcgccgacggcgtggccgtaatcaccatctacaatccgcccgtcaactcgctctccatcgacgtcttacatagcttaaaagaaagctatgaagaagcacttcggagaaacgatgttaaagctattgtcgttacagggaaaggagggaaattttctggaggatttgatattagttcctttggtggtgttcaaggaggccaaacaatgcaaccaaaggttggctacatagcaatagatattctcacagatactgtagaagctgcgacaaagccatcagtggcagcaattgatggtcttgctcttggtggaggtttagaagttgccatggcatgccatgcacggattgcaactccaacagctcaattaggtcttccagaacttcagttaggaattattccaggatttggaggaacacagcgactcccacgactggttggtctgacaaaatctttggaaatgatgctgttatctaagccaatcaagggcggtgaggcacaccaactgggcctggttgatgccttagtttctcctaatgatttggtgaatactgctcgtcaatgggctttggatatatatgaatgtaggaggccctggatcaaaagcctttataagactgacaagctagaacctcttggggaggctagggaaattctgaagtttgcaagagctcaagctcaaaagcaggcagctaatcttcatcacccacttgtttgtattgatgtcattgaagaaggtatagttgcaggaccacgggctggactctggaaggaagcaacttctttccaggaactgcttttctcagatacttgtaaaagcttagttcatgtgttcttttctcagcgggcaacgtctaagattccaggtgctacagacttggggttgatgcctaggaaaataactaaagttgccattctaggtggtgggcttatgggttcaggaattgcaactgcgatggtattaagtaactatcctgtgctacttaaagaagtaaatgagaagttcctaactgctggaatcaacagaatccaagccaatttgcagagtcgagtaaggaaaggaaaaatgaccgatgagcgatatgagaaggctatgtctctcgttactggtgtccttgattatgaacgtttcaaagatgtagacctcgttatagaggcagttattgagaatgtgaagttgaagcagcaaatattttctgacttagagaagtactgtccttcacattgcatccttgctactaacacatctacaattgatcttaatctgattggggagaaaacaaaggctcaagatcgtattgctggtgcacacttctttagtcctgcgcatgtgatgccacttctggaaatagttcgtactcagcacacttcaccacaagttgttgttgacttgctggatgttgggaagaagattaaaaagacaccaatagtcgtcgggaactgtactggctttgcagttaataggatgttctttccatacactcaatcagcactcttttatgttgatcttggtatggatgtttataagattgatcgtgcttgtaccaaatttggaatgcctatgggtcctttcagactggcagatctggttggttttggtgtggctgtggccactggtatgcaataccttgaaaatttcccagagagggtctacaaatcaatgctacttcctctgatgatggaggacaatagggcaggtgaagccacccaaaaaggattttacaagtatgagggcaagaggaaagcgactcctgatcctgaaattatgaaatatattgaaaaatctaggagcatggcaggagttacaccagatcctgagctgatgaagctaagtgagaaagacatagtcgagatggtgtttttcccggtgataaatgaagcctgccgagtccttgatgagggtatcgccgtcaaggcttctgacctagacatcgcttcgatcttcggcatggggttcccaccttataggggaggtgtcatgcactgggcagattccatcggcgcaaagtacatccatggaaagttggaggagtggacaaagcggtatgggggcttcttcaagccctgctcttacctcgctgaaagagctgcaaaagggattcctctgagtgcaccaacaaagaaagttcaggctcggctataagatgatttccttgtggacggaggagactacgttgaataatggattccggtgaagcatttggaatgcgtagagctgtaggctaccactatcacatgcatgtaacgcaatatactactgtgaaaataaagtgcactgcacggcggtttttttatatataaatacaaggatttttttctagaaaaaaaaaaaaaaaa

SEQ ID NO: 4990 - protein, 723 aa, Zea mays
MAAKGRTELDVGADGVAVITIYNPPVNSLSIDVLHSLKESYEEALRRNDVKAIVVTGKGGKFSGGFDISSFGGVQGGQTMQPKVGYIAIDILTDTVEAATKPSVAAIDGLALGGGLEVAMACHARIATPTAQLGLPELQLGIIPGFGGTQRLPRLVGLTKSLEMMLLSKPIKGGEAHQLGLVDALVSPNDLVNTARQWALDIYECRRPWIKSLYKTDKLEPLGEAREILKFARAQAQKQAANLHHPLVCIDVIEEGIVAGPRAGLWKEATSFQELLFSDTCKSLVHVFFSQRATSKIPGATDLGLMPRKITKVAILGGGLMGSGIATAMVLSNYPVLLKEVNEKFLTAGINRIQANLQSRVRKGKMTDERYEKAMSLVTGVLDYERFKDVDLVIEAVIENVKLKQQIFSDLEKYCPSHCILATNTSTIDLNLIGEKTKAQDRIAGAHFFSPAHVMPLLEIVRTQHTSPQVVVDLLDVGKKIKKTPIVVGNCTGFAVNRMFFPYTQSALFYVDLGMDVYKIDRACTKFGMPMGPFRLADLVGFGVAVATGMQYLENFPERVYKSMLLPLMMEDNRAGEATQKGFYKYEGKRKATPDPEIMKYIEKSRSMAGVTPDPELMKLSEKDIVEMVFFPVINEACRVLDEGIAVKASDLDIASIFGMGFPPYRGGVMHWADSIGAKYIHGKLEEWTKRYGGFFKPCSYLAERAAKGIPLSAPTKKVQARL

SEQ ID NO: 4991 - DNA, 923 bp, Zea mays
  misc_feature (1)..(923): Ceres cDNA ID no. 22005499
  misc_feature (1)..(923): Ceres CLONE  ID no. 460412
  misc_feature (1)..(923): Also known as  Ceres CDNA ID no. 24365101
aaacgaaatccagcagaccgacgcgaaccgagaaaaatcccacgaaatctcgtggccgcggcgaccggaagaagaggacgacgacggacggagcggcgatggcgtgccgcgcacttgccctccgctccctgctcctccccgacccgctacaccgcctcccggccgcggcgccacctgtttggagagcgtcccgcggtggccgccgtccgcacctccgctgctgctccggcggcgggggcggggagcccgggcagccgccgcaagaagctgtgctcgaggccatatccaagatagcaaggtctaaaggaagggttgcactcacaacaaatatggtcatgggtggtactgtgactgacgatgcaagtgatgaatggcttgttctggatcagaaggtaaattcctaccccacagatagaggatttacagcaattggcactggaggtgatgattttgtccagtcaatggtagttgctgttgaatctgttcttcaagaatcaattcccaagggccgggtatctcagaaattatcttcaagagggaaatatgtttctgtaaacattgggccaattcgtgttgtttctagtgagcaggtccaagctgtgtatcgtgccatgagaagagataacaggatgaaatacttcttatgaagtgcaatttcatgtcctggatgttccctagtccattccatgttgtatcctacgatgcattttcgccatatttgctggacctccggtgaattccaatgacttttatgtgccattcaagcccaaattgaagcttctctactacaaaacaatatgttgggtccagctacgttatttagtgcagggggcgtatatagctactatgtattccctttcttctataatgaataagattcaaaggttcacagtttgtcctaaaataaaaaaaaaaaaaaaaaa

SEQ ID NO: 4992 - protein, 182 aa, Zea mays
MACRALALRSLLLPDPLHRLPAAAPPVWRASRGGRRPHLRCCSGGGGGEPGQPPQEAVLEAISKIARSKGRVALTTNMVMGGTVTDDASDEWLVLDQKVNSYPTDRGFTAIGTGGDDFVQSMVVAVESVLQESIPKGRVSQKLSSRGKYVSVNIGPIRVVSSEQVQAVYRAMRRDNRMKYFL

SEQ ID NO: 4993 - DNA, 2372 bp, Zea mays
  misc_feature (1)..(2372): Ceres cDNA ID no. 22005500
  misc_feature (1)..(2372): Ceres CLONE  ID no. 461928
  misc_feature (1)..(2372): Also known as  Ceres CDNA ID no. 24396278
agataaccccgcatcgtcagccatggccaacagggtcaccgtcgcaagcgtcatcgccgcggtgggcatcgtcgccgtgatcggcaccatggccacggtgaccagcgccgacgacaacgatggcaacatgctctccagcgtgaaggtctccacggtgtgcgccttcacgcggtacccggagaagtgcgagcagagcctcaagcatgtcgtgagcgacacctccagcccggaggacgtcttccgggacgcgctcaacgtggcgctggacgaggtctccaccgccttccagcggtccgcgcacattggcaaggacgcccaggacaaactcagcaggaacgccatggacgtgtgcaagaagctcctggacgacgccaccgaggacctcagggccctggcacgggtcaagcccgcggacgtggtgcgccacgtcaaggacctccgggtctgggtctccggtatcatgacctacgtctacacctgcgccgacgggttcgagaagcccgagctcaaggaggccatggacaaggtgctgcagaactccaccgagctcagcagcaacgcgctcgctatcctcacccgcctcggcgatctcatgccgtggaaagccaaagatctgcaggccaccctggcgggtgctgtggggcacgaccgccggcttcttggctggcagataggcgatgccgaggaggtgaccagcggcggccgcgggcttctggacgagatcgtgggcgtggcaaacgcaaaccggaagctcctgtcggatacgctggacgagatcaccggcatgtcccacggcgcaaacggccggcgcttgcttagctccttggggtctcggatttccagcgcccagggagacgacgtcctcgcccgccaccagctgctgggcgtgtcgcccgacgacgagaccgataacgctgcccggcgcaaccttttgtccaccgagctcgagagcatcgccagcacgtccgccgaggcaaaccgccagcttctcgcggcggaggagctccccgacgagctcgccggtaagcgagagctgctgtcccggacgctcatggggatcgacgaggcggccaccgaggccaagcgccagcttgatgaggcgacgacggagaacaccatgtccggcgaccacagggtactgaccacgggcctcatcggcacgttcgatgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacgtgaaggccggcacgtataaggagtacgtcaccgttcccaagaacatggccaacatcttcatgtacggcgacgggccgacacagacggtggtcaccggcgacaagagcaacgcaggcggcttcgccaccttcgcctcagccaccttctctgctgagggcaacgggttcatctgcaagtcgatggggttcgtcaacacggcggggccggaggggcaccaggcggtggcgatgcacgtgcagggcgacaagtcggtgttctacaactgccggttcgaggggtaccaggacacgctgtacgtgcacgccaaccggcagttcttccgcgactgcgaggtgctgggcaccgtggacttcatcttcggcaactcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggacaggccgacgccacgccattcaccgccggcgccttcatcgacggcgcgtcatggctgcagagcaccggcacgcccaacgtcatgggattcaccaaagggtaatgatcgggggattgcagtatgcgtgcgatgatgatacgcgcgcgtgtcttcatgcatgcaacatgcttttgggtttatctggaaactgctagcatttttgtgcgcatatatatatagctggaagctcctgtgcacgcatgcacggagaaaaaaaaaaaaaaaa

SEQ ID NO: 4994 - protein, 728 aa, Zea mays
  misc_feature: PFam Name: Pectinesterase; PFam Description: Pectinesterase
  misc_feature: PFam Name: PMEI; PFam Description: Plant invertase/pectin
  misc_feature: PFam Name: Glutenin_hmw; PFam Description: High molecular
  misc_feature: PFam Name: Pyr_redox_2; PFam Description: Pyridine
  misc_feature: GI Number: 2239262; NR Description: pectin methylesterase-like protein [Zea mays] >gi|7447384|pir||T04359
  misc_feature: GI Number: 10241627; NR Description: putative pectin
  misc_feature: GI Number: 25313441; NR Description: pectinesterase (EC 3.1.1.11) [imported] - Salix gilgiana >gi|6714532|dbj|BAA89480.1|
  misc_feature: GI Number: 22330893; NR Description: pectinesterase family
  misc_feature: GI Number: 39104585; NR Description: putative pectin
MANRVTVASVIAAVGIVAVIGTMATVTSADDNDGNMLSSVKVSTVCAFTRYPEKCEQSLKHVVSDTSSPEDVFRDALNVALDEVSTAFQRSAHIGKDAQDKLSRNAMDVCKKLLDDATEDLRALARVKPADVVRHVKDLRVWVSGIMTYVYTCADGFEKPELKEAMDKVLQNSTELSSNALAILTRLGDLMPWKAKDLQATLAGAVGHDRRLLGWQIGDAEEVTSGGRGLLDEIVGVANANRKLLSDTLDEITGMSHGANGRRLLSSLGSRISSAQGDDVLARHQLLGVSPDDETDNAARRNLLSTELESIASTSAEANRQLLAAEELPDELAGKRELLSRTLMGIDEAATEAKRQLDEATTENTMSGDHRVLTTGLIGTFDEIQDGRSGVPPSDFPKWLPATQRRLLQQTQKPNTVVAQDGSGDFKTITEAITAVPNTFEGRFVIYVKAGTYKEYVTVPKNMANIFMYGDGPTQTVVTGDKSNAGGFATFASATFSAEGNGFICKSMGFVNTAGPEGHQAVAMHVQGDKSVFYNCRFEGYQDTLYVHANRQFFRDCEVLGTVDFIFGNSAALFQNCLMTVRKPGDSQSNMVTAQGRTDPNMPTGIVLQGCRIVPEQALFPDRLQIATYLGRPWKEYARTVVMESTIGDLIRPEGWAEWMGDLGLKTLYYAEYANTGPGAGTSKRVNWPGYHVIGQADATPFTAGAFIDGASWLQSTGTPNVMGFTKG

SEQ ID NO: 4995 - DNA, 2088 bp, Glycine max
  misc_feature (1)..(2088): Ceres cDNA ID no. 22005502
  misc_feature (1)..(2088): Ceres CLONE  ID no. 463456
  misc_feature (1)..(2088): Also known as  Ceres CDNA ID no. 24355933
aaacctcgtgcagctgcggggcgtgttcttttgtgccgaaccatggatcctccaaggaagaagaagaaaggacgatacggcgtcgcagagctgaaaaccctagggaaccagcttctctcttccgcctcgcacatcaacaacctccctctcctcctcaccttcgtttccccttcttcccctcctcaccacgtcctcgaatccctcctctcgctccactccttcttcctccctctcctccccaagcttccttcctcctccgccccctcctccgccgacgaccaatccgagttcatctacctcgcctggctccgttccaagtttgacgagttcctcaagtccctcctcgacgtcctcgcctcgccgcagggagatgagacgctcaaggaactcgtgctggacacgctcatggagtttgtcaaggtcgccaatggcggtgccttccactcttctctgtaccacaagcttctccatagtattgtttactcttctagcccccctacgtttttggtggatttactggcgacgaagtatttcaagtatattgatgttcgctattttacgtttataagtctaaaaaagctcgctagtactttggagggaaaagatgtctcagatgataaaattgcaagtgcagatggcaccagtgaaagtcaattgagctcaaatatggaatgtgtcatccacaacatgtattacactatatcacatgttcccccacataaaggctcggataatacatctgatttggaaatgtggagcagctcagaaagtgaccataagcaactctctggagataagggtgctgatgataagccgcagaagtcccagaagcctaacaaaaatgtattgtcagcagccaaaattgcgaagaagatgaagttaaaatttactaaagcatggattgcatatcttagattgcctcttccacatgatgtttacaaagaggttcttgtttgtcttcaccaagcagttattcctcatctatctaatcccatcatcttatgtgatttcttaacaagatcatatgatgttggtggtgtagttagtgtgatggctcttagcagcctttttgtcctaatgacccagtatggattggaatacccaaatttctatgacaaactatatgccctcttagttccatctatcttcatggcaaaacatcgagcaaggtttttccagcttcttgattcttgcctcaagtcacctcttcttccagcttacctggctgcttcctttgcaaagaaattgagtaggttgttgctttcagttcctccttcaggtgcattagttattacagctctgatacacaatcttctgcgtagacatccttcaatcaactgtttggtgcaccgggaagatggtgttgacgaagggaaaggggatgaaggaatggctactaactcggataatgcaaagactgccatgcccagccagaaatcaggcattgaccattttaacagtagtgaaactgatcctaagaagtcaggtgctatgaggagttctctttgggaaattgatactattcttcaccactactgtcctcctgcctcacggtttgctttgtctcttgggaatgatttgacagtcagggccaaaacaactgaagttaatgttggtgattttagtgctggttcatatgcaacaatccttggagcagagatatcgcggagggtaaagcaggttcccctagcattcttcaaagcaactccttcctctttattttcagagactgattttgctggttggactttcaaatgtgaagaaacacccaaaatgatcaatgacagggagagtacctaagatttatcgtaacatgaatgctgttctgtgaaatgactcaacagagtgctcaccattcattgttgtccatctcggaaatgtctgcttgttttgtgaagagatgtcacttgtttgatttatttatttttacttgaggaagcaaatcataaaggaagagggttttgggttggggtgagcgcctgggaacatgttcgagttcccttgtggctcactattggaacataaacttaagattaaattgaagtgttagatgtaacattcagaagatagaaaaaaaaaaaaaaaaaa

SEQ ID NO: 4996 - protein, 2088 aa, Glycine max
  misc_feature: PFam Name: CBF; PFam Description: CBF/Mak21 family
  misc_feature: PFam Name: Mucin; PFam Description: Mucin-like glycoprotein
  misc_feature: GI Number: 18086412; NR Description: At2g17250/T23A1.11
  misc_feature: GI Number: 19354321; NR Description: Expressed sequence
  misc_feature: GI Number: 46249506; NR Description: MGC81137 protein
  misc_feature: GI Number: 39644583; NR Description: MGC3162 protein [Homo sapiens]
  misc_feature: GI Number: 47124736; NR Description: MGC83080 protein
AAACCTCGTGCAGCTGCGGGGCGTGTTCTTTTGTGCCGAACCATGGATCCTCCAAGGAAGAAGAAGAAAGGACGATACGGCGTCGCAGAGCTGAAAACCCTAGGGAACCAGCTTCTCTCTTCCGCCTCGCACATCAACAACCTCCCTCTCCTCCTCACCTTCGTTTCCCCTTCTTCCCCTCCTCACCACGTCCTCGAATCCCTCCTCTCGCTCCACTCCTTCTTCCTCCCTCTCCTCCCCAAGCTTCCTTCCTCCTCCGCCCCCTCCTCCGCCGACGACCAATCCGAGTTCATCTACCTCGCCTGGCTCCGTTCCAAGTTTGACGAGTTCCTCAAGTCCCTCCTCGACGTCCTCGCCTCGCCGCAGGGAGATGAGACGCTCAAGGAACTCGTGCTGGACACGCTCATGGAGTTTGTCAAGGTCGCCAATGGCGGTGCCTTCCACTCTTCTCTGTACCACAAGCTTCTCCATAGTATTGTTTACTCTTCTAGCCCCCCTACGTTTTTGGTGGATTTACTGGCGACGAAGTATTTCAAGTATATTGATGTTCGCTATTTTACGTTTATAAGTCTAAAAAAGCTCGCTAGTACTTTGGAGGGAAAAGATGTCTCAGATGATAAAATTGCAAGTGCAGATGGCACCAGTGAAAGTCAATTGAGCTCAAATATGGAATGTGTCATCCACAACATGTATTACACTATATCACATGTTCCCCCACATAAAGGCTCGGATAATACATCTGATTTGGAAATGTGGAGCAGCTCAGAAAGTGACCATAAGCAACTCTCTGGAGATAAGGGTGCTGATGATAAGCCGCAGAAGTCCCAGAAGCCTAACAAAAATGTATTGTCAGCAGCCAAAATTGCGAAGAAGATGAAGTTAAAATTTACTAAAGCATGGATTGCATATCTTAGATTGCCTCTTCCACATGATGTTTACAAAGAGGTTCTTGTTTGTCTTCACCAAGCAGTTATTCCTCATCTATCTAATCCCATCATCTTATGTGATTTCTTAACAAGATCATATGATGTTGGTGGTGTAGTTAGTGTGATGGCTCTTAGCAGCCTTTTTGTCCTAATGACCCAGTATGGATTGGAATACCCAAATTTCTATGACAAACTATATGCCCTCTTAGTTCCATCTATCTTCATGGCAAAACATCGAGCAAGGTTTTTCCAGCTTCTTGATTCTTGCCTCAAGTCACCTCTTCTTCCAGCTTACCTGGCTGCTTCCTTTGCAAAGAAATTGAGTAGGTTGTTGCTTTCAGTTCCTCCTTCAGGTGCATTAGTTATTACAGCTCTGATACACAATCTTCTGCGTAGACATCCTTCAATCAACTGTTTGGTGCACCGGGAAGATGGTGTTGACGAAGGGAAAGGGGATGAAGGAATGGCTACTAACTCGGATAATGCAAAGACTGCCATGCCCAGCCAGAAATCAGGCATTGACCATTTTAACAGTAGTGAAACTGATCCTAAGAAGTCAGGTGCTATGAGGAGTTCTCTTTGGGAAATTGATACTATTCTTCACCACTACTGTCCTCCTGCCTCACGGTTTGCTTTGTCTCTTGGGAATGATTTGACAGTCAGGGCCAAAACAACTGAAGTTAATGTTGGTGATTTTAGTGCTGGTTCATATGCAACAATCCTTGGAGCAGAGATATCGCGGAGGGTAAAGCAGGTTCCCCTAGCATTCTTCAAAGCAACTCCTTCCTCTTTATTTTCAGAGACTGATTTTGCTGGTTGGACTTTCAAATGTGAAGAAACACCCAAAATGATCAATGACAGGGAGAGTACCTAAGATTTATCGTAACATGAATGCTGTTCTGTGAAATGACTCAACAGAGTGCTCACCATTCATTGTTGTCCATCTCGGAAATGTCTGCTTGTTTTGTGAAGAGATGTCACTTGTTTGATTTATTTATTTTTACTTGAGGAAGCAAATCATAAAGGAAGAGGGTTTTGGGTTGGGGTGAGCGCCTGGGAACATGTTCGAGTTCCCTTGTGGCTCACTATTGGAACATAAACTTAAGATTAAATTGAAGTGTTAGATGTAACATTCAGAAGATAGAAAAAAAAAAAAAAAAAA

SEQ ID NO: 4997 - DNA, 1870 bp, Glycine max
  misc_feature (1)..(1870): Ceres cDNA ID no. 22005503
  misc_feature (1)..(1870): Ceres CLONE  ID no. 467409
  misc_feature (1)..(1870): Also known as  Ceres CDNA ID no. 24402513
atgatgaaccttcaaattctggagacgatgatggcgtttcatatgatttagaccccagtgttactgaaactgctgcaactgtagctctaaatgggaacttcgataatttccatcagtcagatagtgctgcatctgataactcatttgtggcagaaatcaaagaatcaaatgacaacattgatggcactaatatgaccattcctaaggaagaggaagttaaaatatcagatcaaacaaagcaatcaagagcaccaaagggtcttgtcaagaacaagaatgcaaaggctccaagttccagtggtgttcatgcaagtttggtgaataagagcaaaattggaaaagataaagaagcatcttcatctgtttcaaatggtacttcagctttagactctcgcccaagacagtctactaaaagcagcagatctttcaatgaccggcagacacaattgtctaagcccaagcacccttcgaagtctgatgcaacatcttctgaagtatcagtggagaagacaaaaccaaaatcatcgagaaaagaacccattgataaagttcaaggagaagcagaatcttccttaagttccaacacagaagatgccaaacctcaaagggtgggaacacttccaaattatggattcagttttaagtgtggtgaacgagctgagagaaggagagagttctacaataagcttgaggagaggattcaggcaaaggaggtggagaagagtaacttgcaagcaaaatccaaggaaacccaagaagccgagattaagatgcttaggaagagtctgaattttaaagcaactccaatgccaagtttttaccaggagcctgctcctgctaaggcggagttaaagaagataccaactacaagagcaaaatcacccaagctcggtcgtaagaagagttcagcaaattcagagtcagatggaaacaacagcagcagttcacgactagctcgtttaagtctggatgagaaagtgtcagagagtaacctcactaagggacctactcctcctgtccatcaaaagaagccacaacgaagatctcttcctgctcggctggcccctgaaaggaacagtgtatcaaattcaaggactgcaccaacttcatccaaggctatcaaagatgaaaagtcctccttgtctagtgctgctaaaaaacataccaacttatccaatgctacaggagaggagaaagccaagacgattgcagcaaatgaagagaaaagtaccttgtccagtgaaacaagtgatgctgtgctgctgaatgtggttcttccttcagataagccaagtgaagaagtgtctcatgtgaatggtgacatagcagttgaagagaatcctcagctctccttggcaaaagaacctatcatggcagcgcattgaacaaaatagcaggttactttccgagaatttgattcatcatctggtgagatattatagaagcatatgactcattatttgacaatgaagaaggcttgcagatttgcattacaatttgtgttgtcaattgtcatcatgatgtccaagcaacattgtttctttgtgtttacccactctcaatcttgctggtccagtcctcattctctttcgcgcttgcaacaatgtgtacttaacaatttgccaggttattctagttgatgttattttggtatatgtgcagcacttgtctgtttagtggacatttatttggagcaaaattttgagaaagtttgccatctggtgatggttcaagtgcttcttgttcaggcctttgctttgttaaacaaatttgacattgtctcatgtacaagctgtttgtgttgtggacacccttctagctgaatcatatggatcaaattctgctttgtcgtacaaaaaaaaaaaaaaaa

SEQ ID NO: 4998 - protein, 1870 aa, Glycine max
  misc_feature: PFam Name: TPX2; PFam Description: Targeting protein for
  misc_feature: PFam Name: AF-4; PFam Description: AF-4 proto-oncoprotein
  misc_feature: PFam Name: Borrelia_P83; PFam Description: Borrelia P83/100
  misc_feature: GI Number: 51091378; NR Description: putative BRI1-KD
  misc_feature: GI Number: 42733498; NR Description: BRI1-KD interacting
  misc_feature: GI Number: 50906049; NR Description: putative BRI1-KD interacting protein [Oryza sativa (japonica cultivar-group)] >gi|46390384|dbj|BAD15848.1| putative BRI1-KD interacting protein
  misc_feature: GI Number: 50934761; NR Description: putative seed specific protein [Oryza sativa (japonica cultivar-group)] >gi|34393229|dbj|BAC83008.1| putative seed specific protein [Oryza
  misc_feature: GI Number: 21553401; NR Description: unknown [Arabidopsis thaliana]
ATGATGAACCTTCAAATTCTGGAGACGATGATGGCGTTTCATATGATTTAGACCCCAGTGTTACTGAAACTGCTGCAACTGTAGCTCTAAATGGGAACTTCGATAATTTCCATCAGTCAGATAGTGCTGCATCTGATAACTCATTTGTGGCAGAAATCAAAGAATCAAATGACAACATTGATGGCACTAATATGACCATTCCTAAGGAAGAGGAAGTTAAAATATCAGATCAAACAAAGCAATCAAGAGCACCAAAGGGTCTTGTCAAGAACAAGAATGCAAAGGCTCCAAGTTCCAGTGGTGTTCATGCAAGTTTGGTGAATAAGAGCAAAATTGGAAAAGATAAAGAAGCATCTTCATCTGTTTCAAATGGTACTTCAGCTTTAGACTCTCGCCCAAGACAGTCTACTAAAAGCAGCAGATCTTTCAATGACCGGCAGACACAATTGTCTAAGCCCAAGCACCCTTCGAAGTCTGATGCAACATCTTCTGAAGTATCAGTGGAGAAGACAAAACCAAAATCATCGAGAAAAGAACCCATTGATAAAGTTCAAGGAGAAGCAGAATCTTCCTTAAGTTCCAACACAGAAGATGCCAAACCTCAAAGGGTGGGAACACTTCCAAATTATGGATTCAGTTTTAAGTGTGGTGAACGAGCTGAGAGAAGGAGAGAGTTCTACAATAAGCTTGAGGAGAGGATTCAGGCAAAGGAGGTGGAGAAGAGTAACTTGCAAGCAAAATCCAAGGAAACCCAAGAAGCCGAGATTAAGATGCTTAGGAAGAGTCTGAATTTTAAAGCAACTCCAATGCCAAGTTTTTACCAGGAGCCTGCTCCTGCTAAGGCGGAGTTAAAGAAGATACCAACTACAAGAGCAAAATCACCCAAGCTCGGTCGTAAGAAGAGTTCAGCAAATTCAGAGTCAGATGGAAACAACAGCAGCAGTTCACGACTAGCTCGTTTAAGTCTGGATGAGAAAGTGTCAGAGAGTAACCTCACTAAGGGACCTACTCCTCCTGTCCATCAAAAGAAGCCACAACGAAGATCTCTTCCTGCTCGGCTGGCCCCTGAAAGGAACAGTGTATCAAATTCAAGGACTGCACCAACTTCATCCAAGGCTATCAAAGATGAAAAGTCCTCCTTGTCTAGTGCTGCTAAAAAACATACCAACTTATCCAATGCTACAGGAGAGGAGAAAGCCAAGACGATTGCAGCAAATGAAGAGAAAAGTACCTTGTCCAGTGAAACAAGTGATGCTGTGCTGCTGAATGTGGTTCTTCCTTCAGATAAGCCAAGTGAAGAAGTGTCTCATGTGAATGGTGACATAGCAGTTGAAGAGAATCCTCAGCTCTCCTTGGCAAAAGAACCTATCATGGCAGCGCATTGAACAAAATAGCAGGTTACTTTCCGAGAATTTGATTCATCATCTGGTGAGATATTATAGAAGCATATGACTCATTATTTGACAATGAAGAAGGCTTGCAGATTTGCATTACAATTTGTGTTGTCAATTGTCATCATGATGTCCAAGCAACATTGTTTCTTTGTGTTTACCCACTCTCAATCTTGCTGGTCCAGTCCTCATTCTCTTTCGCGCTTGCAACAATGTGTACTTAACAATTTGCCAGGTTATTCTAGTTGATGTTATTTTGGTATATGTGCAGCACTTGTCTGTTTAGTGGACATTTATTTGGAGCAAAATTTTGAGAAAGTTTGCCATCTGGTGATGGTTCAAGTGCTTCTTGTTCAGGCCTTTGCTTTGTTAAACAAATTTGACATTGTCTCATGTACAAGCTGTTTGTGTTGTGGACACCCTTCTAGCTGAATCATATGGATCAAATTCTGCTTTGTCGTACAAAAAAAAAAAAAAAA

SEQ ID NO: 4999 - DNA, 1292 bp, Glycine max
  misc_feature (1)..(1292): Ceres cDNA ID no. 22005504
  misc_feature (1)..(1292): Ceres CLONE  ID no. 467492
  misc_feature (1)..(1292): Also known as  Ceres CDNA ID no. 24402558
gaagagagcgagttgattaaggcaaagggtgtgatgagattagttttgagaagaaaccagcaatcggcgattaggagtgagagagatatggagggaattgaaggaaatagcagcagatacagtctgaaaccctcgcgaatttgcaacgaagatgttctgatctgcgtcgacgtcgatcctcagtgcctcgtcgaaatgaaaggtgccaccggtcccaatggcagacccctcacccgtttggactccatcaaacaagccatcgttctcttcgtcaatgccaaactcaccatcaaccccgaacaccgttttgccttcgccactctctccaacaccctcgtctcttgggtcaggaaagagtttagcagtgaaattgagtcaacacttgcagcaatgcgtgttctttcagcttcttcttcttcttccaccaccgccggccaacccgatctcactcatttgttccgtcttgccgctcatgaagccaagaaatcccgtcttcagggtcgcatcctaagagtcattttgttctactgtagatcatcagagcgaccaaagcatcagtggcctgtgaaccagaagctcttcactttggatgttatgtaccttcatgataaacctggaccagataactgcccccaggaggtttacgatacactggtggaggcacttgaacatgttagtgaatatgagggttatatcttggagagtggacaggggttggcacgtgttctattccgtcatgtgctgatactattgtcacatcctcagcagcgttgcatccaagagtatgttgacataccaaagtcaattgcaaagaagcctccccaggtggagcctatggctactgaagatagtgctcccatatcaagccaataatactatgagttgggaagtggatggcagttgcatgtggtcaacctcttaaggggaatggaatatgatcataattcagcaatgttcaagttggaggttagtgtcactaggttgacaagggaatgattgttactagcgtaacagtttctgaaattggattcgattcctacaaccctctttcgttctcaagttgataccatttactattttgaatcaaatgtatgaaaagtgtactttcaaacatatccatattcattagtaatcaagcgtttaggtctggtaatgaaagtgagcaagggatgtgattatacacaagctgttagattttattttatttttcttgtcggtaactttcaaagacaaagacaatattaataaatttataacacaaagacaatattaacaaaaaaaaaaaaaaaaaa

SEQ ID NO: 5000 - protein, 1292 aa, Glycine max
  misc_feature: GI Number: 38564256; NR Description: At4g32960 [Arabidopsis
GAAGAGAGCGAGTTGATTAAGGCAAAGGGTGTGATGAGATTAGTTTTGAGAAGAAACCAGCAATCGGCGATTAGGAGTGAGAGAGATATGGAGGGAATTGAAGGAAATAGCAGCAGATACAGTCTGAAACCCTCGCGAATTTGCAACGAAGATGTTCTGATCTGCGTCGACGTCGATCCTCAGTGCCTCGTCGAAATGAAAGGTGCCACCGGTCCCAATGGCAGACCCCTCACCCGTTTGGACTCCATCAAACAAGCCATCGTTCTCTTCGTCAATGCCAAACTCACCATCAACCCCGAACACCGTTTTGCCTTCGCCACTCTCTCCAACACCCTCGTCTCTTGGGTCAGGAAAGAGTTTAGCAGTGAAATTGAGTCAACACTTGCAGCAATGCGTGTTCTTTCAGCTTCTTCTTCTTCTTCCACCACCGCCGGCCAACCCGATCTCACTCATTTGTTCCGTCTTGCCGCTCATGAAGCCAAGAAATCCCGTCTTCAGGGTCGCATCCTAAGAGTCATTTTGTTCTACTGTAGATCATCAGAGCGACCAAAGCATCAGTGGCCTGTGAACCAGAAGCTCTTCACTTTGGATGTTATGTACCTTCATGATAAACCTGGACCAGATAACTGCCCCCAGGAGGTTTACGATACACTGGTGGAGGCACTTGAACATGTTAGTGAATATGAGGGTTATATCTTGGAGAGTGGACAGGGGTTGGCACGTGTTCTATTCCGTCATGTGCTGATACTATTGTCACATCCTCAGCAGCGTTGCATCCAAGAGTATGTTGACATACCAAAGTCAATTGCAAAGAAGCCTCCCCAGGTGGAGCCTATGGCTACTGAAGATAGTGCTCCCATATCAAGCCAATAATACTATGAGTTGGGAAGTGGATGGCAGTTGCATGTGGTCAACCTCTTAAGGGGAATGGAATATGATCATAATTCAGCAATGTTCAAGTTGGAGGTTAGTGTCACTAGGTTGACAAGGGAATGATTGTTACTAGCGTAACAGTTTCTGAAATTGGATTCGATTCCTACAACCCTCTTTCGTTCTCAAGTTGATACCATTTACTATTTTGAATCAAATGTATGAAAAGTGTACTTTCAAACATATCCATATTCATTAGTAATCAAGCGTTTAGGTCTGGTAATGAAAGTGAGCAAGGGATGTGATTATACACAAGCTGTTAGATTTTATTTTATTTTTCTTGTCGGTAACTTTCAAAGACAAAGACAATATTAATAAATTTATAACACAAAGACAATATTAACAAAAAAAAAAAAAAAAAA

SEQ ID NO: 5001 - DNA, 952 bp, Zea mays
  misc_feature (1)..(952): Ceres cDNA ID no. 22005508
  misc_feature (1)..(952): Ceres CLONE  ID no. 487323
  misc_feature (1)..(952): Also known as  Ceres CDNA ID no. 23818622
ctataactgaataaccgatcgaggagcgcaacgcacaccaccgaccagcgcgcgagaggacgtacggacgaacagctataggcggaggcgatggacggccaacgacgacggcaatggccgaggtcgcgctcgggagcggccgccgcgcgtctcctcctcctgctgctgctcctggcggtgtccttgggggccgggcatggtgatcacggcgcggcggctgcgggcgtcgccccggcagccggcaacggcatgacggagctgcagaagcacgtggcgttcttcgaccgcaaccacgacggcgtcatcaccttcgacgagacctaccaaggtctgcaggacgtcggagttggcgctgtcacggccaaagccagcgccgcgtacattaacggcgccctcgggcccaagaccagacctgataattcaaactcctcaacattggatatctacgtagagaacattcagaagggcaaacatggaagcgacacgggcgcctacgacgctcaaggaaggttcgttcccgcgaagctggacgagatgttcaccaagcacgccaagaccgtaccgaacgctctgacgaaagacgagctcgacgagatgctcaaggataaccgggagaagatggacgtcgcaggatggctgggagccaagtcggagtgggagatgctgtacaagctggccaaggacaaggacgggcgcctgcccaaggacaccgtcagggccgtgtacgacggatccctcttttaccagctggcggcgcaggggaagaagggctgattcggttacgttaatttcagtaatcaataacaagcgacgttttttttttgtcgtttctgaatgcttgcctgtgtggctgtgtaagaaagcgagtgggtcggactcaatggcaggcaacggttttgttttttttattattattttaacggatcggttctacctaaaaaaaaaaaaaaaa

SEQ ID NO: 5002 - protein, 227 aa, Zea mays
  misc_feature: PFam Name: Caleosin; PFam Description: Caleosin related protein
  misc_feature: GI Number: 50912497; NR Description: putative caleosin [Oryza sativa (japonica cultivar-group)] >gi|46390679|dbj|BAD16161.1|
  misc_feature: GI Number: 50912501; NR Description: putative calcium binding protein [Oryza sativa (japonica cultivar-group)] >gi|46390425|dbj|BAD15887.1| putative calcium binding protein [Oryza sativa (japonica cultivar-group)]
  misc_feature: GI Number: 52077126; NR Description: putative calcium binding protein [Oryza sativa (japonica cultivar-group)] >gi|52076402|dbj|BAD45232.1| putative calcium binding protein
  misc_feature: GI Number: 44894211; NR Description: putative ABA-induced
  misc_feature: GI Number: 52077122; NR Description: putative calcium binding protein [Oryza sativa (japonica cultivar-group)] >gi|52076398|dbj|BAD45228.1| putative calcium binding protein
MDGQRRRQWPRSRSGAAAARLLLLLLLLAVSLGAGHGDHGAAAAGVAPAAGNGMTELQKHVAFFDRNHDGVITFDETYQGLQDVGVGAVTAKASAAYINGALGPKTRPDNSNSSTLDIYVENIQKGKHGSDTGAYDAQGRFVPAKLDEMFTKHAKTVPNALTKDELDEMLKDNREKMDVAGWLGAKSEWEMLYKLAKDKDGRLPKDTVRAVYDGSLFYQLAAQGKKG

SEQ ID NO: 5003 - DNA, 761 bp, Zea mays
  misc_feature (1)..(761): Ceres cDNA ID no. 22005509
  misc_feature (1)..(761): Ceres CLONE  ID no. 488370
  misc_feature (1)..(761): Also known as  Ceres CDNA ID no. 23831887
atcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgactccctctgcgccctcgccctcctccccttcctccccgagcacgcccgccaccccgtcgccgccatcggacaccccgtcgccgccgtcgtccggtggagggggcaggtccccgccgtcgtctgggggcgggcgatccacgccgtcctcccactcgcctcccaagtcgcactcgccggggggcggtggcggcagctccgggccgtctacgtcgcttgtcgtgggcgtggccgtcggcggcctcgtgctgctgctgctcgccagcttcatctgcctctgctgcctccgcaagaagcgccgcttttttttttttttttttgttttttttttttttcttttaaaaagagcattgcagatacttgtaataaaccttacattactgtggacaagcatcgatcagagcttttaaataaatgtcaaaaaaaaaaaaaaaa

SEQ ID NO: 5004 - protein, 207 aa, Zea mays
  misc_feature: PFam Name: Pyr_redox_2; PFam Description: Pyridine
  misc_feature: PFam Name: GATase_2; PFam Description: Glutamine
  misc_feature: PFam Name: LMBR1; PFam Description: LMBR1-like membrane protein
  misc_feature: PFam Name: FH2; PFam Description: Formin Homology 2 Domain
  misc_feature: PFam Name: Extensin_2; PFam Description: Extensin-like region
  misc_feature: GI Number: 41400381; NR Description: minus agglutinin
  misc_feature: GI Number: 57472005; NR Description: minus agglutinin
  misc_feature: GI Number: 51214392; NR Description: Protease-1 (PRT1),
  misc_feature: GI Number: 51228140; NR Description: Protease-1 (PRT1)
  misc_feature: GI Number: 6523547; NR Description: hydroxyproline-rich
MSSSPTAAPAPTTPSAPPANATNPPPATPSAPPPAAPTPPTPTPPTPSPPSPAAPPPSPPSVPAPAPSSTPATPSAPSPSSPSSPSTPATPSPPSDTPSPPSSGGGGRSPPSSGGGRSTPSSHSPPKSHSPGGGGGSSGPSTSLVVGVAVGGLVLLLLASFICLCCLRKKRRFFFFFFVFFFFLLKRALQILVINLTLLWTSIDQSF

SEQ ID NO: 5005 - DNA, 1108 bp, Zea mays
  misc_feature (1)..(1108): Ceres cDNA ID no. 22005510
  misc_feature (1)..(1108): Ceres CLONE  ID no. 491696
  misc_feature (1)..(1108): Also known as  Ceres CDNA ID no. 24361830
atccacctcggctcactccactcactgcaccgagctcactggcaatggctaccagcaccaagctcgtggcccttggctttgccgtcctcctgagcatcggcttctccgatgcagcgagggtagttaggcttggtagccatgcgtctgcgggaggtggaggtggcggcgggggaggcggctccgggtcgactgggggtggctttggcggtgggtcgggcggtggcggtggttacggcataggtaagggtggcggggactggtggaacaatttcgtctctagtatagcaggtggtggaggaggaggacaaggcggaggcggtggcaccaatggtgggtccgggtccggcggtgggtccggttatggttctggcagcagctcgactgcagcctctggccccagcagtggcaactacgccgacgctgagggcaagggcgccggtggaggcatgggcggtggtgccaatggtgcatatggttctggtgctggtggaggcgttggcaagggcgagggtgtgagtggtgtggcactcgcaccatcgtccaacggctactacaatggcggtgccgccgatgctaccggtggcggttccggcgccggcggtggacatggtggtggcgcagccggagctccaagctatggaaccggaggcggcctcggcggaggcaagggtgaggccggcagcgatggatcgtgggggtcaggttatgctcagggaatcggtgctggcacaggcggcggtggcggcggcggatcccaaggcggctctggtggcggtggaggctctgggtccggatccggcagcggtggaatccactgagcttgcacttcagtagctagagcctagagccccgcattagtgtcagtccattctgtggttttttgctgtctttgttacgagaattaatcaggaataaagcgtaatgggcttcgtgattgtagttcgagtaggtagcaaagcatgcaactgatatgaatgcatgtaatggctatctacgagtgtgtgcccctagctgtaatctgtttctcatcgatcgttaaggtcgttgcatccggttttatttatcttctgaaaccaaaatacattggaactcaaaaaaaaaaaaaaaa

SEQ ID NO: 5006 - protein, 1108 aa, Zea mays
  misc_feature: PFam Name: Dehydrin; PFam Description: Dehydrin
  misc_feature: PFam Name: GRP; PFam Description: Glycine rich protein family
  misc_feature: PFam Name: S-antigen; PFam Description: S-antigen protein
  misc_feature: PFam Name: Secretin_N; PFam Description: Bacterial type
  misc_feature: PFam Name: Harpin; PFam Description: Harpin protein (HrpN)
  misc_feature: GI Number: 1532071; NR Description: glycine-rich protein [Zea
  misc_feature: GI Number: 51090508; NR Description: putative glycine rich
  misc_feature: GI Number: 7636182; NR Description: glycine-rich protein
  misc_feature: GI Number: 51091828; NR Description: putative glycine rich
  misc_feature: GI Number: 34898126; NR Description: putative glycine-rich cell wall protein precursor [Oryza sativa (japonica cultivar-group)] >gi|24059890|dbj|BAC21356.1| putative glycine-rich cell wall protein precursor [Oryza sativa (japonica
ATCCACCTCGGCTCACTCCACTCACTGCACCGAGCTCACTGGCAATGGCTACCAGCACCAAGCTCGTGGCCCTTGGCTTTGCCGTCCTCCTGAGCATCGGCTTCTCCGATGCAGCGAGGGTAGTTAGGCTTGGTAGCCATGCGTCTGCGGGAGGTGGAGGTGGCGGCGGGGGAGGCGGCTCCGGGTCGACTGGGGGTGGCTTTGGCGGTGGGTCGGGCGGTGGCGGTGGTTACGGCATAGGTAAGGGTGGCGGGGACTGGTGGAACAATTTCGTCTCTAGTATAGCAGGTGGTGGAGGAGGAGGACAAGGCGGAGGCGGTGGCACCAATGGTGGGTCCGGGTCCGGCGGTGGGTCCGGTTATGGTTCTGGCAGCAGCTCGACTGCAGCCTCTGGCCCCAGCAGTGGCAACTACGCCGACGCTGAGGGCAAGGGCGCCGGTGGAGGCATGGGCGGTGGTGCCAATGGTGCATATGGTTCTGGTGCTGGTGGAGGCGTTGGCAAGGGCGAGGGTGTGAGTGGTGTGGCACTCGCACCATCGTCCAACGGCTACTACAATGGCGGTGCCGCCGATGCTACCGGTGGCGGTTCCGGCGCCGGCGGTGGACATGGTGGTGGCGCAGCCGGAGCTCCAAGCTATGGAACCGGAGGCGGCCTCGGCGGAGGCAAGGGTGAGGCCGGCAGCGATGGATCGTGGGGGTCAGGTTATGCTCAGGGAATCGGTGCTGGCACAGGCGGCGGTGGCGGCGGCGGATCCCAAGGCGGCTCTGGTGGCGGTGGAGGCTCTGGGTCCGGATCCGGCAGCGGTGGAATCCACTGAGCTTGCACTTCAGTAGCTAGAGCCTAGAGCCCCGCATTAGTGTCAGTCCATTCTGTGGTTTTTTGCTGTCTTTGTTACGAGAATTAATCAGGAATAAAGCGTAATGGGCTTCGTGATTGTAGTTCGAGTAGGTAGCAAAGCATGCAACTGATATGAATGCATGTAATGGCTATCTACGAGTGTGTGCCCCTAGCTGTAATCTGTTTCTCATCGATCGTTAAGGTCGTTGCATCCGGTTTTATTTATCTTCTGAAACCAAAATACATTGGAACTCAAAAAAAAAAAAAAAA

SEQ ID NO: 5007 - DNA, 653 bp, Zea mays
  misc_feature (1)..(653): Ceres cDNA ID no. 22005511
  misc_feature (1)..(653): Ceres CLONE  ID no. 492887
  misc_feature (1)..(653): Also known as  Ceres CDNA ID no. 0
aaaaaagcagcagcatccttaccagcacacagtggagctagctagctagtagaggtcaatcaccaaaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcattaacgagaccgtgcgagtgaacctgcatgaacgaatgccattatgccatgcaactatgttgtgttgcgttgttggaataataatcgaatccgctagaataaatatgtacgtgcacgacggcctcttgcttgtatcactggactttgcttgtgtgctgtacgtcaaatatgttccgtttctctcatataagaaaaatctgcaatgcttgttattaagccaaaaaaaaaaaaaaaa

SEQ ID NO: 5008 - protein, 111 aa, Zea mays
MARQLVVLALLFVIAGVAHGAGECGRASADRVALRMAPCISAADDPQSTPTSSCCSAVHTIGQSPSCLCAVMLSGTARAAGIKPEVAITIPKRCNMADRPVGYKCGDYTLP

SEQ ID NO: 5009 - DNA, 974 bp, Zea mays
  misc_feature (1)..(974): Ceres cDNA ID no. 22005512
  misc_feature (1)..(974): Ceres CLONE  ID no. 493130
  misc_feature (1)..(974): Also known as  Ceres CDNA ID no. 23815387
agctattatttgggcagacgagcagcggcgctgtcgcagacgcagagcatcccacggttgtcagtttgtcactcactcggtccagcgctcacgagtcacgagtcacgacccacaactgacgatcgtccatgttcggcggcgtcgatggcgctagggcgctgcggcgagccggcagtttcccacggccaccgcccccgccggcgacggcgaggcacattctctccaggagcgagtcaatcaagaagaagagcggagccgccaagcggtcgaagcgggcacgcgtgcgcgcggggctcgccgccgctctgcaggagctcaggctcgccggccggaagcacggggccagaagccggggagccggggcgttgtcagaagctgtcagcgccggcgccggagccgcggggccgcgggctagcgatgacgtccaaggaggaggctgctgcgccgctgctcccctgcatgtgtccgacgttgccgaggcgcaggcgagcagaggagcagcagccaccgctggtcgtcgtcgcgtgaacgcagcaggcggctggacgacgccgctgctgcttgtagcggtgctagccctggcgtgcgtggtggcgctcggcaggacgccggccgtttgctgctgcacctgtgcggcatggctgtgccgcggcccttgtgcggttcggcctcgacggacgggcgccaccggagcagcgagccctctgctgcagcgcggtgcagcgtcagatgcctgtggctgtgagcttaacattgcacatgtacgagcaggtgattagcatcagacgtgttgtttgtcactcatggaccgtttggttctaccggcttcgcatgaatgttgcaggcctcgtaatttagctagagtcgtgttgtatgtttaaagttagttgcaggtgtttatatatattcagttgtgtgtttactatttaatgcgaggagtgaaaataatagtacctgtaaaaaaaaaaaaaaaa

SEQ ID NO: 5010 - protein, 216 aa, Zea mays
MFGGVDGARALRRAGSFPRPPPPPATARHILSRSESIKKKSGAAKRSKRARVRAGLAAALQELRLAGRKHGARSRGAGALSEAVSAGAGAAGPRASDDVQGGGCCAAAPLHVSDVAEAQASRGAAATAGRRRVNAAGGWTTPLLLVAVLALACVVALGRTPAVCCCTCAAWLCRGPCAVRPRRTGATGAASPLLQRGAASDACGCELNIAHVRAGD

SEQ ID NO: 5011 - DNA, 978 bp, Zea mays
  misc_feature (1)..(978): Ceres cDNA ID no. 22005513
  misc_feature (1)..(978): Ceres CLONE  ID no. 502958
  misc_feature (1)..(978): Also known as  Ceres CDNA ID no. 23818903
aacatcaaagcagagaaatgctgtcgcctgccaatctgttgccagccgttggattgcttcaacggtggagagcagctgactgggtgagccttcggtgggcgacggcaggcgatcccagtccagcacctccccctcccttcctatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggtagctgaggagaagccctctagtggtactgagactgaatctgctccttcaaccaatgatgggactccttcatctgtagaagataagaatgaaacatctgaagtacaagatgctgctgaaaagtcagacgcagaagaaactaacactgctgcagaggaagcaagtgagactaccgaggaggaagaggctgagaaacctgagatcaagattgaaacagctccagcagattttcgtttcccaacaacaaatcaaacgaggcactgtttcacacgctatgttgaataccacaggtgtgtggctgcaaaaggtgaggatgcacctgagtgtgataagtttgccaagtactatcgatccctgtgcccaggtgaatgggttgaacgctggaacgagcagcgtgaaaatggcacgttccctggacctctgtaatcctacaatgcaaaaagaattaggaactcacgatgttgtgccggccttctcctccttggtaactggcgccaagttagcagggagagagacaaatcatcctctttggagctctctacaaaataagagattctttttgacttgaagaatgccttgttgctcttcctaacggtcttgttctgcgctgctgagaaaccagcgtcacagttacatttttgtccgtatatacagtttaaaataaatgattcatgattcaaaaaaaaaaaaaaaa

SEQ ID NO: 5012 - protein, 166 aa, Zea mays
  misc_feature: PFam Name: COX6B; PFam Description: Cytochrome oxidase c
  misc_feature: PFam Name: MSA_2; PFam Description: Merozoite Surface
  misc_feature: GI Number: 37991922; NR Description: cytochrome c oxidase subunit 6b-1 [Oryza sativa (japonica cultivar-group)] >gi|50920887|ref|XP_470804.1| cytochrome c oxidase subunit 6b-1 [Oryza sativa (japonica cultivar-group)] sativa (japonica
  misc_feature: GI Number: 22204116; NR Description: putative cytochrome c
  misc_feature: GI Number: 34906824; NR Description: putative cytochrome c oxidase subunit 6b-1 [Oryza sativa (japonica cultivar-group)] >gi|22296419|dbj|BAC10187.1| putative cytochrome c oxidase subunit
  misc_feature: GI Number: 21554378; NR Description: cytochrome c oxidase
  misc_feature: GI Number: 20465723; NR Description: putative cytochrome c oxidase subunit [Arabidopsis thaliana] >gi|17381082|gb|AAL36353.1| putative cytochrome c oxidase subunit [Arabidopsis thaliana] >gi|6587843|gb|AAF18532.1| Subunit 6b of
MAAEAKTPSLAEEYSLPPQEVPVEKVAEEKPSSGTETESAPSTNDGTPSSVEDKNETSEVQDAAEKSDAEETNTAAEEASETTEEEEAEKPEIKIETAPADFRFPTTNQTRHCFTRYVEYHRCVAAKGEDAPECDKFAKYYRSLCPGEWVERWNEQRENGTFPGPL
